United States Patent 12,569,549 (FLAVIVIRUS VACCINE) - sequence listing, part 34

SEQ ID NO: 13247 - RNA, 9879 nt, synthetic construct
  misc_feature 1..9879: note = derived and/or modified CDS sequence (opt3) from DENV-1__GQ868569__SS-prME
  source 1..9879: mol_type = other RNA
agcgtgaccatgctgctcatgcttctgcccacagccttggctttccacttaactacgagaggcggggagcctcatatgatcgtctccaagcaggaaaggggaaaatctctgctatttaagacctcagcaggtgttaacatgtgcacactcattgccatggacctgggcgagctttgtgaagatactatgacctacaaatgcccacggataacagaggcggaaccggacgatgtggactgttggtgcaatgctaccgatacttgggtaacatatgggacctgtagtcaaacgggagagcaccgccgagacaagcgtagcgtggccctggcaccccatgtcggcttgggtctcgagactagaaccgaaacatggatgtcctctgagggggcctggaaacagatccagagggtggaaacttgggctctgcggcaccctggattcaccgttattgcactgtttctcgcccatgctatcggcacatcgattacccagaagggcatcatattcatcttactgatgcttgtgacgccatcaatggccatgcgctgcgtcgggattggaaacagagattttgtggagggtttgagcggcgcgacttgggtagacgttgtgctggagcacgggagttgtgtcacaaccatggcaaagaataaacccactctagatatcgaactcctgaagacagaggtggccaaccctgctgtgcttaggaaactgtgcattgaagccaagatctccaataccacgaccgactctcggtgtccaacacaaggagaggcaactttggtcgaagagcaggatgctaacttcgtttgccgccgaacctttgtggacagaggctggggtaatgggtgtggactcttcggcaaaggcagcctgttaacatgcgccaagtttaagtgcgtaactaaactggaggggaagatagtgcagtacgaaaacctcaaatattccgtcattgtgaccgttcacacaggagatcagcatcaagtgggtaatgagaccactgaacacggcacgatcgcgacaattaccccccaggcccctacttcagagatccagcttaccgactacggggcactgacattggactgtagtccaaggaccggactagatttcaacgaaatggtcctgctcactatgaaggagaaaagctggctggtgcataagcagtggtttcttgacctgccgttgccctggacatctggcgcttccacgtcacaagagacctggaatcggcaggatctcctggtaactttcaaaacagcccacgctaagaagcaggaagttgtggtcttaggtagccaagagggggccatgcacaccgcactgacaggcgccactgaaatccagaccagtggaacgaccacaatttttgctggccatctaaaatgccgtctcaagatggacaaactgactcttaaggggatgtcttatgtgatgtgtaccggatccttcaaattggagaaggaagtcgcggagacacagcacggtactgtgctggttcaggtgaagtacgagggcaccgatgcaccttgcaaaataccattcagcacgcaagacgaaaagggggtaacacagaacggacgcctcatcaccgccaatcccattgtcactgataaagagaagcctgtgaacatcgaaacagagccaccctttggcgagtcgtatatagttgtgggtgctggggaaaaagccctgaagctttcttggttcaagaaaggctcctcaattggaaagatgtttgaggcaaccgccagaggcgctaggcggatggccatcctgggggacactgcatgggatttcggaagtatcggtggcgtctttaccagcgtggggaaattggtacatcaggtgttcggaacagcgtacggcgttctcttttccggtgtctcttggacgatgaagattgggatcggcattctgttaacctggctgggactaaatagccgatcaactagtctctccatgacatgtatagctgtgggcatggtgaccctgtaccttggggtcatggttcaggccgacagcggatgcgtgatcaactggaaaggccgcgaattgaagtgtggttctgggattttcgtgacaaacgaggtacacacttggaccgaacaatataagtttcaggcagattcaccgaaaagactgagtgccgctatcggaaaggcctgggaggagggcgtctgcggtatcaggagcgcaacgcggctcgaaaatattatgtggaaacagatatccaacgagctgaatcatatcttactggaaaacgacatgaagttcacagtggttgtgggcgacgctaatgggattcttgcccagggaaaaaagatgatccgccctcaacccatggagcacaaatactcttggaagtcgtggggcaaggcgaaaattatcggggccgatatacagaacgctacctttatcattgacggaccagatactcctgaatgtcccgacggccagagagcatggaatatctgggaggtcgaggattatggtttcgggatttttaccacaaacatctggttgaagctcagggacagctacactcagatgtgcgatcaccgtctgatgtccgccgctataaaagactcaaaggccgtgcatgcagatatgggatattggattgaaagtgagaaaaatgaaacctggaagctagcgcgggcctctttcatcgaggttaagacatgtacgtggccaaaaagccacaccctgtggtccaacggcgtgctcgaatcagagatgattatccccaagatatacggtggccctatcagccaacataattatcgaccagggtacttcactcagacagctggaccgtggcacctgggcaaacttgagttggactttgatctgtgcgaagggaccactgtagtcgtggacgagcactgcggaaacagaggcccctctttaaggacaaccacggtgactggtaagattatccatgaatggtgttgccgctcctgtaccctccctccactgcggttcagaggggaggatggatgctggtacggcatggagattaggcccgtcaaagaaaaggaggaaaatcttgttcgcagtatggtgagcgccggttctggcgaggtagactccttttcactggggatcttgtgtgtgagtataatgattgaagaggtcatgcgaagccggtggtcgcgtaagatgctcatgacaggaaccctggcagtgttcctactgctcatcatgggccagctgacttggaacgaccttacaagattgtgcatcatggttggggctaatgcctccgataggatgggaatgggcaccacatatctggcattaatggccacttttaaaatgcgccctatgttcgctgtgggtctcctgtttcggagacttacctctagggaggtcctgctactcacgattgggctgagcttggtggcgtcagttgaactgccaaacagtttagaggaactcggagacggcctggccatgggcatcatgatgcttaagctgttgacagagttccaaccccaccagctctggaccactctgctatccctgacctttgtgaaaacaactctttctctcgattacgcatggaagaccacggctatggtcctgagcattgtatccttgttcccgctgtgtttatcaacaaccagccagaaaactacatggctccctgtgctgcttgggagttttggatgcaagccactgaccatgttcttgataactgaaaacaagatctggggtcgaaaatcttggcccctcaatgagggcattatggccatcgggattgtttccatcctgctaagctcgctgcttaagaacgacgtgcctctcgccggacccctgatagctggcggtatgttgatcgcatgttatgtcatttcagggtctagtgccgatttatccctggagaaagcggctgaagtgagctgggagcaggaagccgagcattctggagcaagccacaatatcctcgtagaagtgcaagacgatggcacaatgaagattaaagacgaggagcgcgatgacaccctgacgatccttctgaaggccactttgctagctgtctccggcgtttacccaatgtcaatacctgcaaccctgtttgtgtggtatttctggcagaaaaagaagcagcggagtggggtgctctgggatacacccagcccaccggaagtcgagagagccgtgctggacgatggaatttacaggatccttcagcgtggtttactgggccgctctcaagttggggtaggagtgttccaggacggcgtctttcataccatgtggcacgtgacacggggtgcggttctcatgtatcaggggaaaagattggaaccttcctgggcttcagtgaagaaagacctgatcagttacggaggcggctggaggttccaggggctctggaacatgggagaggaggtccaagtgattgccgtagaacccggtaagaatccacgaaacgtccagactacccccggcacgtttaaaacacctgagggggaagtgggagcaatagccctggatttcaagccaggcactagcggttcccccatcgttaatcgggaggggaagattgtgggactttacggcaacggcgtcgtgaccacatctgggacctatgtttcggctatcgcccaggcaaaagctagccaagaaggacctctgccggagattgaggacgaagtgtttaagaaacgcaatttgactatcatggatctacacccaggttcaggcaagaccagaaggtacctgcccgccatagtccgggaggcgatcaaacgaaagctcagaacattaattctggcccctacgcgcgtggtagcatccgaaatggctgaggcccttaaggggatgccaatcaggtatcagactaccgctgtgaaaagtgaacatacaggacgtgagattgttgacctgatgtgccacgcaaccttcactatgcggctcttgtctcccgtcagagtgcctaactacaatatgatcataatggatgaggcccattttacagacccggccagcattgctgcgaggggctatatctccacccgcgtgggtatgggggaagcagccgctatcttcatgacggccactcccccaggatcagtcgaggcatttcctcagtctaacgccgtaattcaggatgaagagcgagacatccccgaaagaagctggaatagtggctacgattggataacagacttcccaggcaagaccgtgtggtttgttccttccattaaaagcgggaacgatatcgctaattgtctgcggaagaacggaaaaagggtgattcaactctctcgcaagaccttcgacactgagtatcagaagacaaaaaacaatgactgggattacgtcgtgaccacagacatctcagagatgggtgcgaacttccgtgccgatagagttatagacccccggaggtgcctgaagccagtgattcttaaagatggcccggaacgcgtcatcctagcagggcctatgcccgtgactgtagcttccgccgcacagcgaagaggacggatcggcaggaatcagaacaaggagggtgaccaatacgtgtatatggggcagccactgaataacgatgaagaccacgcccattggacggaggctaaaatgttgttagataatattaacacccccgagggcatcattcctgccctgtttgaaccagagcgcgaaaagagtgcggcaatagacggagagtacagactcaggggcgaagcccggaagacattcgttgagctgatgcgtcgcggggatcttcccgtctggctgagctataaagtggcttcggagggatttcagtactctgaccgaagatggtgcttcgatggtgaaaggaataaccaggtgctcgaggaaaatatggacgtcgagatctggactaaggaaggcgagcggaaaaagttgcgccctagatggctggacgccaggacctattccgatccgctagctctgcgggagtttaaagaattcgcagccgggcgaagaagcgtttcaggagacctcattcttgagatcggcaagctgccacaacacttaacattgcgcgctcagaacgccctggataatctcgtgatgctgcacaacagtgaacagggtgggaaagcatacaggcatgcgatggaggaacttcccgacaccatcgagactctgatgctcttggccctgattgctgtattaacgggcggagtgaccctatttttcctgtctggcaaggggctcggaaagacatccataggtcttctgtgtgtcactgccagctcagcattgctgtggatggctagtgtggagcctcactggatcgccgcaagcattatcctcgaatttttcctgatggttcttctcattcccgagccagatcggcagcgtacccctcaagacaatcagctggcctatgtggtcatcggcttgctgtttatgatattaacagtagctgcgaacgaaatggggctactggagaccactaaaaaggatctcggaatcggctacgccgcagctgagaaccatcagcacgccacaatgcttgacgtggatctgagacccgcctccgcatggacgttgtacgctgttgccaccactgtgattacaccaatgatgaggcacaccatcgaaaataccacagcgaacatttctctgactgctatcgccaatcaagcagccatactcatgggtctggacaaagggtggcctattagcaagatggatatcggcgtcccgcttttagctctgggatgctattcccaggtgaaccccctcacgttgaccgcagccgtcctgatgctagtggcgcattacgctattatcggcccagggctgcaggccaaagcaacacgcgaggcccagaagcggactgctgccggaataatgaagaatcctaccgttgacggcatcgtggcaattgatctcgaccccgtagtgtatgacgctaaattcgaaaagcaacttggtcagatcatgctgttgattctgtgtacatcacagatcctcctgatgcgaaccacttgggccttatgcgagtctataacgcttgcgacagggccactgaccactctctgggaaggaagtcctggcaaattttggaacaccacaattgccgtctcgatggcaaatatcttcagaggtagctacctagctggcgccgggctggcattctccttgatgaagtctctgggaggcgggaggcgcggaactggcgctcagggtgagaccctcggggagaaatggaagcggcaacttaaccagctgtcaaagagcgaatttaatacatataaaagatccggaatcatggaggttgatcgtagtgaagccaaggagggcttgaaaaggggtgaaacgaccaagcacgccgtgtctcggggcactgcgaaactgcgctggttcgtcgagcgaaacctcgtgaagcccgaggggaaggtaattgacttaggatgtggcagagggggatggagctactattgcgctggcctgaaaaaggtgacagaagttaaaggttacaccaaggggggaccgggccatgaggaaccaatccctatggcaacttacggctggaatcttgtgaaactgcactcagggaaggatgtctttttcatgcccccagagaaatgtgacacactactctgcgatataggagaatccagtcccaaccctaccattgaggagggtaggacgctgcgggtgttgaagatggtcgaaccgtggctgcgcggcaatcagttttgtatcaagattctcaacccctatatgccaagcgtggttgagacccttgaacagatgcaaagaaaacatgggggaatgctggtaaggaatcctttatctcgaaactccacacacgagatgtactgggtgtcatgcggcactggtaatatcgtcagcgccgtgaacatgacctcgcggatgctgttgaaccgtttcacaatggctcacagaaagcccacttatgagcgcgacgttgatctcggggccggaaccaggcatgtggcagtcgaacctgaggtggccaatctggacataatcggccagcggattgaaaacatcaaaaatgagcacaagtctacatggcattacgatgaagacaacccatataaaacctgggcttaccacggcagttatgaggtaaagccctccgggagcgcgtcatccatggtgaatggagttgtcagactacttactaagccttgggatgtgattccaatggtgacgcagatcgccatgacagacaccactccctttggtcaacagcgcgtcttcaaagagaaggttgacaccaggacaccgcgagcaaaacggggcacgacccagattatggaagtgactgctaagtggctgtgggggtttctctctagaaacaaaaagcctaggatctgtacacgcgaggaattcacccgtaaggtacggagcaatgccgcaataggagccgtgtttgtcgatgagaaccagtggaatagtgctaaagaagccgtggaggacgagagattctgggatctggttcacagggaacgcgagttgcataagcaaggcaaatgcgcgacttgcgtgtacaacatgatgggtaagcgagaaaaaaagctgggggagtttggaaaggcaaaaggctcccgggccatttggtacatgtggctcggcgctagattccttgaattcgaggccctggggtttatgaatgaggaccactggttcagcagggaaaactctttatcaggagtcgagggtgaaggcctgcataagttggggtatatcctccgcgatatcagtaaaattccaggaggcaatatgtacgcagacgatacagctggttgggacaccagaataacagaggatgacctgcagaacgaggccaagatcactgatattatggaacccgagcacgctctacttgccacctccatctttaaactgacgtatcagaataaggtggtacgggttcagaggcctgcaaaaaacgggaccgtgatggacgtcattagccgtcgagatcaacgcggatctggccaggtgggcacatacgggctcaacactttcaccaatatggaagtgcagctgatcagacagatggagtcggaaggaatatttttgccatcagagttagagacacccaacctggcggaacgggtcctcgactggcttgagaagcatggtgccgaaaggctgaagcgcatggctatcagcggcgacgattgtgttgtgaaaccgattgacgatagattcgccactgcactaaccgctctgaatgacatggggaaggtacggaaagatatccctcaatgggagccctccaagggatggaacgactggcagcaggtgccattttgcagtcaccacttccatcagctcattatgaaagatggcagggaaatcgtcgtgccttgtcgaaatcaagacgagttggttggtcgtgccagagtgtctcagggggcaggatggagcctgcgcgagacggcctgccttggcaagtcctatgcgcagatgtggcaactgatgtactttcaccggagggatctcagattagctgccaacgcaatatgttcagccgtccccgtggaatgggtaccaacaagtcgcaccacttggtctattcatgctcaccaccagtggatgacaaccgaggacatgctgagcgtttggaatcgggtgtggatcgaagagaacccctggatggaagataagactcatgtctcctcatgggaggaggtgccttatttgggcaaaagggaagaccagtggtgcgggagcctgatcggactcaccgcccgagcaacatgggctacgaatattcaggttgccataaaccaagtgagacggcttatcggtaatgagaactacctggactacatgacctctatgaagaggttcaaaaatgaatccgatccagagggcgcgctatggtga

SEQ ID NO: 13248 - RNA, 9879 nt, synthetic construct
  misc_feature 1..9879: note = derived and/or modified CDS sequence (opt3) from DENV-1__GQ868570__SS-prME
  source 1..9879: mol_type = other RNA
agcgtgaccatgctgctcatgcttctgcccacagccttggctttccacttaactacgagaggcggggagcctcatatgatcgtctccaagcaggaaaggggaaaatctctgctatttaagacctcagcaggtgttaacatgtgcacactcattgccatggacctgggcgagctttgtgaagatactatgacctacaaatgcccacggataacagaggcggaaccggacgatgtggactgttggtgcaatgctaccgatacttgggtaacatatgggacctgtagtcaaacgggagagcaccgccgagacaagcgtagcgtggccctggcaccccatgtcggcttgggtctcgagactagaaccgaaacatggatgtcctctgagggggcctggaaacagatccagagggtggaaacttgggctctgcggcaccctggattcaccgttattgcactgtttctcgcccatgctatcggcacatcgattacccagaagggcatcatattcatcttactgatgcttgtgacgccatcaatggccatgcgctgcgtcgggattggaaacagagattttgtggagggtttgagcggcgcgacttgggtagacgttgtgctggagcacgggagttgtgtcacaaccatggcaaagaataaacccactctagatatcgaactcctgaagacagaggtgaccaaccctgccgtgcttaggaaactgtgcattgaagctaagatctccaatacgaccacagactctcggtgtccaactcaaggagaggccaccttggtcgaagagcaggatgcaaacttcgtttgccgccgaacatttgtggacagaggctggggtaatgggtgtggactcttcggcaaaggcagcctgttaacttgcgctaagtttaagtgcgtaaccaaactggaggggaagatagtgcagtacgaaaacctcaaatattccgtcattgtgacagttcacaccggagatcagcatcaagtgggtaatgagactacggaacacggcacaatcgccaccattactccccaggcgcctacctcagagatccagcttacagactacggggccctgaccttggactgtagtccaaggactggactagatttcaacgaaatggtcctgctcacaatgaaggagaaaagctggctggtgcataagcagtggtttcttgacctgccgttgccctggacgtctggcgcatccacctcacaagagacttggaatcggcaggatctcctggtaacattcaaaaccgctcacgccaagaagcaggaagttgtggtcttaggtagccaagagggggctatgcacacagccctgactggcgcaaccgaaatccagacgagtggaaccacaactatttttgccggccatctaaaatgccgtctcaagatggacaaactgacccttaaggggatgtcttatgtgatgtgtacaggatccttcaaattggagaaggaagtcgctgagactcagcacggtaccgtgctggttcaggtgaagtacgagggcacggatgcgccttgcaaaataccattcagcacacaagacgaaaagggggtaacccagaacggacgcctcatcactgcaaatcccattgtcacagataaagagaagcctgtgaacatcgaaaccgagccaccctttggcgagtcgtatatagttgtgggtgccggggaaaaagctctgaagctttcttggttcaagaaaggctcctcaattggaaagatgtttgaggccactgcaagaggcgccaggcggatggctatcctgggggacaccgcctgggatttcggaagtatcggtggcgtctttacaagcgtggggaaattggtacatcaggtgttcggaacggcatacggcgttctcttttccggtgtctcttggaccatgaaggtggggattggcatcctgttaacttggctgggactaaatagccgatcaacaagtctctccatgacctgtattgcggtgggcatggtcacactgtaccttggggttatggtgcaggctgacttgggatgcgtgataaactggaaaggccgcgaactgaagtgtggtagcgggatcttcgtaactaacgaggtccacacctggacggaacaatataagtttcaggccgattctccgaaaagactctcagcagccattggaaaggcttgggaggagggcgtgtgcggtatcaggagtgttacacggctggaaaatatcatgtggaaacagattagcaacgagttaaatcatatactgcttgaaaacgacatgaagttcaccgtggtcgtgggcgacgccaatgggatcttggcacagggaaaaaagatgattcgccctcaacccatggagcacaaatactcctggaagtcttggggcaaggctaaaatcattggggccgatactcagaacaccacatttatcatagacggaccagatactcctgaatgtcccgacggccagagagcgtggaatatctgggaggttgaggattatggtttcgggatttttaccacaaacatctggctcaagctgagggactcgtacacgcagatgtgcgatcaccgtctaatgagcgccgctattaaagactccaaggcagtgcatgccgatatgggatattggatcgaatcagagaaaaatgaaacctggaagctggctcgggccagtttcatagaggtaaagacttgtacatggccaaaatctcacaccctctggagcaacggcgtcctggaatccgagatgattatccccaagatttacggtggccctatctcacaacataattatcgaccagggtacttcactcagacagcaggaccgtggcaccttggcaaattggagctggactttgatttatgcgaagggaccacggtggtggtcgacgagcactgcggaaacagaggccccagcctcaggactaccacagttaccggtaagataatccatgaatggtgttgccgctcttgtactctgcctccacttcggttcagaggggaggatggatgctggtacggcatggagattaggcccgtgaaagaaaaggaggaaaatctggtacgctccatggtgagtgcgggtagcggcgaggtcgactctttttccttggggatcctctgtgtgtcaattatgatcgaagaggttatgcgaagtcggtggagccgtaagatgctgatgacaggaaccctagccgtgttcctgctcctgataatgggccagcttacatggaacgacttgattagactgtgcatcatggtcggggctaatgcctcggataggatgggaatgggcactacctatttagcactcatggctacgtttaaaatgcgccctatgttcgccgtgggtctgctttttcggagactgacatccagggaggttctactcctgaccatcgggttgtctctggtggcaagcgtcgaattaccaaactcactcgaggaactgggagacggccttgccatgggcattatgatgctgaagttgctcactgagttccaaccccaccagctgtggaccacactactgagtcttacttttgtaaaaaccacgctctccctggattacgcttggaagacaaccgcgatggtgttgtctatcgttagcctgttcccgttatgtctctccactacatcacagaaaaccacttggctgcctgtgcttctggggagctttggatgcaagccattgacaatgttcctcattaccgaaaacaagatatggggtcgaaaaagttggcccctgaatgagggcatcatggccattgggatcgtctctattctactgtccagccttctcaagaacgacgtgcctctggcaggacccttgatcgctggcggtatgttaatagcctgttatgtaatctcggggtcatctgccgatctgagtctcgagaaagctgcagaagtgtcctgggagcaggaagccgagcatagcggagcgtctcacaatattctggtcgaagttcaagacgatggcacgatgaagatcaaagacgaggagcgcgatgacactcttaccattctgttgaaggctacactactggccgtgagcggcgtgtacccaatgtccatccctgcaaccctctttgtctggtatttctggcagaaaaagaagcagcggtcaggggtgctgtgggatacacccagtccaccggaagttgagagagccgtacttgacgatggaatatacaggattttacagcgtggtctgctcggccgcagccaagtgggggtcggagtgttccaggacggcgtttttcatactatgtggcacgtgacccggggtgctgtcttgatgtatcaggggaaaagactggaaccttcttgggcatccgtgaagaaagacctcatctcatacggaggcggctggaggttccaggggagttggaacacgggagaggaggtacaagtcatcgccgtggaacccggtaagaatccaaaaaacgttcagacaactcccggcacctttaagacacctgagggggaagtgggagcgattgctctggatttcaagccaggcaccagcggttcccccatagtcaatcgagaggggaaaatcgtgggactttacggcaacggcgttgtgactacctctgggacatatgtctcggccattgcacaggccaaggctagccaagaaggacctctgccggagatcgaggacgaagtgtttaaaaagcggaatttgacgattatggatctacacccaggttcaggcaaaactcgcagatacctgcccgccatcgtaagggaggcaataaagcggaagctccgaaccttaatcctggctcctacaagagtggttgcctccgaaatggcggaggcccttaaagggatgccaattcgctatcagaccactgcagtcaagagtgaacatacaggaagggagatcgtggacctgatgtgccacgctaccttcacgatgcgtctcttgtctcccgtgcgggtccctaactacaatatgattatcatggatgaggcccattttactgacccggctagcatagcagccagaggctatatttccacaagggtaggtatgggggaagccgctgcgatcttcatgaccgcaacccccccaggatcagtggaggcctttcctcagtctaacgctgttatccaggatgaagagcgcgacattcccgaacgaagctggaatagtggctacgattggatcactgacttcccaggcaaaacagtgtggtttgtcccttccataaagagcgggaacgatattgccaattgtctgagaaaaaacggaaagcgggtgatccaactctctaggaagaccttcgacacagagtatcagaaaactaagaacaatgactgggattacgttgtgacgaccgacatttcagagatgggtgcaaacttccgcgccgatcgtgtcatcgaccccagacggtgcctgaaaccagtgatacttaaggatggcccggaaagggtaattctagctgggcctatgcccgtgacagttgcgtccgccgcacagcgccgaggaagaatcggccggaatcagaacaaagagggtgaccaatacgtctatatggggcagccactgaataacgatgaagaccacgctcattggactgaggccaagatgttgttagataatatcaacacccccgagggcattatccctgcactgtttgaaccagagagggaaaagagtgccgctattgacggagagtaccgcctcagaggcgaagccaggaaaacattcgtggagctgatgcggcgtggggatcttcccgtgtggctgagctataaggtcgcgtcggagggatttcagtactctgaccgccgatggtgcttcgatggtgaaagaaataaccaggttctcgaggaaaatatggacgtggagatatggaccaaagaaggcgagaggaagaaattgcggcctcgctggctggacgcaagaacttattccgatccgctagccctgagggagtttaaggaattcgctgccgggcggcgaagcgtatcaggagacctcatccttgagattggcaaactgccacaacacttaacgttgagagctcagaacgcactggataatctcgtgatgctgcacaacagtgaacagggtgggaaggcctaccgccatgctatggaggaacttcccgacaccatcgagacactgatgctcttggccctgatcgcagtcttaactggcggagtgaccctatttttcctgtctggcaaggggctcggaaaaacatccattggtcttctgtgtgttaccgcgagctcagccttgctgtggatggctagtgtggagcctcactggatagccgcaagcatcattctcgaatttttcctgatggtccttctcatccccgagccagataagcagaggactcctcaagacaatcagctggcttatgtagtgattggcttgctgtttatgatcttagccgttgcagccaacgaaatggggctactggagacaacgaaaaaggatctcggaataggctacgtggctaccgagaaccatcagcacgcgactatgcttgacgtcgatctgcggcccgcctccgcatggacattgtacgctgtggccaccaccgtcatcacaccaatgatgcgtcacactattgaaaatacgaccgccaacatctctctgacagcaattgctaatcaagccgcgatcctcatgggtctggacaaagggtggcctataagcaagatggatattggcgtgccgcttttagctctgggatgctattcccaggttaaccccctcactttgaccgccgcagtgctgatgctagtagcccattacgctatcattggcccagggctgcaggcaaaggccacaagagaggcgcagaaaaggaccgctgccggaatcatgaagaatcctactgtggacggcatagtcgcaatcgatctcgaccccgttgtgtatgacgccaaattcgaaaagcaacttggtcagattatgctgttgatcctgtgtacgtcacagattctcctgatgcgcacaacctgggctttatgcgagtctatcactcttgccaccgggccactgacaactctctgggaaggaagtcctggcaaattttggaacaccacaatagcagtctcgatggctaatattttccggggtagctacctagccggcgcggggctggccttctccttgatgaagtctctgggaggcgggcgaagaggaacgggcgcacagggtgagaccctcggggagaagtggaaaaggcaacttaaccagctgtcaaagagcgaatttaatatctataaacgctccggaatcatggaggtggatcggagtgaagctaaggagggcttgaaaagaggtgaaactacaaagcacgccgtatctcgtggcaccgcaaagctgaggtggttcgtggagcggaacctcgttaaacccgaggggaaggtgattgacttaggatgtggccgcgggggatggagctactattgcgctggcctgaaaaaggtcactgaagtgaaaggttacacaaaggggggaccgggccatgaggaaccaatccctatggccacctacggctggaatcttgtcaaactgcactcagggaaggatgtgtttttcatgcccccagagaagtgtgacacgctactctgcgatataggagaatccagtcccaaccctaccattgaggagggtcgaacactgagagttttgaaaatggtagaaccgtggctgaggggcaatcagttttgtatcaagattctcaacccctatatgccaagcgtggtcgagactcttgaacagatgcaacggaaacatgggggaatgctggtgcgcaatcctttatctagaaactccacccacgagatgtactgggtttcatgcggcacaggtaatatcgtgagcgccgtcaacatgacttcgaggatgctgttgaaccgattcaccatggcgcaccggaagcccacatatgagcgtgacgtggatctcggggctggaaccagacatgtagcagtggaacctgaggttgccaatctggacataatcggccagcgcattgaaaacatcaaaaatgagcacaagtctacttggcattacgatgaagacaacccatataagacgtgggcttaccacggcagttatgaggtcaaaccctccgggagcgcctcatccatggtgaatggagtggtcaggctacttacaaagccttgggatgttattccaatggtgacccagatcgcaatgactgacaccacaccctttggtcaacagcgggtattcaaagagaaggtggacacgagaaccccgcgcgccaaaaggggcactacacagattatggaagtcaccgctaagtggctgtgggggtttctctctcgaaacaagaaacctcggatctgtactagagaggaattcacaaggaaggtgcgcagcaatgcggccataggagcagtttttgtggatgagaaccagtggaatagtgctaaagaagccgtcgaggacgagcgtttctgggatctggtgcaccgggaaagagagttgcataagcaaggcaaatgcgcaacctgcgtatacaacatgatgggtaagagggaaaagaaactgggggagtttggaaaggccaaaggctcccgcgctatttggtacatgtggctcggcgcccgattccttgaattcgaggcgctggggtttatgaatgaggaccactggttcagccgggaaaactctttatcaggagttgagggtgaaggcctgcataagttggggtatatcctcagagatatcagtaaaattccaggaggcaatatgtacgcagacgatacagccggttgggacactaggataaccgaggatgacctgcagaacgaggctaagatcacggatattatggaacccgagcacgccctacttgcaacctccatctttaaactgacatatcagaataaggtggtccgcgtgcagagacctgctaagaacgggactgtgatggacgtcattagccggagggatcaacgtggatctggccaggttggcacctacgggctcaacacattcactaatatggaagtgcagctgatccgacagatggagtcggaaggaatatttttgccatcagagttagagacccccaacctggccgaacgcgtactcgactggcttgagaaacatggtgctgaaagactgaagcggatggccatcagcggcgacgattgtgtggtcaaaccgattgacgataggttcgcagcggccctaacggctctgaatgacatggggaaggtgcgcaaagatatccctcaatgggagccctccaagggatggaacgactggcagcaggttccattttgcagtcaccacttccatcagctcattatgaaggatggcagagaaatcgtggtcccttgtcggaatcaagacgagttggtgggtagggcccgagtatctcagggggcaggatggagcctgcgtgagacagcttgccttggcaaatcctatgcccagatgtggcaactgatgtactttcacagacgcgatctccggttagcagccaacgcgatatgttcagctgttcccgtggactgggtcccaaccagtaggactacatggtctattcatgcccaccaccagtggatgaccactgaagatatgctgagcgtgtggaatagagtttggatcgaggaaaacccctggatggaggacaagacccatgtgtcctcatgggaagaggtcccttatttgggcaaacgcgaggaccagtggtgcgggagcctgatcggactcacagcacgggccacgtgggctaccaatattcaggtggccataaaccaagtaaggcgacttatcggtaatgaaaactacctggattacatgacttctatgaagagattcaaaaatgagtccgacccagaaggcgcactatggtga

SEQ ID NO: 13249 - RNA, 9879 nt, synthetic construct
  misc_feature 1..9879: note = derived and/or modified CDS sequence (opt3) from DENV-1__KJ189302__SS-prME
  source 1..9879: mol_type = other RNA
agcgtgaccatgctgctcatgcttctgcccactgccttggctttccacttaactacgagaggaggggagcctcatatgatcgtctccaagcaggaaagaggaaaatctctgctatttaagacctcagctggtgttaacatgtgcaccctcattgccatggacctgggcgagctttgtgaagatactatgacctacaaatgcccacggataacagaggcggaaccggacgatgtggactgttggtgcaatgctaccgatacttgggtaacatatgggacctgtagtcaaacgggagagcaccgccgagacaagcgtagcgtggccctggctccccatgtcggcttgggtctcgagactagaaccgaaacatggatgtcctctgagggggcctggaaacagatccagagggtggaaacttgggccctgcggcaccctggattcaccgttattgcatttttcctggcccatgctatcggcacatcgattacccagaagggcatcatatttatcctcttaatgctggtgacgccatcaatggccatgcgctgcgtcgggattggaaacagagatttcgtggagggtcttagcggcgcgacttgggtagacgttgtgttggagcacgggagttgtgtcacaaccatggcaaagaataaacccactctggatatcgaactactcaagacagaggtgaccaaccctgccgtgctgaggaaactttgcattgaagctaagatctccaatacgaccacagactctcggtgtccaactcaaggagaggccaccctggtcgaagaacaggatgcaaactttgtttgccgccgaacattcgtggacagaggctggggtaatgggtgtggattgtttggcaaaggcagcctcctgacttgcgctaagttcaagtgcgtaaccaaattagaggggaagatagtgcagtacgaaaacctgaaatattccgtcattgtgacagttcacaccggagatcagcatcaagtgggtaatgagactacggaacacggcacaatcgccaccattactccccaggcgcctacctcagagatccagctcacagactacggggcccttaccctggactgtagtccaaggactggattggattttaacgaaatggtcctactgacaatgaaggagaaaagctggctcgtgcataagcagtggttcctggaccttccgctgccctggacgtctggcgcatccacctcacaagagacttggaatcggcaggatttgctcgtaacatttaaaaccgctcacgccaagaagcaggaagttgtggtcctgggtagccaagagggggctatgcacacagccttaactggcgcaaccgaaatccagacgagtggaaccacaactattttcgccggccatctgaaatgccgtctaaagatggacaaactcaccctgaaggggatgtcttatgtgatgtgtacaggatccttcaaacttgagaaggaagtcgctgagactcagcacggtaccgtgttggttcaggtgaagtacgagggcacggatgcgccttgcaaaataccatttagcacacaagacgaaaagggggtaacccagaacggacgcctgatcactgcaaatcccattgtcacagataaagagaagcctgtgaacatcgaaaccgagccacccttcggcgagtcgtatatagttgtgggtgccggggaaaaagctctcaagctgtcttggtttaagaaaggctcctcaattggaaagatgttcgaggccactgcaagaggcgccaggcggatggctatccttggggacaccgcctgggattttggaagtatcggtggcgtcttcacaagcgtggggaaactggtacatcaggtgtttggaacggcatacggcgttttgttctccggtgtctcttggaccatgaagattgggatcggcattctcctgacttggttaggactgaatagccgatcaacaagtctatccatgacctgtatagcggtgggcatggtgacactctacctgggggtcatggttcaggctgacagcggatgcgtgatcaactggaaaggccgcgaacttaagtgtggttctgggatttttgtgactaacgaggtacacacctggacggaacaatataagttccaggccgattcaccgaaaagattgagtgcagccatcggaaaggcttgggaggagggcgtctgcggtatcaggagcgccacacggctggaaaatattatgtggaaacagatatccaacgagctcaatcatatcctgttagaaaacgacatgaagtttaccgtggttgtgggcgacgcaaatgggattctggctcagggcaagaagatgatccgccctcaacccatggagcacaaatactcttggaagtcgtggggcaaggccaaaattatcggggcggatatacagaacactaccttcatcattgacggaccagatacacctgaatgtcccgacggccagagagcctggaatatctgggaggtcgaggattatggttttgggattttcactaccaacatctggcttaagttgagggacagctacacacagatgtgcgatcaccgtctcatgtccgctgcaataaaagactcaaaggccgtgcatgctgatatgggatattggattgaaagtgagaaaaatgaaacgtggaagctggcccgggcatctttcatcgaggttaagacctgtacttggccaaaaagccacacactatggtccaacggcgtgctggaatcagagatgattatccccaagatatacggtggccctatcagccaacataattatcgaccagggtactttacccagactgcgggaccgtggcacctcggcaaactggagcttgacttcgatttgtgcgaagggacaaccgtagtcgtggacgagcactgcggaaacagaggcccctctctgaggacgactaccgtgacaggtaagattatccatgaatggtgttgccgctcctgtaccttacctccactccggtttagaggggaggatggatgctggtacggcatggagattaggcccgtcaaagaaaaggaggaaaatctggttcgcagtatggtgagcgccggttctggcgaggtagactccttctcacttgggatcctgtgtgtgagtataatgattgaagaggtcatgcgaagccggtggtcgcgtaagatgttgatgactggaacactcgctgtgtttctgctactgatcatgggccagctcacctggaacgacctgatcagactttgcattatggttggggccaatgcatccgataggatgggaatgggcacaacttatttggctctgatggccaccttcaaaatgcgccctatgtttgcagtgggtttactcttccggagactgacgtctagggaggtccttctgctaacaatcgggctcagcctggtggcctcagttgaattgccaaacagtctggaggaattaggagacggcctcgctatgggcattatgatgctgaaacttctgaccgagtttcaaccccaccagttgtggactaccctcctgtccctaacattcgtgaaaactaccctgtctcttgattacgcgtggaagacgacagccatggtcctcagcatagtatccctgtttccgttgtgtctgtcaaccactagccagaaaacaacctggttacctgtgctcctggggagtttcggatgcaagccacttactatgtttctgatcacagaaaacaagatttggggtcgaaaatcttggcccttgaatgagggcatcatggcaattgggatcgtttccatactcctgagctcgctactgaagaacgacgtgcctcttgctggacccctcatcgccggcggtatgctgattgcctgttatgtcatctcagggtctagtgctgatttgtccttagagaaagcagccgaagtgagctgggagcaggaagcggagcattctggagctagccacaatattctggtagaagtgcaagacgatggcaccatgaagatcaaagacgaggagcgcgatgacacgctcactatactgcttaaggccaccctgttggcagtctccggcgtttacccaatgtcaattcctgccacactattcgtgtggtatttctggcagaaaaagaagcagcggagtggggtgctgtgggatacccccagcccaccggaagtcgagagagctgtgctcgacgatggaatctacaggatcctgcagcgtggtcttttaggccgctctcaagttggggtaggagtgtttcaggacggcgtcttccatacaatgtggcacgtgactcggggtgcagttctgatgtatcaggggaaaagactcgaaccttcctgggcctcagtgaagaaagacttgattagttacggaggcggctggaggtttcaggggagctggaacaccggagaggaggtccaagtgatagcggtagaacccggtaagaatcccaaaaatgtccagacgacacccggcactttcaagacccctgagggggaagtgggagctatcgccctggattttaagccaggcacatccggttctcccattgttaatcgagaggggaaaatcgtgggactctacggcaacggcgtcgtgaccacttcggggacctatgttagcgcaattgcccaggctaaggcctcacaagaaggacctctgccggagatcgaggacgaagtgttcaaaaagcggaatcttacaataatggatctgcacccaggttccggcaaaacgcgcagatacttgcccgcaatcgtcagggaggctattaagcggaagctacgaactctgatcctcgcccctaccagagtggtagcgagtgaaatggccgaggcattaaaagggatgccaattcgctatcagacaaccgctgtgaagtctgaacatactggaagggagatcgttgacctgatgtgccacgccacatttaccatgcgtcttctgagccccgtccgggtgcctaactacaatatgataattatggatgaggctcatttcacggacccggcatccatcgccgccagaggctatatctcaactagggtgggtatgggggaagctgcggcaatttttatgacagccacaccaccaggatctgtcgaggctttccctcagagcaacgccgtaatccaggatgaagaacgcgacatacccgaacgaagttggaactccggctacgattggattaccgactttccaggcaaaactgtgtggttcgttcctagcatcaagtctgggaacgatattgcaaattgtctcaggaaaaacggaaagcgggtgatccaattgtcaaggaagacattcgacaccgagtatcagaaaacaaagaacaatgactgggattacgtcgtgactacggacatatccgagatgggtgccaactttcgcgctgatcgtgttattgaccccagacggtgcctgaaaccagtgatcctcaaggatggcccggaaagggtcatcctggcggggcctatgcccgtgaccgtagccagtgcagctcagcgccgaggaagaattggccggaatcagaacaaagagggtgaccaatacgtgtatatggggcagccacttaataacgatgaagaccacgcccattggacagaggcaaagatgctactggataatatcaacactcccgagggcattatacctgccttgttcgaaccagagagggaaaagagcgctgccatcgacggagagtaccgcttaagaggcgaagcgaggaaaacctttgttgagctgatgcggcgtggggatctccccgtctggctgtcgtataaggtggcatctgagggattccagtactccgaccgccgatggtgctttgatggtgaaagaaataaccaggtgcttgaggaaaatatggacgtcgagatttggacaaaagaaggcgagaggaagaaactgcggcctcgctggctcgacgccagaacctatagcgatccgttggctctgagggagttcaaggaatttgccgctgggcggcgatcagttagtggagacctaatcctggagatcggcaaactcccacaacaccttactctgagagcacagaacgccttagataatttggtgatgctgcacaactctgaacagggtgggaaggcttaccgccatgccatggaggaactccccgacacgattgagaccctgatgcttctggcactcatagcggtattgacaggcggagtgactctgttctttttatccggcaaggggctaggaaaaaccagcatcggtctgctctgtgtcacagcctcaagtgcacttctgtggatggccagcgtggagcctcactggattgcagcttccatcattttggagttctttctgatggttctcctgatccccgagccagataggcagcggacccctcaagacaatcagcttgcctatgtggtcataggcctcctgttcatgatcttgactgtagcagccaacgaaatggggctgttagagacaacgaagaaagatctaggaattggctacgtggctgcggagaaccatcagcacgccaccatgctggacgttgatctccgtcccgcatctgcttggactctttacgccgtggccacaaccgtcatcaccccaatgatgagacacacaattgaaaatactacggcaaacatcagcctgaccgctatagccaatcaagcggctattttgatgggtctggacaaggggtggcctatctccaaaatggatattggcgtgccgctcctggcccttggatgctattcacaggtcaaccccttaacactgactgcagccgtgctcatgttggttgctcattacgcaatcataggcccagggctgcaggccaaggcgaccagggaggctcagaagcgcacagccgcaggaatcatgaaaaatcctaccgtggacggcattgtagccatcgatctagaccccgtggtctatgacgctaagtttgaaaaacaactgggtcagattatgctccttatcctgtgtacttctcagatattgctgatgcggacgacatgggccctctgcgagagtattaccctggcaactgggccattaaccacactttgggaaggatcgcctggcaagttctggaacactaccatcgctgttagcatggccaatatcttccgaggttcctacctggcgggcgccgggctcgcattttctctaatgaaatcactgggaggcgggagaaggggaacaggcgctcagggtgagacgttgggggagaagtggaagcgccaactgaaccagctcagcaaatccgagttcaatacctataagcggagtggaattatggaggtggatagatctgaagccaaagagggccttaagcgtggtgaaactacaaaacacgcagtcagcaggggcaccgctaagctgcggtggtttgtggagcgcaacttggtaaagcccgaggggaaagtgatcgacctgggatgtggccgagggggatggtcatactattgcgccggcctcaagaaagttactgaagtgaagggttacacaaaagggggaccgggccatgaggaaccaatacctatggccacctacggctggaatttagtcaagctgcactccgggaaagatgtgttctttatgcccccagagaagtgtgacacgcttctgtgcgatattggagaaagtagcccctctcctaccatcgaggagggtagaacactaagggtcctcaagatggtggaaccgtggctgcggggcaaccagttctgtattaaaatcttgaatccctatatgccatccgttgtagagactctggaacagatgcaacgcaagcatgggggaatgctcgtgagaaaccctctttcaaggaatagcacccacgagatgtactgggtctcgtgcggcacaggtaacatagtgtctgcggttaatatgacaagtcgaatgctgttaaaccggtttaccatggctcaccgtaaacccacatatgagagagacgtggatctgggggcaggaacccgccatgtcgccgtggaacctgaggtagctaacttggacatcattggccagaggatcgaaaatattaagaacgagcacaaatccacttggcattacgatgaagacaatccatataagacgtgggcctaccacggcagctatgaggtgaagccctcagggtccgcatctagcatggttaacggagtcgtgcggctcctgacaaaaccttgggatgtgatcccaatggtcacccagattgccatgactgacaccacacccttcggtcaacagagagtttttaaggagaaagtggacacgcgcaccccgagggctaagcgaggcactacacagatcatggaagtaaccgcgaaatggctatgggggttccttagtcggaataagaagcctagaatatgtactagggaggaatttacacgcaaagtgcgttccaacgccgcaattggagctgtcttcgtggatgagaatcagtggaacagcgccaaggaagcagttgaggacgagcggttttgggatctggtgcacagagaaagggagctccataaacaaggcaagtgcgcaacctgcgtctacaatatgatgggtaaacgcgaaaagaagctgggggagttcggaaaagctaagggctctcgagccatctggtacatgtggttgggcgcgcggttcctggaatttgaggcactcgggttcatgaacgaggaccactggttttcaagagaaaatagtctttccggagtggagggtgaaggcctgcataaattagggtatatcctgagggatattagcaagataccaggaggcaacatgtacgccgacgatacagctggttgggacactcgcatcaccgaggatgacttgcagaatgaggccaaaattacggatatcatggaacccgagcacgcactcctggctacctctattttcaagctaacatatcagaacaaagtagttagagtgcagcggcctgccaagaatgggactgtcatggacgtgatctcgaggcgtgatcaacgaggatcaggccaggtgggcacctacgggcttaacacatttactaacatggaagtccagctgatacgccagatggagagcgaaggaatcttcctcccatccgagctggagacccccaatttggctgaaagagttttagactggctggagaagcatggtgccgaacggctcaaaaggatggcaattagtggcgacgattgtgtggtaaagccgatcgacgatcgctttgcgacggcccttacagctctgaacgacatggggaaagtgagaaaggatattcctcaatgggagccctctaaaggatggaatgactggcagcaggtcccattctgcagccaccactttcatcagctaatcatgaaggatggccgggaaatagtggttccttgtaggaaccaagacgagctggtgggtcgagcccgtgtctcccagggggcaggatggtcactcagagagaccgcttgcttgggcaagagttatgcccagatgtggcaactgatgtacttccaccgccgggatcttaggctggcagccaatgcgatttgttctgctgtgcccgtagactgggttccaactagcagaacaacctggtccatccatgcccaccaccagtggatgactaccgaagatatgctctcagtgtggaaccgcgtctggatcgaggaaaatccctggatggaggacaaaacacatgtgagctcttgggaagaggttccttatttaggcaagcgggaggaccagtggtgcgggtccctgattggattgacggcaagggccacctgggctactaacatacaggtggccatcaatcaagtccgaagactgattggtaacgaaaattacctcgattacatgacaagtatgaaacggtttaagaacgagagcgacccagaaggcgcactttggtga

SEQ ID NO: 13250 - RNA, 9879 nt, synthetic construct
  misc_feature 1..9879: note = derived and/or modified CDS sequence (opt3) from DENV-1__KJ189303__SS-prME
  source 1..9879: mol_type = other RNA
agcgtgaccatgctgctcatgcttctgcccacagccttggctttccacttaactacgagaggcggggagcctcatatgatcgtctccaagcaggaaaggggaaaatctctgctatttaagacctcagcaggtgttaacatgtgcacactcattgccatggacctgggcgagctttgtgaagatactatgacctacaaatgcccacggataacagaggcggaaccggacgatgtggactgttggtgcaatgctaccgatacttgggtaacatatgggacctgtagtcaaacgggagagcaccgccgagacaagcgtagcgtggccctggcaccccatgtcggcttgggtctcgagactagaaccgaaacatggatgtcctctgagggggcctggaaacagatccagagggtggaaacttgggctctgcggcaccctggattcaccgttattgcactgtttctcgcccatgtgatcggcacatcgattacccagaagggcatcatattcatcttactgatgcttgtcacgccatcaatggctatgcgctgcgtggggattggaaacagagattttgtagagggtttgagcggcgccacttgggttgacgtggtcctggagcacgggagttgtgtgacaaccatggcgaagaataaacccactctagatatcgaactcctgaagacagaggtgaccaaccctgcagtccttaggaaactgtgcattgaagccaagatctccaatacgaccacagactctcggtgtccaactcaaggagaggctaccttggttgaagagcaggatgccaacttcgtgtgccgccgaacatttgtagacagaggctggggtaatgggtgtggactcttcggcaaaggcagcctgttaacttgcgcaaagtttaagtgcgtgaccaaactggaggggaagatagtccagtacgaaaacctcaaatattccgtgattgttacagtgcacaccggagatcagcatcaagtcggtaatgagactacggaacacggcacaatcgctaccattactccccaggcccctacctcagagatccagcttacagactacggggcgctgaccttggactgtagtccaaggactggactagatttcaacgaaatggtgctgctcacaatgaaggagaaaagctggctggtacataagcagtggtttcttgacctgccgttgccctggacgtctggcgcctccacctcacaagagacttggaatcggcaggatctcctggttacattcaaaaccgcacacgctaagaagcaggaagtggtcgtgttaggtagccaagagggggccatgcacacagctctgactggcgccaccgaaatccagacgagtggaaccacaactatttttgcaggccatctaaaatgccgtctcaagatggacaaactgacccttaaggggatgtcttatgtcatgtgtacaggatccttcaaattggagaaggaagtggccgagactcagcacggtaccgttctggtgcaggtaaagtacgagggcacggatgctccttgcaaaataccattcagcacacaagacgaaaagggggtcacccagaacggacgcctcatcactgcgaatcccattgtgacagataaagagaagcctgttaacatcgaaaccgagccaccctttggcgagtcgtatatagtggtcggtgcaggggaaaaagccctgaagctttcttggttcaagaaaggctcctcaattggaaagatgtttgaggctactgccagaggcgcaaggcggatggccatcctgggggacaccgcttgggatttcggaagtatcggtggcgtgtttacaagcgtagggaaattggtgcatcaggttttcggaacggcctacggcgtcctcttttccggtgtgtcttggaccatgaagattgggatcggcattctgttaacttggctgggactaaatagccgatcaacaagtctctccatgacctgtatagcagtgggcatggtcacactgtaccttggggttatggtgcaggcggacagcggatgcgtgatcaactggaaaggccgcgaattgaagtgtggttctgggattttcgtaactaacgaggtccacacctggacggaacaatataagtttcaggctgattcaccgaaaagactgagtgccgcaatcggaaaggcctgggaggagggcgtgtgcggtatcaggagcgctacacggctcgaaaatattatgtggaaacagatatccaacgagctgaatcatatcttactggaaaacgacatgaagttcaccgttgtggtcggcgacgccaatgggattcttgcacagggaaaaaagatgatccgccctcaacccatggagcacaaatactcttggaagtcgtggggcaaggctaaaattatcggggccgatactcagaacaccacatttataatcgacggaccagatactcctgaatgtcccgacggccagagagcgtggaatatttgggaggtggaggattatggtttcgggatctttaccacaaacatttggttgaagctcagggacagctacacgcagatgtgcgatcaccgtctgatgtccgccgctatcaaagactcaaaggcagttcatgccgatatgggatattggatagaaagtgagaaaaatgaaacctggaagctagctcgggcctctttcattgaggtgaagacttgtacatggccaaaaagccacaccctgtggtccaacggcgtactcgaatcagagatgatcattcccaagatctacggtggccctataagccaacataattatcgaccagggtacttcactcagacagcaggaccgtggcacctgggcaaacttgagttggactttgatctgtgcgaagggaccacggtcgtggtggacgagcactgcggaaacagaggcccctctttaaggactaccacagtcaccggtaagatcattcatgaatggtgttgccgctcctgtactctccctccactgcggttcagaggggaggatggatgctggtacggcatggagatcaggcccgttaaagaaaaggaggaaaatcttgtgcgcagtatggtaagcgcgggttctggcgaggtggactccttttcactggggattttgtgtgtcagtatcatgatagaagaggtgatgcgaagccggtggtcgcgtaagatgctcatgacaggaaccctggccgttttcctactgctcattatgggccagctgacatggaacgaccttactagattgtgcatcatggtgggggctaatgcctccgataggatgggaatgggcaccacgtatctggcattaatggctacatttaaaatgcgccctatgttcgccgtcggtctcctgtttcggagacttacctctagggaggtgctgctactcactatcgggctgagcttggttgcatcagtggaactgccaaacagtttagaggaactcggagacggcctggccatgggcattatgatgcttaagctgttgaccgagttccaaccccaccagctctggacaactctgctatccctgacctttgtcaaaacgacactttctctcgattacgcttggaagaccactgcgatggtactgagcatcgtgtccttgttcccgctgtgtttatcaacaaccagccagaaaactacatggctccctgttctgcttgggagttttggatgcaagccactgaccatgttcttgattacggaaaacaagatatggggtcgaaaatcttggcccctcaatgagggcatcatggccattgggatcgtgtccattctgctaagctcgctgcttaagaacgacgtccctctcgcaggacccctgatcgctggcggtatgttgatagcctgttatgtgatctcagggtctagtgccgatttatccctggagaaagctgcagaagtaagctgggagcaggaagccgagcattctggagcgagccacaatattctcgtggaagtccaagacgatggcactatgaagatcaaagacgaggagcgcgatgacaccctgacaattcttctgaaggctaccttgctagccgtttccggcgtgtacccaatgtcaatccctgcaacactgtttgtgtggtatttctggcagaaaaagaagcagcggagtggggtcctctgggatactcccagcccaccggaagtggagagagccgttctggacgatggaatatacaggattcttcagcgtggtttactgggccgctctcaagtaggggtgggagtcttccaggacggcgtgtttcataccatgtggcacgttacgcggggtgctgtgctcatgtatcaggggaaaagattggaaccttcctgggcatcagtcaagaaagacctgatcagttacggaggcggctggaggttccaggggagctggaacacaggagaggaggtgcaagtaatcgccgtcgaacccggtaagaatccaaaaaacgtgcagactacccccggcacatttaagacccctgagggggaagttggagcgattgctctcgatttcaagccaggcacttccggttctcccatagtgaatcgagaggggaaaatcgtcggactgtacggcaacggcgtggttaccacatcggggacgtatgtgagcgccattgcacaggccaaggcttcacaagaaggacctcttccggagatcgaggacgaagtctttaaaaagcggaatctgactattatggatttgcacccaggttccggcaaaacccgcagatacctacccgccatcgtgagggaggcaataaagcggaagctgcgaacactcatcttagctcctaccagagtagtggccagtgaaatggcggaggccctgaaagggatgccaattcgctatcagactacagcagttaagtctgaacataccggaagggagatcgtcgaccttatgtgccacgctacgttcactatgcgtctgctcagccccgtgcgggtgcctaactacaatatgattatcatggatgaggcccattttacagacccggcttccatagcagccagaggctatatttcaaccagggtcggtatgggggaagccgctgcgatcttcatgaccgcaactcccccaggatctgtagaggcctttcctcagagcaacgctgtgatccaggatgaagagcgcgacattcccgaacgaagttggaattccggctacgattggatcacagacttcccaggcaaaaccgtttggtttgtgcctagcataaagtctgggaacgatattgccaattgtttgagaaaaaacggaaagcgggtcatccaactgtcaaggaagacattcgacactgagtatcagaaaacgaagaacaatgactgggattacgtggttaccacagacatttccgagatgggtgcaaacttccgcgccgatcgtgtgatcgaccccagacggtgcctcaaaccagtcatactgaaggatggcccggaaagggtgattcttgctgggcctatgcccgtaactgtggcgagtgccgcacagcgccgaggaagaatcggccggaatcagaacaaagagggtgaccaatacgtttatatggggcagccactaaataacgatgaagaccacgctcattggaccgaggccaagatgctgttggataatatcaacacacccgagggcattatccctgcattatttgaaccagagagggaaaagagcgccgctgtcgacggagagtaccgcctgagaggcgaagccaggaaaaccttcgtggagctcatgcggcgtggggatctgcccgtgtggctttcgtataaggtcgcgtctgagggatttcagtactccgaccgccgatggtgcttcgatggtgaaagaaataaccaggttctggaggaaaatatggacgtggagatttggactaaagaaggcgagaggaagaaactccggcctcgctggttggacgcaagaacgtatagcgatccgctggccctaagggagtttaaggaattcgctgccgggcggcgatcagtaagtggagacctgatactcgagatcggcaaacttccacaacacctgaccttaagagctcagaacgcattggataatctggtgatgctccacaactctgaacagggtgggaaggcctaccgccatgctatggaggaactgcccgacacaattgagactcttatgctgctcgccttgatcgcagtcctgaccggcggagtgacattatttttcctatccggcaaggggctgggaaaaaccagcatcggtctcctttgtgttactgcgtcaagtgccctgttgtggatggctagcgtggagcctcactggattgccgcatccataatcctggaatttttcctcatggtcctgcttattcccgagccagataggcagcggacacctcaagacaatcagctcgcttatgtagtgatcggcctgttgtttatgattctgacggttgccgcaaacgaaatggggttactagagaccactaagaaagatctgggaatcggctacgtggccgctgagaaccatcagcacgcgacaatgctcgacgtcgatcttcgtcccgcctctgcatggaccctgtacgctgtggccaccacagtcataactccaatgatgagacacacgatcgaaaataccacagccaacattagcttgactgcaatcgctaatcaagccgcgattctgatgggtctcgacaaggggtggcctatctccaaaatggatataggcgtgccgctgcttgctttaggatgctattcacaggttaaccccctgaccctcacagccgcagtgttgatgctggtagcccattacgctattatcggcccagggctacaggcaaaggccaccagggaggcgcagaagcgcactgctgccggaattatgaaaaatcctacggtggacggcatcgtcgcaatagatctggaccccgttgtgtatgacgccaagttcgaaaaacaactcggtcagatcatgcttctgattttgtgtacatctcagatcctgctcatgcggaccacttgggctctgtgcgagagtattaccttagccacagggccacttactaccctgtgggaaggatcgcctggcaagttttggaacacaacgatcgcagtcagcatggctaatatattccgaggttcctacctcgccggcgcggggctagccttctctctgatgaaatcattgggaggcgggagaaggggaaccggcgcacagggtgagactctgggggagaagtggaagcgccaactcaaccagcttagcaaatccgaatttaatacatataagcggagtggaattatggaggtggatagatctgaagctaaagagggcctgaagcgtggtgaaaccactaaacacgccgtaagcaggggcacagcaaagttgcggtggttcgtggagcgcaacctggttaagcccgaggggaaagtgatcgacctcggatgtggccgagggggatggtcatactattgcgctggcttaaagaaagtcaccgaagtgaagggttacacgaaagggggaccgggccatgaggaaccaatccctatggccacctacggctggaatctggtcaagcttcactccgggaaagatgtgtttttcatgcccccagagaagtgtgacacactgctatgcgatattggagaaagtagccccaaccctactatcgaggagggtagaaccctcagggttctgaagatggtagaaccgtggttgcggggcaatcagttttgtataaaaattctgaacccctatatgccatctgtggtcgagacactcgaacagatgcaacgcaagcatgggggaatgcttgtgagaaatcctctgtccaggaactcaactcacgagatgtactgggttagctgcggcaccggtaatatcgtgtcggccgtcaacatgacatctcgaatgttactgaaccggttcaccatggcgcaccgtaaacccacttatgagagagacgtggatttgggggctggaacgcgccatgtagcagtggaacctgaggttgccaatctcgacattatcggccagaggatagaaaacatcaagaatgagcacaaaagtacatggcattacgatgaagacaacccatataagacctgggcttaccacggctcctatgaggtcaagcccagcgggtcagcctcctctatggtgaatggagtggtccggctgctaactaaaccttgggatgttattccaatggtgacccagatcgcaatgacagacacgaccccctttggtcaacagagagtattcaaggagaaagtggacactcgcacaccgagggccaagcgaggcaccactcagattatggaagtcacagctaaatggctttgggggtttctgagccggaacaagaagcctagaatctgtaccagggaggaattcacacgcaaagtgcgtagtaatgcggccattggagcagtttttgtggatgagaaccagtggaattccgctaaggaagccgtcgaggacgagcggttctgggatctcgtgcacagagaaagggagctgcataaacaaggcaagtgcgcaacttgcgtatacaacatgatgggtaaacgcgaaaagaagttgggggagtttggaaaagccaagggcagccgagctatctggtacatgtggctgggcgcccggttcctcgaattcgaggcgcttgggtttatgaatgaggaccactggttctctagagaaaactcactgagtggagttgagggtgaaggcttacataaactggggtatatattgagggatatttccaagatcccaggaggcaatatgtacgcagacgataccgccggttgggacacgcgcatcaccgaggatgacctccagaacgaggctaaaattacagatataatggaacccgagcacgccctgctagcaactagcatctttaagcttacctatcagaataaagtggtcagagtgcagcggcctgctaagaacgggacagtgatggacgtcatttctaggcgtgatcaacgaggatcgggccaggttggcacttacgggctgaacaccttcacgaatatggaagtgcagctcatccgccagatggagtcagaaggaatttttctgccaagcgagttggagacacccaacttagccgaaagagtactggactggctcgagaagcatggtgctgaacggcttaaaaggatggccatctccggcgacgattgtgtggtcaagccgatagacgatcgcttcgcaaccgcgctgactgccctaaatgacatggggaaagtgagaaaggatatccctcaatgggagcccagtaaaggatggaacgactggcagcaggttccattttgctctcaccacttccatcagctgattatgaaggatggccgggaaatcgtggtcccttgtaggaatcaagacgagctcgtgggtcgagctcgtgtaagccagggggccggatggtccttgagagagacagcatgcctgggcaagtcatatgctcagatgtggcaacttatgtactttcaccgccgggatctgaggctcgccgcaaacgccatttgtagtgcggttcccgtggaatgggtcccaacctctagaactacctggagcatccatgctcaccaccagtggatgacaacggaggacatgttatccgtgtggaatcgcgtttggatagaagagaacccctggatggaagataaaacccatgtgtcaagctgggaggaggtcccttatctgggcaagcgggaagaccagtggtgcgggtctttgattggactgactgccagggcaacatgggccaccaatatccaggtggctatcaaccaagtacgaagactcattggtaatgagaactaccttgactacatgacttccatgaaacggttcaagaatgaaagtgatccagagggcgccctgtggtga

SEQ ID NO: 13251 - RNA, 9879 nt, synthetic construct
  misc_feature 1..9879: note = derived and/or modified CDS sequence (opt3) from DENV-1__KR028435__SS-prME
  source 1..9879: mol_type = other RNA
agcgtgaccatgctgctcatgcttatgcccacagcactggctttccacttgactacgcgaggaggggaacctcatatgatcgtctccaagcaggaaaggggaaaatctttactgtttaagacctcagccggtgttaacatgtgcacactaattgccatggacctcggcgaactgtgtgaagatactatgacctacaaatgcccacggattacagaagcggaaccggacgatgtggactgttggtgcaatgctaccgatacttgggtaacatatgggacctgtagtcaaacgggagagcaccgccgagacaagcgtagcgtggcccttgcaccccatgtcggcctgggtttggagactagaaccgaaacatggatgtcctctgagggggcctggaaacagatccagagggtggaaacttgggctctccggcaccctggattcaccgttattgcactgtttctggcccatgctatcggcacatcgattacccagaagggcatcatattcatcctcttaatgctggtgacgccatcaatggccatgcgctgcgtcgggattggaagcagggattttgtggagggtcttagtggcgcgacttgggtagacgttgtgttggagcacgggtcctgtgtcacaaccatggcaaaggataaacccactctggacatcgaactactcaagacagaggtgaccaaccctgccgtgctgaggaaactttgcattgaagctaagatctctaatacgaccacagatagccggtgtccaactcaaggagaggccaccctggtcgaagaacaggacgcaaacttcgtttgccgccgaacatttgtggataggggctggggtaatgggtgtggattgttcggcaaaggctccctcataacttgcgctaagtttaagtgcgtaaccaaactggaggggaagattgtgcagtacgaaaacttaaaatattcagtcatcgtgacagttcacaccggagaccagcatcaagtgggtaatgagagtactgaacacggcacgacagccaccattactccccaggcgcctaccacagagatccagctgaccgactacggggccctcactcttgattgtagcccaaggacaggactggacttcaacgaaatggtcttgctaacgatgaaggagaaatcttggctggtgcataagcagtggtttctcgatctgccgcttccctggacctccggcgcatcaactagccaagagacatggaatcggcaggacctgttggtaaccttcaaaacagctcacgccaagaagcaggaagttgtggtcctcggtagtcaagagggggctatgcacactgccctgaccggcgcaacggaaatccagacctctggaacaactaccatttttgccggccatttaaaatgccgtctgaagatggataaactaacactcaaggggatgtcctatgtgatatgtactggtagcttcaaactggagaaggaagtcgctgagacccagcacggaacggtgcttgttcagatcaagtacgagggcacagacgcgccttgcaaaattccattctcgacccaagatgaaaagggggtgactcagaacggacgcttgatcacagcaaatcccatagtaaccgacaaagagaagcctgtcaacattgaagccgagccaccctttggcgagtcttatatcgtgatcggtgctggggaaaaagccctgaagctctcctggttcaagaaaggctcaagtattggaaagatgtttgaggcaactgccagaggcgctaggcggatggccatcctgggggataccgcatgggacttcggaagcattggtggcgtttttacatccgtggggaaacttgtccatcagatattcggaacggcgtacggcgtgctgttttctggtgtaagctggaccatgaagatcgggattggcgtgttgctcacttggctgggattaaattcacgaagtacatccctgagcatgacctgtatcgctgttggcctagtcacactctacctgggggtgatggtgcaggccgattctggatgcgtcatcaactggaaaggccgcgaacttaagtgtggttcagggattttcgttactaatgaggtgcacacctggacggaacaatataagtttcaggcagacagtccgaaaagattgagcgccgctataggaaaggcctgggaggagggcgtgtgcggtatcaggtccgcaacacggctggaaaacattatgtggaaacagatctctaacgagctcaatcatattctgttagaaaacgacatgaagttcaccgtagtcgtgggcgatgttgctgggatcctggcccagggcaagaagatgatacgccctcaacccatggagcacaaatactcgtggaaaagctggggcaaggcgaaaatcattggggccgacgtgcagaatactacctttatcattgatggaccaaacacacctgaatgtcccgacgatcagagagcttggaatatctgggaggtcgaggactatggcttcggtatatttactaccaacatttggcttaagttgagggattcctacacacaggtgtgcgaccaccgtctcatgtcagcagccatcaaagatagtaaggctgttcatgccgacatggggtattggattgaatctgagaaaaatgaaacgtggaagctggcacgggcgagcttcatcgaggtgaagacctgtatatggccaaaatcccacactctatggtcaaacggagtactggaaagcgagatgatcattcccaagatctacggcggtcctatttctcaacataattatcgaccaggctacttcacacagaccgccgggccgtggcacctcggaaaactggagcttgattttgacttgtgcgaaggcactacagtcgtggtggatgagcactgcgggaacagaggaccctccctgaggaccacgactgtcaccggcaagatcatacatgaatggtgttgccgcagttgtacattacctccactccggttcagaggtgaggacgggtgctggtacggaatggagattaggcccgttaaagaaaaggaggaaaatctggtgaagtccatggtatctgctggctccggtgaggtggactcatttagtcttggcctgttgtgtatcagcatcatgattgaagaggtcatgcgctcgcgatggtcccggaaaatgctcatgaccgggactctggccgtgttctttctactgatcatgggacagctcacatggaacgatctgattcgtctttgcataatggttggcgcaaatgcttctgacagaatggggatgggaaccacatatttggccctgatggcaactttcaagatgaggcctatgtttgccgtgggcttactcttccgccggctgaccagcagagaggtccttctgctaacgatcggtctctcactggtggctagtgttgaattgccaaactccctggaggaattaggggatggactcgcgatgggcattatgatcctgaaacttctgacagactttcaatctcaccagttgtgggccaccctcctgagcctaactttcattaagaccacattttccctgcattacgcatggaaaactatggctatggtgctttcaatcgtcagcctcttccccctgtgtttgagtaccacgtctcagaagacaacctggctgccggtattactcggctccctggggtgcaagcctcttactatgtttctgatagccgagaataaaatctggggaagaaagagctggccattgaacgaaggtattatggccgtgggcatcgtttcgattctcctgtcatctctactgaaaaacgatgtgccccttgctgggcctctcatcgcaggaggcatgctgatagcctgttatgtcattagtggttccagcgcggacttgtctttagagaaggctgccgaggtgagctgggaagaggaagcagagcactccggggcctcacataatatcctggtagaagtgcaggatgacggaacaatgaaaatcaaggatgaggagcgagacgataccctcactattctgcttaaagctacactgttggcaataagtggcgtctaccccctaagcatcccagccaccctgttcgtttggtatttctggcaaaagaagaaacagcgctctggcgtgctctgggacacgccttcacccccagaagtggagcgggcggtcctggatgacgggatttacagaatcatgcagaggggacttttaggtcgtagccaggtgggcgttggggtatttcaagaaaacgtgttccacactatgtggcacgtcacccgcggagctgtgctgatgtatcagggcaagcggctcgagccgagttgggccagcgttaaaaaggacttgatttcctacggtgggggatggagactgcagggctcttggaatacaggcgaggaagtgcaggtcatcgcagtggagcctgggaaaaaccccaagaatgtacaaaccgccccaggaacatttaagactcccgaaggtgaggtcggcgctatagccctcgatttcaaacctgggacctcgggaagcccaatcgtgaacagggaaggcaagattgttggtctgtacgggaatggagtggtcacgacatcaggcacttatgtgtccgcaatcgctcaggccaaagcgagtcaggagggcccccttcctgagattgaagacgaggtttttcgaaagcggaacctgaccatcatggatttgcatccggggtctggaaaaacacgcagatacctaccagccatagtgagggaagcaattaagcggaagctgcgaaccctcatcttagctcccactagagtcgtggccagcgagatggctgaagcactgaaaggtatgcctatccgctatcaaaccacagccgtaaagtccgagcacacgggcaaagagattgtggaccttatgtgccatgccactttcaccatgaggctgctctcaccagttcgtgtccccaattacaacatgatcataatggatgaagctcactttacagacccttctagcattgcggcacgggggtatatcagtaccagagtgggaatgggcgaggccgctgccattttcatgactgcaacaccgcccggttccgtggaagcctttccacagagcaatgctgtcatccaggatgaggaagggggaatatctgagaggtcatggaactccggctacgagtggattaccgacttccctggcaagacggtatggtttgtgcccagtatcaaaagcgggaatgatatcgcgaactgtttgcgcaagaatggaaagcgagttattcagctgtcgagaaaaactttcgacacagaatatcaaaagaccaaaaacaacgattgggactacgtggtcaccactgacatctctgagatgggtgccaatttccgggcagatagggtgattgacccacgccgttgcctcaagcctgttatactgaaagatggccccgaaagagtgatccttgctgggccaatgccggtcacagtggcctccgcagcccagcggaggggacgcattggccgaaaccataataaggagggtgaccagtacatctatatggggcagcctctaaacaatgatgaggaccacgctcactggaccgaagccaagatgctgttggataacatcaatacacccgagggcattataccagcgttatttgaacccgagagagaaaagagcgcagccatcgacggagagtaccggctgaggggcgaggctcgcaagactttcgtagagctcatgagaagaggggatctgcctgtgtggctttcatataaagttgccagtgagggatttcaatactctgaccggcgttggtgcttcgatggtgaacgcaacaatcaggtcctggaggaaaacatggacgtggagatttggacgaaggagggcgaaagaaagaagctcagaccaaggtggttggatgctcggacctattccgaccccctggcactacgcgagtttaaagagttcgccgctgggagaaggagcgtgtcaggagacctgatcctcgagattggcaaacttcctcagcatctgacacagcgggcccaaaatgcattagataacttggtcatgctgcacaatagtgaacagggtgggcgagcgtacagacatgccatggaggagctcccggacactatcgaaaccctgatgcttctggctctcatagccgttttgacaggcggagtgaccctgtttttcttaagcggccgcgggctaggaaagacttccatcggtctgctctgtgtaatggcatctagcgtgcttctgtggatggcttccgtcgagccacactggattgccgcatcaatcattttggaatttttcctgatggtgctcctgatccccgagcctgataggcagcggacgccccaggacaaccaacttgcctatgttgtgataggcctcctgtttatgattttgaccgtcgctgcgaatgagatggggctgttagaaacaactaaaaaggatctaggaatcggccacgtagccgtggagaaccatcaccatgcaaccatgctggacgttgatctccacccagcttctgcctggacactttacgccgtggcaaccactattatcacacctatgatgcgtcatacgatagaaaacaccactgctaatatcagtctgacagccattgcgaaccaggctgccatcttgatgggtctggacaaagggtggcccatttcgaagatggatatcggcgtcccactcctggcacttggatgctacagccaggtgaatcctttaaccctgaccgccgctgtcctcatgttggtggcacactatgccataattggcccggggctgcaagcgaaagctacaagagaggcccagaagaggactgcagccggaatcatgaagaaccccacggttgacggcatcgtggctattgatctagacccagtagtgtacgatgccaaattcgaaaagcagctgggtcagatcatgctccttatactgtgtacctcccaaattttgctgatgcgcacaacttgggcactctgcgagtctatcaccctggctacagggcctttaaccactctttgggagggatcacccggcaaattttggaatacgacaattgccgtcagcatggcgaacatcttccggggttcctatctggccggcgcagggctcgctttcagtctaatgaagtctctgggaggcgggcgaagaggaaccggcgcccagggtgaaactttgggggagaaatggaagaggcagctgaatcagctcagcaagtcagaatttaacacctacaaacgctccggaataatggaggttgaccggagtgaagcaaaggagggccttaaaagaggtgagacaactaagcacgctgtgagccgtggcaccgccaaactgaggtggttcgtcgaacggaatttggtgaagccagaggggaaggtaatcgacctgggatgtggccgcgggggatggtcttattactgcgccggcctcaaaaaggtgacagaagttaaaggttatacgaaagggggacctggccatgaggaacccattccgatggcgacctacggctggaacttagtgaaactgtactccgggaaggatgtctttttcatcccacctgagaaatgtgacactcttctgtgcgatattggagagtcaagccccaatccaacaatcgaagagggtcgaaccctaagagtgctcaagatggtcgaaccctggctgaggggcaaccaattttgtattaagatcttgaatccttatatgccgtcggtggttgagactctggagcagatgcagcggaaacacgggggaatgctcgtacgcaaccccctttctagaaatagtacacatgaaatgtactgggtgtcctgcggcaccggtaacatagtcagcgctgtgaatatgacgtcaaggatgctgttaaaccgattcaccatggcacaccggaagccaacatatgagcgtgacgttgatctgggggccggaactagacacgtggctgtcgaacctgaggtggccaacttggacattatcggccagcgcatcgaaaatattaaacatgagcacaagtccacctggcattacgatgaggacaacccctataaaacatgggcataccacggctcttatgaagtaaagcctagcgggagtgcctccagcatggtgaatggagttgtcaagctcctgactaaaccatgggatgtgatacccatggtgacccaaatcgctatgacagacaccactccttttggtcagcagagggtcttcaaggagaaagttgatacgcggacaccaaaggcgaaaagaggcaccgcccaaattatggaagtgactgcacgctggctatgggggtttctttctaggaacaagaagccccgaatctgtacccgggaggagttcacaagaaaagtaaggtcaaatgctgccattggagcagtgtttatcgacgagaaccagtggaatagtgccaaggaggctgtcgaagacgagcgcttctgggatctggtgcatcgtgaacgggagctccacaaacagggcaagtgcgccacgtgcgtttacaacatgatgggtaaaagagaaaagaagctgggggagtttggaaaagcgaagggctccagggcaatatggtacatgtggttgggcgcccgcttcctggagttcgaagctctcgggtttatgaatgaggaccactggttcagccgagaaaactctctttcgggagtggagggtgagggcctgcataaattagggtatatcctgcgggatatttcaaagatcccgggaggcaatatgtacgccgacgataccgcaggttgggacactagaattacagaagatgacttgcagaacgaggctaaaatcaccgatataatggaacctgagcacgccctcctggctaaggccatttttaaactaacttatcaaaataaggtcgtgagggtacagcgcccagcaaagaacgggacagttatggacgtgatcagcagacgggatcagaggggatccggccaggtcggcacctacgggcttaatacattcactaacatggaagcgcaactgatccgtcagatggagagtgagggaatattttctcccagcgaactcgagacccctaacctggccgaacgagtgttggactggttagagaaatatggtgtggaacgcctgaagagaatggctatatccggcgatgactgtgtcgttaaaccaatcgacgatcggttcgccacggcactcaccgctcttaatgacatggggaaggtgaggaaagatattccccagtgggagccgtcaaagggatggaacgactggcagcaagtacctttttgcagtcatcacttccaccagctgatcatgaaggatggccgcgagattgtggtcccctgtagaaatcaggacgagctagtgggtcgggccagggtttctcagggggcaggatggagcctgcgagagacagcctgcctcggcaaatcctacgcgcaaatgtggcagttgatgtattttcatcgtagagatctgcgccttgctgccaacgcaatctgttcagccgtgccagtcgactgggtgcctactagccggaccacatggtctatacacgctcatcaccagtggatgactaccgaagatatgctgtccgtatggaatagggtttggatcgaggaaaacccctggatggaggacaagacgcatattagtagctgggaggatgtgccatacctcggcaaaagagaagaccaatggtgcgggtcgttaatcggactgacagcccgcgcaacctgggctactaatattcaggtcgccatcaaccaggtgcggaggttgattggtaatgagaactacctggactatatgacatccatgaagcgattcaaaaatgaatctgatcccgagggcgcgctctggtga

SEQ ID NO: 13252 - RNA, 9879 nt, synthetic construct
  misc_feature 1..9879: note = derived and/or modified CDS sequence (opt3) from DENV-1__JQ922548__SS-prME
  source 1..9879: mol_type = other RNA
agcgtgaccatgctgctcatgcttctgcccacagccttggctttccacttaactacgagaggcggggagcctcatatgatcgtctccaagcaggaaaggggaaaatctctgctatttaagacctcagcaggtgttaacatgtgcacactcattgccatggacctgggcgagctttgtgaagatactatgacctacaaatgcccacggataacagaggcggaaccggacgatgtggactgttggtgcaatgctaccgatacttgggtaacatatgggacctgtagtcaaacgggagagcaccgccgagacaagcgtagcgtggccctggcaccccatgtcggcttgggtctcgagactagaaccgaaacatggatgtcctctgagggggcctggaggcagatccagaaagtggaaacttgggctctgcggcaccctggattcaccgttattgcactgtttctcgcccatacaatcggcacctcgattacgcagaagggcatcatattcatcttactgatgcttgtgactccatcaatggctatgcgctgcgtcgggattggaaacagagattttgtggagggtttgagcggcgccacatgggtagacgttgtgctggagcacgggagttgtgtcaccactatggcgaggaataagcccacactagatatcgaactcctgaaaaccgaggtgacgaaccctgcagtgcttcggaagctgtgcattgaagccaaaatctccaataccacaactgactctcgctgtccaacccaaggagaggctacattggtcgaagagcaggatgccaacttcgtttgccgaagaacttttgtggacaggggctggggtaatgggtgtggactcttcggcaagggcagcctgttaacctgcgcaaaatttaagtgcgtaacaaagctggaggggaaaatagtgcagtacgaaaacctcaagtattccgtcattgtgaccgttcacactggagatcagcatcaagtgggtaatgagacgacagaacacggcaccatcgctactattaccccccaggcccctatgtcagagatccagcttacagactacggggcgctgaccttggactgtagtccacggactggactagatttcaacgaaatggtcctgctcacaatgaaagagaagagctggctggtgcataaacagtggtttcttgacctgccgttgccctggacgtctggcgcctccacctcacaagagacttggaatcgtcaggatctcctggtaacattcaagaccgcacaggctaaaaagcaagaagttgtggtcttaggtagccaggagggggccatgcacacagctctgactggcgccaccgaaatccagacgagtggaaccacaactatgtttgcaggccacctaaagtgccgcctcaaaatggacaagctgacccttaaaggggcctcttatgtgatgtgtacaggacctttcaagttggagaaagaagtcgctgagactcagcatggtaccgtgctggttcaagtgaagtacgagggcacggatgcgccatgcaagattcccttctccacacaggacgaaaaaggggtaacccagaacggaagactcataactgcaaatcctatcgtcacagataaggagaaaccagtgaacattgaaaccgagcccccgtttggcgagagctatatcgttataggtgccggggaaaaggctctgaaactttcgtggttcaagaagggctcttccattggaaaaatgtttgaggccactgcaaggggcgcccggcgaatggctatcctgggggacaccgcctgggatttcggatcaatcggtggcgcatttacaagtgtggggaagttggtccaccaggtgttcggaacggcgtacggcgtactctttagcggtgtgtcctggaccatgaaaattgggatcggcattctgttaacttggctgggactaaattctcgcagcacatcactcagtatgacctgtatagctgttggcatggtcacactgtaccttggggtgatggtgcaagccgactccggatgcgtcatcaactggaagggcagagaattgaaatgtggtagcgggattttcgttactaacgaggtgcatacctggacggaacagtataagtttcaggcagattctcctaagaggctgtcagccgctatcggaaaagcctgggaggagggcgtgtgcggtatccggagtgcaacacgcctcgaaaatattatgtggaagcagataagcaacgagctgaatcacatcttactggaaaacgacatgaaattcaccgtagtcgtgggcgacgctaatgggattcttactcaaggaaagaaaatgatcagaccccagccaatggagcataagtactcctggaaatcttggggcaaggccaagattatcggggcggatgcccagaacaccacatttataatcgacggacctgatactcccgaatgtccagacgatcagagggcttggaatatttgggaggttgaggactatggcttcggtatctttaccacaaacatttggttgaaactccgtgattcgtacacgcaaatgtgcgaccaccggctgatgagcgcagccatcaaggattccaaagctgtgcacgccgacatggggtattggatagaatcagagaagaatgaaacctggaaactaactcgagcaagtttcattgaggtcaagacatgtacctggcccagatctcatactctgtggagcaacggagtgctcgaatccgagatgatcattcctaagatctacggcggtccaatatcacagcacaattataggccgggctacttcacacagaccgcggggccctggcatctgggaaaacttgagttggattttaacctgtgcgaaggcacgactgttgtggtagacgagcactgcgggaatggaggcgccagcttaggtaccacaaccgtcactgggaagatcattcacgaatggtgttgccgctcttgtacactccctccactgcggttccttggagaggatggctgctggtacggtatggagatcagacccgtgaaagaaaaggaggaaaacctgtttaggtccatggtgagtgctggcagcggggaggtcgactctttctccttgggactcctgtgtgtttcaattatgatcgaagaggtgatgcgcagtcgatggagccggaaaatgctaatgaccggcacactggccgtatttttcctcctgataatggggcaacttacttggaatgacttgattcgtctgtgcatcatggtgggagcaaacgcttcggatagaatcggcatgggtaccacgtatttagccctcatggcaacatttaagatgaggcctatgttcgccgtcgggctgctttttcgccggctgacctccagagaggtgctactcctgactattggattgtctctggttgctagcgtggaattaccaaactcactcgaggaactgggcgacggccttgcgatggggatcatgatgctgaagttgctcaccgatttccagagtcatcagctgtggacaactctactgtcccttacctttattaaaacgacactctctctggactacgcctggaagaccatagcaatggtcttgagcatcgtgtccctgttccccttatgtctctcaactacaagccagaaaaccacttggctgccggttcttctgggaagttttggttctaagcctttgacaatgttcctcattaccgagaataaaatctggggcaggaagtcctggccactgaacgaagggattatggctgtgggaatcgtcagcatactactgtcgtcacttcccaagaatgatgtacctctcgccggccccctgatcgccggtgggatgttgattgcttgctatgtgatctctggaagttccgcagacttaagcctggagcgagccgcggaggtttcttgggaagaggaagctgagcacagcggcgcctcccataacattctcgtggaagtccaagatgacggcaatatgaaaatcaaggatgaggagcgcgacgattcactgacgatacttctgaaagcaactttgctagccgtgagtggggtatacccaatgagcattcctgctaccctgttcgtgtggtatttttggcagaagaaaaagcagcggtctggagtcctctgggacacaccctccccaccggaagttgtgagagcagtgctggatgacggtatctacaggatccttcagcgtggcttactggggcgctcacaagtcggagtgggcgttttccaggacggtgtatttcacaccatgtggcatgtgacacggggggccgtcctcatgtatcagggaaaaagattggagcctagttgggcgagcgtgaagaaggatctgatttcctacggcggcgggtggaggttccagggatcttggaacactggtgaagaggttcaagtgatagctgtcgagcccggcaaaaatccaaagaacgtgcagaccacgcccgggacatttaaaactcctgaaggagaggtaggcgccatcgcactcgacttcaagccaggtacctcggggagccccattgtcaatcgagaaggaaaaatcgtgggcctgtacggcaacggggttgtgacaacctcaggaacttatgtctccgccattgctcaggccaaggcaagtcaagagggtcctcttccggaaatcgaggatgaggtgtttaagaaacggaatctgaccataatggacttgcacccaggctctgggaagacacgcagatacctacccgctatcgttagggaagccattaaacggaagctgcgaacgctcatcttagcgcctactagagtggtcgccagcgagatggcagaagctctgaaaggaatgccaattcgctatcagaccacagccgtgaagtccgagcacaccggcagggaaatcgtagatcttatgtgtcatgctaacttcactatgcgtctgctctcacccgtgcgggttcctaattacaacatgataattatggacgaggcacactttacagatccggcctctatcgccgctagaggttatatcagcaccagggtcgggatgggagaggcggcagccattttcatgacggctactcccccaggcagtgtggaagcctttcctcagtccaatgcagtgatccaggacgaggaacgcgatatacccgagcgaagctggaactctggctacgactggattacagatttcccagggaagaccgtctggttcgtaccttcaatcaaatccggaaacgacattgccaattgcttgagaaagaacggtaaacgggtgatccaactgagtaggaagacctttgacactgaatatcagaaaacaaagaataacgattgggactacgttgtgaccacagatataagcgagatgggcgctaattcgcgcactgaccgtgtcattgatcccagacggtgtctcaagccagtgatcctgaaagacgggccggagagggttatccttgcgggacctatgcccgtgacggccgcatctgctgcccagcgccgaggcagaattggtcggaaccagaataaggaaggggatcaatacatctatatgggccagccactaaacaatgacgaggatcatgcacactggaccgaagccaaaatgctgttggacaacattaatacacccgagggaataatccctgctttattcgagccagaaagggagaagtccgccgcgattgatggcgaataccgcctgagaggggaggcaaggaaaacttttgtcgaactcatgcggcgtggagacctgcccgtgtggcttagctataaggtagcctcagagggtttccagtacagtgatcgccgatggtgctttgacggcgagagaaacaatcaggtgctggaagagaacatggacgttgaaatctggaccaaggagggggaaaggaaaaagctccggcctcgctggttggatgctagaacatattctgacccgctggccctaagggagttcaaagagtttgctgcaggacggcgatccgtcagcggcgatctgatcctcgaaattggtaagcttccacaacatctgaccttaagagcccagaatgctttggacaacctggtgatgctccacaactcagagcaggggggcaaagcctaccgccacgcaatggaagagctgcccgatactatagaaacgcttatgctgctcgcgttgatcgccgtgctgaccggaggcgtcacattattctttctaagtgggaagggactgggtaaaactagcattggcctcctttgcgttatggcttcctctgtgctgttgtggatggccagcgtagagcctcattggatcgcagcttccattatcctggagttctttctcaaggaactgcttatacccgacgccgatgggcagaggaccccacaagacaatcagctcgcatatgtggtcatcggactgttgttcatgattctgacagtggccgctaacgagatgggcttactagaaaccactaagaaaaatctgggtatcgggcacgttgtggcggagaaccatcaccacgccacaatgctcgatattgaccttcatcctgcatcagcttggacgctgtacgccgtcgccaccactatcataacacccatgatgcggcacaccattgagaataccacagcaaacatctctttgactgctattgccaatcaggcggctatcctgatgggcctcgataagggacgtccaataagtaaaatggacatcggcgtacctctgcttgccttagggtgttactcgcaagtgaacccgctgacgctcaccgcagccgttttgatgctggtggctcattatgcaattatcggacccggcctacaggccaaggcgacaagagaagctcagaaaaggactgccgcaggtctgatgaagaatccaaccgtcgatgggattgccgctatcgacctcgaccctgtggtctacgatgccaagtttgagaaacagcttggacaaataatgctgttgattctgtgcacaagccagatcctcctgatgcgcaccacttgggcattatgtgaatccatcacgcttgctacaggccccctgaccactctctgggagggttctccaggcaagttctggaacaccacaattgccgtgtcaatggcgaatatcttccgggggagctatctagccggagcaggcctggctttttccttgatgaaaagtctggggggaggccgaagaggtactggggcccagggagaaaccctcggcgagaagtggaaaaggcagcttaaccaactgtctaagagcgagttcaatacatacaagcgctcaggtataatggaagttgaccggtccgaggcaaaagaaggcttgaagagaggggagacgaccaaacacgctgtgagtcgtggaactgccaagctgaggtggtttgtagaacggaacctcgtgaaacctgagggcaaggtcattgatttagggtgcggacgcggcggttggagctattactgtgccgggctgaagaaagttacagaggtgaagggatataccaaaggcggccccgggcatgaagagccgatcccaatggcgacttacggatggaatcttgtcaagctgcactctggtaaagacgtgttctttacacctcccgaaaagtgcgataccctactctgtgacattggcgagtcctcaccaaaccccacgatcgaagaggggcgaaccctgagagtattgaaaatggtggagccttggctgaggggaaatcagttctgcataaagatcctcaacccgtacatgcccagcgttgtggaaacacttgagcagatgcagcggaagcacggcggtatgctggtccgcaacccattatcgagaaattctactcatgaaatgtattgggtgagttgtgctaccgggaacattgtctccgcagtgaatatgacaagcaggatgctgttgaaccgatttactatggcccaccggaaacctacctacgagcgtgatgttgacctcggagctggcacaagacatgtagccgtggagcccgaaatcgcaaatctggatattatcggccaacgcattgagaacatcaagaatgaacacaaatcaacctggcactatgacgaggataacccttacaagacttgggcctatcatgggacgtacgaagtcaaaccatccggatctgctagcagtatggtgaatggtgttgtgaggctacttacaaagccctgggacgtcatacctatggtgacccagattgcgatgactgacaccacaccattcggccagcaacgggtatttaaggagaaagtggatacgagaaccccccgcccgaagagggggactgcccagatcatggaggttacagcacgatggctgtggggattcctctcccggaacaaaaagcctagaatctgcaccagggaagagtttactcgcaaagtccgtagcaatgctgccattggcgcagtgttcgtggacgaaaaccagtggaattctgccaaggaggctgtcgaagatgagcggttttgggacctggttcacagagagagggaattgcataagcagggtaaatgtgccacatgcgtgtataacatgatggggaagcgcgagaaaaagctgggagaattcggcaaagcgaagggctcacgagcaatatggtacatgtggctcggggcccggttccttgagtttgaagctctgggattcatgaatgaggatcactggtttagtagagagaactccttaagcggtgtagaaggcgaggggctgcataagttgggatacatcctcagggacatttctaaaatcccaggcggtaacatgtatgccgatgacaccgcagggtgggatacacgcattactgaagacgatctgcaaaatgaggctaagatcaccgacataatggagcccgaacacgccctacttgctacgtcgatcttcaaactgacctaccagaacaaggtggtcagagtgcagcggcctgccaaatcaggaacagttatggatgtgattagcaggcgtgaccagcgaggctccggccaagtcgggacttatggactcaatacctttacaaacatggaggtgcagctgatccgccagatggaaagtgagggtattttctctccaagcgaattggagaattccaacttagcagagagagcgctggactggctcgaaaagcacggcgtagagcggcttaaaaggatggccatctcaggggatgactgcgttgtgaagcccactgatgaccgctttgctaccgccctgacggcactaaatgatatgggaaaggtcagaaaagacataccgcagtgtgaacctagtaagggctggaacgattggcaacaggtgcccttctgctctcatcactttcatcagctgattatgaaagacggtcgggagatcgtggtcccatgtaggaatcaggatgaactcgttgggcgagctcgtgtgagccaaggagccggctggtccttgagagagacagcatgcctgggcaagtcatacgcccagatgtggcagcttatgtatttccaccgccgggacctgaggctcgcggctaacgccatctgtagcgcagtacctgtgaattgggtccccacctctagaactacatggtccattcacgcccatcaccaatggatgaccactgaggatatgttaagtgtgtggaaccgcgtttggatagaagagaatccatggatggaagacaaaacccatgtgagctcgtgggctgacgtcccctacctggggaagcgggaggatcagtggtgcggatccttgatcggtctggccgcaagggctacatgggccacgaacattcaggtggcgctcaatcaggtacgaagacttatcggcaacgaaaactatctggactacatgacctctatgaagcggtttaaaaatgagtcagatcctgagggggctctatggtga

SEQ ID NO: 13253 - RNA, 9879 nt, synthetic construct
  misc_feature 1..9879: note = derived and/or modified CDS sequence (opt3) from DENV-1__JQ922544__SS-prME
  source 1..9879: mol_type = other RNA
agcgtgaccatgctgctcatgcttctgcccactgccttggctttccacttaactacgcgaggaggggaacctcatatgatcgtctccaagcaggaaaggggtaaatctctgctatttaagacctcagccggtgttaacatgtgcaccctcattgccatggacctgggcgaactttgtgaagatactatgacctacaaatgcccacggataacagaggcggaaccggacgatgtggactgttggtgcaatgctaccgatacttgggtaacatatgggacctgtagtcaaacgggagagcaccgccgagacaagcgtagcgtggccctggcaccccatgtcggcttgggtctcgagactagaaccgaaacatggatgtcctgcgagggggcctggaaacagatccagaaggtggaaatttgggctctgaggcaccctggattcactgttatcgcactgtttctcgcccatgctattggcacctctatcacacagaagggcataatcttcattttactgatgcttgtgaccccatcgatggccatgcggtgtgtcgggatcggaaaccgcgagtttgtggagggtttgtcaggcgcgacgtgggtagatgttgtgctggaacacgggagctgcctacacactatggcacaaaataaacccacactcgacattgagctgcttaagaccgaagtcactaaccctgccgtgctgagaaaattgtgtatcgaggctaagataagtaatacaaccacggattccaggtgcccaacccagggagaagccacactcgtggaggagcaggacgcaaacttcgtctgtcggcgcacttttgttgatcgaggctggggtaatgggtgcggactgttcggcaaaggctctttactgacctgcgctaagtttaagtgtgtgacaaaactcgaagggaagattgtacagtacgagaaccttaaatatagcgtgatcgtcactgtgcataccggagaccaacaccaggttggtaatgaaacaaccactcatggcacgattgccacaatcacaccccaggcgcctacttccgagatccagctgaccgattacggggccttgacactagactgctcaccaagaaccggactggacttcaacgaaatggtgctcctgactatgaaggagaaaagttggcttgtccacaagcaatggtttctggatttgccgctcccctggacaagcggcgcatctacgtcccaggagacctggaataggcaggacctgttagtgactttcaaaacagctcacgccaagaagcaagaagtagttgtgctgggttcacaggagggggctatgcataccgccctaacaggcgcaactgaaattcagaccagcggaacgaccacaatatttgccggccacctcaaatgtcggctgaagatggataaacttactttgaaggggatgagttatgtcatgtgcaccggatctttcaaactggagaaggaagtggctgagacacagcatggtactgtcctcgtgcaagttaagtacgagggcaccgacgcgccttgtaaaatcccattctccacgcaggatgaaaagggggtgacacagaacggacgtctgattaccgcaaatcccatcgtaactgacaaagagaagcctgtcaacatagaagccgagccaccctttggcgagagctatattgtggttggtgctggggaaaaagcccttaagctgtcgtggttcaagaaaggatcttccatcggaaagatgtttgaggcaacagcccgcggcgctagaaggatggccatcttgggggataccgcatgggacttcggatcaattggtggcgtgtttacaagtgtcgggaaactcgtgcaccaggtattcggaaccgcgtacggcgtgctgtttagcggtgtttcctggatcatgaagattgggataggcatcttactgacatggctaggactcaattctcggagcacgtcactgagtatgacctgcattgctgtcggcatggtgactctttacttgggggtgatggtccaagccgattccggatgtgttatcaactggaaaggccgagaactgaagtgcggtagcgggatcttcgtgacaaacgaggtgcatacctggacagaacagtataagtttcaggcagactctccgaaacgcctctcagccgctattggaaaggcctgggaggagggcgtatgtggtataagaagtgcaactaggctggaaaatatcatgtggaaacagattagcaacgagttaaatcacatcctgcttgaaaacgatatgaagttcaccgtcgtggttggcgacgctaatgggattttggcccaaggcaagaaaatgatccggcctcagcccatggagcacaaatactcctggaagtcttggggcaaggcgaaaataatcggggccgacattcagaacacgacatttatcattgatggaccagacacccctgaatgccccgatgaccagcgcgcttggaatatctgggaggtggaggattatggcttcggtatatttactaccaacatttggctcaagctgagagactcgtacacacaaatgtgtgatcataggctaatgagcgcagccatcaaagactccaaggctgtccacgccgatatggggtattggattgaatcagagaaaaatgaaacttggaagctggcacgtgcgagtttcatcgaggtgaagacctgcatatggccaaaatctcatacactctggagcaacggagttctggaatccgagatgatcattcccaagatctacggcggtcctatttcacagcacaattatcggccaggctacttcacgcagaccgccgggccgtggcaccttggaaaattggagctggactttgatttatgcgaaggcactacagtggtagtcgaggaacattgtgggaaccgaggacccagcctcagaaccactacagtgaccggcaagatcatacacgagtggtgctgtaggtcttgcacgctgcctccacttcgcttcaaaggtgaggacgggtgttggtacggaatggaaattcggcccgtgaaggagaaggaagagaatctggtcagatccatggttagtgctggcagcggtgaagtggattctttttccttgggcctcctgtgcgtatcaatcatgatcgaggaggtgatgaggagtcgctggagccgaaaaatgctaatgactgggaccctggccgtcttcctcctgcttattatgggacaattgacatggaacgacctgatccggttatgtattatggtgggcgcaaatgcttcggaccgtatggggatgggaaccacttatctcgccctgatggcaacatttaagatgagacctatgttcgccgttggccttctgtttaggcgcctaacctcccgggaagtgctcctgttgacaataggtctgtctttagtcgctagcgtggagctcccaaactcactggaagaacttggggatggactggcgatgggcatcatgatgttgaaactcctgactgacttccagagtcatcagctatggaccacgctgctttccctcacatttattaagaccactctgtctttggattacgcctggaaaaccatggcaatggttctgagcatcgtgtccttattccccctctgcctgtcaacaactagccagaagaccacgtggcttccggtcctgttgggcagttttgggtgtaagcctctcacaatgttcctgattaccgaaaacaaaatctggggaagaaagtcttggccactaaatgagggtataatggctgtaggcatcgtgtccattctgcttagctcgctcctgaaaaacgacgttcccttggccgggcctttaatcgccggaggcatgctgatttcatttttcgtgatctctggtagttccgctgatctcagcctggagaaggcagccgaagtctcttgggaggaagaggcggaacacagcgggacttcccataatatacttgtggaggtacaagacgatggaacaatgaaaattaaggacgaggaaagggatgacaccctgactatcttgctaaaagctacactgctcgccgtgtcaggcgtctatcccatgagtatcccagcaaccctgttcgtttggtacttttggcagaagaagaaacagcgaagcggcgtgctttgggatacgccttctcccccagaggtggaacgcgccgtcttagacgatgggatttatcggatactgcagagaggactcttgggtaggtcccaagtgggcgttggggtattccaggacggagtgtttcacactatgtggcacgtcacccgtggcgctgtgctgatgtaccagggtaagcgcctcgagccgtcatgggcaagtgttaaaaaggacctgatcagctatgggggaggctggcggttccagggctcctggaacacaggggaggaagtgcaagtcattgccgtggagcctggcaagaatcccaagaacgtacagaccacaccaggtacttttaagacccccgaaggcgaggtcggggcgatcgctcttgatttcaaacctggaacgtctggctcgccaattgtgaatagagaaggtaagatcgttgggctgtacggaaacggcgtggtcacaactagcggcacctacgtgtcagccatagcacaggccaaggcttcccaagaggggcccttgcctgagatcgaagacgaggtttttaggaagcgaaatctaacaattatggatctgcatccgggaagtggtaaaacccggcgctatctcccagccatcgtgagagaagcaattaagaggaagttacggactctgatccttgctcccacccgagtcgtggcctctgagatggcggaagccctgaaaggcatgcctataagataccagacaacggcagtaaagagcgagcacactgggcgcgagattgtggacctcatgtgccatgctaccttcacaatgaggttgctgtccccagttcgtgtccccaactataatatgatcatcatggatgaagcccactttaccgaccctgcttcaattgcagcccggggatacatctctactagagtgggcatgggtgaggccgctgcgatattcatgacagcaaccccgcccgggagcgtggaagcctttccacagagtaacgctgtcattcaggatgaggaaagggacatccctgagcgctcctggaatagcggatatgattggattacggacttccccggcaaaactgtatggttcgtgccatctatcaagtcaggcaacgatatagccaattgtctccggaaaaacgggaagagagttattcaactgtccagaaagacatttgacaccgagtaccagaaaaccaagaacaatgactgggattatgtggtcactacagacatcagtgaaatgggagcaaacttcagggccgatcgcgtgatcgaccctcgtagatgccttaaacccgttattctaaaggatggtccagagcgggtgatcctggctggcccgatgcctgtcaccgtggcgagcgccgcacagaggcgcgggcgaattggaagaaatcagaacaaagaaggcgaccaatacgtaaatatgggtcagcccttgaacaatgatgaggaccatgctcactggacagaggccaagatgttactggataacataaatactccagaagggatcattcccgcactctttgagcctgaacggaagaaatcggccgctgtggacggcgagtacaggctgcgcggagaagccagaaagacgttcgttgagcttatgaggcggggcgatctgccagtctggctctcttataaagtggcgtccgaggggtttcagtacagcgaccgtcgctggtgcttcgatggagaacgaaacaatcaggtgttggaggaaaacatggacgtcgagatctggaccaaggaaagagagaggaaaaagctgcggccccgctggctagacgcaagaacatattcagatcctctggccctcagggagtttaaagagttcgctgccggtcggcgaagtgtttctggcgaccttatcctggagattgggaagttaccgcaacacttgactctgagagctcagaatgcactcgataacctggtgatgcttcataattccgaacagggaggcaaggcctaccgccacgctatggaggaactgccagacaccatagagacactcatgttgctggccttaatcgcagtactaaccggtggggtgactctgtttttcctcagcggcaaaggacttggcaagacgtcaattgggctgttgtgtgtcatggcgagtagcgccctgctctggatggcttccgtggagccccattggatcgccgcatctattatcctggaatttttccttatggttctcctgatacctgagcccgataggcagcggaccccacaagacaaccagttggcttatgtggtcatcggactgttatttatgattctaacagtagccgcaaacgaaatgggtctgctcgagactaccaaaaaggatcttggcatcgggcacgtggccgctgagaatcaccatcacgcgacaatgctggacgttgatttgcgtcctgccagcgcatggaccctgtacgctgtggccactacaattatcacgcccatgatgagacataccatagaaaacactacagccaatatttccctcaccgcaatcgctaaccaggccgcgattctgatgggacttgacaaaggctggccaatctcattaatggatataggtgtccctctgctcgctttggggtgctattctcaagtgaatccgctgaccctaacagccgcagtcctgatgctcgtggcccactacgctatcattggccccggacttcaggcaaaggccactagggaggcgcagaagcgcacggctgccggcatcatgaaaaacccaaccgttgacgggattgtggcaatcgatctggaccctgtagtgtacgacgccaagttcgaaaaacagttgggacaaataatgctgctcattctgtgtacaagtcagatcttacttatgcggactacctgggctctgtgcgagtcgatcacactcgccaccggccccctaactacgctgtgggaaggtagcccagggaagttctggaatacaaccattgcagtctccatggctaacatctttcgaggatcttatttggccggcgcgggtctggccttctcactcatgaaaagccttggcgggggaagaaggggcactggggcacagggagagaccctgggcgagaagtggaagcgccagttgaatcaactgtccaaaagtgaatttaacatatacaagcggtctggtattatggaggttgatagaagcgaagctaaagaggggctcaagcgtggagaaacaactaaacatgccgtgtcaaggggcaccgcaaagttacggtggttcgtcgagcgcaatctggtgaagcctgagggtaaagtaatcgaccttggctgtgggcgaggaggctggtcctattactgcgctgggctgaagaaagtgacagaagttaagggatatacgaaaggcggtcccgggcacgaggaaccgattccaatggccacctacggatggaacctagtgaagctccacagtggcaaagatgtctttttcactcctcccgagaagtgtgacacactgttgtgcgatatcggcgaaagctctccaaatcccaccatagaggaggggagaactctgagggtgctcaagatggtcgaaccttggcttcggggaaaccagttttgtatcaaaattctgaatccgtatatgccctccgtggttgagacattagaacagatgcagcgcaagcatggtggcatgctggtaagaaacccattgtcaaggaatagcacccacgagatgtactgggtgtcgtgcgggacgggaaacatcgtctctgccgtgaacatgaccagtcgaatgctcctgaatcggttcacaatggcgcatcgtaaacctacttacgagagagacgttgatctaggcgctggtacccgccacgtggcagtcgaacccgaggtggccaaccttgacattatcgggcaaaggattgaaaatatcaagaacgagcacaaatccacatggcattatgatgaagacaatccttacaagacttgggcttatcacggaagctacgaggtaaagccatcaggctccgcctctagcatggtgaacggcgttgtccggctgctcaccaaaccctgggatgtgatacctatggtgacacagattgcaatgaccgacactacgccatttgggcagcaaagagtcttcaaggagaaagttgacacacgcacccccagggccaagcgaggaactgctcagatcatggaagtgaccgcgaaatggctgtggggatttttgagtcggaataagaagccgagaatctgtacaagggaggagttcacgcgcaaagtacgttccaacgccgcaatgggcgctgtgtttgtcgatgagaatcagtggaacagcgccaaggaagcagtggaggacgagcggttctgggatctggttcatagagaaagggagctccacaaacaggggaagtgcgcaacctgcgtgtataatatgatgggaaaacgcgaaaagaaacttggcgagttcggtaaagctaaggggtctcgagccatttggtacatgtggctgggagcgcggtttttagagttcgaggcactgggctttatgaacgaggaccattggttctcaagagaaaatagtttgtccggcgtcgagggggaaggactccacaaactgggttatatactaagggatatcagcaagattcctggcgggaacatgtacgccgacgatactgctggatgggacacacgcatcaccgaggatgaccttcaaaatgaggccaaaattactgatatcatggaaccagagcacgcactgctcgctacatctatatttaagctgacctaccagaacaaagtggtaagagttcagcggcccgccaagtcgggcacagtgatggacgtcatctcaaggcgtgatcagcgaggtagcgggcaagtgggaacttatggcttgaacaccttcacgaatatggaagtgcagttaattcgccagatggagtccgaaggcatctttctgcctagtgagctcgagaccccaaaccttgctgaaagagtcctggactggctagagaagcatggggccgaacggctgaaaaggatggcaatttctggagacgattgtgttgtgaagcccatcgacgatcgcttcgcgacagccctcactgctttgaatgacatgggtaaagtaagaaaggatataccgcagtgggagcctagcaaaggctggaacgactggcaacaggtgcccttttgctcccaccatttccaccagctgattatgaaggatgggcgggaaatcgtcgtgccatgtaggaatcaggacaaacttgttggacgagcccgtgtgtcacaaggcgcaggttggagtctgagagagaccgcttgcctcgggaaatcttacgcccagatgtggcagttaatgtattttcaccgccgggatctgaggttggcagccaacgcgatctgtagcgctgtccctgtggactgggtacccacatccagaactacctggtcaattcatgcccaccatcaatggatgacgacagaggatatgctgagcgtttggaataaggtgtggatagaagagaacccatggatggaagacaaaacccacgtctcttcctgggaggacgtgccctacctcggaaagcgcgaagatcagtggtgcggcagtcttatcggcctgactgcacgggccacatgggctaccaatattcaggttgccatcaaccaggtgaggcgactaattgggaatgagaactatctggactacatgactagcatgaaaagattcaagaatgagtcggatcctgaaggagcactctggtga

SEQ ID NO: 13254 - RNA, 9879 nt, synthetic construct
  misc_feature 1..9879: note = derived and/or modified CDS sequence (opt3) from DENV-1__JQ922546__SS-prME
  source 1..9879: mol_type = other RNA
agcgtggccatgctgctcatgcttctgcccaccgctttggcattccacttaacaactagaggcggggagcctcatatgatcgtctccaagcaggaaaggggaaaatctctgctatttaagacgtcagccggtgttaacatgtgcaccctcattgcgatggacctgggcgagctttgtgaagatacaatgacttacaaatggccacggataaccgaggctgaaccggacgatgtggactgctggtgtaatgccacagatacctgggtaacttatgggacatgcagtcaaaccggagagcaccgccgagacaagcgtagcgtggcactggccccccatgtcggcttgggtctcgagacgagaactgaaacctggatgtcctctgagggggcttggaaacagatccagaaggtggaaacatgggcactgaggcaccctggattcactgttattgccctgtttctcgctcatgccatcggcacctcgattacacagaagggcatcatattcatcttactgatgcttgtgaccccatcaatggcgatgcggtgtgtcgggattggaaaccgcgattttgtggagggtttgagcggcgcaacgtgggtagacgttgtgctggagcacgggagttgcgtcactacaatggccaaaaataagcccaccctagatatcgaactcctgaaaactgaggtgacaaaccctgctgtgcttagaaagctgtgtattgaagccaaaatctccaataccacgaccgactctaggtgcccaacacaaggagaggcaactttggtcgaagagcaggatgctaacttcgtttgtcggcgcacctttgtggaccgaggctggggtaatgggtgcggactcttcggcaagggcagcctgttaacatgtgccaagtttaaatgcgtaactaagctggaggggaaaatagtgcagtacgaaaacctcaagtattccgtcattgtgaccgttcacacaggagatcagcatcaagtgggtaatgagaccactgaacacggcacgatcgcgattatcacaccccaggcccctacctcagagatccagcttactgactacggggcactgaccttggactgcagtccaagaacaggactagatttcaacgaaatggtcctgctcaccatgaaagagaagagctggctggtgcataaacagtggtttcttgacctgccgttgccctggacttctggcgcttccacatcacaagagacgtggaataggcaggatctcctggtaaccttcaagactgcccacgctaagaaacaggaagttgtggtcttaggtagccaagagggggccatgcacacagcactgaccggcgccacagaaattcagactagtggaaccacgaccatatttgctggccatctaaagtgtcggctcaaaatggacaagctgacacttaaagggatgtcttatgtgatgtgcactggatccttcaagttggagaaggaagtcgcggagacccagcacggtacagtgctggttcaggtgaaatacgagggcactgatgcaccttgtaagatcccattcagcattcaagacgaaaaaggggtaacccagaacggacgtctcatcacggccaatcccatagtcacagataaggagaaacctgtgaacattgaaaccgagccaccctttggcgagtcgtatatcgttgtgggtgctggggaaaaggccctgaagctttcttggttcaaaaagggctcctcaatcggaaaaatgtttgaggcaactgcccgcggcgctagaaggatggccattctgggggacacagcatgggatttcggaagtatcggtggcgtctttaccagcgtggggaagttggtacatcaggtgttcggaactgcgtacggcgttctcttttccggtgtctcttggaccatgaaaattgggataggcatcctgttaacatggctgggactaaatagccggtcaacgagtctctccatgacctgcattgctgtgggcatggtgactctgtaccttggggtcatggttcaggccgacagcggatgtgtgatcaactggaagggccgagaattgaagtgcggttctgggatcttcgtgacaaacgaggtacacacctggacagaacaatataaatttcaggcagattcaccgaagcgcctgagtgccgctattggaaaagcctgggaggagggcgtctgtggtataagaagcgcaactaggctcgaaaatgtgatgtggaagcagatctccaacgagctgaatcatattttactggaaaacgacatgaaattcaccgttgtggtcggcgacgtgaatgggatccttgctcagggaaagaaaatgattcggcctcaacccatggagcacaagtactcttggaagtcgtggggcaaagccaagatcataggggcggatatccagaacacgacatttattatcgacggaccagatacccctgaatgccccgacgatcagcgcgcctggaatatttgggaggttgaggactatggcttcggtatctttactaccaacatatggttgaaactcagagatagctacacacaggtgtgtgaccacaggctgatgtccgctgcaattaaggattcaaaagccgtacatgctgacatggggtattggatcgaaagtgagaagaatgaaacttggaagctagcccgtgcatctttcattgaggtcaaaacctgcacatggccaaagagccacacgctgtggtccaacggagtgctcgaatcagagatgatcatacccaaaatctacggcggtcctattagccaacataattatcggccaggctacttcacccagactgcggggccgtggcacctgggaaagcttgagttggattttgacctgtgtgaaggcacaaccgtggtcgttgatgagcactgcgggaaccgaggaccctctttaagaactacaaccgtgacgggcaaaatcattcatgaatggtgctgtaggtcctgcactctccctccactgcgcttcaagggtgaggacgggtgttggtacggaatggagatccggcccgtaaaggaaaaagaggaaaatcttgtgagaagtatggtcagcgccggctctggtgaggtggactccttttcactgggcttgctctgcgttagtataatgattgaagaggtgatgaggagccgctggtcgcgaaagatgctgatgaccgggacactagctgtcttctttctgctcatcatgggacagctgacctggaacgatcttttccggttgtgtatcatggtgggcgccaatgcatccgaccgtatggggatgggaactacatatctggctttaatggccacctttaaaatgagacctatgttcgcagttggcctcctgtttaggcgccttacatctcgggaggtgctgctactcactattggtctgagcttggtcgcctcagtagaactgccaaacagtttagaggaactcggggatggactggctatgggcatcatgatgcttaagctgttgaccgacttccaatcccaccagctctggacgacactgctatctctgacctttattaaaactacccttagcctcgattacgcgtggaagacaatggccatggtgctgtccatagtttcattgagccccctgtgcttaagtactacctctcagaagacgacatggctcccggtgctgcttggctccttcgggtgtaaacctctgaccatgtttttgatcactgagaacaagatttggggaagaaaaagctggccactcaatgaaggtatcatggcagtcggcattgtgtcgatcctgctatcatctctgcttaagaacgacgtacccctcgctgggcctctgatagccggaggcatgttgatcgcctgctatgtgattagtggttccagcgctgatttatctctggagaaagcagccgaggtcagctgggaagaggaagcggagcattccggggcttcacacaatatcctcgttgaagtgcaggacgatggaacaatgaagattaaagacgaggagagggatgacaccctgactatccttctgaaggccagtttgctagcagtgagcggcgtctaccccatgtctataccagccacactgttcgtgtggtatttctggcaaaagaaaaagcagcgatccggcgttctctgggataccccttcacccccagaagtagagcgcgctgtgctggacgacgggatttaccggatccttcagagaggattactgggtaggagtcaggtcggcgtggggatctttcaagatggagttttccatacgatgtggcacgtgactcgtggcgcagtcctcatgtatcagggtaaacgcttggaaccgagctgggcctccgtgaagaaagacctgatttcttacgggggaggctggcggtttcagggctcgtggaacaccggggaggaggtacaggtcatagcggtggaacctggaaagaatcccaagaacgttcaaacaaccccaggtatcttcaaaacacccgagggcgaagtgggggctattactctcgattttaagcctggaaccagcggctcaccaatcgtcaatagagagggtaaaattgtggggctgtacggaaacggcgttgtgacgacatccggcacttatgtcagtgccatcgcacaggccaaggcttctcaggaagggccccttcctgagatagaggacgaagtgttcaggaaacgaaatctgaccatcatggatttgcacccgggaagcggtaagacacggcgctacctaccagccattgtaagagaggcaatgaagaggaaactgcggaccctcatcttagctcccactcgagtggttgcctccgaaatggcggaggccctgaagggcatgcctattagatatcaaaccacagcagtcaaatcagaacatacggggcgcgagatcgtggaccttatgtgtcacgctacttttaccatgaggctgctctctccagtgcgtgtccccaactacaatatgataattatggatgaggcccatttcacagaccctgctagcatcgcagcccggggatatatcagtaccagagtaggcatgggtgaagccgctgcgatttttatgactgcaacaccgcccgggtccgtggaggccttcccacagagcaacgctgttatccaggatgaagagagggacatacctgaacgctcttggaattcaggatacgattggattaccgactttcccggcaagacggtgtggttcgtcccatccatcaaaagtggcaacgacattgccaattgcttgcgaaagaacgggaagagagtgatccagctgagccggaaaactttcgatacagagtatcaaaagaccaaaaacaatgactgggattacgttgtgaccactgacatatcggagatgggagcaaactttagggccgatcgcgtcattgaccctcgtagatgtctcaagcccgtgatcctgaaagaaggtccagagcgggtaatccttgctggcccgatgcctgtgacagttgcgtctgccgcacagaggcgcgggcgaattggaagaaatcagaacaaggaaggcgatcagtacgtctatatgggtcaacccctaaataacgacgaggatcacgctcattggaccgaggccaagatgctgttggaccacatcaatacaccagaagggattatacccgcattattcgagcctgaacgggagaaatccgccgctatcgatggcgaatacaggctgcgcggagaggccagaaagacttttgtggagctcatgaggcggggcgacctgccagtgtggcttagctataaagtcgcgtcagaagggttccagtacacggatcgtcgctggtgctttgacggagagcgaaacaatcaggttctggaagagaacatggacgtggaaatttggatggaggagggtgaaaagaaaaagatcagacccaggtggctcgagatcgaaaaatatagtgatcctttggcactgcgggagttcaaggaattttctgccaagcgcaaatccgtactaggcgacctgaagctcgagattgggaaacttccgcagcacctgaccataaaggctagaaatgccttagataacttggtgatgctgcataatagcgagcaaggaggcaaagcttacaggcacgcaatggaagagctcccagacacaatcgaaactctgatgcggcttggtctgattgccgtcatgaccgggggcgtgacactcttctttttgtcaggaaagggcctggggaagaccagtaacggattactatgcgttatggctagctccgtgctgctctggatggcctctgtcgagccccattggatcgcagcgagcattatccttgagttctttctgatggtattgctgatacctgaacccgatcgacagagaactccacaggacaatcagctcgcctatgtggttatcggtctgcttttcatgattctcacggtggctgccaacgagatgggcctgttggaaaccacaaaaaaggatctggggatcggacacgtcgtggcagagaaccaccatcacgctactatgttagacgtcgatctacatcctgcctccgcatggaccctgtacgccgtggctacaaccattatcactcccatgatgcgccacacaatagaaaatacgaccgcgaacatttcactcactgccatcgcaaatcaagctgccattcttatgggcctggacaaaggttggccaatctctaagatggatataggggttcctttgctggccctcggctgttacagtcaggtgaacccgctgacacttaccgcagctgtattaatgctggtggcccattatgcgatcattggacccggcctccaggctaaagccaccagggaggcacaaaagcggacagccccacagatcatgaagaatcagattgtcgacgggatcgttgctgtggatttggaccctgtcgtgtacgacgcaaaatttgagaagcagctgggacaaataatgctactgattctctgcacttcgcagatccttctgatgcgtacgacctgggccttgtgtgaaagcatcacactggcgactggccccctcaccacactgtgggagggttccccagggaaattctggaacaccactattgctgtatctatggccaatatcttcagaggatcatatttagcaggcgccggtcttgcttttagcctgatgaagtccctcggcgggggaaggcgcggcacgggggcccagggagaaacactaggcgagaaatggaagcggcagctgaaccaattgagtaagtctgaattcaatacctacaaacgaagcggtataatggaggtggatagatcagaggcaaaggaagggctgaaaaggggagagactaccaagcacgctgtttcccgcggcacagccaaactccggtggtttgtggaaagaaaccttgtcaagcctgagggtaaagtgattgacctgggctgcgggcgtggaggctggagttattactgtgcggggttgaagaaggtcactgaagtgaaaggatataccaagggcggtcccgggcacgaggagccgatcccaatggccacatacggatggaatctggttaaactccatagcggcaaggatgtattctttacgcctcccgaaaaatgcgacaccttactgtgtgatattggcgagtcttccccaaaccccactatcgaagaggggaggacacttcgggtgctgaagatggtcgagccttggctacgcggaaatcagttctgcataaagatcctcaacccgtacatgccctcagtggttgaaaccctggagcagatgcagcgaaaacacggtggcatgttggtgagaaatccactgagcaggaactcgactcatgaaatgtattgggtctcttgtgggacaggaaatattgtgagtgcagtaaacatgacctcccggatgctccttaaccgctttacgatggctcacagaaagcctacctacgagagggacgtggatctgggcgccggtacacgacacgttgcagtcgaacccgaggtggctaatttagacatcattgggcaacggatcgagaacattaaaaatgaacataagagcacttggcactatgatgaggacaacccttacaaaacctgggcctatcatggatcatacgaagtgaagccatccggctctgccagcagtatggtcaatggcgttgtgcgtctgttgacaaagccctgggatgtaatccctactgtgacccagatagcgatgacagacaccactccattcgggcagcaaagagtctttaaagagaaggtggacacgcgcacacccaaagctaagaggggaaccgcacagattatggaagttactgccaactggctctggggtttcctgtcccggaataaaaagccgagaatctgcacccgcgaggagtttacaaggaaggtgcgaagcaacgctgccatcggcgcagtcttcgtggatgaaaatcagtggaactctgccaaagaggctgtagaagacgagcggttttgggatctagttcacagagaaagggagcttcataagcaggggaaatgtgcgacgtgcgtgtataatatgatgggaaagcgcgagaaaaagctgggcgaattcggtaaagccaaggggtcacgtgcaatttggtacatgtggctcggagctcggttcctggagtttgaagccttgggcttcatgaacgaggaccactggtttagtagagagaattccctgagcggcgtcgaaggggagggactccacaagcttggttacatactgagggatatctctaaaattcctggcgggaacatgtatgcagacgataccgccggatgggacactcgcatcacagaagatgacttacaaaatgaggctaagattaccgatatcatggaaccagagcatgccctgttggcgacttcgatattcaaactcacataccagaacaaggtggtgcgagtccagcggcccgcaaaatcaggcaccgttatggacgtgatcagcagaagggatcagcgcggttccgggcaagtaggaacatatggcctgaacacttttaccaatatggaggtgcagctaattagacagatggaaagtgagggcatcttccttccttctgaactggagacgccaaacctcgccgaacgggtcctgaattggttggagaagcacggggtggagaggttaaagcgtatggctattagcggagacgactgcgttgtgaaacccaccgatgaccgatttgccacagcactgactgctctcaacgatatgggtaaggtccgcaaagacaccccgcagtgggaaccttccaagggctggaatgattggcaacaggtgcccttctgttcacatcactttcaccagcttatcatgaaagacgggagagagatagtagttccatgccggaaccaggatgaactggtgggaagggcccgcgtcagtcatggcgctggttggtctctaagagagacagcctgtctggggaagagctacgcacaaatgtggcagctcatgtatttccaccggagggacttgcgactggcggccaatgctatttgctccgccgtgcctgttgattgggtgcccacttcacgtaccacgtggagcatccatgcacaccatcagtggatgacaaccgaagacatgctttctgtctggaacagagtgtggatcgaggagaatccatggatggaagataagactcacgtatccagttgggaggacgtgccctacctgggaaaacgcgaagaccaatggtgtggcagcattataggcctcacagctcgggccacctgggcaactaacatccaggtcgccattaatcaggttaggagattaatcgggaacgagaattatctggattacatgacctcgatgaagcgctttaaaaacgagtccgaccctgaaggagcgttgtggtga

SEQ ID NO: 13255 - RNA, 9879 nt, synthetic construct
  misc_feature 1..9879: note = derived and/or modified CDS sequence (opt3) from DENV-1__JQ922545__SS-prME
  source 1..9879: mol_type = other RNA
agcgtgaccatgctgctcatgcttctgcccaccgcattggctttccacttaactacgagaggcggggagcctcatatgatcgtctccaagcaggaaagggggaaatctctgctctttaagacctcagccggtgttaacatgtgcacgctcattgccatggacctgggcgagctttgtgaagatactatgacctacaaatgcccacggataacagaggcggaaccggacgatgtggactgttggtgcaatgctaccgatacttgggtaacatatgggacctgtagtcaaacgggagagcaccgccgagacaagcgtagcgtggccctggcaccccatgtcggcttgggtctcgagactagaaccgaaacatggatgtcctctgagggggcctggaggcagatccagaaagtggaaacttgggctctgcggcaccctggattcaccgttattgcactgtttctcgcccatacaatcggcacctcgattacgcagaagggcatcatattcatcttactgatgactggggctccaattatggccatgcgctgcgtgggaatcggtaacagagattttgtcgagggcctttcaggggcgccctgggtggacgtagttttggagcacggaagctgtctgagtaatatggcaaagaacaaacctacactagatattgacttctttaagaccgaagtgactaatccagccgtcctcaggaaactgtgcatcgaggctaagatatccaacacaaccacggattctcggtgtcccacccaaggcgaagccacacttgtggaggaacaggacgcaaatttcgtgtgccgccgaacttttgtcgatagaggttgggggaacggatgtggcctgttcggcaaagggagcttgctaacctgcgctaagtttaagtgcgttacaaaactggagggaaagattgtgcagtacgagaatttaaaatattccgtaatcgtgactgtccacaccggtgaccagcatcaagtgggcaacgaaacaaccgagcacgggactattgccacgatcacacctcaggcgccaacctcagaaatccagctgactgactacggagccctcacccttgattgtagtccgaggacaggcctggacttcaatgagatggttttgctaaccatgaaggaaaagagctggctggtgcataagcagtggtttctcgatctgccccttccttggacttctggtgcatccacatcacaagagacgtggaaccggcaggacctgttggtcaccttcaaaactgctcacgccaagaagcaggaggtggtagttctcgggagccaagaaggcgctatgcacacagccctgaccggagcaacagagattcagatgagtggcactaccacgatattcgccgggcatttaaaatgccgtctgaagatggataaactaaccctcaagggagtgtcttatgtcatgtgtacaggttcctttaaactggaaaaggaggtggctgaaactcagcacggcaccgtccttgtgcaggttaagtacgaggggacagacgcgccatgcaaaatccccttcagcactcaagatgagaagggagtgacccagaatggccgcttgattacggcaaaccctatcgtaacagacaaagaaaagccagtcaatatagagaccgaacccccgtttggtgagtcgtatattgtgatcggggccggcgagaaagctctgaagctctcttggttcaagaaaggatcctcaatcggcaagatgtttgaagccactgcaagaggggccaggcggatggctattctgggagatacagcctgggacttcggtagtatcggcggggtttttaccagcgtgggaaaacttgtccatcaggtgttcggcactgcatacggtgtactgttttccggggtgtcttggaccatgaagattggcataggaatcttgctcacatggctgggcttaaacagccgatcaacgagtctgtccatgacctgtattgcggttgggatggtcactctatacctcggagtgatggtgcaggctgatagcggctgcgtcatcaactggaaaggtcgcgagctgaagtgtgggtctggaatcttcgttacaaatgaagtgcacacctggacagagcaatataagtttcaggccgactcacctaaaagacttagtgcagccattggcaaggcttgggaagagggtgtgtgcggcataaggagcgccacttgtttggagaacatcatgtggaaacagatttccaatgaactgaaccatatcctcctggagaatgacatgaagttcaccgtagtcgtgggggatgcaaacggaattttaacgcagggcaaaaagatgatccggccccaaccaatggaacacaaatactcttggaagtcgtgggggaaggctaaaataatcggagccgacattcagaatacaacctttatcattgatggccctgacactcccgagtgcccagatgaccagcgcgcgtggaacatctgggaagttgaggattatggtttcgggatattcaccacaaatatttggctgaaacttagagacagctacactcagatgtgtgatcacaggttgatgtccgccgctatcaaagactcaaaggcagtgcatgccgatatgggatattggattgagagtgagaaaaacgagacctggaagctcgctcgtgcctcttttatcgaagtcaagacatgcatatggccccggagccacacgctgtggtccaatggcgtgctagagtcagaaatgatcattcctaaaatctacggtggcccaattagccaacataactatcgaccggggtacttcacccagactgcaggaccctggcacctgggcaagctcgagctggactttgatctttgcgaggggacaaccgttgtggtagacgaacactgtggaaatagaggcccttctttgaggactacaaccgtcacgggtaaaatcatacatgagtggtgctgtcgctcctgcactctgccacccttacggttcaagggggaagacggatgttggtacggcatggagattagacctgtgaaagagaaggaagagaacctcgtgaggagtatggtcagcgcgggttctggcgaagttgattccttttcactggggcttctgtgcgtgagtatcatgatcgaggaagtaatgcgcagccgatggtcgcggaagatgttgatgaccggaacactcgccgtgttctttctgctaattatgggccagctgacctggaatgacctcatccgtctgtgtattatggtcggggctaacgtgtccgatagaatgggaatgggcactacatatcttgccttgatggcaaccttcaaaatgaggccaatgtttgctgttggtctgttattccgccggctcacatctagagaggtgctgcttctgactatagggctaagcctcgtcgcctcagtggagctgcccaacagtttggaggaactgggagacggcttagcaatgggcatcatgatgctcaagctgcttaccgattttcaatcccaccagctgtggacgacattgctctctctgaccttcattaaaactaccctaagcctggactacgcctggaagacaatcgctatggttctttccattgtgtcactctttccgctgtgcttgagcactaccagtcagaaaacgacatggctgcctgtcttactcgggtctttcggatgtaagccactgaccatgttccttatcactgaaaataagatatggggtaggaaatcctggcccctgaacgagggcatcatggcggtagggattgtgagcatcttgctctcgtcactgctaaagaatgatgttcctctggccggaccccttattgcaggcggtatgctcatcgcttgctatgtgatatctgggagttccgccgacctgagcttggaaaaagccgctgaggtctcttgggaggaagaggcacagcatagcggagcctcccacaacattttagtggaagtacaagatgacggcacaatgaagatcaaagatgaggaacgagacgataccctgactatcctcctgaaggcgacacttctggctgtgtcaggcgtctacccaatgagtattcctgccaccttgtttgtttggtatttctggcagaaaaagaagcagcgcagcggggtgctatgggacacgccctctccaccggaggtggagcgggcagtcctggacgatggaatatacagaatcctccagaggggtctgcttggccgttcccaagtgggggttggagtatttcaggacggcgtgttccatactatgtggcacgtcacccgcggtgccgtgttaatgtatcaggggaaacggctggaaccttcatgggctagtgttaagaaagatctcattagctacggaggcggctggagatttcaggggtcctggaatacaggagaggaagtgcaagtcatcgcagtggagcccggtaagaaccccaaaaatgtacagaccacacccggcactttcaagacccctgagggggaagtcggagccattgcgttggactttaagccaggcacgtctggttcgcccatcgtgaacagggaggggaaaatagttggactgtacggcaatggcgtggtcacaactagcgggacctatgtgtcagctatcgcccaggcaaaggcctcccaagaaggacctctcccggagattgaagatgaggttttcaaaaagcgaaacctgacaatcatggaccttcacccaggtagtggcaaaacccggcgctacctgcccgctattgtgagagaggccatcaagaggaagttgcggactctaatactggcacctacccgagtcgtggcttctgaaatggccgaggcgctcaaagggatgccaattagatatcagacaacggccgtaaagagcgaacatactggacgcgagatcgtggatttaatgtgtcacgcaacctttacaatgaggctgctttcccccgttcgtgtccctaattacaacatgatcattatggacgaagctcatttcaccgatccggcctcaatcgctgcacggggctatatatctactagagtgggtatgggggaggccgccgctatttttatgacagcgacaccaccaggaagcgtggaggcattccctcagagtaatgccgtcatccaggacgaagagagggatattcccgaacgctcctggaacagcggctacgactggatcacggacttcccaggcaaaactgtatggtttgtgccttctataaagtcagggtccgatattgctacagttctggagcgaagtagagaacccgtgatccaactcagccggaaaaccttcgacaccgagtatcagaagactaagaataacgattgggactacgtcgtgacaaccgatatctcggagatgggagccaactttagggcagaccgcgttattgatccacgtagatgcttgaaaccggtgatccctaaggacggtcccgaacgggtcattctggccggcccaatgcccgtgacagtagcttctgcggcccagaggcgcgggcgaataggaagaaatcagaacaaagagggcgatcaatacatctatatgggtcagcctctcaataacgacgaagatcacgcacattggactgaggctaagatgctgcttgacaatattaacacgccagaggggatcatccccgccctattcgaacctgagcgggaaaaatccgcagccattgatggcgagtacaggctgcgcggagaagctagaaagacctttgtggagttgatgaggcggggcgacttaccggtttggctgagctataaggtcgcctcagaggggttccagtacagtgaccgtcgctggtgctttgatggagaacgaaataaccaggtgctcgaggaaaatatggacgtggagatatggacaaaagaaggtgagagaaagaaactgaggccacggtggcttgatgcgcgcacttattctgaccccctggcactcagagagttcaaggaatttgccgctggcaggcggtccgtcagcggggatttgatcctggagattgaaaaactacctcaacacctgaccctccgagcccagaacgctcttgacaatctggttatgttacacaactcagagcagggaggcaaggcatacagacatgccatggaagagttgcccgatacaatcgagaccctgatgctcctggctcttattgccgtgctgactggtggggtaacactcttctttttgagtggcaaaggactgggcaagaccagcatcgggttactatgtgtgatggcatcctctgtcctgctctggatggcgagcgtggaaccacactggatagccgcttccatcattcttgagttcatcctgatggttttgctgattcctgaacccgaccgccagaggacaccacaagataatcagctcgcctatgtggtcatcggactgctttttatgatactcactgtagcagctaacgagatgggtctgttggagaccacaaagaaagacctgggcattgggcatgtggttgccgaaaatcaccaccatgcaaccatgttagatatcgacctacaccctgcctcagcttggactctgtacgcggtggccacaacgattatcaccccgatgatgcggcatactatagagaacacaaccgcaaacatctctctcaccgctattgccaatcaggccgcaatccttatgggactggataagggctggcccattagtaaaatggacatcggtgtcccattgctggctctcgggtgctactcgcaagtgaaccctctgacacttactgccgcggtcttaatgctggtggctcactatgccataattggccccggactccaggcaaaggccacgcgtgaagctcagaaaagaaccgcagccggcatcatgaagaatccaacagttgacgggatcgtggcgattgatttggaccctgtagtgtacgatgctaagttcgagaaacagctgggacaaatcatgctactgatactctgtactagccagattcttctgatgaggaccacatgggccttgtgcgaatccatcaccctggcaactggccccctcacgacactgtgggagggttctccggggaagttctggaacaccactattgccgtctcaatggctaatatctttcgcggaagctatttagccggcgcaggtcttgctttctccctgatgaaaagtctcggcgggggacggcgaggcaccggggcccagggagagacactaggcgaaaagtggaaaagacagctgaaccaattgtctaagagcgagtttaatacttacaagaggtcaggtataatggaagttgaccgctccgaggcgaaagaagggctgaagcggggagagaccacaaaacatgccgtgagtagaggcacggcaaagctccgttggttcgtcgagaggaaccttgtgaaaccagaaggtaaggtaatcgatctgggctgtgggcggggaggctggagctattactgcgctgggttgaagaaagtgaccgaggttaagggatatactaaaggcggtcctgggcacgaagaacccattccaatggccacatacggatggaatctggtgaagctccactctggcaaagacgtctttttcactccccctgaaaagtgtgataccttactgtgcgacatcggcgagtcctcaccgaaccccacaattgaggaagggcgcacccttcgagtgctgaaaatggtcgagccatggctaagaggaaatcagttttgtatcaagattctcaacccttacatgcccagcgtggttgaaacgctggagcagatgcagaggaagcatggtggcatgttggtacggaatcctctgtcgcgcaactctacccacgagatgtattgggtgagttgcgggacaggaaatatcgtctccgcagtgaacatgactagcagaatgctccttaataggttcaccatggctcatcgaaaaccaacatacgaacgggatgttgacctgggcgccggtactcgtcacgtggccgtcgagcccgaaatagcgaacttagatattatcgggcaaagaatcgagaacattaagataggacacaaatcaacctggcattatgacgaagacaatccttacaagacatgggcttatcacggctcctacgaggtgaaaccatctggcagcgcaagttccatggtaaacggggtggttcgcctgttgaccaagccctgggatgtcatcccgatggtgactcagattgccatgacggacacaaccccttttggacagcaaagggtgttcaaggagaaagtcgatactcggaccccaagacccaagcgcggtacagctcagatcatggaagttacggccaaatggatgtggggctttctcttcaggaatcgacctccacggatttgtaccagagacgagtttgcaaggaaggtgcgcagctctactgccaacggggctgtattcgtggatgaaaatcagtggaactcagcgaaagaggccgtcgaagacgagcgtttctgggatctggtgcatcgggagagagaactacacaagcagggaaagtgcgcaacatgcgtttataatatgatgggcaaaagggagaagaaacttggtgaatttgggaaggctaaaggaagtcgcgccatctggtacatgtggctgggcgcacgattcctcgagtttgaagccctgggcttcatgaacgaggaccattggttttcccgggagaatagcttgtctggggtggaaggagagggtctgcacaagctcggctacatacttagagatatctcgaagattcccgggggaaacatgtatgctgacgataccgccggctgggacactaggatcacagaagatgactcaagcaatgaggcgaaaattatcgagctgatgcgcccggaacacgcattactggccacctccatattcaagttgacatttcaaattagtgtcgtgagagtacagcggcctgctaaatctggtactgttatggagtgtatcagcaggcgtgaccagaagcgatccggacaggtgggaacctacggcctcaacacgttcaccaatatggaagtccaactgatccgccagatggagtcagaaggcatttttagtccctctgagatggagaacagcaatctagccgaaagagtgcttgattggctggagaaacatggggtggaacggctcaagaggatggcaatatccggagacgattgcgtcgttaaaccaacagacgatcgcttcgctactgccctgaccgctttgaacgacatgggtaaggtgagaaaggatatccctcagtgggagccctcaaaaggctggaacgactggcagcaagtaccattttgtagccaccatttccaccagttaattatgaaggatgggcgggaaatcgtggtcccctgcaggaatcaggacgagctggtgggacgagcccgtgtttctcagggcgcaggttggtccctcagagagacagcgtgtcttgggaaaagttatgcccaaatgtggcagctgatgtactttcaccgccgggatctaaggctggctgccaacgcaatttgcagcgctgtgcctgtcgactgggtgccaacttcgagaaccacgtggtccatccatgcccaccatcagtggatgacaaccgaagacatgctctctgtatggaatcgcgtttggatagaggaaaacccgtggatggaggataagactcacgtgtcaagctgggaagacgtcccctatttgggaaaacgggaggatcaatggtgtggcagtctgatcggccttacagcaagggccacctgggcgactaatattcaggtggctatcaaccaggttcgaagactgattgggaatgagaactacctcgactatatgacctccatgaagcggttcaagaatgaatctgatcctgagggagccttatggtga

SEQ ID NO: 13256 - RNA, 9879 nt, synthetic construct
  misc_feature 1..9879: note = derived and/or modified CDS sequence (opt3) from DENV-1__GU131887__SS-prME
  source 1..9879: mol_type = other RNA
tccgtgaccatgctgctcatgcttatgcccacagcactggctttccacttgactacgagaggaggggagcctcatatgatcgtctccaagcaggaaagaggaaaatctttactgtttaagacctcagccggtgttaatatgtgcacactgattgccatggacctcggcgagctgtgtgaagatactatgacctacaaatgcccacggataacagaggcggaaccggacgatgtggactgttggtgcaatgctaccgatacttgggtaacatatgggacctgtagtcaaacgggagagcaccgccgagacaagcgtagcgtggcccttgcaccccatgtcggcctgggtttggagactagaaccgaaacatggatgtcctctgagggggcctggaaacagatccagagggtggaaacttgggctctccggcaccctggattcaccgttattgcactgtttctggcccatgctatcggcacatcgattacccagaagggcatcatattcatcctcttaatgctggtgacgccatcaatggccatgcgctgcgtcgggattggaagcagagattttgtggagggtcttagtggcgcgacttgggtagacgttgtgttggagcacgggtcctgtgtcacaaccatggcaaaggataaacccactctggacatcgaactactcaagacagaggtgaccaaccctgccattctgaggaaactttgcatcgaagctaagatatctaatacgaccacagatagccggtgtccaactcaaggagaggccaccctggtggaagaacaagacgcaaacttcgtctgccgccgaacatttgttgatagaggctggggtaatgggtgtggattgttcggcaaaggctccctcattacttgcgctaagtttaagtgcgtgaccaaactggaggggaagatcgtacagtacgaaaacttaaaatattcagtgattgtcacagtgcacaccggagaccagcatcaagttggtaatgagagtactgaacacggcacgacagccaccatcactccccaggcgcctaccacagagatccagctgaccgactacggggccctcactcttgattgtagcccaaggacaggactggacttcaacgaaatggtgttgctaacgatgaaggagaaatcttggctggtccataagcagtggtttctcgatctgccgcttccctggacctccggcgcatcaactagccaagagacatggaatcggcaggacctgttggtgaccttcaaaacagctcacgccaagaagcaggaagtagttgtgctcggtagtcaagagggggctatgcacactgccctgaccggcgcaacggaaattcagacctctggaacaactaccatatttgccggccatttaaaatgccgtctgaagatggataaactaacactcaaggggatgtcctatgtcatgtgtactggtagcttcaaactggagaaggaagtggctgagacccagcacggaacggtccttgtgcagatccgctacgagggcacagacgcgccttgcaagattccattctcgacccaagatgaaagaggggttactcagaacggaaggttgatcacagcaaatcccatagtgaccgacaaagagaagcctgtaaacattgaagccgagccaccctttggcgagtcttatatcgtcatcggtgctggggaaaaagccctgaagctctcctggttcaaaaagggctcaagtattggaaagatgtttgaggcaactgcccggggcgctcgacgcatggccatcctgggggataccgcatgggacttcggaagcattggtggcgtgtttacatccgttgggaaacttgtgcatcagatattcggaacggcgtacggcgtcctgttttctggtgtgagctggaccatgaagatcgggattggcgtattgctcacttggctgggattaaattcaagaagtacatccttcagcatgacctgtatcgctgtgggcctggttacactatacctcggggtcatggtgcaggccgattctggatgcgtgatcaactggaaaggcagggaactgaagtgtggttcagggatttttgtcactaatgaggttcacacctggacggaacaatataaattccaggcagacagtccgaagcggcttagcgccgctataggaaaggcctgggaggagggcgtgtgcggtatccgctccgcaacaagattggaaaacattatgtggaaacagatctctaacgagctgaatcatattctcctggaaaacgacatgaagtttaccgtggtagtcggcgatgtggctgggatcttagcccagggcaagaagatgataaggcctcaacccatggagtacaaatattcgtggcgtagctggggcaaggcgaaaatcattggggccgacgttcagaatactaccttcatcattgatggaccaaacacacctgaatgtcccgacgatcagcgggcttggaatatctgggaggtggaggactacggctttggtatattcactaccaacatttggctgaaacttcgagattcctatacacaggtctgcgaccacagattgatgtcagcagccatcaaggatagtaaagctgtgcacgccgacatggggtactggattgaatctgagaagaatgaaacgtggaaactcgcaagggcgagcttcatcgaggttaagacctgtatatggccaaaatcccatactctgtggtcaaacggagtgctagaaagcgagatgatcattcccaagatctatggcggtcctatttctcaacacaattaccgcccaggctactttacacagaccgccgggccgtggcatctgggaaagctcgagctggatttcgacctttgcgaaggcactacagtagtcgtggatgagcactgcgggaaccggggaccctccttgagaaccacgactgtgaccggcaaaatcatacacgaatggtgttgcaggagttgtacactgcctccattacgctttcgaggtgaggacgggtgctggtatggaatggagattcggcccgtcaaggaaaaagaggaaaatctcgttaagagcatggtgtctgctggctccggtgaggtagactcattcagtctgggccttctgtgtatcagcatcatgattgaagaggtgatgcgttcgagatggtccaggaaaatgttgatgaccgggactctcgccgtctttctgctactgatcatgggacagctcacatggaacgatctgattcgcctttgcataatggtgggcgcaaatgcttctgaccggatggggatgggaaccacatacttggccctgatggcaactttcaagatgagacctatgtttgccgttggcttactcttcaggcgactgaccagccgcgaggtgcttctgctaacgatcggtctctcactggtcgctagtgtggaattgccaaactccctggaggaattaggggatggactcgcgatgggcattatgatcctgaaacttctgacagactttcaatctcatcagttgtgggccaccctcctgagcctaactttcattaaaaccacattttccctgcactatgcatggaagactatggctatggttctttcaatcgtgagcctcttccccctgtgtttgagtaccacgtctcagaaaacaacctggctgccggtcttactcggctccctggggtgcaagcctcttactatgtttctgatagccgagaataaaatctggggacggagaagctggccattgaacgaaggtattatggccgtaggcatcgtgtcgattctcctgtcatctctactgaagaacgatgttccccttgctgggcctctcatcgcaggaggcatgctgatagcctgttacgtgattagtggttccagcgcggacttgtctttagagaaggctgccgaggtcagctgggaagaggaagcagagcattccggggcctcacacaatatcctggtggaagtacaggatgacggaacaatgaaaatcaaggatgaggagagggacgataccctcactattctgcttaaagctacactgttggcagtgagtggcgtctatcccctaagcataccagccaccctgttcgtttggtacttctggcaaaagaaaaagcagcgttctggcgtgctctgggacacgccttcacccccagaagtggagcgcgcggtcctggatgacgggatctatcggattatgcagagaggacttttaggtaggagccaggtgggcgttggggtatttcaagaaaacgtgttccatactatgtggcacgtcacccgaggagctgtgctgatgtaccagggcaaacggctcgagccgagttgggccagcgttaagaaggacttgatctcctacggtgggggatggcgcctgcagggctcttggaatacaggcgaggaagtgcaggtcattgcagtggagcctgggaaaaaccccaagaatgtacaaaccgccccaggaacatttaaaactcccgaaggtgaggtcggcgctatcgccctcgatttcaagcctgggacctcgggaagcccaatagtgaacagagaaggcaaaatcgttggtctgtatgggaatggagtggtcacgacatcaggcacttacgtgtccgcaattgctcaggccaaggcgagtcaggagggcccccttcctgagatcgaagacgaggtttttaggaagcggaacctgaccattatggatttgcacccggggtctggaaaaacacgaagatatctaccagccatcgtgcgcgaagcaataaagaggaaactgcgtaccctcattttagctcccactcgggtcgtggccagcgagatggctgaagcactgaagggtatgcctatcagataccaaaccacagccgtaaaatccgagcatacgggcaaggagatcgtggaccttatgtgccacgccactttcaccatgaggctgctctcaccagttcgcgtccccaattataacatgattatcatggatgaagctcattttacagacccttctagcatagcggcacgagggtacattagtaccagagtgggaatgggcgaggccgctgccatcttcatgactgcaacaccgcccggttccgtggaagcctttccacagagcaatgctgtcattcaggatgaggaacgggacatccctgagaggtcttggaactcagggtatgagtggataaccgatttccccggaaagacggtatggtttgtgccatccattaaaagtggcaatgacatcgcgaactgtttgcgcaagaatggcaaacgtgttatccagctgagcagaaagactttcgatacagaataccagaagaccaagaacaacgactgggactacgtggtcaccactgatatttcggagatgggggccaatttccgggcagacagggtgatcgatcctcgccgatgcctcaagcccgttattctgaaagacggaccagaaagagtgatacttgctggtccgatgcctgtcacagtggcctctgcagcccagcggaggggccgcatcgggagaaaccacaataaggagggagatcagtatatttacatgggccagcccctaaacaatgacgaggatcatgctcactggaccgaagccaaaatgctgttggacaacatcaatacaccagagggtatcattcccgcgttatttgaacctgagagggaaaagtccgcagccatagatggggagtatcggctgcgtggcgaggctcgcaaaactttcgtagaactcatgcgaagaggagacctgccagtgtggcttagctacaaggttgcctcagagggctttcaatatagtgataggcggtggtgcttcgacggggaacgcaacaatcaggtcctggaggaaaacatggatgtggagatctggacgaaggagggagaaaggaagaagctcaggccccggtggttggacgctcgaacctactctgaccctctggcactaagagagtttaaagagttcgccgctggtcgcaggtccgtgagcggcgatctgattctcgagatcgggaaacttccgcagcacctgacacagcgggcccaaaatgcattagacaacttggtcatgctgcataattcagaacagggaggccgtgcgtatagacacgccatggaggagctcccagatactattgaaaccctgatgcttctggctctcatcgccgcattgacaggtggggttaccctgtttttcttaagtggcaggggactaggcaaaactagcatagggctgctctgtgtgatggcttcctctgtacttctgtggatggccagcgtggagccccattggatcgcagcctccattatcttggaatttttcctgatggtcctcctgattcctgagcccgaccgccagcggacgccacaggataaccaacttgcttacgtggttatcggactcctgtttatgatattgaccgtggcggccaatgagatgggtctgttagaaacaactaagaaagacctaggcattgggcacgtcgcagtaggaaaccaccatcacgctgccatgctggatgtggacctccatcctgcctcagcatggaccctttacgctgttgccacaaccatcattactcccatgatgcgacacacaatcgagaacacgaccgcgaatatatctctgactgctatcgccaaccaggcagccattttgatgggcctggataagggttggccaatcagtaagatggacattggggtgcctctcctggctcttggctgctattcgcaggtcaatccgttaacactgaccgcagccgtgctcatgttggtcgcgcattacgctatcataggacccggcctgcaagccaaagcaaccagagaagcccagaagaggacagctgccgggattatgaaaaacccaactgtggatggaatcgttgcaatcgacctagatcctgtggtatatgacgctaagttcgagaaacagctgggccagattatgctccttatcctgtgtacgagccaaatattgctgatgcgcaccacatgggccctctgcgaatccattactctggcgaccggtcccttaacaaccctttgggaggggtctccaggaaagttttggaatactacgatcgccgtgtcaatggcaaacattttccggggcagctacctggctggtgccggcctcgcattctccctaatgaagagtctagggggaggcagacgtgggacaggagctcagggcgagaccttgggtgaaaaatggaagaggcagctgaatcagctctctaaaagcgagtttaacacttataagcggtcagggatcatggaagtcgaccgctccgaggccaaagaaggacttaagcgaggcgagataaccaagcacgccgttagtagaggtacagcgaaactgaggtggttcgtggagcggaatttggtcaagcctgaaggcaaagtgatcgatctggggtgtggacgcggcgggtggagctactattgcgctggactcaagaaagtaactgaggtgaagggctacaccaagggtgggcccggacacgaggaaccgattccaatggcaacatacggctggaacttagttaaactgcattctggcaaggacgtgtttttcgtccctcccgaaaaatgtgatacgcttctgtgcgacatcggggagtcctcaccaaatcccaccattgaggaaggaagaactctaagggtgctcaagatggtcgagccttggctgcgaggtaaccaattttgtatcaaaattttgaatccgtatatgcccagcgtggttgaaacactggagcagatgcagcggaagcacggcgggatgctcgtacgtaacccactttcgagaaattctacccatgagatgtactgggtgagttgcggaactggcaacatcgtctccgccgtgaatatgacaagccgcatgctgttaaacaggttcaccatggctcaccggaaacctacgtatgaaagagatgttgacctgggtgccgggacccgccacgtggcagtcgagcccgaagtggccaacttggatataattggacagaggatcgagaatatcaagcatgaacacaagtcaacatggcattacgacgaggataacccttataaaacttgggcttaccacggctcctatgaggtaaagccatctggcagcgcgagttccatggtgaatggggttgtcaaactcctgaccaagccctgggacgtgattcctatggtgacacaaatagccatgactgataccacaccatttggacagcagcgagtcttcaaagaaaaggttgacacccggactcccaaggcaaaaagaggtacggctcaaatcatggaggtgacagccaagtggctatggggctttcttagcaggaacaaaaagccgcgcatttgtacccgtgaagagttcactcggaaagtaagatctaatgcagccatcggggctgtgtttgtcgacgaaaaccagtggaactcagccaaggaggcggtggaggatgaaaggttctgggacctggttcatcgcgagcgagaactccacaagcagggaaaatgcgcaacctgcgtgtacaacatgatgggcaagcgggagaaaaagctgggtgaatttgggaaagccaagggaagtagagctatttggtacatgtggttgggcgccaggttcctggagttcgaggcactcggctttatgaatgaagatcactggttctcccgcgagaacagcctttctggggtcgaaggagagggtctgcataagttaggctatatcctgagagacatatcgaaaatccctgggggaaatatgtacgctgatgacacagccggctgggatacgcggattaccgaggacgatttgcagaacgaagctaggatcactgacattatggagccagaacacgccctcctggcaaagtcaatctttaaactaacatatcaaaataaggtggtacgtgttcagcgacccgcgaaaaacggtaccgtgatggatgtcataagccgcagagaccagcgggggtccggacaggtgggcacttacggccttaatacattcaccaacatggaggcccaactgattaggcagatggaaagtgaggggatcttttctcctagcgagctcgaaacaccaaacctggctgagcgcgtgttggattggttagaaaagtatggagtcgagagactgaaacggatggccatctccggtgacgactgtgttgtgaagcccattgatgacaggttcgcaactgctctcaccgcccttaatgatatgggcaaggtacgaaaagacataccgcagtgggaaccttcaaaggggtggaacgattggcagcaagtgcccttttgcagtcatcacttccaccagctgatcatgaaagacggacgtgagattgtcgtgccatgtagaaatcaggatgagctagttggccgcgcacgggtgtctcagggtgccgggtggagcctgagggaaacggcgtgcctcggaaagtcctacgctcaaatgtggcagttgatgtattttcatagacgcgacctgcggcttgccgcaaacgccatctgttcagctgtccctgtggattggattcccaccagcaggacaacttggtctatccacgcccatcaccagtggatgaccacagaggacatgctgtccgtatggaatcgagtttggatagaagagaacccatggatggaagataaaactcatatcagtagctggggcgacgtgccctacctcggcaagagagaggaccaatggtgcgggtcgttaattggactgaccgcacgggctacgtgggccacaaatatccaggtcgcgattaaccaggtgaggcgcttgatcggtaatgagaactacctggattatatgacctccatgaagcgtttcaaaaatgaatctgaccctgagggcgctctctggtga

SEQ ID NO: 13257 - RNA, 9879 nt, synthetic construct
  misc_feature 1..9879: note = derived and/or modified CDS sequence (opt3) from DENV-1__GU131888__SS-prME
  source 1..9879: mol_type = other RNA
agcgtgaccatgctgctcatgcttatgccaacagcactggctttccacttgactacgagaggaggggagcctcatatgatcgtctccaagcaagaaagaggaaaatctttactgtttaagacctcagccggtgttaatatgtgcacactgattgccatggacctcggcgagctgtgtgaagatactatgacctacaaatgcccacggataacagaggcggaaccggacgatgtggactgttggtgcaatgctaccgatacttgggtaacatatgggacctgtagtcaaacgggagagcaccgccgagacaagcgtagcgtggcccttgcaccccatgtcggcctgggtttggagactagaaccgaaacatggatgtcctctgagtcggcctggaaacagatccagagggtggaaacttgggctctccggcaccctgggttcaccgttattgcactgtttctggcccatgctatcggaacatcaattacccagaagggcatcatattcatcctcttaatgctggtgacgccaagcatggccatgcgctgcgtcggcattgggagtagagattttgtggagggactttccggtgcgacttgggtagacgttgtgttggagcacggctcttgtgtcacaaccatggcaaaggataaacccactctggacatcgaactactcaagacagaggtgaccaaccctgccattctgaggaaactttgcatcgaagctaagataagcaatacgaccacagattcccggtgtccaactcaaggggaggccaccctggtggaagaacaggacgcaaacttcgtctgccgccgaacatttgttgatagaggatggggcaatggttgtgggttgttcggaaaaggctcactcattacttgcgctaagtttaagtgcgtgaccaaactggagggcaagatcgtacagtacgaaaacttaaaatatagtgtgattgtcacagtgcacaccggggaccagcatcaagttggaaatgagagcactgaacacggtacgacagccaccatcactccccaggcgcctaccacagagatccagctgaccgactacggcgccctcactcttgattgttctccaaggacagggctggacttcaacgaaatggtgttgctaacgatgaaggagaaatcctggctggtccataagcagtggtttctcgatctgccgcttccctggacctcaggagcaagcacaagtcaagagacatggaatcggcaggacctgttggtgaccttcaaaacagctcacgccaagaagcaggaagtagttgtgctcggctctcaagagggtgctatgcacactgccctgaccggggcaacggaaattcagacctccggcacaactaccatatttgccggacatttaaaatgccgtctgaagatggataaactaacactcaagggcatgagctatgtcatgtgtactgggtcgttcaaactggagaaggaagtggctgagacccagcacggaacggtccttgtgcagatcaagtacgagggtacagacgcgccttgcaaaattccattcttgacccaagatgaaaagggcgttactcagaacgggcgcctgatcacagcaaatcccatagtgaccgacaaagagaagcctgtaaacattgaagccgagccaccctttggagagtcttatatcgtcatcggcgctggtgaaaaagccctcaagctgtcctggttcaagaaagggtcaagtattggcaagatgtttgaggcaactgccagaggagctaggcggatggccatccttggcgataccgggtgggacttcggaagcattggtggcgtgtttacatccgttgggaaactggtgcatcagatattcggaacggcatacggcgtcttgttttctggtgtgagctggaccatgaagatcgggattggcgtactcctgacttggttaggactaaattcacgaagtacatccctaagcatgacctgtatcgcggtgggcctcgttacactgtaccttggggtcatggtgcaggctgattctggatgcgtgatcaactggaaaggccgcgaattgaagtgtggttcagggattttcgtcactaatgaggttcacacctggacggaacaatataagtttcaggccgacagtccgaaaagactgagcgcagccataggaaaggcttgggaggagggcgtgtgcggtatcaggtccgccacacggctcgaaaacattatgtggaaacagatctctaacgagctgaatcatattttactggaaaacgacatgaagttcaccgtggtagtcggcgatgtggcagggatccttgctcagggcaagaagatgatacgccctcaacccatggagtacaaatattcgtggaaaagctggggcaaggccaaaatcattggggcggacgttcagaatactacctttatcattgatggaccaaacacacctgaatgtcccgacgatcagagagcctggaatatctgggaggtggaggactacggcttcggtatatttactaccaacatttggttgaagctcagggattcctatacacaggtctgcgaccaccgtctgatgtcagctgcaatcaaagatagtaaggccgtgcacgctgacatggggtactggattgaatctgagaaaaatgaaacgtggaagctagcccgggccagcttcatcgaggttaagacctgtatatggccaaaatcccatactctgtggtcaaacggagtgctcgaaagcgagatgatcattcccaagatctatggcggtcctatttctcaacacaattaccgaccaggctacttcacacagaccgcggggccgtggcatctgggaaaacttgagttggattttgacctgtgcgaaggcactacagtagtcgtggatgagcactgcgggaacagaggaccctccttaaggaccacgactgtgaccggcaagatcatacacgaatggtgttgccgcagttgtacactccctccactgcggttcagaggtgaggacgggtgctggtatggaatggagattaggcccgtcaaagaaaaggaggaaaatcttgttaagagcatggtgtctgccggctccggtgaggtagactcatttagtctgggcttgctctgtatcagcatcatgattgaagaggtgatgcgctcgcgatggtcccggaaaatgctgatgaccgggactctagctgtcttcctgctcctgatcatgggacagcttacatggaacgatttgattcgtctgtgcataatggtgggcgccaatgcatctgacagaatggggatgggaaccacatacttagctctcatggccacttttaagatgaggcctatgttcgcagttggcctgctttttcgccggctgaccagcagagaggtgctactcctgacgatcggtttgtcactggtcgccagtgtggaattaccaaactccctcgaggaactgggggatggacttgctatgggcattatgatcctgaaattgctcacagacttccaatctcatcagctgtgggcgaccctactgagccttacttttattaagaccacattctccctccactatgcctggaaaactatggcaatggttctgtcaatcgtgagcttgtttcccctgtgtttaagtaccacgtctcagaagacaacctggctcccggtcctgcttggctccctggggtgcaagcctttgactatgttcctcatagctgagaataaaatctggggaaggcgaagctggccactgaacgaaggtattatggccgtaggcatcgtgtcgattctactgtcatctcttctcaagaacgatgttcccctggccgggcctttgatcgctggaggcatgttaatagcatgttacgtgattagtggttccagcgccgacctgtctctcgagaaagcggctgaggtcagctgggaagaggaagccgagcattccggggcatcacacaatatcctggtggaagtacaggatgacggacccatgaagatcaaagatgaggagcgcgacgatacacttaccattctgttgaaggccactctactggctgtgagtggcgtctatccactcagcatacctgcaacactgtttgtttggtacttctggcagaaaaagaagcagcggtctggcgtgctttgggacaccccctccccaccggaagtggagagagccgtcttagatgacgggatctataggattatgcagcgtggactgctcggtcgctcacaggtgggcgttggggtattccaagaaaacgtgtttcatacgatgtggcacgtcactcggggagcggtgttgatgtaccagggcaaaagactggagcctagttgggctagcgttaagaaagacctcatctcctacggtgggggatggaggctgcagggctcttggaataccggcgaggaagtgcaggtcattgccgtggagcccgggaagaaccccaaaaatgtacaaacagcacccggaaccttcaagacacctgaaggtgaggtcggcgccatcgctcttgattttaagccagggacttcgggaagccccatagtgaaccgagaaggcaaaatcgttggtctgtatgggaatggagtggtcaccacgtcaggcacatacgtgtccgccattgcacaggctaaggccagtcaggagggccctttgccggagatcgaagacgaggttttccggaaacgcaacctaactattatggatctgcacccagggtctggaaagaccagaaggtatctccccgcgatcgtgcgggaagccataaaacgaaagttaagaacactgattcttgcacctacccgcgtcgtggctagcgagatggccgaagctctgaagggtatgccaatcaggtaccaaactaccgcagtaaaatccgagcatacaggcaaggagatcgtggacctcatgtgccacgccacgtttactatgcgtttgctgtcacccgttcgggtccctaattataacatgattatcatggatgaagcccatttcaccgacccgtctagcatagctgcgagagggtacattagtacaagggtgggaatgggcgaggcagccgctatctttatgaccgccactcccccaggttccgtggaagcattccctcagagcaatgccctcattcaggatgaggaacgcgacatccccgagcgatcttggaactcagggtatgagtggataacagattttccaggaaaaaccgtctggttcgtaccttccattaagagtggcaatgacatcgctaactgtctgaggaaaaatggcaagcgggtgatccagcttagcaggaagacgtttgatactgaataccaaaagactaagaacaacgactgggactacgttgtgaccaccgatatttcggagatgggggcgaatttccgcgccgaccgtgtcatcgatcccagacggtgcctaaaaccagtgattctgaaggacggaccggaaagggttatattggcaggtcctatgcccgtgactgtcgcttctgccgcacagcgccgaggcagaatcgggcggaaccacaataaagagggagatcagtatatttacatgggccagccattaaacaatgacgaggatcatgcccactggacagaagctaagatgctgctcgacaacatcaatacccccgagggtatcattcctgccctgttcgaaccagagagggaaaagtccgcggcaatagatggggagtatcgccttagaggcgaggccaggaaaacatttgtggaactgatgcggcgtggagacctccccgtatggttgagctacaaggtggcttcagagggcttccaatatagtgatcgccgatggtgctttgacggggaaagaaacaatcaggttctggaggaaaacatggatgtcgagatctggactaaagagggagaaaggaagaaactacggcctcgctggctggacgccagaacgtactctgacccgctcgctcttagggagttcaaggaatttgcagccggtcggcgatccgtgagcggcgatctgattttagagatcgggaaattgccacagcacctgacccagagagctcaaaatgccctcgacaacctggtgatgcttcataattcagaacagggaggccgcgcatataggcacgcgatggaggagctgcccgatacaattgaaactctcatgttgctggccttaatcgctgtcctaaccggtggggttacactgttctttctcagtggccggggacttggcaagaccagcatagggctgttgtgtgtgatggcctcctctgtactgctctggatggcaagcgtggagcctcattggatcgctgcctccattatcctggagttctttcttatggtcctcctgattcccgagccagaccgtcagagaactcctcaggataaccaattggcatacgtggttatcggactgttattcatgatactaacggtggccgctaatgagatgggtctgctcgaaaccacaaagaaagaccttggcattgggcacgtcgcggtaggaaaccaccatcacgccgcaatgctggatgtggacttgcatcccgcttcagcctggactctgtacgccgttgcaaccacaatcattaccccaatgatgaggcacactatcgagaacacaacggctaatatatctctcaccgccatcgcgaaccaggctgccattctgatgggccttgataagggttggcctatcagtaaaatggacattggggtgccgttactggcactcggctgctattcgcaggtcaatcccttgactctgacagccgctgtgctaatgctggtcgcacattacgccatcataggaccaggcctccaagcgaaggctacccgcgaagcccagaaacggaccgcagccgggattatgaagaaccctacagtggatggaatcgttgctatcgaccttgatcccgtggtatatgacgccaagtttgagaaacagctgggccagattatgttgctgatcctctgtactagccaaatactgttaatgcgaacgacctgggcactttgcgaatccattacactggctactggtccactcaccacactatgggaggggtctcctggaaagttctggaataccactatcgccgtgtcaatggcgaacatttttagaggcagctacctggccggtgcaggcttggctttctccctgatgaaaagtctcgggggaggcaggcgcgggacgggagcccagggcgagacacttggtgaaaagtggaaacggcagctgaatcagttgtctaagagcgagttcaacacctataagagatcagggatcatggaagtcgaccgttccgaggcaaaagaaggactgaagaggggcgagactaccaaacacgctgttagtcggggtacagccaagctccgctggtttgtggagcgaaatttagtcaaacccgaaggcaaggtgatagatctggggtgtggaagaggcgggtggagctactattgcgccggacttaagaaagtaactgaggtgaagggctacaccaaaggtgggccgggacacgaagaaccaatccctatggcgacatacggctggaacctggttaagctacattctggcaaagacgtgttctttattcccccagaaaagtgtgatacgctcctgtgcgacatcggggagtcctcacccaatcctaccattgaggaaggaaggactttgcgggtcctgaaaatggtggagccgtggctccgcggtaaccaattctgtatcaagattcttaatccctatatgccaagcgtcgtggaaacactggagcagatgcagagaaagcacggcgggatgttagttaggaaccctctgtcgcgaaattctacccatgagatgtactgggtaagttgcggaactggcaacatcgtgtccgctgtcaatatgacaagccggatgttgctcaaccgttttaccatggcacacagaaaacccacgtatgaacgcgatgtggacctgggtgccgggaccaggcacgttgctgtggagcctgaagtcgccaacctagatataattggacagcggatcgagaatatcaagcatgaacacaaatcaacatggcattacgacgaggataacccatataagacttgggcataccacggctcctatgaggtgaaaccctctggcagcgccagttccatggtaaatggggtggttaaacttctgaccaagccttgggacgtcattccaatggtgacacaaatagctatgactgataccacacccttcggacagcagagagtgtttaaagaaaaggtcgacacccgcactccgaaagcgaagaggggtacggcccaaatcatggaggttacagcaaaatggctctggggcttcctgagccgaaacaagaagcctcggatttgtaccagagaagagtttactaggaaagtgcgctctaatgctgccatcggggcagtattcgtggacgaaaaccagtggaactcagccaaggaggctgtcgaggatgaacgtttttgggacttggtgcatcgggagagagaactgcacaaacagggaaagtgcgcaacctgcgtttacaacatgatgggcaaaagggagaagaagctcggtgagttcgggaaagcgaagggaagtcgcgcaatttggtacatgtggcttggcgcccgatttctggagttcgaggctttaggcttcatgaatgaagatcactggttttcccgggagaacagcctgtctggggtggaaggagagggtttgcataaactcggctatatcctgagagacatatcgaagatcccagggggaaatatgtacgccgatgacacagcaggctgggatacgaggattaccgaggacgatctacagaacgaagctcgcatcactgacattatggagcccgaacacgcccttctggctaaatcaatcttcaagctcacatatcaaaataaagtcgtgagagtacagcggcctgccaagaacggtaccgttatggatgtgataagcaggcgtgaccagcgagggtccggacaggtcggcacttacggcctgaatacatttaccaacatggaggcacaattgattcgccagatggaaagtgaggggatcttctctccaagcgagttagaaacacccaacctggcggagagagtgctcgattggcttgaaaagtatggagtggagcggctgaaaaggatggccatctccggtgacgactgtgtcgttaagccgattgatgaccgctttgctactgccctaaccgcactgaatgatatgggcaaagtgagaaaggacatacctcagtgggaaccctcaaaagggtggaacgattggcagcaagtaccattctgcagtcatcactttcaccagctcatcatgaaggacggacgggagattgtggtcccttgtaggaatcaggatgagttggtgggccgagctcgtgtttctcagggtgccgggtggagcctgagagaaacggcatgccttggaaagtcctacgcccaaatgtggcagctgatgtatttccatcgccgggacctcaggttagcggctaacgccatctgttcagcagtgcccgtcgattggattccaaccagcagaacaacttggtctatccacgcccatcaccagtggatgaccacagaggacatgctgtccgtgtggaatcgcgtatggatagaagagaacccctggatggaagataaaactcatatcagtagctggggcgacgttccttacttgggcaagcgggaggaccaatggtgcgggtcgctgattggactcaccgctagggccacgtgggcaacaaatatccaggtggctattaaccaggtccgaagacttatcggtaatgagaactacctggattatatgacctccatgaaacggtttaagaatgaatctgacccagagggcgccctatggtga

SEQ ID NO: 13258 - RNA, 9879 nt, synthetic construct
  misc_feature 1..9879: note = derived and/or modified CDS sequence (opt3) from DENV-1__GU131892__SS-prME
  source 1..9879: mol_type = other RNA
agcgtgaccatgctgctcatgcttatgcccacagcactggctttccacttgactacgagaggaggggagcctcatatgatcgtctccaagcaagaaagaggaaaatctttactgtttaagacctcagccggtgttaatatgtgcacattgattgccatggacctcggcgagctgtgtgaagatactatgacctacaaatgcccacggataacagaggcggaaccggacgatgtggactgttggtgcaatgctaccgatacttgggtgacatatgggacctgtagtcaaacgggagagcaccgccgagacaagcgtagcgtggcccttgcaccccatgtcggcctgggtttggagactagaaccgaaacatggatgtcctctgagggggcctggaaacagatccagagggtggaaacttgggctctccggcaccctggattcaccgttattgcactgtttctggcccatgctatcggcacatcgattacccagaagggcatcatattcatcctcttaatgctggtgacgccatcaatggccatgcgctgcgtcgggattggaagcagagattttgtggagggtcttagtggcgcgacttgggtagacgttgtgttggagcacgggtcctgtgtcacaaccatggcaaaggataaacccactctggacatcgaactactcaagacagaggtgaccaaccctgccattctgaggaaactttgcatcgaagctaagatatctaatacgaccacagatagccggtgtccaactcaaggagaggccaccctggtggaagaacaagacgcaaacttcgtctgccgccgaacatttgttgatagaggctggggtaatgggtgtggattgttcggcaaaggctccctcattacttgcgctaagtttaagtgcgtgaccaaactggaggggaagatcgtacagtacgaaaacttaaaatattcagtgattgtcacagtgcacaccggagaccagcatcaagttggtaatgagagtactgaacacggcacgacagccaccatcactccccaggcgcctaccacagagatccagctgaccgactacggggccctcactcttgattgtagcccaaggacaggactggacttcaacgaaatggtgttgctaacgatgaaggagaaatcttggctggtccataagcagtggtttctcgatctgccgcttccctggacctccggcgcatcaactagccaagagacatggaatcggcaggacctgttggtgaccttcaaaacagctcacgccaagaagcaggaagtagttgtgctcggtagtcaagagggggctatgcacactgccctgaccggcgcaacggaaattcagacctctggaacaactaccatatttgccggccatttaaaatgccgtctgaagatggataaactaacactcaaggggatgtcctatgtcatgtgtactggtagcttcaaactggagaaggaagtggctgagacccagcacggaacggtccttgtgcagatcaagtacgagggcacagacgcgccttgcaaaattccattctcgacccaagatgaaaagggggttactcagaacggacgcttgatcacagcaaatcccatagtgaccgacaaagagaagcctgtaaacattgaagccgagccaccctttggcgagtcttatatcgtcatcggtgctggggaaaaagccctgaagctctcctggttcaagaaaggctcaagtattggaaagatgtttgaggcaactgccagaggcgctaggcggatggccatcctgggggataccgcatgggacttcggaagcattggtggcgtgtttacatccgttgggaaacttgtgcatcagatattcggaacggcgtacggcgtcctgttttctggtgtgagctggaccatgaagatcgggattggcgtattgctcacttggctgggattaaattcacgaagtacatccctgagcatgacctgtatcgctgtgggcctagttacactctacctgggggtcatggtgcaggccgattctggatgcgtgatcaactggaaaggccgcgaacttaagtgtggttcagggattttcgtcactaatgaggttcacacctggacggaacaatataagtttcaggcagacagtccgaaaagattgagcgccgctataggaaaggcctgggaggagggcgtgtgcggtatcaggtccgcaacacggctggaaaacattatgtggaaacagatctctaacgagctcaatcatattctgttagaaaacgacatgaagttcaccgtggtagtcggcgatgtggctgggatcctggttcagggcaagaagatgatacgccctcaacccatggagtacaaatattcgtggaaaagctggggcaaggccaagatcattggggcggacgtgcagaatactacctttatcattgatggaccaaacacacctgaatgtcccgacgatcagagagcctggaatatctgggaggtcgaggactacggcttcggtatatttactaccaacatttggcttaagttgagggattcctatacacaggtgtgcgaccaccgtctcatgtcagctgcaatcaaagatagtaaggccgttcacgctgacatggggtactggattgaatctgagaaaaatgaaacgtggaagctggcccgggcatccttcatcgaggtgaagacctgtatatggccaaaatcccatactctatggtcaaacggagtactggaaagcgagatgatcattcccaagatctatggcggtcctatttctcaacacaattaccgaccaggctacttcacacagaccgcggggccgtggcatctcggaaaactggagcttgattttgacttgtgcgaaggcactacagtcgtggtggatgagcactgcgggaacagaggaccctccctgaggaccacgactgtcaccggcaagatcatacacgaatggtgttgccgcagttgtacattacctccactccggttcagaggtgaggacgggtgctggtatggaatggagattaggcccgttaaagaaaaggaggaaaatctggtaaagagcatggtatctgccggctccggtgaggtggactcatttagtcttggcctgttgtgtatcagcatcatgattgaagaggtcatgcgctcgcgatggtcccggaaaatgctcatgaccgggactctggctgtgttcctactgctcatcatgggacagctgacatggaacgatcttattcgtttgtgcataatggttggcgccaatgcatctgacagaatggggatgggaaccacatacctggctttaatggccacttttaagatgaggcctatgttcgcagtgggcctcctgtttcgccggcttaccagcagagaggtcctgctactcacgatcggtctgtcattggtggccagtgttgaactgccaaactccttagaggaactcggggatggactggctatgggcattatgatccttaaactgttgacagacttccaatctcatcagctctgggcgaccctgctaagcctgacttttattaagaccacattctcccttcactatgcctggaaaactatggcaatggtgctctcaatcgtcagcctgtttcccttgtgtctgagtaccacgtctcagaagacaacctggttaccggtactcctgggctcccttgggtgcaagcctctgactatgttcttgatagctgagaataaaatctggggaaggcgaagctggccactcaacgaaggtattatggccgtgggcatcgtttcgattctgctatcatctctgcttaagaacgatgtgcccctcgccgggcctctgatcgctggaggcatgttgatagcatgttacgtcattagtggttccagcgccgacttatctctggagaaagcggctgaggtgagctgggaagaggaagccgagcattccggggcatcacacaatatcctcgtagaagtgcaggatgacggaacaatgaagatcaaagatgaggagcgcgacgataccctgactattcttctgaaggccacattgctagctgtcagtggcgtttatcccctgagcataccagcaaccctctttgtgtggtacttctggcagaagaagaagcagcggtctggcgtgctgtgggacacgccttcacccccagaagtcgagagagccgtgcttgatgacgggatctataggattatgcagcgtggattactgggtcgcagccaggttggcgtaggggtgttccaagaaaacgtctttcatactatgtggcacgtgacccggggagcggttctcatgtaccagggcaaaagattggagccgagttgggctagcgtgaagaaagacctgatctcctacggtgggggatggaggctccagggctcttggaatacaggcgaggaagtccaggtgattgccgtagagcctgggaagaaccccaaaaatgtccaaaccgcaccaggaacattcaagactcccgaaggtgaggtgggcgccatcgctctggattttaagcctgggacctcgggaagcccaatagttaaccgagaaggcaaaatcgtgggtctttatgggaatggagtcgtgacgacatcaggcacttacgtttccgccattgcacaggctaaggccagtcaggagggccccctgcctgagatcgaagacgaggtgttccggaaacgcaacttgaccattatggatctacacccggggtctggaaagacaagaaggtatctgccagcgatcgtccgggaagccataaaacgaaagctcagaaccttaattctggcacccactcgcgtggtagctagcgagatggccgaagctcttaagggtatgcctatcaggtaccaaaccacagcagtgaaatccgagcatacgggcaaggagatcgttgacctgatgtgccacgccacttttaccatgcgtctcttgtcaccagtccgggtgcccaattataacatgattatcatggatgaagcccatttcacagacccttctagcatagctgcgagagggtacattagtaccagggtgggaatgggcgaggcagccgctatctttatgactgccacaccgcccggttccgtcgaagcattcccacagagcaatgccgtaattcaggatgaggaacgcgacatccctgagcgatcttggaactcagggtatgagtggataaccgattttcccggaaaaacggtgtggttcgttccatccattaagagtggcaatgacatcgctaactgtctgaggaaaaatggcaagcgggtgatccagctcagcaggaagacttttgatacagaataccagaaaaccaagaacaacgactgggactacgtcgtgaccactgatatttcggagatgggggcgaatttccgcgccgaccgtgttatcgatcctagacggtgcctgaaacccgtgattcttaaggacggaccagaaagggtcatactagcaggtccgatgcctgtgacagtagcttctgccgcacagcgccgaggcagaatcgggcggaaccacaataaagagggagatcagtatatttacatgggccagcccctgaacaatgacgaggatcatgcccactggaccgaagctaagatgttgttagacaacatcaatacaccagagggtatcattcccgccctgttcgaacctgagagggaaaagtccgcggcaatagatggggagtatcgcctcagaggcgaggccaggaaaacttttgtggaactgatgcggcgtggagaccttccagtttggctgagctacaaggtcgcttcagagggcttccaatatagtgatcgccgatggtgctttgacggggaaagaaacaatcaggtgctcgaggaaaacatggatgtggagatctggacgaaagagggagaaaggaagaaattgcggccccgctggctggacgccagaacctactctgaccctctagctctgagggagttcaaggaatttgcagccggtcggcgatccgtcagcggcgatctcattcttgagatcgggaaactgccgcagcacttaacacagagagctcaaaatgccttggacaacctggttatgctccataattcagaacagggaggccgcgcatataggcacgcgatggaggagctgccagatactattgaaacccttatgctgctcgccttgatcgctgtgctgacaggtggggtaaccttattctttctaagtggccggggactgggcaagactagcatagggctcctttgtgtgatggcctcctctgtcctgttgtggatggcaagcgtggagccccattggatcgctgcctccattatcctggagttctttctcatggttctgcttattcctgagcccgaccgtcagagaacgccacaggataaccaactcgcatacgtggtcatcggactgttgttcatgatactgaccgtagccgctaatgagatgggtttactagaaacaactaagaaagacctgggcattgggcacgtggcggttggaaaccaccatcacgccgcaatgctcgatgtggaccttcatcctgcttcagcctggaccctgtacgccgtcgcaacaaccatcattactcccatgatgaggcacacaatcgagaacacgaccgctaatatatctttgactgccatcgcgaaccaggctgccattctgatgggcctcgataagggttggccaatcagtaaaatggacattggggtgcctctgcttgcattaggctgctattcgcaggtcaatccgctgacactcaccgccgctgtgttgatgctggttgcacattacgccatcataggacccggcctacaagcgaaggctacccgcgaagcccagaaacggacagcagccgggattatgaagaacccaactgtggatggaatcgtagctatcgacctggatcctgtggtctatgacgccaagtttgagaaacagctcggccagattatgcttctgatcttgtgtacgagccaaatactgctcatgcgaaccacatgggcactgtgcgaatccattactttagctaccggtccccttacaaccctgtgggaggggtctccaggaaagttctggaatactacgatcgccgtttcaatggcgaacatttttagaggcagctacctcgccggtgcaggcctagctttctccctgatgaaaagtctagggggaggcaggcgcgggacaggagcccagggcgagaccctgggtgaaaagtggaaacggcagctcaatcagctttctaagagcgagttcaacacttataagagatcagggatcatggaagtggaccgttccgaggcaaaagaaggactgaagaggggcgagaccacaaaacacgctgtcagtcggggtactgccaagttgcgctggtttgtggagcgaaatctggtaaaacctgaaggcaaggtgatagatctcgggtgtggaagaggcgggtggagctactattgcgccggattaaagaaagttaccgaggtgaagggctacacaaaaggtgggcccggacacgaagaaccgatcccaatggcgacgtacggctggaacctggtcaaacttcattctggcaaagacgtgttctttattcctcccgaaaagtgtgataccctgctatgcgacatcggggagtcctcaccaaatcccactattgaggaaggaaggacactccgggtcctgaaaatggtggagccttggttgcgcggtaaccaattctgtatcaagattctgaatccgtatatgcccagcgttgtagaaaccctcgagcagatgcagagaaagcacggcgggatgcttgtgaggaacccactgtcgcgaaattctactcatgagatgtactgggtcagttgcggaacaggcaacatcgtgtccgctgttaatatgaccagccggatgttactgaaccgttttacgatggcacacagaaaacctacctatgaacgcgatgtggacttgggtgccgggacaaggcacgtcgctgtggagcccgaagtagccaacctcgatataattggacagcggatcgagaatatcaagcatgaacacaaatcaacttggcattacgacgaggataacccttataagacctgggcataccacggctcctatgaggtgaaaccatctggcagcgccagttccatggttaatggggtcgtgaagctgctaacaaagccctgggacgtgattcctatggtcactcaaatagctatgaccgatacaaccccattcggacagcagagagtttttaaagaaaaggtggacactcgcacgcccaaagcgaagaggggtacagcccaaatcatggaggtaaccgcaaaatggctttggggcttcctgagccgaaacaagaagccgcggatttgtactagagaagagtttaccaggaaagtgcgctctaatgctgccatcggggcagtcttcgtggacgaaaaccagtggaactcagccaaggaggctgttgaggatgaacgtttttgggacctcgtgcatcgggagagagaactgcacaaacagggaaagtgcgccacatgcgtctacaacatgatgggcaaaagggagaagaagttgggtgagttcgggaaagcgaagggaagtcgcgcaatttggtacatgtggctgggcgcccgatttctcgagttcgaggctcttggcttcatgaatgaagatcactggttttcccgggagaacagcctgtctggggtggaaggagagggtttacataaactgggctatatcttgagagacatatcgaagatccctgggggaaatatgtacgccgatgacacggcaggctgggataccaggattactgaggacgatctccagaacgaagctcgcatcacagacattatggagccagaacacgccctgctagctaaatcaatcttcaaacttacctatcaaaataaagtagttagagtgcagcggcccgccaagaacggtactgtcatggatgtgataagcaggcgtgaccagcgagggtccggacaggtgggcacatacggcctgaatacctttacaaacatggaggcacaactcattcgccagatggaaagtgaggggatcttctctcctagcgagctggaaactccaaacttggcggagagagtcttagattggctggaaaagtatggagttgagcggctcaaaaggatggccatctccggtgacgactgtgtggtaaagcccattgatgaccgctttgctaccgcccttacggcactgaatgatatgggcaaagtgagaaaggacataccgcagtgggaaccttcaaaagggtggaacgattggcagcaagtccccttctgcagtcatcactttcaccagctaatcatgaaggacggacgggagattgtggttccatgtaggaatcaggatgagctggtgggccgagctcgtgtctctcagggtgccgggtggagcctcagagaaaccgcatgcttgggaaagtcctacgcccaaatgtggcagctgatgtatttccatcgccgggaccttaggctggcggctaacgccatctgttcagcagtgcctgtagattggattcccacaagcagaactacctggtctatccacgcccatcaccagtggatgacaactgaggacatgctctccgtttggaatcgcgtgtggatagaagagaacccatggatggaagataaaacccatatcagtagctggggcgacgtcccctacttaggcaagcgggaggaccaatggtgcgggtcgctgattggattgacggctagggccacatgggcaaccaatatccaggtggctattaaccaggttcgaagactgatcggtaatgagaactacctcgattatatgacttccatgaaacggtttaagaatgaatctgaccctgagggcgccctttggtga

SEQ ID NO: 13259 - RNA, 9879 nt, synthetic construct
  misc_feature 1..9879: note = derived and/or modified CDS sequence (opt3) from DENV-1__GU131893__SS-prME
  source 1..9879: mol_type = other RNA
tccgtgaccatgctgctcatgcttatgcccacagcactggctttccacttgactacgagaggaggggagcctcatatgatcgtctccaagcaagaaagaggaaaatctttactgtttaagacctcagccggtgttaacatgtgcacactgattgccatggacctcggcgagctgtgtgaagatactatgacctacaaatgcccacggataacagaggcggaaccggacgatgtggactgttggtgcaatgctaccgatacttgggtaacatatgggacctgtagtcaaacgggagagcaccgccgagacaagcgtagcgtggcccttgcaccccatgtcggcctgggtttggagactagaaccgaaacatggatgtcctctgagggggcctggaaacagatccagagggtggaaacttgggctctccggcaccctggattcaccgttattgcactgtttctggcccatgctatcggcacatcgattacccagaagggcatcatattcatcctcttaatgctggtgacgccatcaatggccatgcgctgcgtcgggattggaagcagagattttgtggagggtcttagtggcgcgacttgggtagacgttgtgttggagcacgggtcctgtgtcacaaccatggcaaaggataaacccactctggacatcgaactgctcaagacagaggtgaccaaccctgccattctgaggaaactttgcatcgaagctaagatatctaatacgaccacagatagccggtgtccaactcaaggagaggccaccctggtggaagaacaagacgcaaacttcgtctgccgccgaacatttgttgatagaggctggggtaatgggtgtggattgttcggcaaaggctccctcatgacttgcgctaagtttaagtgcgtgaccaaactggaggggaagattgtacagtacgaaaacttaaaatattcagtgatcgtcacagtgcacaccggagaccagcatcaagttggtaatgagagtactgaacacggcacgacagccaccattactccccaggcgcctaccacagagatccagctgaccgactacggggccctcactcttgattgtagcccaaggacaggactggacttcaacgaaatggtgttgctaacgatgaaggagaaatcttggctggtccataagcagtggtttctcgatctgccgcttccctggacctccggcgcatcaactagccaagagacatggaatcggcaggacctgttggtgaccttcaaaacagctcacgccaagaagcaggaagtagttgtgctcggtagtcaagagggggctatgcacactgccctgaccggcgcaacggaaatccagacctctggaacaactaccatttttgccggccatttaaaatgccgtctgaagatggataaactaacactcaaggggatgtcctatgtcatgtgtactggtagcttcaaactggagaaggaagtggctgagacccagcacggaacggtccttgtgcagataaagtacgagggcacagacgcgccttgcaaaatcccattctcgacccaagatgaaaagggggcaactcagaacggacgcttgattacagccaatcccatcgttaccgacaaagagaagcctgtgaacatagaagctgagccaccctttggcgagtcttatattgtaatcggtgccggggaaaaagcactgaagctctcctggttcaagaaaggctcaagtatcggaaagatgtttgaggccactgctagaggcgccaggcggatggcaattctgggggataccgcgtgggacttcggaagcatcggtggcgtctttacatccgtggggaaacttgttcatcagattttcggaacggcttacggcgtgctgttttctggtgtcagctggaccatgaagatagggttgggcgtgctcctgacttggttaggactaaattcacgaagtacatccctaagcatgacctgtatcgccgtaggcctcgtgacactgtaccttggggttatggtccaggcagattctggatgcgtgattaactggaaaggccgcgaattgaagtgtggttcagggatcttcgtgactaatgaggtccacacctggacggaacaatataagtttcaggccgacagtccgaaaagactgagcgctgccatcggaaaggcatgggaggagggcgtttgcggtattaggtccgctacacggctcgaaaacataatgtggaaacagatctctaacgagctgaatcatattttactggaaaacgacatgaagttcaccgtggtggtaggcgatgtcgccgggatccttgcgcagggcaaaaagatgattcgccctcaacccatggagtacaaatattcgtggaaaagctggggcaaggccaagatcataggggctgacgtgcagaatactacctttatcattgatggaccaaacacacctgaatgtcccgacgatcagagagcatggaatatctgggaggttgaggactacggcttcggtatttttactaccaacatctggttgaagctcagggattcccacacacaggtgtgcgaccaccgtctgatgtcagccgctataaaagatagtaaggccgtccatgcagacatggggtattggattgaatctgagaaaaatgaaacgtggaagctagcgcgggccagcttcatcgaggtgaagacctgtatttggccaaaatcccacactctgtggtcaaacggagttctcgaaagcgagatgatcatacccaagatctacggcggtcctatttctcaacataattatcgaccaggctacttcacacagaccgctgggccgtggcacctgggaaaacttgagttggattttgacctgtgcgaaggcactacagtggtagtcgatgagcactgcgggaacagaggaccctccttaaggaccacgactgtgaccggcaagatcattcatgaatggtgttgccgcagttgtacactccctccactgcggttcagaggtgaggacgggtgctggtacggaatggagatcaggcccgtgaaagaaaaggaggaaaatcttgtcaagagcatggtttctgccggctccggtgaggtggactcatttagtctgggcttgctctgtataagcattatgatcgaagaggtaatgcgctcgcgatggtcccggaaaatgctgatgaccgggactctagcagtgttcctgctcctgatcatgggacagcttacatggaacgatttgattcgtctgtgcatcatggtcggcgctaatgcctctgacagaatggggatgggaaccacatatttagcactcatggccacttttaagatgaggcctatgttcgctgtgggcctgctttttcgccggctgaccagcagagaggttctactcctgacgattggtttgtcactggtggcgagtgtcgaattaccaaactccctcgaggaactgggggatggacttgccatgggcataatgatcctgaaattgctcacagacttccaatctcaccagctgtgggcaaccctactgagccttacttttattaagaccacattctccctccattacgcttggaaaactatggccatggtgctgtcaatcgttagcttgtttcccctgtgtttaagtaccacgtctcagaagacaacctggctcccggtgctgcttggctccctggggtgcaagcctttgactatgttcctcattgccgagaataaaatctggggaaggcgaagctggccactgaacgaaggtataatggctgtcggcatcgtatcgattctactgtcatctcttctcaagaacgatgtgcccctggcagggcctttgatcgccggaggcatgttaattgcgtgttatgttatcagtggttccagcgctgacctgtctctcgagaaagccgcagaggtgagctgggaagaggaagccgagcactccggggcttcacataatatactggtcgaagtgcaggatgacggaacaatgaagattaaagatgaggagcgcgacgatacccttactatcctgttgaaggcaacactactggccgtaagtggcgtgtaccccctcagcatcccagcgaccctgtttgtctggtatttctggcagaaaaagaagcagcggtctggcgttctttgggacacgccttcacccccagaagtggagagagctgtgttagatgacgggatttacaggataatgcagcgtggactgctcggtcgcagccaggtcggcgtgggggttttccaagaaaacgtatttcacactatgtggcacgtgacccggggagccgtcttgatgtatcagggcaaaagactggagccgagttgggcaagcgtgaagaaagacctcatctcctacggtgggggatggaggctgcagggctcttggaatacaggcgaggaagttcaggtgattgccgtcgagcctgggaagaaccccaaaaatgtgcaaaccgctccaggaacattcaagactcccgaaggtgaggtaggcgccatcgcacttgattttaagcctgggacctcgggaagcccaattgtcaaccgagaaggcaaaatcgtgggtctgtacgggaatggagttgtgacgacatcaggcacttatgtctccgctatagcccaggcgaaggccagtcaggagggccccttgcctgagatcgaagacgaggtgttccggaaacgcaacctaaccattatggatctgcatccggggtctggaaagacaagaaggtacctcccagcaatcgttcgggaagctattaaacgaaagttaagaaccctgatccttgcccccactcgcgtggtcgctagcgagatggcagaagccctgaagggtatgcctataaggtatcaaaccacagccgtgaaatccgagcacacgggcaaggagattgtagacctcatgtgccatgctacttttaccatgcgtttgctgtcaccagtgcgggttcccaattacaacatgatcatcatggatgaagcgcacttcacagacccttctagcattgcagccagagggtatatcagtaccagggtcggaatgggcgaggctgccgcaatatttatgactgccacaccgcccggttccgtggaggctttcccacagagcaatgcggtgattcaggatgaggaacgcgacatccctgagcgatcttggaactcagggtacgagtggattaccgattttcccggaaaaacggtctggttcgtaccatccatcaagagtggcaatgacatagccaactgtctcaggaaaaatggcaagcgggtgattcagctgagcaggaagacttttgatacagaatatcagaaaaccaagaacaacgactgggactacgttgtgaccactgatatctcggagatgggggcaaatttccgcgctgaccgtgtcatcgatcctagacggtgccttaaacccgtgattctaaaggacggaccagaaagggttatcctggccggtccgatgcctgtgacagtcgcatctgccgctcagcgccgaggcagaattgggcggtcccataacaaagagggagatcagtacatatatatgggccagcccttgaataacgacgaggatcacgcccactggaccgaagcgaagatgttactggacaatatcaacacaccagagggtattatccccgcactcttcgaacctgagagggaaaagagcgccgctatcgatggggagtaccgcctgagaggcgaggccaggaaaacttttgtggaacttatgcggcgtggagacctgccagtatggctctcatataaggtggctagtgagggcttccaatactctgatcgccgatggtgctttgacggggaaagaaataaccaggttttggaggaaaatatggatgtcgagatttggacgaaagagggagaaaggaagaaactgcggccccgctggctagacgcaagaacctattccgaccctctggccctcagggagttcaaggaatttgctgccggtcggcgaagcgtgtcaggcgatcttatactggagatcgggaaattaccgcagcatttgacacagagagcacaaaacgcgctggacaatctcgtgatgctgcacaacagtgaacagggaggccgcgcctacaggcatgctatggaggagcttccagatactattgaaaccctgatgctcttggccctgatcgcagtcttaacaggtggggttaccctattctttctgagcggccggggactcggcaagacttccattgggcttctgtgtgtgatggcttctagcgtattgctgtggatggcctccgtggagccccactggatcgcagcctcaataatcctcgagttctttctgatggtccttctcattcctgagcccgaccgtcagagaacgccacaggataatcaactggcttatgtggttatcggattgctgttcatgattttaaccgtggcggccaacgagatgggtctactggaaacaactaagaaagacctcggcatcgggcacgtcgcagtaggaaatcatcaccatgctgccatgcttgatgtggacctgcaccctgcctctgcatggaccttgtacgctgttgccacaaccataattactcccatgatgaggcatacaatcgagaacacgaccgcgaacattagtctgactgctatcgccaatcaggcagccatactcatgggcctggataagggttggccaatctcgaaaatggacattggggtgcctcttttagctctgggctgctacagccaggtcaacccgctcacattgaccgcagccgtgctgatgctagtcgcgcactatgctatcattggacccggcctgcaagccaaggcaacccgcgaagcccagaaacggacagctgccgggatcatgaagaatccaactgtggatggaatagttgcaattgacctcgatcctgtggtatacgacgctaagtttgagaaacagcttggccagatcatgctgttgatcctgtgtacgtcccaaattctcctgatgcgaaccacatgggccttatgcgaatctatcactcttgcgaccggtcccctgacaaccctctgggaggggtcaccaggaaagttctggaacactacgatagccgtgagcatggcaaatatttttagaggctcctatctagctggtgccggcctggcattcagtttgatgaaatctctagggggaggcaggcgcgggacaggagctcagggcgagaccctcggtgaaaagtggaaacggcagcttaaccagctgagcaagtcagagttcaatacttacaagagatccgggatcatggaagtcgaccgtagtgaggccaaagaaggattgaagaggggcgagaccacaaaacacgccgttagccggggtactgcgaagctgcgctggtttgtggagcgaaacctcgtcaaacctgaaggcaaggtgattgatttagggtgtggaagaggcgggtggtcttattactgcgctggactgaagaaagtaaccgaggtgaagggctatacaaaaggtgggcccggacatgaagaaccgatcccaatggcaacgtacggctggaatcttgttaagctgcactccggcaaagacgtgttctttatacctcccgaaaagtgtgataccctactctgcgacatcggggagtcaagcccaaaccccactattgaggaaggaaggacactgcgggtcttgaaaatggtggagccttggctgcgcggtaatcaattctgtatcaagattctcaacccgtacatgccctcggtcgtggaaacccttgagcagatgcagagaaagcatggcgggatgctggttaggaatccattatctcgaaacagtactcacgagatgtattgggtatcctgcggaacaggcaatatcgtgagcgccgtcaacatgacctcacggatgctgttgaatcgttttacgatggctcacagaaaacctacctacgaacgcgatgtggacctcggtgccgggacaaggcatgttgcagtggagcccgaagtcgccaacctggatattatcggacagcggatagagaacattaagcacgaacataaatccacttggcactatgacgaggataatccttacaagacctgggcttatcatggctcttacgaggtgaaaccaagcggcagtgcgtccagcatggtaaacggggtggttaagctacttacaaagccctgggacgtcatccctatggtgactcaaatcgccatgaccgatacaaccccattcggacagcagagagtgtttaaagaaaaggtcgacactcgcacgcccaaagcaaagaggggtacagctcaaattatggaggttaccgccaaatggctgtggggcttcctctctcgaaataagaagccgcggatatgtactagagaagagtttaccaggaaagtgcgctcaaacgcagccatcggggctgtattcgtggacgaaaatcagtggaacagtgccaaggaggcggtcgaggatgaacgtttttgggacctggtgcaccgggagagagaattgcacaaacagggaaagtgcgcaacatgcgtttataatatgatgggcaaaagggagaagaagctgggtgagttcgggaaagccaagggatcccgcgctatttggtacatgtggctcggcgcccgatttcttgagttcgaggcactgggcttcatgaacgaagatcattggtttagccgggaaaattctttatcgggggtggaaggagagggtctgcacaaattgggctacatcctcagagacatttcaaagatccctgggggaaacatgtatgctgatgacacggccggctgggataccaggataactgaggacgatctgcagaatgaagctcgcatcacagacattatggagccagaacatgccctacttgcaaaaagcatcttcaagctgacctaccaaaacaaagtcgtgagagtacagcggcccgcgaagaatggtactgttatggatgtgatttccaggcgtgaccagcgagggagtggacaggtcggcacatatggcctcaacacctttacaaatatggaggcccaactgatccgccagatggaatctgaggggatattcagcccttccgagttggaaactccaaacttagctgagagagtgctggtgtggctcgaaaagtacggagtcgagcggcttaaaaggatggccatttcaggtgatgactgtgttgtgaagcccatcgacgatcgctttgcaaccgctctgacggccctaaacgacatgggcaaagtaagaaaggatatcccgcagtgggaacctagtaaagggtggaatgactggcagcaagtgcccttctgctctcaccactttcatcagctgattatgaaggatggacgggagatagtcgtgccatgtaggaaccaggacgagctcgttggccgagcacgtgtgagccagggtgccgggtggtccttgagagaaaccgcgtgcctgggaaagtcatatgctcaaatgtggcagcttatgtacttccaccgccgggatctgaggctcgccgcaaatgccatctgtagcgctgtccctgtggactggattcccacatctagaactacctggtccatccatgcccaccatcagtggatgacaactgaggatatgttaagtgtatggaaccgcgtttggattgaagagaatccatggatggaagacaaaacccacatcagctcgtggggcgatgtgccctatctgggcaagcgggaggaccaatggtgcgggtccttgataggactgacggcaagggctacatgggccaccaacatccaggtcgcgattaatcaggtgcgaagactcatcggtaacgagaattaccttgactacatgacttctatgaaacggtttaagaacgaatcagatcctgagggcgctctgtggtga

SEQ ID NO: 13260 - RNA, 9879 nt, synthetic construct
  misc_feature 1..9879: note = derived and/or modified CDS sequence (opt3) from DENV-1__GU131894__SS-prME
  source 1..9879: mol_type = other RNA
tccgtgaccatgctgctcatgcttatgcccacagcactggctttccacttgactacgagaggaggggagcctcatatgatcgtctccaagcaggaaagaggaaaatctttactgtttaagacctcagccggtgttaatatgtgcacattgattgccatggacctcggcgagctgtgtgaagatactatgacctacaaatgcccacggataacagaggcggaaccggacgatgtggactgttggtgcaatgctaccgatacttgggtaacatatgggacctgtagtcaaacgggagagcaccgccgagacaagcgtagcgtggcccttgcaccccatgtcggcctgggtttggagactagaaccgaaacatggatgtcctctgagggggcctggaaacagatccagagggtggaaacttgggctctccggcaccctggattcaccgttattgcactgtttctggcccatgctatcggcacatcgattacccagaagggcatcatattcatcctcttaatgctggtgacgccatcaatggccatgcgctgcgtcgggattggaagcagagattttgtggagggtcttagtggcgcgacttgggtagacgttgtgttggagcacgggtcctgtgtcacaaccatggcaaaggataaacccactctggacatcgaactactcaagacagaggtgaccaaccctgccattctgaggaaactttgcatcgaagctaagatatctaatacgaccacagatagccggtgtccaactcaaggagaggccaccctggtggaagaacaagacgcaaacttcgtctgccgccgaacatttgttgatagaggctggggtaatgggtgtggattgttcggcaaaggctccctcattacttgcgctaagtttaagtgcgtgaccaaactggaggggaagatcgtacagtacgaaaacttaaaatattcagtgattgtcacagtgcacaccggagaccagcatcaagttggtaatgagagtactgaacacggcacgacagccaccatcactccccaggcgcctaccacagagatccagctgaccgactacggggccctcactcttgattgtagcccaaggacaggactggacttcaacgaaatggtgttgctaacgatgaaggagaaatcttggctggtccataagcagtggtttctcgatctgccgcttccctggacctccggcgcatcaactagccaagagacatggaatcggcaggacctgttggtgaccttcaaaacagctcacgccaagaagcaggaagtagttgtgctcggtagtcaagagggggctatgcacactgccctgaccggcgcaacggaaattcagacctctggaacaactaccatatttgccggccatttaaaatgccgtctgaagatggataaactaacactcaaggggatgtcctatgtcatgtgtactggtagcttcaaactggagaaggaagtggctgagacccagcacggtacggtccttgtgcagatcaagtacgagggcacagacgcgccttgcaaaattccattctcgacccaagatgaaaagggggttactcagaacggacgcttgatcacagcaaatcccatagtgaccgacaaagagaagcctgtaaacattgaagccgagccaccctttggcgagtcttatatcgtcatcggtgctggggaaaaagccctgaagctctcctggttcaagaaaggctcaagtattggaaagatgtttgaggcaactgccagaggcgctaggcggatggccatcctgggggataccgcatgggacttcggaagcattggtggcgtgtttacatccgttgggaaacttgtgcatcagatattcggaacggcgtacggcgtcctgttttctggtgtgagctggaccatgaagatcgggattggcgtattgctcacttggctgggattaaattcacgaagtacatccctgagcatgacctgtatcgctgtgggcctagttacactctacctgggggtcatggtgcaggccgattctggatgcgtgatcaactggaaaggccgcgaacttaagtgtggttcagggattttcgtcactaatgaggttcacacctggacggaacaatataagtttcaggcagacagtccgaaaagattgagcgccgctataggaaaggcctgggaggagggcgtgtgcggtatcaggtccgcaacacggctggaaaacattatgtggaaacagatctctaacgagctcaatcatattctgttagaaaacgacatgaagttcaccgtggtagtcggcgatgtggctgggatcctggcccagggcaagaagatgatacgccctcaacccatggagtacaaatattcgtggaaaagctggggcaaggcgaagatcattggggccgacgttcagaatactacctttatcattgatggaccaaacacacctgaatgtcccgacgatcagagagcttggaatatctgggaggtggaggactacggcttcggtatatttactaccaacatttggcttaagttgagggattcctatacacaggtctgcgaccaccgtctcatgtcagcagccatcaaagatagtaaggctgtgcacgccgacatggggtactggattgaatctgagaaaaatgaaacgtggaagctggcacgggcgagcttcatcgaggttaagacctgtatatggccaaaatcccatactctatggtcaaacggagtgctggaaagcgagatgatcattcccaagatctatggcggtcctatttctcaacacaattaccgaccaggctacttcacacagaccgccgggccgtggcatctcggaaaactggagcttgattttgacttgtgcgaaggcactacagtagtcgtggatgagcactgcgggaacagaggaccctccctgaggaccacgactgtgaccggcaagatcatacacgaatggtgttgccgcagttgtacattacctccactccggttcagaggtgaggacgggtgctggtatggaatggagattaggcccgtcaaagaaaaggaggaaaatctggttaagagcatggtgtctgctggctccggtgaggtagactcatttagtcttggcctgttgtgtatcagcatcatgattgaagaggtgatgcgctcgcgatggtcccggaaaatgctcatgaccgggactctggccgtcttcctactgctcatcatgggacagctgacatggaacgatcttattcgtttgtgcataatggtgggcgcaaatgcttctgacagaatggggatgggaaccacatacctggccttaatggcaacttttaagatgaggcctatgttcgccgttggcctcctgtttcgccggcttaccagcagagaggtgctgctactcacgatcggtctgtcattggtcgctagtgtggaactgccaaactccttagaggaactcggggatggactggcgatgggcattatgatccttaaactgttgacagacttccaatctcatcagctctgggccaccctgctaagcctgacttttattaagaccacattctcccttcactatgcatggaaaactatggctatggttctctcaatcgtgagcctgtttcccttgtgtctgagtaccacgtctcagaagacaacctggttaccggtcctcctgggctcccttgggtgcaagcctctgactatgttcttgatagccgagaataaaatctggggaaggcgaagctggccactcaacgaaggtattatggccgtaggcatcgtgtcgattctgctatcatctctgcttaagaacgatgttcccctcgctgggcctctgatcgcaggaggcatgttgatagcctgttacgtgattagtggttccagcgcggacttatctctggagaaagctgccgaggtcagctgggaagaggaagcagagcattccggggcctcacacaatatcctcgtggaagtacaggatgacggaacaatgaagatcaaagatgaggagcgcgacgataccctgactattcttctgaaggctacattgctagcagtgagtggcgtctatcccctgagcataccagccaccctctttgtttggtacttctggcagaaaaagaagcagcggtctggcgtgctgtgggacacgccttcacccccagaagtggagagagcggtccttgatgacgggatctataggattatgcagcgtggattactgggtcgcagccaggtgggcgttggggtattccaagaaaacgtgtttcatactatgtggcacgtcacccggggagctgtgctcatgtaccagggcaaaagattggagccgagttgggccagcgttaagaaagacctgatctcctacggtgggggatggaggctccagggctcttggaatacaggcgaggaagtgcaggtcattgcagtggagcctgggaagaaccccaaaaatgtacaaaccgccccaggaacattcaagactcccgaaggtgaggtcggcgctatcgccctggattttaagcctgggacctcgggaagcccaatagtgaaccgagaaggcaaaatcgttggtctttatgggaatggagtggtcacgacatcaggcacttacgtgtccgcaattgctcaggccaaggcgagtcaggagggccccctgcctgagatcgaagacgaggttttccggaaacgcaacttgaccattatggatctacacccggggtctggaaagacaagaaggtatctgccagccatcgtgcgggaagcaataaaacgaaagctcagaaccttaattctggctcccactcgcgtcgtggccagcgagatggctgaagcacttaagggtatgcctatcaggtaccaaaccacagccgtaaaatccgagcatacgggcaaggagatcgtggacctgatgtgccacgccacttttaccatgcgtctcttgtcaccagttcgggtccccaattataacatgattatcatggatgaagctcatttcacagacccttctagcatagcggcaagagggtacattagtaccagggtgggaatgggcgaggccgctgccatctttatgactgcaacaccgcccggttccgtggaagccttcccacagagcaatgctgtcattcaggatgaggaacgcgacatccctgagcgatcttggaactcagggtatgagtggataaccgattttcccggaaaaacggtatggttcgtgccatccattaagagtggcaatgacatcgcgaactgtctgaggaaaaatggcaagcgggttatccagctcagcaggaagacttttgatacagaataccagaaaaccaagaacaacgactgggactacgtggtcaccactgatatttcggagatgggggccaatttccgcgcagaccgtgtgatcgatcctagacggtgcctgaaacccgttattcttaaggacggaccagaaagggtgatactagctggtccgatgcctgtcacagtggcctctgcagcccagcgccgaggcagaatcgggcggaaccacaataaagagggagatcagtatatttacatgggccagcccctgaacaatgacgaggatcatgctcactggaccgaagccaagatgttgttagacaacatcaatacaccagagggtatcattcccgcgctgttcgaacctgagagggaaaagtccgcagccatagatggggagtatcgcctcagaggcgaggctaggaaaacttttgtagaactgatgcggcgtggagaccttccagtgtggctgagctacaaggttgcctcagagggcttccaatatagtgatcgccgatggtgctttgacggggaaagaaacaatcaggtcctcgaggaaaacatggatgtggagatctggacgaaagagggagaaaggaagaaattgcggccccgctggctggacgctagaacctactctgaccctctagcactgagggagttcaaggaatttgccgctggtcggcgatccgtgagcggcgatctcattcttgagatcgggaaactgccgcagcacttaacacagagagcccaaaatgcattggacaacctggtcatgctccataattcagaacagggaggccgcgcgtataggcacgccatggaggagctgccagatactattgaaacccttatgctgctcgctttgatcgccgttctgacaggtggggtgaccttattctttctaagtggccggggactgggcaagactagcatagggctcctttgtgtaatggcatcctctgtgctgttgtggatggctagcgtcgagccccattggatcgccgcatccattatcctggagttctttctcatggtgctgcttattcctgagcccgaccgtcagagaacgccacaggataaccaactcgcctacgttgtgatcggactgttgttcatgatactgaccgtcgctgcgaatgagatgggtttactagaaacaactaagaaagacctgggcattgggcacgtagccgtgggaaaccaccatcacgcagctatgctcgatgttgaccttcatcctgcctcagcctggaccctgtacgcagtggctacaaccatcattactcccatgatgaggcacacaatcgagaacacgaccgccaatatatctttgactgcgatcgctaaccaggccgcaattctgatgggcctcgataagggttggccaatcagtaaaatggacattggggtccctctgcttgccttaggctgctattcgcaagtgaatccgctgacactcaccgctgcagtcttgatgctggtggcccattacgcgatcataggacccggcctacaagctaaggccacccgcgaagcacagaaacggacagccgctgggattatgaagaacccaactgttgatggaatcgtggccatcgacctggatcctgtagtgtatgacgcaaagtttgagaaacagctcggccagattatgcttctgatcttgtgtacgagccaaatactgctcatgcgaaccacatgggctctgtgcgaatccattactttagccaccggtccccttacaaccctgtgggaggggtctccaggaaagttctggaatactacgatcgcggtctcaatggccaacatttttagaggcagctacctcgcaggagctggcctagccttctccctgatgaaaagtctagggggaggcaggcgcgggacaggagcacagggcgagaccctgggtgaaaagtggaaacggcagctcaatcagctttctaagagcgagttcaacacttataagagatcagggatcatggaagttgaccgttccgaggctaaagaaggactgaagaggggcgagaccacaaaacacgccgtgagtcggggtactgccaagttgcgctggtttgtcgagcgaaatctggtgaaacctgaaggcaaggtaatagatctcgggtgtggaagaggcgggtggagctactattgcgcgggattaaagaaagtgaccgaggttaagggctacacaaaaggtgggcccggacacgaagaaccgatcccaatggctacgtacggctggaacctggtgaaacttcattctggcaaagacgtcttctttattcctcccgaaaagtgtgataccctgctatgcgacatcggggagtcctcaccaaatcccactattgaggaaggaaggacactccgggtgctgaaaatggtcgagccttggttgcgcggtaaccaattctgtatcaagattctgaatccgtatatgcccagcgtggttgaaaccctcgagcagatgcagagaaagcacggcgggatgcttgtaaggaacccactgtcgcgaaattctactcatgagatgtactgggtgagttgcggaacaggcaacatcgtctccgcagtgaatatgaccagccggatgttactgaaccgttttacgatggcccacagaaaacctacctatgaacgcgatgttgacttgggtgctgggacaaggcacgtggccgtcgagcccgaagtggcaaacctcgatataattggacagcggatcgagaatatcaagcatgaacacaaatcaacttggcattacgacgaggataacccttataagacctgggcctaccacggctcctatgaggtaaaaccatctggcagcgctagttccatggtgaatggggttgtcaagctgctaacaaagccctgggacgtgattcctatggtgactcaaatagcgatgaccgatacaaccccattcggacagcagagagtctttaaagaaaaggttgacactcgcacgcccaaagccaagaggggtacagcacaaatcatggaggtgaccgctaaatggctttggggcttcctgagccgaaacaagaagccgcggatttgtactagagaagagtttaccaggaaagtacgctctaatgccgcaatcggggccgtgttcgtcgacgaaaaccagtggaactcagctaaggaggccgtggaggatgaacgtttttgggacctcgttcataaagagcgggaactgcacaagcagggaaaatgcgcgacatgcgtgtacaacatgatgggcaagagagagaagaaattgggtgagttcgggaaggcaaaaggaagtagggccatttggtacatgtggctgggcgctcgctttctcgagttcgaggcccttggcttcatgaatgaagatcactggttttcccgagagaacagcctgtctggggtcgaaggagagggtttacataagctgggctatatcttgcgggacatatcgaaaatccctgggggaaatatgtacgcagatgacacggctggctgggataccagaattactgaggacgatctccagaacgaagccaggatcacagacattatggagccagaacacgctctgctagccaagtcaatcttcaaacttacctatcaaaataaggtggtacgcgttcagagacccgcaaagaacggtactgtgatggatgtcataagccggagggaccagcgtgggtccggacaggtgggcacatacggcctgaatacctttacaaacatggaggcgcaactcattcgacagatggaaagtgaggggatcttctctcctagcgagctggaaactccaaacttggccgagcgcgtgttagattggctggaaaaatatggagtcgagagactcaagcggatggctatctccggtgacgactgtgttgtgaaacccattgatgacaggtttgccaccgcacttacggctctgaatgatatgggcaaggtacgcaaagacataccgcagtgggaaccttcaaaggggtggaacgattggcagcaagtgcccttctgcagtcatcactttcaccagctaatcatgaaggacggaagagagattgtcgtgccatgtcggaatcaggatgagctggttggcagggcccgagtgtctcagggtgcagggtggagcctccgtgaaaccgcctgcttgggaaaatcctacgcgcaaatgtggcagctgatgtatttccatagacgcgaccttcggctggctgccaacgcaatctgttcagccgtccctgtggattggacacccactagcaggaccacatggtctattcacgctcatcaccagtggatgactaccgaggacatgctctccgtatggaatagagtttggatcgaagagaacccatggatggaagataagacgcatataagtagctggggcgacgtgccctacttaggcaaacgcgaggaccaatggtgcgggtcgctgatcggattgacagcccgggcaacctgggctactaatattcaggtcgccatcaaccaggtgaggcgactgattggtaatgagaactacctcgattatatgacatccatgaagagatttaaaaatgaatctgaccctgagggcgcgctttggtga

SEQ ID NO: 13261 - RNA, 9879 nt, synthetic construct
  misc_feature 1..9879: note = derived and/or modified CDS sequence (opt3) from DENV-1__GU131895__SS-prME
  source 1..9879: mol_type = other RNA
tccgtgaccatgctgctcatgcttatgcccacagcactggctttccacttgactacgagaggaggggaacctcatatgatcgtctccaagcaggaaagaggaaaatctttactgtttaagacctcagccggtgttaatatgtgcacattgattgccatggacctcggcgagctgtgtgaagatactatgacctacaaatgcccacggataacagaggcggaaccggacgatgtggactgttggtgcaatgctaccgatacttgggtaacatatgggacctgtagtcaaacgggagagcaccgccgagacaagcgtagcgtggcccttgcaccccatgtcggcctgggtttggagactagaaccgaaacatggatgtcctctgagggggcctggaaacagatccagagggtggaaacttgggctctccggcaccctggattcaccgttattgcactgtttctggcccatgctatcggcacatcgattacccagaagggcatcatattcatcctcttaatgctggtgacgccatcaatggccatgcgctgcgtcgggattggaagcagagattttgtggagggtcttagtggcgcgacttgggtagacgttgtgttggagcacgggtcctgtgtcacaaccatggcaaaggataaacccactctggacatcgaactactcaagacagaggtgaccaaccctgccattctgaggaaactttgcatcgaagctaagatatctaatacgaccacagatagccggtgtccaactcaaggagaggccaccctggtggaagaacaagacgcaaacttcgtctgccgccgaacatttgttgatagaggctggggtaatgggtgtggattgttcggcaaaggctccctcattacttgcgctaagtttaagtgcgtgaccaaactggaggggaagatcgtacagtacgaaaacttaaaatattcagtgattgtcacagtgcacaccggagaccagcatcaagttggtaatgagagtactgaacacggcacgacagccaccatcactccccaggcgcctaccacagagatccagctgaccgactacggggccctcactcttgattgtagcccaaggacaggactggacttcaacgaaatggtgttgctaacgatgaaggagaaatcttggctggtccataagcagtggtttctcgatctgccgcttccctggacctccggcgcatcaactagccaagagacatggaatcggcaggacctgttggtgaccttcaaaacagctcacgccaagaagcaggaagtagttgtgctcggtagtcaagagggggctatgcacactgccctgaccggcgcaacggaaattcagacctctggaacaactaccatatttgccggccatttaaaatgccgtctgaagatggataaactagctctcaaggggatgtcctatgtcatgtgtacaggtagcttcaaactggagaaggaagtggcggagactcagcacggaaccgtccttgtgcagatcaagtacgagggcacggacgcaccttgcaaaattccattctcgacacaagatgaaaagggggttacccagaacggacgcttgatcactgccaatcccatagtgacagacaaagagaagcctgtaaacattgaagctgagccaccctttggcgagtcttatatcgtcatcggtgccggggaaaaagcactgaagctctcctggttcaagaaaggctcaagtattggaaagatgtttgaggccaccgctagaggcgccaggcggatggcaatcctgggggatactgcgtgggacttcggaagcattggtggcgtgtttacctccgttgggaaacttgtgcatcagatattcggaacagcttacggcgtcctgttttctggtgtgagctggacgatgaagatcgggattggcgtattgctcacctggctgggattaaattcacgaagtacttccctgagcatgacatgtatcgccgtgggcctagttaccctctacctgggggtcatggtgcaggcagattctggatgcgtgatcaactggaaaggccgcgaacttaagtgtggttcagggattttcgtcacaaatgaggttcacacttggaccgaacaatataagtttcaggccgacagtccgaaaagattgagcgctgccataggaaaggcatgggaggagggcgtgtgcggtatcaggtccgctacgcggctggaaaacattatgtggaaacagatctctaacgagctcaatcatattctgttagaaaacgacatgaagttcacagtggtagtcggcgatgtggccgggatcctggcgcagggcaagaagatgatacgccctcaacccatggagtacaaatattcgtggaaaagctggggcaaggccaagatcattggggctgacgttcagaataccacttttatcattgatggaccaaacacccctgaatgtcccgacgatcagagagcatggaatatctgggaggtggaggactacggcttcggtatatttacaactaacatttggcttaagttgagggattcctatacccaggtctgcgaccaccgtctcatgtcagccgctatcaaagatagtaaggccgtgcacgcagacatggggtactggattgaatctgagaaaaatgaaacatggaagctggcgcgggccagcttcatcgaggttaagacgtgtatatggccaaaatcccataccctatggtcaaacggagtgctggaaagcgagatgatcattcccaagatctatggcggtcctatttctcaacacaattaccgaccaggctacttcactcagacagctgggccgtggcatctcggaaaactggagcttgattttgacttgtgcgaaggcaccactgtagtcgtggatgagcactgcgggaacagaggaccctccctgaggacaaccacggtgactggcaagatcatacacgaatggtgttgccgcagttgtaccttacctccactccggttcagaggtgaggacgggtgctggtatggaatggagattaggcccgtcaaagaaaaggaggaaaatctggttaagagcatggtgtctgccggctccggtgaggtagactcatttagtcttggcctgttgtgtatcagcatcatgattgaagaggtgatgcgctcgcgatggtcccggaaaatgctcatgacagggaccctggcagtcttcctactgctcatcatgggacagctgacttggaacgatcttattcgtttgtgcataatggtgggcgctaatgcctctgacagaatggggatgggaacaacctacctggcattaatggccacatttaagatgaggcctatgttcgctgttggcctcctgtttcgccggcttactagcagagaggtgctgctactcaccatcggtctgtcattggtcgcgagtgtggaactgccaaactccttagaggaactcggggatggactggccatgggcattatgatccttaaactgttgacggacttccaatctcatcagctctgggcaacactgctaagcctgacctttattaagactaccttctcccttcactatgcttggaaaacaatggccatggttctctcaatcgtgagcctgtttcccttgtgtctgagtactacctctcagaagacgacatggttaccggtcctcctgggctcccttgggtgcaagcctctgaccatgttcttgatagccgagaataaaatctggggaaggcgaagctggccactcaacgaaggtattatggctgtaggcatcgtgtcgattctgctatcatctctgcttaagaacgatgttcccctcgcagggcctctgatcgccggaggcatgttgatagcgtgttacgtgattagtggttccagcgctgacttatctctggagaaagccgcagaggtcagctgggaagaggaagccgagcattccggggcttcacacaatatcctcgtggaagtacaggatgacggaactatgaagatcaaagatgaggagcgcgacgatacactgaccattcttctgaaggcaactttgctagccgtgagtggcgtctatcccctgagcataccagcgacactctttgtttggtacttctggcagaaaaagaagcagcggtctggcgtgctgtgggacaccccttcacccccagaagtggagagagctgtccttgatgacgggatctataggattatgcagcgtggattactgggtcgcagccaggtgggcgttggggtattccaagaaaacgtgtttcatacgatgtggcacgtcactcggggagccgtgctcatgtaccagggcaaaagattggagccgagttgggcaagcgttaagaaagacctgatctcctacggtgggggatggaggctccagggctcttggaataccggcgaggaagtgcaggtcattgccgtggagcctgggaagaaccccaaaaatgtacaaacagctccaggaaccttcaagacacccgaaggtgaggtcggcgccatcgcactggattttaagcctgggacttcgggaagcccaatagtgaaccgagaaggcaaaatcgttggtctttatgggaatggagtggtcaccacgtcaggcacatacgtgtccgctattgcccaggcgaaggccagtcaggagggccccctgcctgagatcgaagacgaggttttccggaaacgcaacttgactattatggatctacacccggggtctggaaagaccagaaggtatctgccagcaatcgtgcgggaagctataaaacgaaagctcagaacattaattctggcccccacccgcgtcgtggctagcgagatggcagaagcccttaagggtatgcctatcaggtaccaaactaccgccgtaaaatccgagcatacaggcaaggagatcgtggacctgatgtgccacgctacgtttactatgcgtctcttgtcaccagttcgggtccccaattataacatgattatcatggatgaagcgcatttcaccgacccttctagcatagcagccagagggtacattagtacaagggtgggaatgggcgaggctgccgcaatctttatgaccgccactccgcccggttccgtggaggctttcccacagagcaatgcggtcattcaggatgaggaacgcgacatccctgagcgatcttggaactcagggtatgagtggataacagattttcccggaaaaaccgtatggttcgtgccatccattaagagtggcaatgacatcgccaactgtctgaggaaaaatggcaagcgggttatccagctcagcaggaagacgtttgatactgaataccagaaaacaaagaacaacgactgggactacgtggtcaccaccgatatttcggagatgggggcaaatttccgcgctgaccgtgtgatcgatcctagacggtgcctgaaacccgttattcttaaggacggaccagaaagggtgatactagccggtccgatgcctgtcactgtggcatctgccgctcagcgccgaggcagaatcgggcggaaccacaataaagagggagatcagtatatttacatgggccagcccctgaacaatgacgaggatcatgcccactggacagaagcgaagatgttgttagacaacatcaataccccagagggtatcattcccgcactgttcgaacctgagagggaaaagtccgccgctatagatggggagtatcgcctcagaggcgaggccaggaaaacatttgtagaactgatgcggcgtggagaccttccagtgtggctgagctacaaggttgcttcagagggcttccaatatagtgatcgccgatggtgctttgacggggaaagaaacaatcaggtcctcgaggaaaacatggatgtggagatctggactaaagagggagaaaggaagaaattgcggccccgctggctggacgcaagaacgtactctgaccctctagccctgagggagttcaaggaatttgctgccggtcggcgatccgtgagcggcgatctcattcttgagatcgggaaactgccgcagcacttaacccagagagcacaaaatgcgttggacaacctggtcatgctccataattcagaacagggaggccgcgcctataggcacgctatggaggagctgccagatacaattgaaactcttatgctgctcgccttgatcgcagttctgaccggtggggtgacattattctttctaagtggccggggactgggcaagaccagcatagggctcctttgtgtaatggcttcctctgtgctgttgtggatggccagcgtcgagccccattggatcgcagcctccattatcctggagttctttctcatggtgctgcttattcctgagcccgaccgtcagagaactccacaggataaccaactcgcttacgttgtgatcggactgttgttcatgatactgacggtcgcggccaatgagatgggtttactagaaaccacaaagaaagacctgggcattgggcacgtagcagtgggaaaccaccatcacgctgccatgctcgatgttgaccttcatcctgcctcagcatggactctgtacgctgtggccaccacaatcattacccccatgatgaggcacactatcgagaacacaacggcgaatatatctttgaccgctatcgccaaccaggcagccattctgatgggcctcgataagggttggccaatcagtaaaatggacattggggtccctctgcttgctttaggctgctattcgcaagtgaatccgctgactctcacagcagccgtcttgatgctggtggcgcattacgctatcataggacccggcctacaagccaaggcaacccgcgaagcccagaaacggaccgctgccgggattatgaagaacccaacagttgatggaatcgtggcaatcgacctggatcctgtagtgtatgacgctaagtttgagaaacagctcggccagattatgcttctgatcttgtgtactagccaaatactgctcatgcgaacgacctgggccctgtgcgaatccattacattagcgactggtccccttaccacactgtgggaggggtctccaggaaagttctggaataccactatcgccgtctcaatggcaaacatttttagaggcagctacctcgctggtgccggcctagcattctccctgatgaaaagtctagggggaggcaggcgcgggacgggagctcagggcgagacactgggtgaaaagtggaaacggcagctcaatcagctttctaagagcgagttcaacacctataagagatcagggatcatggaagttgaccgttccgaggccaaagaaggactgaagaggggcgagactaccaaacacgccgtgagtcggggtacagcgaagttgcgctggtttgtcgagcgaaatctggtgaaacctgaaggcaaggtaatagatctcgggtgtggaagaggcgggtggagctactattgcgctggattaaagaaagtgactgaggttaagggctacaccaaaggtgggcccggacacgaagaaccgatcccaatggcaacatacggctggaacctggtgaaacttcattctggcaaagacgtcttctttattcctcccgaaaagtgtgatacgctgctatgcgacatcggggagtcctcaccaaatcccaccattgaggaaggaaggactctccgggtgctgaaaatggtcgagccttggttgcgcggtaaccaattctgtatcaagattctgaatccgtatatgcccagcgtggttgaaacactcgagcagatgcagagaaagcacggcgggatgcttgtaaggaacccactgtcgcgaaattctacccatgagatgtactgggtgagttgcggaactggcaacatcgtctccgccgtgaatatgacaagccggatgttactgaaccgttttaccatggctcacagaaaacctacgtatgaacgcgatgttgacttgggtgccgggaccaggcacgtggcagtcgagcccgaagtggccaacctcgatataattggacagcggatcgagaatatcaagcatgaacacaaatcaacatggcattacgacgaggataacccttataagacttgggcttaccacggctcctatgaggtaaaaccatctggcagcgcgagttccatggtgaatggggttgtcaagctgctaaccaagccctgggacgtgattcctatggtgacacaaatagccatgactgataccacaccattcggacagcagagagtctttaaagaaaaggttgacacccgcactcccaaagcaaagaggggtacggctcaaatcatggaggtgacagccaaatggctttggggcttcctgagccgaaacaagaagccgcggatttgtaccagagaagagtttactaggaaagtacgctctaatgcagccatcggggctgtgttcgtcgacgaaaaccagtggaactcagccaaggaggcggtggaggatgaacgtttttgggacctcgttcataaagagcgggaactgcacaagcagggaaaatgcgcaacctgcgtgtacaacatgatgggcaagagagagaagaaattgggtgagttcgggaaggccaaaggaagtagggctatttggtacatgtggctgggcgcccgctttctcgagttcgaggcacttggcttcatgaatgaagatcactggttttcccgagagaacagcctgtctggggtcgaaggagagggtttacataagctgggctatatcttgcgggacatatcgaaaatccctgggggaaatatgtacgctgatgacacagccggctgggatacgagaattaccgaggacgatctccagaacgaagctaggatcactgacattatggagccagaacacgccctgctagcaaagtcaatcttcaaacttacatatcaaaataaggtggtacgcgttcagagacccgcgaagaacggtaccgtgatggatgtcataagccggagggaccagcgtgggtccggacaggtgggcacttacggcctgaatacatttaccaacatggaggcccaactcattcgacagatggaaagtgaggggatcttctctcctagcgagctggaaacaccaaacttggctgagcgcgtgttagattggctggaaaaatatggagtcgagagactcaagcggatggccatctccggtgacgactgtgttgtgaaacccattgatgacaggtttgcaactgctcttaccgccctgaatgatatgggcaaggtacgcaaagacataccgcagtgggaaccttcaaaggggtggaacgattggcagcaagtgcccttctgcagtcatcactttcaccagctaatcatgaaggacggaagagagattgtcgtgccatgtcggaatcaggatgagctggttggcagggcacgagtgtctcagggtgccgggtggagcctccgtgaaacggcgtgcttgggaaaatcctacgctcaaatgtggcagctgatgtatttccatagacgcgaccttcggctggccgcaaacgccatctgttcagctgtccctgtggattggattcccaccagcaggacaacttggtctatccacgcccatcaccagtggatgaccacagaggacatgctctccgtatggaatagagtttggatagaagagaacccatggatggaagataagactcatatcagtagctggggcgacgtgccctacttaggcaaacgcgaggaccaatggtgcgggtcgctgattggattgaccgcacgggctacgtgggccacaaatatccaggtcgcgattaaccaggtgaggcgactgatcggtaatgagaactacctcgattatatgacctccatgaagagatttaaaaatgaatctgaccctgagggcgctctttggtga

SEQ ID NO: 13262 - RNA, 9879 nt, synthetic construct
  misc_feature 1..9879: note = derived and/or modified CDS sequence (opt3) from DENV-1__GQ868632__SS-prME
  source 1..9879: mol_type = other RNA
agcgtgaccatgctgctcatgcttatgcccacagcactggctttccacttgactacgcggggaggggagcctcatatgatcgtctccaagcaggaaaggggaaaatctttactgtttaagacctcagccggtgttaatatgtgcacactaattgccatggacctcggcgagctgtgtgaagatactatgacctacaaatgcccacggataacagaggcggaaccggacgatgtggactgttggtgcaatgctaccgatacttgggtaacatatgggacctgtagtcaaacgggagagcaccgccgagacaagcgtagcgtggcccttgcaccccatgtcggcctgggtttggagactagaaccgaaacatggatgtcctctgagggggcctggaaacagatccagagggtggaaacttgggctctccggcaccctggattcaccgttattgcactgtttctggcccatgctatcggcacatcgattacccagaagggcatcatattcatcctcttaatgctggtgacgccatcaatggccatgcgctgcgtcgggattggaagcagagattttgtggagggtcttagtggcgcgacttgggtagacgttgtgttggagcacgggtcctgtgtcacaaccatggcaaaggataaacccactctggacatcgaactactcaagacagaggtgaccaaccctgccattctgaggaaactttgcatcgaagctaagatatctaatacgaccacagatagccggtgtccaactcaaggagaggccaccctggtggaagaacaggacgcaaacttcgtctgccgccgaacatttgttgatagaggctggggtaatgggtgtggattgttcggcaaaggctccctcattacttgcgctaagtttaagtgcgtgaccaaactggaggggaagatcgtacagtacgaaaacttaaaatattcagtgattgtcacagtgcacaccggagaccagcatcaagttggtaatgagagtactgaacacggcacgacagccaccatcactccccaggcgcctaccacagagatccagctgaccgactacggggccctcactcttgattgtagcccaaggacaggactggacttcaacgaaatggtgttgctaacgatgaaggagaaatcttggctggtccataagcagtggtttctcgatctgccgcttccctggacctccggcgcatcaactagccaagagacatggaatcggcaggacctgttggtgaccttcaaaacagctcacgccaagaagcaggaagtagttgtgctcggtagtcaagagggggctatgcacactgccctgaccggcgcaacggaaattcagacctctggaacaactaccatatttgccggccatttaaaatgccgtctgaagatggataaactaacactcaagggggtctcctatgtgatgtgtactggtagcttcaaactggagaaggaagtcgctgagacccagcacggtacggtgcttgttcagatcaagtacgagggcacagacgcgccttgcaaaattccattctcgacccaagatgaaaagggggtgactcagaacggacgcttgatcacagcaaatcccatagtaaccgacaaagagaagcctgtcaacattgaagccgagccaccctttggcgagtcttatatcgtgatcggtgctggggaaaaagccctgaagctctcctggttcaagaaaggctcaagtattggaaagatgtttgaggcaactgccagaggcgctaggcggatggccatcctgggggataccgcatgggacttcggaagcattggtggcgtttttacatccgtggggaaacttgtccatcagatattcggaacggcgtacggcgtgctgttttctggtgtaagctggaccatgaagatcgggattggcgtgttgctcacttggctgggattaaattcacgaagtacatccctgagcatgacctgtatcgctgttggcctagtcacactctacctgggggtgatggtgcaggccgattctggatgcgtcatcaactggaaaggccgcgaacttaagtgtggttcagggattttcgttactaatgaggtgcacacctggacggaacaatataagtttcaggcagacagtccgaaaagattgagcgccgctataggaaaggcctgggaggagggcgtgtgcggtatcaggtccgcaacacggctggaaaacattatgtggaaacagatctctaacgagctcaatcatattctgttagaaaacgacatgaagttcaccgtagtcgtgggcgatgttgctgggatcctggcccagggcaagaagatgatacgccctcaacccatggagtacaaatattcgtggaaaagctggggcaaggcgaagatcattggggccgacgtgcagaatactacctttatcattgatggaccaaacacacctgaatgtcccgacgagcagagagcttggaatatctgggaggtcgaagattacggcttcggtatatttactaccaacatttggcttaagttgagggactcctatacacaggtgtgcgatcaccgtctcatgtcagcagccatcaaagacagtaaggctgttcacgccgatatggggtactggattgagtctgagaaaaatgagacgtggaagctggcacgggcgagcttcatcgaagtgaagacctgtatatggccaaaatcccatactctatggtcaaacggagtactggagagcgagatgatcattcccaagatctatggcggtcctatttctcaacacaattaccgaccaggctacttcacacagaccgccgggccgtggcatctcggaaaactggaacttgactttgatttgtgcgagggcactacagtcgtggtggacgaacactgcgggaacagaggaccctccctgaggaccacgactgtcaccggcaagatcatacacgagtggtgttgccgcagttgtacattacctccactccggttcagaggtgaggatgggtgctggtatggaatggaaattaggcccgttaaagagcgcgaagagaatctggtgaagtccatggtatctgctggctccggtgaagtggactcatttagtcttggcctgttgtgtatcagcatcatgattgaggaggtcatgcgatcgcggtggtcccgtaagatgctcatgaccgggactctggccgtgttcctactgctcatcatgggacagctgacatggaacgaccttattagattgtgcataatggttggcgcaaatgcttctgataggatggggatgggaaccacatacctggccttaatggcaacttttaaaatgcgccctatgttcgccgtgggcctcctgtttcggagacttaccagcagggaagtcctgctactcacgatcggtctgtcattggtggctagtgttgagctgccaaactccttagaagaactcggggacggactggcgatgggcattatgatccttaagctgttgacagatttccaatctcatcagctctgggccaccctgctaagcctgacttttattaaaaccacattctcccttcactatgcatggaagactatggctatggtgctctcaatcgtcagcctgtttcccttgtgtctgagtaccacgtctcagaaaacaacctggttaccggtactcctgggctcccttgggtgcaagcctctgactatgttcttgatagccgaaaataagatctggggacgacgcagctggccactcaacgagggtattatggccgtgggcatcgtttcgattctgctatcatcttttctgaaaaacgacgtgccccttgctgggcctctcatcgcaggaggcatgctgatagcctgttacgtcattagtggttccagcgcggatttgtctttagagaaggctgccgaagtgagctgggaggaagaggcagaacattccggggcctcacacaatatcctggtagaggtgcaggacgatggaacaatgaaaatcaaggacgaggaacgggatgacaccctcactattctgcttaaagctacactgttggcagtcagtggcgtttatcccctaagcataccagccaccctgttcgtgtggtacttctggcaaaagaaaaagcagagatctggcgtgctctgggatacgccttcacccccagaggtcgaaagggcggtgctggacgatgggatctatcgtattatgcagcgcggacttttaggtcggagccaggttggcgtaggggtgtttcaagagaacgtcttccatactatgtggcacgtgaccagaggagctgttctgatgtaccagggcaagaggctcgagccgagttgggccagcgtgaaaaaggacttgatctcctacggtgggggatggcgactgcagggctcttggaatacaggcgaagaggtccaggtgattgcagtagaacctgggaaaaaccccaagaatgtccaaaccgccccaggaacatttaaaactcccgagggtgaagtgggcgctatcgccctcgacttcaagcctgggacctcgggaagcccaatagttaaccgggagggcaagatcgtgggtctgtatgggaatggagtcgtgacgacatcaggcacttacgtttccgcaattgctcaggccaaagcgagtcaggagggcccccttcctgaaatcgaggatgaagtgtttcgcaagagaaacctgaccattatggacttgcacccggggtctggaaaaacaaggcggtatctaccagccatcgtccgagaggcaataaagagaaaactgcgcaccctcattttagctcccactagggtggtagccagcgaaatggctgaggcactgaagggtatgcctatccgttaccaaaccacagccgtgaagtccgagcatacgggcaaagaaatcgttgatcttatgtgccacgccactttcaccatgcggctgctctcaccagtcagagtgcccaattataacatgattatcatggacgaggctcattttacagatccttctagcatagcggcaagggggtacattagtacccgcgtgggaatgggcgaagccgctgccatcttcatgactgcaacaccgcccggttccgtcgaggcctttccacagagcaatgctgtaattcaggacgaagaacgagatatccctgagagatcttggaactcagggtatgaatggataaccgacttccccggaaagacggtgtggtttgttccatccattaaaagtggcaatgatatcgcgaactgtttgcggaagaatggcaaaagggtgatccagctgagccgcaagactttcgacacagagtaccaaaagaccaaaaacaacgattgggactacgtcgtgaccactgacatttcggaaatgggggccaatttccgtgcagatagagttatcgaccctcggaggtgcctcaagcccgtgattctgaaagatggaccagagcgcgtcatacttgctggtccgatgcctgtgacagtagcctctgcagcccagcgaagaggccggatcgggaggaaccacaataaggagggagaccagtatatttacatgggccagcccctaaacaatgatgaagaccatgctcactggaccgaggccaaaatgctgttggataacatcaatacaccagaaggtatcattcccgcgttatttgagcctgaacgcgagaagtccgcagccatagacggggagtatagactgaggggcgaagctcggaagactttcgtggagctcatgcgtcgcggagatctgccagtttggcttagctacaaagtcgcctcagaaggctttcaatatagtgaccgaagatggtgcttcgatggggagaggaacaatcaggtgctggaagagaacatggacgtggagatctggacgaaggaaggagagcggaaaaagctccgccccagatggttggatgctaggacctactctgaccctctggcactacgggaatttaaagagttcgccgctggtcgaagatccgtcagcggcgacctgattctcgaaatcgggaaacttccgcagcacctgacacagcgcgcccaaaatgcattagataacttggttatgctgcataattcagagcagggaggcagggcgtatcggcacgccatggaggaactcccagacactattgagaccctgatgcttctggctctcatcgccgtgttgacaggtggggtaaccctgtttttcttaagtggccgtggactaggcaaaactagcatagggctgctctgtgtgatggcatcctctgtccttctgtggatggctagcgtggaaccccattggatcgccgcatccattatcttggagtttttcctgatggttctcctgattcctgagcccgatagacagaggacgccacaggacaaccaacttgcctacgtggtcatcggactcctgtttatgatattgaccgtagctgcgaatgaaatgggtctgttagagacaactaagaaggatctaggcattgggcacgtggccgttggaaaccaccatcacgcagctatgctggacgtggatctccatcctgcctcagcctggaccctttacgcagtcgctacaaccatcattactcccatgatgcgccacacaatcgaaaacacgaccgccaatatatctctgactgcgatcgctaaccaggccgcaattttgatgggcctggacaaaggttggccaatcagtaagatggatattggggtgcctctcctggcccttggctgctattcgcaggtcaatccgttaacactgaccgctgcagtgctcatgttggttgcccattacgcgatcataggacccggcctgcaagctaaagccacccgggaggcacagaagcgaacagccgctgggattatgaaaaacccaactgtggacggaatcgtagccatcgatctagaccctgtggtctatgatgcaaagttcgaaaagcagctgggccagattatgctccttatcctgtgtacgagccaaatattgctgatgagaaccacatgggctctctgcgagtccattactctggccaccggtcccttaacaaccctttgggaggggtctccaggaaaattttggaatactacgatcgcggtttcaatggccaacattttcaggggcagctacctggcaggagctggcctcgccttctccctaatgaagagtctagggggaggccgccgggggacaggagcacagggcgaaaccttgggtgagaaatggaagagacagctgaatcagctctctaaaagcgaatttaacacttataagcgttcagggatcatggaggtggacaggtccgaagctaaggagggacttaaacggggcgagaccacaaagcacgccgtcagtcgcggtactgccaaactgcgatggttcgtggaaagaaatttggtaaagcctgagggcaaagtgatagacctggggtgtggaaggggcgggtggagctactattgcgcgggactcaagaaggttaccgaagtgaaaggctacacaaagggtgggcccggacacgaggaaccgatcccaatggctacgtacggctggaacttagtcaaactgcattctggcaaggatgtgtttttcattcctcccgagaaatgtgacacccttctgtgcgatatcggggagtcctcaccaaatcccactattgaagagggacggacactacgcgtcctcaagatggtggaaccttggctgagaggtaaccaattttgtatcaaaattttgaatccgtatatgcccagcgttgtagagaccctggagcagatgcagaggaagcacggcgggatgctcgtgcgaaacccactttcgagaaattctactcatgaaatgtactgggtcagttgcggaacaggcaacatcgtgtccgcagttaatatgaccagccgtatgctgttaaacagattcacgatggcccaccgcaagcctacctatgagagggacgtggatctgggtgctgggacacggcacgtcgccgtggaacccgaggtagcaaacttggacataattggacagagaatcgaaaatatcaaacatgagcacaagtcaacttggcattacgatgaggacaacccttataaaacctgggcctaccacggctcctatgaagtgaagccatctggcagcgctagttccatggttaatggggtcgtgaaactcctgacaaagccctgggatgtgattcctatggtcactcaaatagcgatgaccgacacaaccccatttggacagcagcgcgttttcaaggagaaagtggatactaggacgcccaaggccaaacgaggtacagcacaaatcatggaagtaaccgctaagtggctatggggctttcttagccggaacaaaaagccgagaatttgtactagggaggagttcacccgcaaggtgcgttctaatgccgcaatcggggccgtctttgtggacgagaaccagtggaactcagctaaagaggccgttgaagacgagcggttctgggatctggtgcataaggaaagagagctccacaaacagggaaagtgcgcgacatgcgtctacaacatgatgggcaaaagggaaaagaagctgggtgagtttgggaaagcaaagggaagtcgcgccatttggtacatgtggttgggcgctcgattcctggagttcgaagccctcggctttatgaatgaggaccactggttctcccgggaaaacagcctttctggggtggagggagagggtctgcataaattaggctatatcctgagagatatatcgaagatccctgggggaaatatgtacgcagacgatacggctggctgggacaccaggattactgaagatgacttgcagaacgaggcccgcatcacagatattatggaaccagagcacgctctcctggccaaatcaatctttaagctaacctatcaaaataaagtagttagagtgcagcggcccgcaaagaacggtactgtcatggacgtgataagcaggcgtgatcagcgagggtccggacaggtgggcacatacggccttaataccttcacaaacatggaagcgcaactgattcgccagatggagagtgaggggatcttttctcctagcgaactcgagactccaaacctggccgaaagagtcttggactggttagagaagtatggagttgaacggctgaaaaggatggctatctccggtgatgactgtgtggtaaagcccattgacgatcgcttcgccaccgcactcacggctcttaatgacatgggcaaagtgagaaaggatataccgcagtgggagccttcaaaagggtggaacgactggcagcaagtccccttttgcagtcatcacttccaccagctgatcatgaaggatggacgggagattgtggttccatgtaggaatcaggacgagctggtgggccgagcccgtgtctctcagggtgcagggtggagcctgagagagaccgcctgcctcggaaagtcctacgcgcaaatgtggcagttgatgtattttcatcgccgggatctgaggcttgctgccaacgcaatctgttcagccgtgcctgtagactggattcccacaagcagaactacctggtctatccacgctcatcaccagtggatgacaactgaagatatgctgtccgtttggaatcgcgtgtggatagaggaaaacccatggatggaggacaaaacccatatcagtagctggggcgatgtcccctacctcggcaagcgggaggaccaatggtgcgggtcgttaattggactgacggccagggcaacatgggctaccaatatccaggtggccattaaccaggttcgaagattgatcggtaatgaaaactacctggactatatgacttccatgaaacggttcaagaatgagtctgatcctgaaggcgcgctctggtga

SEQ ID NO: 13263 - RNA, 9879 nt, synthetic construct
  misc_feature 1..9879: note = derived and/or modified CDS sequence (opt3) from DENV-1__GQ868633__SS-prME
  source 1..9879: mol_type = other RNA
tccgtgaccatgctgctcatgcttatgcccacagcactggctttccacttgactacgagaggaggggagcctcatatgatcgtctccaagcaggaaagaggaaaatctttactgtttaagacctcagccggtgttaacatgtgcacattgattgccatggacctcggcgagctgtgtgaagatactatgacctacaaatgcccacggataacagaggcggaaccggacgatgtggactgttggtgcaatgctaccgatacttgggtaacatatgggacctgtagtcaaacgggagagcaccgccgagacaagcgtagcgtggcccttgcaccccatgtcggcctgggtttggagactagaaccgaaacatggatgtcctctgagggggcctggaaacagatccagagggtggaaacttgggctctccggcaccctggattcaccgttattgcactgtttctggcccatgctatcggcacatcgattacccagaagggcatcatattcatcctcttaatgctggtgacgccatcaatggccatgcgctgcgtcgggattggaagcagagattttgtggagggtcttagtggcgcgacttgggtagacgttgtgttggagcacgggtcctgtgtcacaaccatggcaaaggataaacccactctggacatcgaactactcaagacagaggtgaccaaccctgccattctgaggaaactttgcatcgaagctaagatatctaatacgaccacagatagccggtgtccaactcaaggagaggccaccctggtggaagaacaagacgcaaacttcgtctgccgccgaacatttgttgatagaggctggggtaatgggtgtggattgttcggcaaaggctccctcattacttgcgctaagtttaagtgcgtgaccaaactggaggggaagatcgtacagtacgaaaacttaaaatattcagtgattgtcacagtgcacaccggagaccagcatcaagttggtaatgagagtactgaacacggcacgacagccaccatcactccccaggcgcctaccacagagatccagctgaccgactacggggccctcactcttgattgtagcccaaggacaggactggacttcaacgaaatggtgttgctaacgatgaaggagaaatcttggctggtccataagcagtggtttctcgatctgccgcttccctggacctccggcgcatcaactagccaagagacatggaatcggcaggacctgttggtgaccttcaaaacagctcacgccaagaagcaggaagtagttgtgctcggtagtcaagagggggctatgcacactgccctgaccggcgcaacggaaattcagacctctggaacaactaccatatttgccggccatttaaaatgccgtctgaagatggataaactaacactcaaggggatgtcctatgtcatgtgtactggtagcttcaaactggagaaggaagtggctgagacccagcacggtacggtccttgtgcagatcaagtacgagggcacagacgcgccttgcaaaattccattctcgacccaagatgaaaagggggttactcagaacggacgcttgatcacagcaaatcccatagtgaccgacaaagagaagcctgtaaacattgaagccgagccaccctttggcgagtcttatatcgtcatcggtgctggggaaaaagccctgaagctctcctggttcaagaaaggctcaagtattggaaagatgtttgaggcaactgccagaggcgctaggcggatggccatcctgggggataccgcatgggacttcggaagcattggtggcgtgtttacatccgttgggaaacttgtgcatcagatattcggaacggcgtacggcgtcctgttttctggtgtgagctggaccatgaagatcgggattggcgtattgctcacttggctgggattaaattcacgaagtacatccctgagcatgacctgtatcgctgtgggcctagttacactctacctgggggtcatggtgcaggccgattctggatgcgtgatcaactggaaaggccgcgaacttaagtgtggttcagggattttcgtcactaatgaggttcacacctggacggaacaatataagtttcaggcagacagtccgaaaagattgagcgccgctataggaaaggcctgggaggagggcgtgtgcggtatcaggtccgcaacacggctggaaaacattatgtggaaacagatctctaacgagctcaatcatattctgttagaaaacgacatgaagttcaccgtggtagtcggcgatgtggctgggatcctggcccagggcaagaagatgatacgccctcaacccatggagtacaaatattcgtggaaaagctggggcaaggcgaagatcattggggccgacgttcagaatactacctttatcattgatggaccaaacacacctgaatgtcccgacgatcagagagcttggaatatctgggaggtggaggactacggcttcggtatatttactaccaacatttggcttaagttgagggattcctatacacaggtctgcgaccaccgtctcatgtcagcagccatcaaagatagtaaggctgtgcacgccgacatggggtactggattgaatctgagaaaaatgaaacgtggaagctggcacgggcgagcttcatcgaggttaagacctgtatatggccaaaatcccatactctatggtcaaacggagtgctggaaagcgagatgatcattcccaagatctatggcggtcctatttctcaacacaattaccgaccaggctacttcacacagaccgccgggccgtggcatctcggaaaactggagcttgattttgacttgtgcgaaggcactacagtagtcgtggatgagcactgcgggaacagaggaccctccctgaggaccacgactgtgaccggcaagatcatacacgaatggtgttgccgcagttgtacattacctccactccggttcagaggtgaggacgggtgctggtatggaatggagattaggcccgtcaaagaaaaggaggaaaatctggttaagagcatggtgtctgctggctccggtgaggtagactcatttagtcttggcctgttgtgtatcagcatcatgattgaagaggtgatgcgctcgcgatggtcccggaaaatgctcatgaccgggactctggccgtcttcctactgctcatcatgggacagctgacatggaacgatcttattcgtttgtgcataatggtgggcgcaaatgcttctgacagaatggggatgggaaccacatacctggccttaatggcaacttttaagatgaggcctatgttcgccgttggcctcctgtttcgccggcttaccagcagagaggtgctgctactcacgatcggtctgtcattggtcgctagtgtggaactgccaaactccttagaggaactcggggatggactggcgatgggcattatgatccttaaactgttgacagacttccaatctcatcagctctgggccaccctgctaagcctgacttttattaagaccacattctcccttcactatgcatggaaaactatggctatggttctctcaatcgtgagcctgtttcccttgtgtctgagtaccacgtctcagaagacaacctggttaccggtcctcctgggctcccttgggtgcaagcctctgactatgttcttgatagccgagaataaaatctggggaaggcgaagctggccactcaacgaaggtattatggccgtaggcatcgtgtcgattctgctatcatctctgcttaagaacgatgttcccctcgctgggcctctgatcgcaggaggcatgttgatagcctgttacgtgattagtggttccagcgcggacttatctctggagaaagctgccgaggtcagctgggaagaggaagcagagcattccggggcctcacacaatatcctcgtggaagtacaggatgacggaacaatgaagatcaaagatgaggagcgcgacgataccctgactattcttctgaaggctacattgctagcagtgagtggcgtctatcccctgagcataccagccaccctctttgtttggtacttctggcagaaaaagaagcagcggtctggcgtgctgtgggacacgccttcacccccagaagtggagagagcggtccttgatgacgggatctataggattatgcagcgtggattactgggtcgcagccaggtgggcgttggggtattccaagaaaacgtgtttcatactatgtggcacgtcacccggggagctgtgctcatgtaccagggcaaaagattggagccgagttgggccagcgttaagaaagacctgatctcctacggtgggggatggaggctccagggctcttggaatacaggcgaggaagtgcaggtcattgcagtggagcctgggaagaaccccaaaaatgtacaaaccgccccaggaacattcaagactcccgaaggtgaggtcggcgctatcgccctggattttaagcctgggacctcgggaagcccaatagtgaaccgagaaggcaaaatcgttggtctttatgggaatggagtggtcacgacatcaggcacttacgtgtccgcaattgctcaggccaaggcgagtcaggagggccccctgcctgagatcgaagacgaggttttccggaaacgcaacttgaccattatggatctacacccggggtctggaaagacaagaaggtatctgccagccatcgtgcgggaagcaataaaacgaaagctcagaaccttaattctggctcccactcgcgtcgtggccagcgagatggctgaagcacttaagggtatgcctatcaggtaccaaaccacagccgtaaaatccgagcatacgggcaaggagatcgtggacctgatgtgccacgccacttttaccatgcgtctcttgtcaccagttcgggtccccaattataacatgattatcatggatgaagctcatttcacagacccttctagcatagcggcaagagggtacattagtaccagggtgggaatgggcgaggccgctgccatctttatgactgcaacaccgcccggttccgtggaagccttcccacagagcaatgctgtcattcaggatgaggaacgcgacatccctgagcgatcttggaactcagggtatgagtggataaccgattttcccggaaaaacggtatggttcgtgccatccattaagagtggcaatgacatcgcgaactgtctgaggaaaaatggcaagcgggttatccagctcagcaggaagacttttgatacagaataccagaaaaccaagaacaacgactgggactacgtggtcaccactgatatttcggagatgggggccaatttccgcgcagaccgtgtgatcgatcctagacggtgcctgaaacccgttattcttaaggacggaccagaaagggtgatactagctggtccgatgcctgtcacagtggcctctgcagcccagcgccgaggcagaatcgggcggaaccacaataaagagggagatcagtatatttacatgggccagcccctgaacaatgacgaggatcatgctcactggaccgaagccaagatgttgttagacaacatcaatacaccagagggtatcattcccgcgctgttcgaacctgagagggaaaagtccgcagccatagatggggagtatcgcctcagaggcgaggctaggaaaacttttgtagaactgatgcggcgtggagaccttccagtgtggctgagctacaaggttgcctcagagggcttccaatatagtgatcgccgatggtgctttgacggggaaagaaacaatcaggtcctcgaggaaaacatggatgtggagatctggacgaaagagggagaaaggaagaaattgcggccccgctggctggacgctagaacctactctgaccctctagcactgagggagttcaaggaatttgccgctggtcggcgatccgtgagcggcgatctcattcttgagatcgggaaactgccgcagcacttaacacagagagcccaaaatgcattggacaacctggtcatgctccataattcagaacagggaggccgcgcgtataggcacgccatggaggagctgccagatactattgaaacccttatgctgctcgctttgatcgccgttctgacaggtggggtgaccttattctttctaagtggccggggactgggcaagactagcatagggctcctttgtgtaatggcatcctctgtgctgttgtggatggctagcgtcgagccccattggatcgccgcatccattatcctggagttctttctcatggtgctgcttattcctgagcccgaccgtcagagaacgccacaggataaccaactcgcctacgttgtgatcggactgttgttcatgatactgaccgtcgctgcgaatgagatgggtttactagaaacaactaagaaagacctgggcattgggcacgtagccgtgggaaaccaccatcacgcagctatgctcgatgttgaccttcatcctgcctcagcctggaccctgtacgcagtggctacaaccatcattactcccatgatgaggcacacaatcgagaacacgaccgccaatatatctttgactgcgatcgctaaccaggccgcaattctgatgggcctcgataagggttggccaatcagtaaaatggacattggggtccctctgcttgccttaggctgctattcgcaagtgaatccgctgacactcaccgctgcagtcttgatgctggtggcccattacgcgatcataggacccggcctacaagctaaggccacccgcgaagcacagaaacggacagccgctgggattatgaagaacccaactgttgatggaatcgtggccatcgacctggatcctgtagtgtatgacgcaaagtttgagaaacagctcggccagattatgcttctgatcttgtgtacgagccaaatactgctcatgcgaaccacatgggctctgtgcgaatccattactttagccaccggtccccttacaaccctgtgggaggggtctccaggaaagttctggaatactacgatcgcggtctcaatggccaacatttttagaggcagctacctcgcaggagctggcctagccttctccctgatgaaaagtctagggggaggcaggcgcgggacaggagcacagggcgagaccctgggtgaaaagtggaaacggcagctcaatcagctttctaagagcgagttcaacacttataagagatcagggatcatggaagttgaccgttccgaggctaaagaaggactgaagaggggcgaggccaccaaacacgccgtgagtcggggtcctgcgaagttgcgctggtttgtcgagcgaaatctggtgaaccccgaaggcaaagtaatagatctcgggtgtggaagaggcgggtggagctactattgcgctggattaaagaaggtgacagaggttaaaggctacactaagggtgggccgggacacgaagaaccaatccctatggcaacctacggctggaatctggtgaaacttcattctggcaaggacgtcttctttattcccccagaaaaatgtgatacactgctatgcgacatcggggagtcctcacccaaccctacgattgaggaaggaaggaccctccgggtgctgaagatggtcgagccgtggttgcgcggtaatcaattctgtatcaaaattctgaacccctatatgccaagcgtggttgaaactctcgagcagatgcagagaaagcacggcgggatgcttgtaaggaatcctctgtcgcgaaactctacacatgagatgtactgggtgagttgcggaaccggcaatatcgtctccgccgtgaacatgactagccggatgttactgaaccgttttacaatggctcacagaaagcccacctatgaacgcgatgttgacttgggtgccgggacgaggcacgtggcagtcgagcctgaagtggccaatctcgatataattggacagcggatcgagaacatcaaacatgaacacaagtcaacctggcattacgacgaggataatccatataaaacatgggcttaccacggctcctatgaggtaaagccctctggcagcgcgagttccatggtgaacggggttgtcaaactgctaactaagccttgggacgtgattccaatggtgacccaaatagccatgacagatactacccccttcggacagcagagagtctttaaggaaaaagttgacacacgcaccccgaaggcaaaaaggggtactgctcaaatcatggaggtgacggccaagtggctttggggcttcctgagccgaaataaaaagcctcggatttgtacaagagaagagtttaccaggaaggtacgctctaacgcagccatcggggctgtgttcgtcgacgaaaatcagtggaactcagccaaagaggcggtggaggatgaacgtttttgggacctcgttcataaggagcgggaactgcacaaacagggaaagtgcgcaacttgcgtgtacaatatgatgggcaaaagagagaagaagttgggtgagttcgggaaagccaagggaagtagggctatttggtacatgtggctgggcgcccgctttctcgagttcgaggcacttggcttcatgaacgaagatcactgggtctcccgagagaatagcctgtctggggtggaaggagagggtttacataaactgggctatatcttgcgggacatatcgaagatcccagggggaaacatgtacgctgatgacaccgccggctgggatacaagaattacggaggacgatctccagaatgaagctaggatcaccgacattatggagcccgaacacgccctgctagcaaaatcaatctttaaacttacttatcaaaacaaagtagttcgcgtgcagagacctgcgaagaatggtacagtcatggatgtgataagccggagggaccagcgtgggtccggacaggtgggcacctacggcctgaacactttcacaaacatggaggcccaactcattcgacagatggaaagtgaggggatcttttctccaagcgagctggaaacccccaatttggctgagcgcgtcttagattggctggaaaagtatggagttgagagactcaaacggatggccatctccggtgacgactgtgtggtaaagccgattgatgacaggttcgcaacagctcttactgccctgaacgatatgggcaaagtgcgcaaggacatacctcagtgggaaccctcaaaagggtggaatgattggcagcaagtcccattttggagtcatcacttccaccagctaatcatgaaggacggaagagagattgtggttccttgccggaaccaggatgagctggtgggcagggcacgagtctctcagggtgccgggtggagcctccgtgaaaccgcgtgtttgggaaagtcctacgctcaaatgtggcagctgatgtattttcatagacgcgaccttcggctggccgcaaatgccatctgctcagctgtgcccgtagattggattccaacgagcaggaccacatggtctatccacgcccatcaccagtggatgactaccgaggacatgctctccgtttggaacagagtgtggatagaagagaatccctggatggaagataaaacacatatcagtagctggggcgacgtcccttacttaggcaagcgcgaggaccaatggtgtgggtcgctgattggattgactgcacgggctacctgggccacgaacatccaggtggcgattaatcaggttaggcgactgatcggtaacgagaattacctcgattatatgacatccatgaaaagattcaagaacgaatctgacccagagggcgctctttggtga

SEQ ID NO: 13264 - RNA, 9879 nt, synthetic construct
  misc_feature 1..9879: note = derived and/or modified CDS sequence (opt3) from DENV-1__GU131919__SS-prME
  source 1..9879: mol_type = other RNA
agcgtgaccatgctgctcatgcttatgcccacagccctggctttccacttgactacgagaggcggggagcctcatatgatcgtctccaagcaggaaaggggaaaatctttactgtttaagacctcagcaggtgttaacatgtgcacactaattgccatggacctcggcgagctgtgtgaagatactatgacctacaaatgcccacggataacagaggcggaaccggacgatgtggactgttggtgcaatgctaccgatacttgggtaacatatgggacctgtagtcaaacgggagagcaccgccgagacaagcgtagcgtggcccttgcaccccatgtcggcctgggtttggagactagaaccgaaacatggatgtcctctgagggggcctggaaacagatccagagggtggaaacttgggctctccggcaccctggattcaccgttattgcactgtttctggcccatgctatcggcacatcgattacccagaagggcatcatattcatcctcttaatgctggtgacgccatcaatggccatgcgctgcgtcgggattggaagcagagattttgtggagggtcttagtggcgcgacttgggtagacgttgtgttggagcacgggtcctgtgtcacaaccatggcaaaggataaacccactctggacatcgaactactcaagacagaggtgaccaaccctgccattctgaggaaactttgcatcgaagctaagatatctaatacgaccacagatagccggtgtccaactcaaggagaggccaccctggtggaagagcaggacgcaaacttcgtctgccgccgaacatttgttgatagaggctggggtaatgggtgtggattgttcggcaaaggctccctcattacttgcgctaagtttaagtgcgtgaccaaactggaggggaagatcgtacagtacgaaaacttaaaatattcagtgattgtcacagtgcacaccggagaccagcatcaagttggtaatgagagtactgaacacggcacgacagccaccatcactccccaggcgcctaccacagagatccagctgaccgactacggggccctcactcttgattgtagcccaaggacaggactggacttcaacgaaatggtgttgctaacgatgaaggagaaatcttggctggtccataagcagtggtttctcgatctgccgcttccctggacctccggcgcatcaactagccaagagacatggaatcggcaggacctgttggtgaccttcaaaacagctcacgccaagaagcaggaagtagttgtgctcggtagtcaagagggggctatgcacactgccctgaccggcgcaacggaaattcagacctctggaacaactaccatatttgccggccatttaaaatgccgtctgaagatggataaactaacactcaaggggatgtcctatgtcatgtgtactggaagcttcaaactggagaaggaagtggctgagacccagcacggtacggtccttgtgcagatcaagtacgagggcacagacgcgccttgcaaaattccattcttgacccaagatgaaaagggggttactcagaacggacgcctgatcacagcaaatcccatagtgaccgacaaagagaagcctgtaaacattgaagccgagccaccctttggcgagtcgtatatcgtcatcggtgctggggaaaaagccctcaagctgtcttggttcaagaaaggctcctcaattggaaagatgtttgaggcaactgccagaggcgctaggcggatggccatccttggggataccgcatgggacttcggaagtattggtggcgtgtttacaagcgttgggaaactgatacatcagatcttcggaacggcgtacggcgtgttgttttccggtgtctcttggaccatgaagattgggatcggcgtgctcctgacttggttaggactgaatagccgatcaacaagtctatccatgacctgtatcgctgtaggcctcgtgacactgtaccttggggttatggtccaggccgatagcggatgcgtgattaactggaaaggccgcgaattgaagtgtggttctgggatattcgtgactaatgaggtccacacctggacggaacaatataagtttcaggcagactcaccgaaaagactgagtgccgctatcggaaaggcctgggaggagggcgtttgcggtattaggagcgcaacacggctcgaaaacatcatgtggaaacagatttccaacgagctgaatcatatcttactggaaaacgacatgaagttcaccgtggtggtaggcgatgtcgctgggatacttgcccagggaaaaaagatgatccgccctcaacccatggagtacaaatattcttggaagtcgtggggcaaggcgaaaattatcggggccgacgtgcagaatactacctttattatcgatggaccaaacacacctgaatgtcccgacgatcagagagcttggaatatatgggaggttgaggactacggcttcggtatttttactaccaacatctggttgaagctcagggatagctatacacaggtgtgcgaccaccgtctgatgtccgcagccattaaagattcaaaggctgtccacgccgacatggggtactggatcgaaagtgagaaaaatgaaacgtggaagctagcacgggcgtctttcatagaggtgaagacctgtatctggccaaaaagccatactctgtggtccaacggagttctcgaatcagagatgattatccccaagatttatggcggtcctatcagccaacacaattaccgaccaggctacttcacacagaccgccgggccgtggcatctgggaaaacttgagttggattttgacctgtgcgaaggcactacagtggtagtcgatgagcactgcgggaacagaggaccctctttaaggaccacgactgtgaccggcaagataattcacgaatggtgttgccgctcctgtacactccctccactgcggttcagaggtgaggacgggtgctggtatggaatggagatcaggcccgtgaaagaaaaggaggaaaatcttgtcaagagtatggttagcgctggctctggtgaggtggactccttttcactgggcttgctctgtatcagtattatgatcgaagaggtaatgcgcagccgatggtcgcggaaaatgctgatgaccgggactctagccgtgttcctgctcctgattatgggacagcttacatggaacgatttgatacgtctgtgcatcatggtcggcgcaaatgcttgtgacagaatggggatgggaaccacatacttagccctcatggcaacttttaagatgaggcctatgttcgccgtgggcctgctttttcgccggctgacctccagagaggttctactcctgacgattggtttgtctctggtggctagcgtcgaattaccaaactcactcgaggaactgggggatggacttgcgatgggcatcatgattctgaaattgctcacagacttccaaagttatcagctgtgggccaccctactgtcccttacttttatcaagaccacattctctctccattacgcatggaaaactatggctatggtgctgagcatagtttccttgtttcccctgtgcttatcaaccacgagccagaagacaacctggctcccggtgctgcttggcagtctggggtgtaagcctttgactatgttcctcatcgccgagaataaaatttggggaaggcgatcttggccactgaacgaaggtatcatggccgtcggcattgtatccatcctactgagctcgcttctcaagaacgatgtgcccctggctgggcctttgatagcaggaggcatgttaattgcctgctatgttatctcaggttctagtgcggacctgtccctcgagaaagctgccgaggtgagctgggaagaggaagcagagcactctggggccagccataatatcctggtcgaagtgcaggatgacggaacaatgaagattaaagatgaggagcgcgacgatacccttactatactgttgaaggctacactactggcagtatccggcgtgtaccccctctcaatcccagccaccctgtttgtctggtatttctggcaaaaaaagaagcagcggagtggcgttctttgggacacgcctagccccccagaagtggagagagcggtgttagatgacgggatttacaggatcatgcagcgtggactgctcggtcgctctcaggtcggcgtgggggttttccaagaaaacgtatttcacactatgtggcatgtgacccggggagctgtcttgatgtaccagggcaaaagactggagccgtcctgggcctcagtgaagaaagacctcattagttatggtgggggatggaggctgcagggcagctggaatacaggcgaggaagttcaggtgatcgcagtcgagcctgggaagaaccccaaaaatgtgcaaaccgccccaggaacattcaagactcccgaaggtgaggtaggcgctatagcccttgattttaagcctgggacctccggatctccaatcgtcaaccgagaaggcaaaattgtgggtctgtacgggaatggagttgtgacgacatcgggcacttatgtcagcgcaatcgctcaggccaaggcgtcacaggagggccccttgcctgagattgaagacgaggtgttccggaaacgcaacctaaccatcatggatctgcacccggggtccggaaagacaagaaggtacctcccagccatagttcgggaagcaattaaacgaaagttaagaaccctgatccttgctcccactcgcgtggtcgccagtgagatggctgaagcactgaagggtatgcctatcaggtatcaaaccacagccgtgaaatctgagcacacgggcaaggagattgtagacctcatgtgtcatgccacttttaccatgcgtttgctgagcccagtgcgggttcccaattacaacatgatcataatggatgaagctcacttcacagacccttcctcaattgcggcaagagggtatatctctaccagggtcggaatgggcgaggccgctgccatttttatgactgcaacaccgcccggtagcgtggaagccttcccacagagtaatgctgtgatccaggatgaggaacgcgacatacctgagcgatcctggaacagcgggtacgagtggattaccgattttcccggaaaaacggtctggttcgtaccatctatcaagtcaggcaatgacatcgcgaactgcctcagaaaaaatggcaagcgggtgattcagctgtccaggaagacttttgatacagaataccaaaaaaccaagaacaacgactgggactatgttgtgaccactgatatcagtgagatgggggccaatttccgcgcagaccgtgtcattgatcctagacggtgccttaaacccgtgatactaaaggacggaccagaaagggttatcctggctggtccgatgcctgtgacagtcgccagcgcagcccagcgccgaggcagaattgggcggaaccataataaagagggagatcagtacatctatatgggccagcccttgaacaatgacgaggatcacgctcattggaccgaagccaagatgttactggacaacatcaatacaccagagggtattatacccgcgctcttcgaacctgagagggaaaagtcggcagccatcgatggggagtaccgcctgagaggcgaggctaggaaaacttttgtggaacttatgcggcgtggagacctgccagtatggctctcttataaggtggcctccgagggcttccaatacagcgatcgccgatggtgttttgacggggaaagaaacaatcaggttttggaggaaaacatggatgtcgagatttggacgaaagagggagaaaggaagaaactgcggccccgctggctagacgctagaacctattcagaccctctggcactcagggagttcaaggaatttgccgctggtcggcgaagtgtgtctggcgatcttatcctggagattgggaaattaccgcagcacttgacacagagagcccaaaatgcactggacaacctcgtgatgctgcacaattccgaacagggaggccgcgcgtacaggcatgccatggaggagcttccagatactatcgaaaccctgatgctcttggctctgatagccgtcttaacaggtggggttaccctattctttctgagcggccggggactcggcaagacttcaatcgggcttctgtgcgtgatggcaagtagcgtattgctgtggatggcttccgtggagccccactggattgccgcatctatcattctcgaattctttctgatggtccttctcatccctgagcccgaccgtcagagaacgccacaggataaccaactggcctacgtggttataggattgctgttcatgattttaaccgtggctgcgaatgagatgggtctactggaaacaactaagaaagacctcggcatcgggcatgtcgccgtaggaaaccaccaccatgcagctatgcttgatgtggacctgcaccctgccagcgcctggaccttgtatgcagttgctacaaccattatcactcccatgatgaggcatacaatagagaacacgaccgccaatatctccctgactgcgattgctaaccaggccgcaatcctcatgggcctggataagggttggccaatttcaaaaatggacatcggggtgcctcttttagccctgggctgttactctcaggtcaatccgctcacattgaccgctgcagtgctgatgctagtcgcccactatgcgataattggacccggcctgcaagctaaggccacccgcgaagcacagaaacggacagccgctgggatcatgaagaacccaactgtggatggaatcgttgccattgacctcgatcctgtggtatacgacgcaaagtttgagaaacagcttggccagatcatgctgttgatactgtgcacgagtcaaattctcctgatgcgaaccacatgggctttatgtgaatcgatcactcttgccaccggtcccctgacaaccctctgggaggggagcccaggaaagttctggaatactacgattgcggtgtccatggccaacatctttagaggctcttatctagcaggtgctggcctggccttctcattgatgaaaagcctggggggaggcaggcgcgggacaggagcacagggcgagaccctcggtgaaaagtggaaacggcagcttaatcagctgtccaagagtgagttcaacacttacaagagatctgggataatggaagtcgaccgtagcgaggctaaagaaggattgaagaggggcgagaccacaaaacatgccgtttcacggggtactgccaagctgcgctggtttgtggagcgaaatctcgtcaaacctgaaggcaaggtgatcgatttagggtgcggaagaggcgggtggtcctattactgtgcgggactgaagaaagtaaccgaggtgaagggctacacaaaaggtgggcccggacacgaagagccgattccaatggctacgtatggctggaaccttgttaagctgcacagtggcaaagacgtgttctttatccctcccgaaaagtgcgataccctactctgtgacattggggagagctctccaaatcccactatcgaggaaggaaggacactgcgggtcttgaaaatggtggagccttggctgcgcggtaaccaattctgcattaagatcctcaatccgtacatgccctccgtcgtggaaacccttgagcagatgcagagaaagcatggcgggatgctggttaggaacccattatcacgaaatagcactcacgagatgtattgggtatcgtgtggaacaggcaacatagtgtctgcagtcaatatgaccagtcggatgctgttgaaccgttttacgatggcccatagaaaacctacctacgaacgcgatgtggacctcggtgctgggacaaggcacgttgccgtggagcccgaagtcgcaaacctggatattatcggacagcggatcgagaatattaagcacgaacataaatccacttggcactatgacgaggataacccttacaagacctgggcctatcatggcagctacgaggtgaaaccatcaggctccgcttctagcatggtaaatggggtggttaagctacttacaaagccctgggacgtcatacctatggtgactcaaatcgcgatgaccgatacaaccccattcggacagcagagagtgtttaaagaaaaggtcgacactcgcacgcccaaagccaagaggggtacagcacaaattatggaggttaccgctaaatggctgtggggcttcctcagtcgaaacaagaagccgcggatctgcactagagaagagtttaccaggaaagtgcgctccaatgccgcaattggggccgtattcgtggacgaaaaccagtggaatagcgctaaggaggccgtcgaggatgaacgtttttgggacctggtgcaccgggagagagaattgcataaacagggaaagtgcgcgacatgtgtttacaacatgatgggcaaaagggagaagaagctgggtgaattcgggaaagcaaagggatctcgcgccatctggtatatgtggctcggcgctcgatttcttgagttcgaggccctgggcttcatgaatgaagatcactggttttcacgggagaacagtttatccggggtggaaggagagggtctgcacaaattgggctacatactcagagacatcagcaagattcctgggggaaatatgtatgcagatgacacggctggctgggataccaggatcactgaggacgatctgcagaacgaagcccgcattacagacatcatggagccagaacatgctctacttgccaaatctatattcaagctgacctaccaaaataaagtcgtgagagtacagcggcccgcaaagaacggtactgttatggatgtgatttcgaggcgtgaccagcgagggtcaggacaggtcggcacatatggcctcaatacctttacaaacatggaggcgcaactgatccgccagatggaaagcgaggggatcttctcccctagtgagttggaaactccaaacttagccgagagagtgctggattggctcgaaaagtacggagtggagcggcttaaaaggatggctatttctggtgacgactgcgtcgttaagcccatagatgaccgctttgccaccgcactgacggctctaaatgatatgggcaaagtgagaaaggacatcccgcagtgggaacctagcaaagggtggaacgattggcagcaagtacccttctgttcccaccattttcaccagctgattatgaaggacggacgggagatcgtggtcccatgcaggaatcaggatgagctcgtgggccgagcccgtgtttcacagggtgcagggtggagtttgagagaaaccgcctgtctgggaaagtcttatgcgcaaatgtggcagcttatgtacttccaccgccgggacctgaggctcgctgccaacgcaatttgcagcgccgtgcctgtcgattggatccccacatccagaactacctggtcaatacatgctcaccatcagtggatgacaactgaggacatgttaagcgtgtggaatcgcgtatggatcgaagagaacccatggatggaagataaaacccacatttcttcctggggcgacgttccctacctgggcaagcgggaggaccaatggtgtgggagtttgatcggactgacggccagggcaacatgggctaccaatattcaggtggccatcaaccaggtccgaagactcattggtaatgagaactatcttgattacatgactagcatgaaacggtttaagaatgaatcggaccctgagggcgcgctgtggtga

SEQ ID NO: 13265 - RNA, 9879 nt, synthetic construct
  misc_feature 1..9879: note = derived and/or modified CDS sequence (opt3) from DENV-1__GU131920__SS-prME
  source 1..9879: mol_type = other RNA
tccgtgaccatgctgctcatgcttatgcccacagcactggctttccacttgactacgagaggcggggagcctcatatgatcgtctccaagcaggaaaggggaaaatctttactgtttaagacctcagccggtgttaacatgtgcacattaattgcaatggacctcggcgagctgtgtgaagatactatgacctacaaatgcccacggataacagaggcggaaccggacgatgtggactgttggtgcaatgctaccgatacttgggtaacatatgggacctgtagtcaaacgggagagcaccgccgagacaagcgtagcgtggcacttgcaccccatgtcggcctgggtttggagactagaaccgaaacatggatgtcctctgagggggcctggaaacagatccagagggtggaaacttgggctctccggcaccctggattcaccgttattgcactgtttctggcccatgctatcggcacatcgattacccagaagggcatcatattcatcctcttaatgctggtgacgccatcaatggccatgcgctgcgtcgggattggaagcagagattttgtggagggtcttagtggcgcgacttgggtagacgttgtgttggagcacgggtcctgtgtcacaaccatggcaaaggataaacccactctggacatcgaattgctcaagacagaggtgaccaaccctgccattctgaggaaactttgcatcgaagctaagatatctaatacgaccacagatagccggtgtccaactcaaggagaggccaccctggtggaagaacaggacgcaaacttcgtctgccgccgaacatttgttgatagaggctggggtaatgggtgtggattgttcggcaaaggctccctcattacttgcgctaagtttaagtgcgtgaccaaactggaggggaagatcgtacagtacgaaaacttaaaatattcagtgattgtcacagtgcacaccggagaccagcatcaagttggtaatgagagtactgaacacggcacgacagccaccatcactccccaggcgcctaccacagagatccagctgaccgactacggggccctcactcttgattgtagcccaaggacaggactggacttcaacgaaatggtgttgctaacgatgaaggagaaatcttggctggtccataagcagtggtttctcgatctgccgcttccctggacctccggcgcatcaactagccaagagacatggaatcggcaggacctgttggtgaccttcaaaacagctcacgccaagaagcaggaagtagttgtgctcggtagtcaagagggggctatgcacactgccctgaccggcgcaacggaaattcagacctctggaacaactaccatatttgccggccatttaaaatgccgtctgaagatggataaactaacactcaaggggatgtcctatgtcatgtgtactggatcgttcaaactggagaaggaagtggctgagacccagcacggtacggtccttgtgcagatcaagtacgagggcacagacgcgccttgcaaaattccattctcgacccaagatgaaaagggggttactcagaacggacgcttgatcacagcaaatcccatagtgaccgacagagagaaacctgtaaacattgaagccgagccaccctttggcgagtcttatatcgtcatcggtgctggggaaaaggccctgaaactctcctggttcaagaagggctcaagtattggaaaaatgtttgaggcaactgccaggggcgctcggcgaatggccatcctgggggataccgcatgggacttcggaagcattggtggcgtgtttacatccgttgggaaacttgtgcatcagatattcggaacggcgtacggcgtcctgttttctggtgtgagctggaccatgaaaatcgggattggcgtattgctcacttggctgggattaaattcacgcagtacatccctgagcatgacctgtatcgctgtgggcctagttacactctacctgggggtcatggtgcaggccgattctggatgcgtgatcaactggaagggcagagaacttaaatgtggttcagggattttcgtcactaatgaggttcacacctggacggaacaatataagtttcaggcagacagtccgaagaggttgagcgccgctataggaaaagcctgggaggagggcgtgtgcggtatccggtccgcaacacgcctggaaaacattatgtggaagcagatctctaacgagctcaatcatattctgttagaaaacgacatgaaattcaccgtggtagtcggcgatgtggctgggatcctggcccagggaaagaaaatgataagacctcaacccatggagtacaagtattcgtggaaaagctggggcaaggcgaagatcattggggccgacgttcagaatactacctttatcattgatggaccaaacacacctgaatgtcccgacgatcagagggcttggaatatctgggaggtggaggactacggcttcggtatatttactaccaacatttggcttaaattgcgtgattcctatacacaggtctgcgaccaccggctcatgtcagcagccatcaaggatagtaaagctgtgcacgccgacatggggtactggattgaatctgagaagaatgaaacgtggaaactggcacgagcgagcttcatcgaggttaagacctgtatatggccaaagtcccatactctatggtcaaacggagtgctggaaagcgagatgatcattcccaaaatctatggcggtcctatttctcaacacaattacagaccaggctacttcacacagaccgccgggccgtggcatctcggaaagctggagcttgattttgacttgtgcgaaggcactacagtagtcgtggatgagcactgcgggaacaggggaccctccctgcgcaccacgactgtgaccggcaaaatcatacacgaatggtgttgccggagttgtacattacctccactcagattcaggggtgaggacgggtgctggtatggaatggagattcgccccgtcaaggaaaaagaggaaaatctggttaagagcatggtgtctgctggctccggtgaggtagactcatttagtcttggcctgttgtgtatcagcatcatgattgaagaggtgatgcgatcgcggtggtcccgtaagatgctcatgaccgggactctggccgtcttcctactgctcatcatgggacagctgacatggaacgatcttattagattgtgcataatggtgggcgcaaatgcttctgacaggatggggatgggaaccacatacctggccttaatggcaacttttaaaatgcgccctatgttcgccgttggcctcctgtttcggagacttaccagcagggaggtgctgctactcacgatcggtctgtcattggtcgctagtgtggaactgccaaactccttagaggaactcggggatggactggcgatgggcattatgatccttaagctgttgacagacttccaatctcatcagctctgggccaccctgctaagcctgacttttattaaaaccacattctcccttcactatgcatggaagactatggctatggttctctcaatcgtgagcctgtttcccttgtgtctgagtaccacgtctcagaaaacaacctggttaccggtcctcctgggctcccttgggtgcaagcctctgactatgttcttgatagccgagaataagatctggggacgacgcagctggccactcaacgaaggtattatggccgtaggcatcgtgtcgattctgctatcatctctgcttaaaaacgatgttcccctcgctgggcctctgatcgcaggaggcatgttgatagcctgttacgtgattagtggttccagcgcggacttatctctggagaaggctgccgaggtcagctgggaagaggaagcagagcattccggggcctcacacaatatcctcgtggaagtacaggatgacggaacaatgaaaatcaaggatgaggagcgggacgataccctgactattcttctgaaagctacattgctagcagtgagtggcgtctatcccctgagcataccagccaccctctttgtttggtacttctggcaaaagaaaaagcagagatctggcgtgctgtgggacacgccttcacccccagaagtggagagggcggtccttgatgacgggatctatcgtattatgcagcgcggattactgggtcggagccaggtgggcgttggggtattccaagaaaacgtgtttcatactatgtggcacgtcaccagaggagctgtgctcatgtaccagggcaagaggttggagccgagttgggccagcgttaaaaaggacctgatctcctacggtgggggatggcgactccagggctcttggaatacaggcgaggaagtgcaggtcattgcagtggagcctgggaaaaaccccaagaatgtacaaaccgccccaggaacattcaaaactcccgaaggtgaggtcggcgctatcgccctggattttaagcctgggacctcgggaagcccaatagtgaaccgggaaggcaagatcgttggtctttatgggaatggagtggtcacgacatcaggcacttacgtgtccgcaattgctcaggccaaagcgagtcaggagggccccctgcctgagatcgaagacgaggttttccgcaagagaaacttgaccattatggatctacacccggggtctggaaaaacaaggcggtatctgccagccatcgtgcgagaagcaataaagagacgcctcaggaccttaattctggctcccactcgtgtcgtggccagcgagatggctgaagcacttaaaggtatgcctatccggtaccaaaccacagccgtaaagtccgagcatacgggcaaggagatcgtggacctgatgtgccacgccacttttaccatgagactcttgtcaccagttagggtccccaattataacatgattatcatggatgaagctcatttcacagacccttctagcatagcggcacgcgggtacattagtacccgagtgggaatgggcgaggccgctgccatctttatgactgcaacaccgcccggttccgtggaagccttcccacagagcaatgctgtcattcaggatgaggaaagagacatccctgagcggtcttggaactcagggtatgagtggataaccgattttcccggaaaaacggtatggttcgtgccatccattaagagtggcaatgacatcgcgaactgtctgaggaaaaatggcaagcgcgttatccagctcagccgtaaaacttttgatacagaataccaaaagaccaagaacaacgactgggactacgtggtcaccactgatatttcggagatgggggccaatttcagagcagaccgggtgatcgatcctaggcgctgcctgaaacccgttattcttaaggacggaccagaacgagtgatactagctggtccgatgcctgtcacagtggcctctgcagcccagagacggggcaggatcgggcgcaaccacaataaagagggagatcagtatatttacatgggccagcccctgaacaatgacgaggatcatgctcactggaccgaagccaagatgttgttagacaacatcaatacaccagagggtatcattcccgcgctgttcgaacctgagagagaaaaatccgcagccatagatggggagtataggctccggggcgaggctcgtaagacttttgtagaactgatgcgccgaggagaccttccagtgtggctgagctacaaggttgcctcagagggcttccaatatagtgatagaaggtggtgctttgacggggaacggaacaatcaggtcctcgaggaaaacatggatgtggagatctggacgaaagagggagaacgcaagaaattgagacccaggtggctggacgctcggacctactctgaccctctagcactgcgagagttcaaggaatttgccgctggtagacgctccgtgagcggcgatctcattcttgagatcgggaaactgccgcagcacttaacacagagggcccaaaatgcattggacaacctggtcatgctccataattcagaacagggaggccgggcgtatcgtcacgccatggaggagctgccagatactattgaaacccttatgctgctcgctttgatcgccgttctgacaggtggggtgaccttattctttctaagtggcagaggactgggcaagactagcatagggctcctttgtgtaatggcatcctctgtgctgttgtggatggctagcgtcgagccccattggatcgccgcatccattatcctggagttctttctcatggtgctgcttattcctgagcccgacaggcagcgcacgccacaggataaccaactcgcctacgttgtgatcggactgttgttcatgatactgaccgtcgctgcgaatgagatgggtttactagaaacaactaaaaaggacctgggcattgggcacgtagccgtgggaaaccaccatcacgcagctatgctcgatgttgaccttcatcctgcctcagcctggaccctgtacgcagtggctacaaccatcattactcccatgatgcggcacacaatcgagaacacgaccgccaatatatctttgactgcgatcgctaaccaggccgcaattctgatgggcctcgataagggttggccaatcagtaaaatggacattggggtccctctgcttgccttaggctgctatagccaggtgaatccgctgacactcaccgctgcagtcttgatgctggtggcccattacgcgatcataggacccggcctacaagctaaggccacccgagaagcacagaaaagaacagccgctgggattatgaagaacccaactgttgatggaatcgtggccatcgacctggatcctgtagtgtatgacgcaaaatttgagaagcagctcggccagattatgcttctgatcttgtgtacgagccaaatactgctcatgaggaccacatgggctctgtgcgaatccattactttagccaccggtccccttacaaccctgtgggaggggtctccaggaaagttctggaatactacgatcgcggtctcaatggccaacatttttcgcggcagctacctcgccggtgctggcctagccttctccctgatgaaaagtctagggggaggccggagagggacaggagcacagggcgagaccctgggtgaaaagtggaaacgtcagctcaatcagctttctaagagcgagttcaacacttataaaaggtcagggatcatggaagttgaccggtccgaggctaaggaaggactgaagcgcggcgagaccacaaaacacgccgtgagtcgaggtactgccaagttgagatggtttgtcgagaggaatctggtgaaacctgaaggcaaggtaatagatctcgggtgtggacggggcgggtggagctactattgcgcgggactaaagaaggtgaccgaggttaagggctacacaaaaggtgggcccggacacgaagaaccgatcccaatggctacgtacggctggaacctggtgaaacttcattctggcaaagacgtcttctttattcctcccgaaaagtgtgataccctgctatgcgacatcggggagtcctcaccaaatcccactattgaggaaggacgcacactcagagtgctgaaaatggtcgagccttggttgaggggtaaccaattctgtatcaagattctgaatccgtatatgcccagcgtggttgaaaccctcgagcagatgcagcgaaaacacggcgggatgcttgtacggaacccactgtcgcgtaattctactcatgagatgtactgggtgagttgcggaacaggcaacatcgtctccgcagtgaatatgaccagcagaatgttactgaaccgctttacgatggcccacaggaagcctacctatgaacgggatgttgacttgggtgctgggacaagacacgtggccgtcgagcccgaagtggcaaacctcgatataattggacagcgcatcgagaatatcaagcatgaacacaaatcaacttggcattacgacgaggataacccttataagacctgggcctaccacggctcctatgaggtaaaaccatctggcagcgctagttccatggtgaatggggttgtcaagctgctaacaaaaccctgggacgtgattcctatggtgactcaaatagcgatgaccgatacaaccccattcggacagcagagggtctttaaggaaaaggttgacactcgaacgcccaaagccaagcggggtacagcacaaatcatggaggtgaccgctaaatggctttggggcttcctgagcagaaacaagaaaccgaggatttgtactcgcgaagagtttacccgtaaggtacggtctaatgccgcaatcggggccgtgttcgtcgacgaaaaccagtggaactcagctaaggaggccgtggaggatgaaagattttgggacctcgttcataaagagagggaactgcacaagcagggaaaatgcgcgacatgcgtgtacaacatgatgggcaagcgcgagaaaaagttgggtgagttcgggaaggcaaaaggaagtcgagccatttggtacatgtggctgggcgctcggtttctcgagttcgaggcccttggcttcatgaatgaagatcactggttttccagagagaacagcctgtctggggtcgaaggagagggtttacataagctgggctatatcttgagggacatatcgaaaatccctgggggaaatatgtacgcagatgacacggctggctgggatacccgcattactgaggacgatctccagaacgaagccagaatcacagacattatggagccagaacacgctctgctagccaagtcaatcttcaaacttacctatcaaaataaggtggtacgggttcagaggcccgccaagaatggtactgtgatggatgtcataagccgtcgagaccagcgcgggtccggacaggtgggcacatacggcctgaatacctttacaaacatggaggcgcaactcattagacagatggaaagtgaggggatcttctctcctagcgagctggaaactccaaacttggccgagcgggtgttagattggctggaaaagtatggagtcgagaggctcaagcgcatggctatctccggtgacgactgtgttgtgaaacccattgatgacagatttgccaccgcacttacggctctgaatgatatgggcaaggtacggaaagacataccgcagtgggaaccttcaaaggggtggaacgattggcagcaagtgcccttctgcagtcatcactttcaccagctaatcatgaaagacggaagggagattgtcgtgccatgtcgaaatcaggatgagctggttggccgtgccagagtgtctcagggtgcagggtggagcctccgcgaaaccgcctgcttgggaaagtcctacgcgcaaatgtggcagctgatgtatttccatcggagggaccttagactggctgccaacgcaatctgttcagccgtccctgtggattggattcccacaagccgcactacctggtctatccacgctcatcaccagtggatgacaactgaggacatgctctccgtatggaatcgggtttggatagaagagaacccatggatggaagataagacccatatcagtagctggggcgacgtgccctacttaggcaaaagggaggaccaatggtgcgggtcgctgattggattgacggcccgagcaacatgggctaccaatatccaggtcgccattaaccaggtgagacggctgatcggtaatgagaactacctcgattatatgacttccatgaagaggtttaaaaatgaatctgaccctgagggcgcgctttggtga

SEQ ID NO: 13266 - RNA, 9879 nt, synthetic construct
  misc_feature 1..9879: note = derived and/or modified CDS sequence (opt3) from DENV-1__GU131921__SS-prME
  source 1..9879: mol_type = other RNA
tccgtgaccatgctgctcatgcttatgcccacagcactggctttccacttgactacgagaggaggggaacctcatatgatcgtctccaagcaggaaaggggaaaatctttactgtttaagacctcagccggtgttaatatgtgcacattaattgccatggacctcggcgagctgtgtgaagatactatgacctacaaatgcccacggataacagaggcggaaccggacgatgtggactgttggtgcaatgctaccgatacttgggtaacatatgggacctgtagtcaaacgggagagcaccgccgagacaagcgtagcgtggcccttgcaccccatgtcggcctgggtttggagactagaaccgaaacatggatgtcctctgagggggcctggaaacagatccagagggtggaaacttgggctctccggcaccctggattcaccgttatggcactgtttctggcccatgctattggcacatcgatcacccagaagggcattatcttcatactcttaatgctggtgacgccatcaatggccatgcgctgcgtcgggatcggaagcagagattttgtggagggtcttagtggcgcgacttgggtagacgttgtgttggagcacgggtcctgtgtcacaaccatggcaaaggataaacccactctggacattgaattgctcaagacagaggtgaccaaccctgccatcctgaggaaactttgcattgaagctaagatctctaatacgaccacagatagccggtgtccaactcaaggagaggccaccctggtggaagaacaggacgcaaacttcgtctgccgccgaacatttgttgatagaggctggggtaatgggtgtggattgttcggcaaaggctccctcataacttgcgctaagtttaagtgcgtgaccaaactggaggggaagattgtacagtacgaaaacttaaaatattcagtgatcgtcacagtgcacaccggagaccagcatcaagttggtaatgagagtactgaacacggcacgacagccaccattactccccaggcgcctatgaccgagatccagctgacagactacggggccctcacccttgattgtagcccaaggactggactggacttcaacgaaatggtgttgctaacaatgaaggagaaatcttggctggtccataagcagtggtttctcgatctgccgcttccctggacgtccggcgcatcaaccagccaagagacttggaatcggcaggacctgttggtgacattcaaaaccgctcacgccaagaagcaggaagtagttgtgctcggtagtcaagagggggctatgcacacagccctgactggcgcaaccgaaatccagacgtctggaaccacaactatttttgccggccatttaaaatgccgtctgaagatggataaactaaccctcaaggggatgtcctatgtcatgtgtacaggtagcttcaaactggagaaggaagtggctgagactcagcacggaaccgtccttgtgcagataaagtacgagggcacggacgcgccttgcaaaatcccattctcgacacaagatgaaaagggggttacccagaacggacgcttgattactgcaaatcccatcgtgacagacaaagagaagcctgtaaacatagaagccgagccaccctttggcgagtcttatattgtcatcggtgctggggaaaaagccctgaagctctcctggttcaagaaaggctcaagtatcggaaagatgtttgaggcaaccgccagaggcgctaggcggatggccattctgggggatactgcatgggacttcggaagcatcggtggcgtgtttacctccgttgggaaacttgtgcatcagattttcggagcggcttacggcgtcctgttttctggtgtgagctggacaatgaagatagggatcggcgtattgctcacgtggctgggattaaattcacgaagtacctccctgagcatgacttgtattgccgtgggcctagttacactctacctgggggtcatggtgcaggcagattctggatgcgtgatcaactggaaaggccgcgaacttaagtgtggttcagggatcttcgtcaccaatgaggttcacacatggactgaacaatataagtttcaggccgacagtccgaaaagattgagcgctgccattggaaaggcatgggaggagggcgtgtgcggtataaggtccgctacccggctggaaaacatcatgtggaaacagatttctaacgagctcaatcatatcctgttagaaaacgacatgaagttcacggtggtagtcggcgatgtggccgggattctggcgcagggcaaaaagatgatccgccctcaacccatggagtacaaatattcgtggaaaagctggggcaaggccaaaataatcggggctgacgttcagaatacaacctttattatcgatggaccaaacactcctgaatgtcccgacgatcagagagcatggaatatttgggaggtggaggactacggcttcggtatctttaccacaaacatatggcttaagttgagggattcctatactcaggtctgcgaccaccgtctcatgtcagccgctattaaagatagtaaggccgtgcacgcagacatggggtactggatcgaatctgagaaaaatgaaacctggaagctggcgcgggccagcttcattgaggttaagacatgtatctggccaaaatcccatacgctatggtcaaacggagtgctggaaagcgagatgataatccccaagatttatggcggtcctatctctcaacacaattaccgaccaggctacttcacccagactgctgggccgtggcatctcggaaaactggagcttgattttgacttgtgcgaaggcacaaccgtagtcgtggatgagcactgcgggaacagaggaccctccctgaggactacaaccgtgacgggcaagattatccacgaatggtgttgccgcagttgtactttacctccactccggttcagaggtgaggacgggtgctggtatggaatggagataaggcccgtcaaagaaaaggaggaaaatctggttaagagcatggtgtctgccggctccggtgaggtagactcatttagtcttggcctgttgtgtattagcatcatgatcgaagaggtgatgcgctcgcgatggtcccggaaaatgctcatgaccgggacactggcagtcttcctactgctcattatgggacagctgacctggaacgatcttatccgtttgtgcattatggtgggcgctaatgcctctgacagaatggggatgggaactacatacctggcattaatggccacctttaagatgaggcctatgttcgctgttggcctcctgtttcgccggcttacaagcagagaggtgctgctactcactataggtctgtcattggtcgcgagtgtggaactgccaaactccttagaggaactcggggatggactggccatgggcatcatgattcttaaactgttgaccgacttccaatctcatcagctctgggcaacgctgctaagcctgacatttatcaagaccactttctcccttcactatgcttggaaaaccatggccatggttctctcaattgtgagcctgtttcccttgtgtctgagtacaacttctcagaagaccacgtggttaccggtcctcctgggctcccttgggtgcaagcctctgacaatgttcttgatcgccgagaataaaatatggggaaggcgaagctggccactcaacgaaggtatcatggctgtaggcattgtgtcgatcctgctatcatctctgcttaagaacgatgttcccctcgcagggcctctgattgccggaggcatgttgatcgcgtgttacgtgataagtggttccagcgctgacttatctctggagaaagccgcagaggtcagctgggaagaggaagccgagcattccggggcttcacacaatattctcgtggaagtacaggatgacggaaccatgaagatcaaagatgaggagcgcgacgatactctgacaatccttctgaaggcaaccttgctagccgtgagtggcgtctatcccctgagcattccagcgactctctttgtttggtacttctggcagaaaaagaagcagcggtctggcgtgctgtgggacacaccttcacccccagaagtggagaaagctgtccttgatgacgggatatatagaatcatgcagaggggattactgggtcgtagccaggtgggcgttggggtattccaagaaaacgtgtttcataccatgtggcacgtcacgcgcggagccgtgctcatgtaccagggcaagcggttggagccgagttgggcaagcgttaaaaaggacctgatttcctacggtgggggatggagactccagggctcttggaatactggcgaggaagtgcaggtcatcgccgtggagcctgggaaaaaccccaagaatgtacaaaccgctccaggaacattcaagacccccgaaggtgaggtcggcgccattgcactggattttaaacctgggacatcgggaagcccaatcgtgaacagggaaggcaagatagttggtctttatgggaatggagtggtcactacctcaggcacgtacgtgtccgctatcgcccaggcgaaagccagtcaggagggccccctgcctgagattgaagacgaggttttccgaaagcggaacttgacaatcatggatctacacccggggtctggaaaaactcgcagatatctgccagcaattgtgagggaagctatcaagcggaagctccgaaccttaatactggcccccacaagagtcgtggctagcgagatggcagaagcccttaaaggtatgcctattcgctaccaaaccactgccgtaaagtccgagcataccggcaaagagatcgtggacctgatgtgccacgctacatttacgatgaggctcttgtcaccagttcgtgtccccaattataacatgatcattatggatgaagcgcatttcactgacccttctagcatcgcagcccgggggtacataagtaccagagtgggaatgggcgaggctgccgcaatttttatgacagccaccccgcccggttccgtggaggctttcccacagagcaatgcggtcatccaggatgaggaaagggacattcctgagcgctcttggaactcagggtatgagtggatcactgattttcccggaaagacagtatggttcgtgccatccataaaaagtggcaatgacattgccaactgtctgcgaaagaatggcaagagagttatccagctcagccggaaaacctttgatacggaataccaaaagactaaaaacaacgactgggactacgtggtcacaaccgatatctcggagatgggggcaaatttcagggctgaccgcgtgattgatcctcgtagatgcctgaagcccgttatccttaaagacggaccagaacgggtgattctagccggtccgatgcctgtcaccgtggcatctgccgctcagaggcgcggccgaatagggagaaaccacaataaggagggagatcagtatatctacatgggccagcccctgaacaatgacgaggatcatgcccactggactgaagcgaagatgttgttagacaacattaatacaccagagggtatcatccccgcactgttcgaacctgagcgggaaaaatccgccgctattgatggggagtataggctccgcggcgaggccagaaagacctttgtagaactgatgaggcggggagaccttccagtgtggctgagctacaaagttgcttcagagggcttccaatatagtgatcgtcgctggtgctttgacggggaacgaaacaatcaggtcctcgaggaaaacatggatgtggagatatggacaaaggagggagaaaggaaaaagttgaggccccggtggctggacgcacgcacttactctgaccctctagccctgagagagttcaaagaatttgctgccggtaggcggtccgtgagcggcgatctcatccttgagattgggaagctgccgcagcacttaacgcagcgagcacaaaatgcgttggacaacctggtcatgctccataattcagaacagggaggcagagcctatcgccacgctatggaggagctgccagataccatcgaaacacttatgctgctcgccttgattgcagttctgactggtggggtgaccttattctttctaagtggcaggggactgggcaagacaagcatcgggctcctttgtgtaatggcttcctctgtgctgttgtggatggccagcgtcgagccccattggatagcagcctccatcattctggagttctttctcatggtgctgcttatccctgagcccgaccggcagcgtaccccacaggataaccaactcgcttacgttgtgattggactgttgttcatgatcctgactgtcgcggccaatgagatgggtttactagaaacgaccaaaaaggacctgggcatagggcacgtagcagtgggaaaccaccatcacgctgccatgctcgatgttgaccttcatcctgcctcagcatggacactgtacgctgtggccactaccattatcacacccatgatgagacacaccattgagaacactacagcgaatatctctttgacggctatagccaaccaggcagccatcctgatgggcctcgataaaggttggccaattagtaagatggacatcggggtccctctgcttgctttaggctgctattcgcaagtgaatccgctgaccctcactgcagccgtcttgatgctggtggcgcattacgctattatcggacccggcctacaagccaaagcaacaagggaagcccagaagcgcaccgctgccgggataatgaagaacccaaccgttgatggaattgtggcaatcgacctggatcctgtagtgtatgacgctaaatttgagaagcagctcggccagatcatgcttctgattttgtgtacaagccaaatcctgctcatgcggactacgtgggccctgtgcgaatccataaccttagcgacaggtccccttactaccctgtgggaggggtctccaggaaaattctggaatacaaccattgccgtctcaatggcaaacatctttcgaggcagctacctcgctggtgccggcctagcattctccctgatgaagagtctagggggaggcagaagggggactggagctcagggcgagacgctgggtgaaaaatggaagcgccagctcaatcagctttctaagagcgagttcaacacatataaacggtcagggattatggaagttgacagatccgaggccaaggaaggactgaaacgtggcgagaccactaagcacgccgtgagtaggggtaccgcgaaattgcggtggtttgtcgagcgcaatctggtgaagcctgaaggcaaggtaatcgatctcgggtgtggacgaggcgggtggagctactattgcgctggactaaagaaggtgacagaggttaaaggctacactaagggtgggcccggacacgaagaaccgataccaatggcaacctacggctggaacctggtgaaacttcattctggcaaggacgtcttctttatccctcccgaaaaatgtgatacactgctatgcgacattggggagtcctcaccaaatcccacgatcgaggaaggaagaaccctcagggtgctgaagatggtcgagccttggttgcggggtaaccaattctgtattaagatcctgaatccgtatatgcccagcgtggttgaaactctcgagcagatgcagcgcaaacacggcgggatgcttgtaagaaacccactgtcgagaaattctacacatgagatgtactgggtgagttgcggaaccggcaacattgtctccgccgtgaatatgactagccgaatgttactgaaccggtttacaatggctcaccgtaagcctacctatgaaagagatgttgacttgggtgccgggacgcgccacgtggcagtcgagcccgaagtggccaacctcgatatcataggacagaggattgagaatatcaaacatgaacacaagtcaacctggcattacgacgaggataacccttataaaacatgggcttaccacggctcctatgaggtaaagccatctggcagcgcgagttccatggtgaatggggttgtcaagctgctaactaaaccctgggacgtgatccctatggtgacccaaattgccatgacagatactaccccattcggacagcagcgggtctttaaggaaaaagttgacacaagaacccccaaggcaaaacgcggtactgctcaaataatggaggtgacggccaagtggctttggggcttcctgagcaggaacaagaaaccgcgaatctgtacacgggaagagtttaccagaaaggtaaggtctaatgcagccattggggctgtgttcgtcgacgaaaaccagtggaactcagccaaagaggcggtggaggatgaacgcttttgggacctcgttcatcgtgagcgggaactgcacaagcagggaaaatgcgcaacttgcgtgtacaacatgatgggcaagagagagaagaaattgggtgagttcgggaaggccaaaggaagtagggctatctggtacatgtggctgggcgcccgctttctcgagttcgaggcacttggcttcatgaatgaagatcactggttttcccgagagaacagcctgtctggggtcgaaggagagggtttacataagctgggctatattttgcgggacatctcgaaaatacctgggggaaatatgtacgctgatgacaccgccggctgggatacaagaatcacggaggacgatctccagaacgaagctaggattaccgacatcatggagccagaacacgccctgctagcaaagtcaattttcaaacttacttatcaaaataaggtggtacgcgttcagagacccgcgaagaacggtacagtgatggatgtcatcagccggagggaccagcgtgggtccggacaggtgggcacctacggcctgaatacttttacaaacatggaggcccaactcatacgacagatggaaagtgaggggattttctctcctagcgagctggaaaccccaaacttggctgagcgcgtgttagattggctggaaaaatatggagtcgagagactcaagcggatggccatctccggtgacgactgtgttgtgaaacccatcgatgacaggtttgcaacagctcttactgccctgaatgatatgggcaaggtacgcaaagacattccgcagtgggaaccttcaaaggggtggaacgattggcagcaagtgcccttctgcagtcatcactttcaccagctaataatgaaggacggaagagagatcgtcgtgccatgtcggaatcaggatgagctggttggcagggcacgagtgtctcagggtgccgggtggagcctccgtgaaaccgcgtgcttgggaaaatcctacgctcaaatgtggcagctgatgtatttccatagacgcgaccttcggctggccgcaaacgccatttgttcagctgtccctgtggattggatccccacgagcaggaccacatggtctattcacgcccatcaccagtggatgactaccgaggacatgctctccgtatggaatagagtttggatcgaagagaacccatggatggaagataagacacatataagtagctggggcgacgtgccctacttaggcaaacgcgaggaccaatggtgcgggtcgctgatcggattgactgcacgggctacctgggccacgaatattcaggtcgcgatcaaccaggtgaggcgactgattggtaatgagaactacctcgattatatgacatccatgaagagatttaaaaatgaatctgaccctgagggcgctctttggtga

SEQ ID NO: 13267 - RNA, 9879 nt, synthetic construct
  misc_feature 1..9879: note = derived and/or modified CDS sequence (opt3) from DENV-1__GQ868635__SS-prME
  source 1..9879: mol_type = other RNA
tccgtgacaatgctgctcatgcttatgcccacagcactggctttccacttgactacgagaggaggggaacctcatatgatcgtctccaagcaggaaaggggaaaatctttactgtttaagacatcagccggtgttaacatgtgcacattaattgccatggacctcggcgagctgtgtgaagatactatgacctacaaatgcccacggataacagaggcggaaccggacgatgtggactgttggtgcaatgctaccgatacttgggtaacatatgggacctgtagtcaaacgggagagcaccgccgagacaagcgtagcgtggcccttgcaccccatgtcggcctgggtttggagactagaaccgaaacatggatgtcctctgagggggcctggaaacagatccagagggtggaaacttgggctctccggcaccctggattcaccgttatggcactgtttctggcccatgctattggcacatcgatcacccagaagggcattatcttcatactcttaatgctggtgacgccatcaatggccatgcgctgcgtcgggatcggaagcagagattttgtggagggtcttagtggcgcgacttgggtagacgttgtgttggagcacgggtcctgtgtcacaaccatggcaaaggataaacccactctggacattgaattgctcaagacagaggtgaccaaccctgccatcctgaggaaactttgcattgaagctaagatctctaatacgaccacagatagccggtgtccaactcaaggagaggccaccctggtggaagaacaggacgcaaacttcgtctgccgccgaacatttgttgatagaggctggggtaatgggtgtggattgttcggcaaaggctccctcataacttgcgctaagtttaagtgcgtgaccaaactggaggggaagattgtacagtacgaaaacttaaaatattcagtgatcgtcacagtgcacaccggagaccagcatcaagttggtaatgagagtactgaacacggcacgacagccaccattactccccaggcgcctaccacagagatccagctgaccgactacggggccctcactcttgattgtagcccaaggacaggactggacttcaacgaaatggtgttgctaacgatgaaggagaaatcttggctggtccataagcagtggtttctcgatctgccgcttccctggacctccggcgcatcaactagccaagagacatggaatcggcaggacctgttggtgaccttcaaaacagctcacgccaagaagcaggaagtagttgtgctcggtagtcaagagggggctatgcacactgccctgaccggcgcaacggaaatccagacctctggaacaactaccatttttgccggccatttaaaatgccgtctgaagatggataaactaacactcaaggggatgtcctatgtcatgtgtactggtagcttcaaactggagaaggaagtggctgagacccagcacggaacggtccttgtgcagataaagtacgagggcacagacgcgccttgcaaaatcccattctcgacccaagatgaaaagggggttactcagaacggacgcttgattacagcaaatcccatcgtgaccgacaaagagaagcctgtaaacatagaagccgagccaccctttggcgagtcttatattgtcatcggtgctggggaaaaagccctgaagctctcctggttcaagaaaggctcaagtatcggaaagatgtttgaggcaactgccagaggcgctaggcggatggccattctgggggataccgcatgggacttcggaagcatcggtggcgtgtttacatccgttgggaaacttgtgcatcagattttcggagcggcttacggcgtcctgttttctggtgtgagctggacgatgaagatagggatcggcgtattgctcacctggctgggattaaattcacgaagtacttccctgagcatgacatgtattgccgtgggcctagttaccctctacctgggggtcatggtgcaggcagattctggatgcgtgatcaactggaaaggccgcgaacttaagtgtggttcagggatcttcgtcacaaatgaggttcacacttggaccgaacaatataagtttcaggccgacagtccgaaaagattgagcgctgccattggaaaggcatgggaggagggcgtgtgcggtataaggtccgctacgcggctggaaaacatcatgtggaaacagatttctaacgagctcaatcatatcctgttagaaaacgacatgaagttcacagtggtagtcggcgatgtggccgggattctggcgcagggcaaaaagatgatccgccctcaacccatggagtacaaatattcgtggaaaagctggggcaaggccaaaataatcggggctgacgttcagaataccacttttattatcgatggaccaaacacccctgaatgtcccgacgatcagagagcatggaatatttgggaggtggaggactacggcttcggtatctttacaactaacatatggcttaagttgagggattcctatacccaggtctgcgaccaccgtctcatgtcagccgctattaaagatagtaaggccgtgcacgcagacatggggtactggatcgaatctgagaaaaatgaaacatggaagctggcgcgggccagcttcattgaggttaagacgtgtatctggccaaaatcccataccctatggtcaaacggagtgctggaaagcgagatgataatccccaagatttatggcggtcctatctctcaacacaattaccgaccaggctacttcactcagacagctgggccgtggcatctcggaaaactggagcttgattttgacttgtgcgaaggcaccactgtagtcgtggatgagcactgcgggaacagaggaccctccctgaggacaaccacggtgactggcaagattatccacgaatggtgttgccgcagttgtaccttacctccactccggttcagaggtgaggacgggtgctggtatggaatggagataaggcccgtcaaagaaaaggaggaaaatctggttaagagcatggtgtctgccggctccggtgaggtagactcatttagtcttggcctgttgtgtattagcatcatgatcgaagaggtgatgcgctcgcgatggtcccggaaaatgctcatgacagggaccctggcagtcttcctactgctcattatgggacagctgacttggaacgatcttatccgtttgtgcattatggtgggcgctaatgcctctgacagaatggggatgggaacaacctacctggcattaatggccacatttaagatgaggcctatgttcgctgttggcctcctgtttcgccggcttactagcagagaggtgctgctactcaccataggtctgtcattggtcgcgagtgtggaactgccaaactccttagaggaactcggggatggactggccatgggcatcatgattcttaaactgttgacggacttccaatctcatcagctctgggcaacactgctaagcctgacctttatcaagactaccttctcccttcactatgcttggaaaacaatggccatggttctctcaattgtgagcctgtttcccttgtgtctgagtactacctctcagaagacgacatggttaccggtcctcctgggctcccttgggtgcaagcctctgaccatgttcttgatcgccgagaataaaatatggggaaggcgaagctggccactcaacgaaggtatcatggctgtaggcattgtgtcgatcctgctatcatctctgcttaagaacgatgttcccctcgcagggcctctgattgccggaggcatgttgatcgcgtgttacgtgataagtggttccagcgctgacttatctctggagaaagccgcagaggtcagctgggaagaggaagccgagcattccggggcttcacacaatattctcgtggaagtacaggatgacggaactatgaagatcaaagatgaggagcgcgacgatacactgaccatccttctgaaggcaactttgctagccgtgagtggcgtctatcccctgagcattccagcgacactctttgtttggtacttctggcagaaaaagaagcagcggtctggcgtgctgtgggacaccccttcacccccagaagtggagaaagctgtccttgatgacgggatatatagaatcatgcagaggggattactgggtcgtagccaggtgggcgttggggtattccaagaaaacgtgtttcatacgatgtggcacgtcactcgcggagccgtgctcatgtaccagggcaagcggttggagccgagttgggcaagcgttaaaaaggacctgatttcctacggtgggggatggagactccagggctcttggaataccggcgaggaagtgcaggtcatcgccgtggagcctgggaaaaaccccaagaatgtacaaacagctccaggaaccttcaagacacccgaaggtgaggtcggcgccattgcactggattttaaacctgggacttcgggaagcccaatcgtgaacagggaaggcaagatagttggtctttatgggaatggagtggtcaccacgtcaggcacatacgtgtccgctatcgcccaggcgaaagccagtcaggagggccccctgcctgagattgaagacgaggttttccgaaagcggaacttgactatcatggatctacacccggggtctggaaaaacccgcagatatctgccagcaattgtgagggaagctatcaagcggaagctccgaacattaatactggcccccaccagagtcgtggctagcgagatggcagaagcccttaaaggtatgcctattcgctaccaaactaccgccgtaaagtccgagcatacaggcaaagagatcgtggacctgatgtgccacgctacgtttactatgaggctcttgtcaccagttcgtgtccccaattataacatgatcattatggatgaagcgcatttcaccgacccttctagcatcgcagcccgggggtacataagtacaagagtgggaatgggcgaggctgccgcaatttttatgaccgccactccgcccggttccgtggaggctttcccacagagcaatgcggtcatccaggatgaggaaagggacattcctgagcgctcttggaactcagggtatgagtggatcacagattttcccggaaagaccgtatggttcgtgccatccataaaaagtggcaatgacattgccaactgtctgcgaaagaatggcaagagagttatccagctcagccggaaaacgtttgatactgaataccaaaagaccaaaaataacgactgggactacgtggtcaccaccgatatctcggagatgggggcaaatttcagggctgaccgcgtgattgatcctcgtagatgcctgaagcccgttatccttaaagacggaccagaacgggtgattctagccggtccgatgcctgtcactgtggcatctgccgctcagaggcgcggccgaatagggagaaaccacaataaggagggagatcagtatatctacatgggccagcccctgaacaatgacgaggatcatgcccactggacagaagcgaagatgttgttagacaacattaataccccagagggtatcatccccgcactgttcgaacctgagcgggaaaaatccgccgctattgatggggagtataggctccgcggcgaggccagaaagacatttgtagaactgatgaggcggggagaccttccagtgtggctgagctacaaagttgcttcagagggcttccaatatagtgatcgtcgctggtgctttgacggggaacgaaacaatcaggtcctcgaggaaaacatggatgtggagatatggactaaggagggagaaaggaaaaagttgaggccccggtggctggacgcacgcacgtactctgaccctctagccctgagagagttcaaagaatttgctgccggtaggcggtccgtgagcggcgatctcatccttgagattgggaagctgccgcagcacttaacccagcgagcacaaaatgcgttggacaacctggtcatgctccataattcagaacagggaggcagagcctatcgccacgctatggaggagctgccagatacaatcgaaactcttatgctgctcgccttgattgcagttctgaccggtggggtgacattattctttctaagtggcaggggactgggcaagaccagcatcgggctcctttgtgtaatggcttcctctgtgctgttgtggatggccagcgtcgagccccattggatagcagcctccatcattctggagttctttctcatggtgctgcttatccctgagcccgaccggcagcgtactccacaggataaccaactcgcttacgttgtgattggactgttgttcatgatcctgacggtcgcggccaatgagatgggtttactagaaaccaccaaaaaggacctgggcatagggcacgtagcagtgggaaaccaccatcacgctgccatgctcgatgttgaccttcatcctgcctcagcatggactctgtacgctgtggccaccacaattatcacccccatgatgagacacactattgagaacacaacggcgaatatctctttgaccgctatagccaaccaggcagccatcctgatgggcctcgataaaggttggccaattagtaagatggacatcggggtccctctgcttgctttaggctgctattcgcaagtgaatccgctgactctcacagcagccgtcttgatgctggtggcgcattacgctattatcggacccggcctacaagccaaagcaaccagggaagcccagaagcgcaccgctgccgggataatgaagaacccaacagttgatggaattgtggcaatcgacctggatcctgtagtgtatgacgctaaatttgagaagcagctcggccagatcatgcttctgattttgtgtactagccaaatcctgctcatgcggacgacctgggccctgtgcgaatccataacattagcgactggtccccttaccacactgtgggaggggtctccaggaaaattctggaataccactattgccgtctcaatggcaaacatctttcgaggcagctacctcgctggtgccggcctagcattctccctgatgaagagtctagggggaggcagaagggggacgggagctcagggcgagacactgggtgaaaaatggaagcgccagctcaatcagctttctaagagcgagttcaacacctataaacggtcagggattatggaagttgacagatccgaggccaaggaaggactgaaacgtggcgagactaccaagcacgccgtgagtaggggtacagcgaaattgcggtggtttgtcgagcgcaatctggtgaagcctgaaggcaaggtaatcgatctcgggtgtggacgaggcgggtggagctactattgcgctggactaaagaaggtgactgaggttaaaggctacaccaagggtgggcccggacacgaagaaccgataccaatggcaacatacggctggaacctggtgaaacttcattctggcaaggacgtcttctttatccctcccgaaaaatgtgatacgctgctatgcgacattggggagtcctcaccaaatcccaccatcgaggaaggaagaactctcagggtgctgaagatggtcgagccttggttgcggggtaaccaattctgtattaagatcctgaatccgtatatgcccagcgtggttgaaacactcgagcagatgcagcgcaaacacggcgggatgcttgtaagaaacccactgtcgagaaattctacccatgagatgtactgggtgagttgcggaactggcaacattgtctccgccgtgaatatgacaagccgaatgttactgaaccggtttaccatggctcaccgtaagcctacgtatgaaagagatgttgacttgggtgccgggacccgccacgtggcagtcgagcccgaagtggccaacctcgatatcataggacagaggattgagaatatcaaacatgaacacaagtcaacatggcattacgacgaggataacccttataaaacttgggcttaccacggctcctatgaggtaaagccatctggcagcgcgagttccatggtgaatggggttgtcaagctgctaaccaaaccctgggacgtgatccctatggtgacacaaattgccatgactgataccacaccattcggacagcagcgggtctttaaggaaaaagttgacaccagaactcccaaggcaaaacgcggtacggctcaaataatggaggtgacagccaagtggctttggggcttcctgagcaggaacaagaaaccgcgaatctgtacccgggaagagtttactagaaaggtaaggtctaatgcagccattggggctgtgttcgtcgacgaaaaccagtggaactcagccaaagaggcggtggaggatgaacgcttttgggacctcgttcatcgtgagcgggaactgcacaagcagggaaaatgcgcaacctgcgtgtacaacatgatgggcaagagagagaagaaattgggtgagttcgggaaggccaaaggaagtagggctatctggtacatgtggctgggcgcccgctttctcgagttcgaggcacttggcttcatgaatgaagatcactggttttcccgagagaacagcctgtctggggtcgaaggagagggtttacataagctgggctatattttgcgggacatctcgaaaatacctgggggaaatatgtacgctgatgacacagccggctgggatacgagaatcaccgaggacgatctccagaacgaagctaggattactgacatcatggagccagaacacgccctgctagcaaagtcaattttcaaacttacatatcaaaataaggtggtacgcgttcagagacccgcgaagaacggtaccgtgatggatgtcatcagccggagggaccagcgtgggtccggacaggtgggcacttacggcctgaatacatttaccaacatggaggcccaactcatacgacagatggaaagtgaggggattttctctcctagcgagctggaaacaccaaacttggctgagcgcgtgttagattggctggaaaaatatggagtcgagagactcaagcggatggccatctccggtgacgactgtgttgtgaaacccatcgatgacaggtttgcaactgctcttaccgccctgaatgatatgggcaaggtacgcaaagacattccgcagtgggaaccttcaaaggggtggaacgattggcagcaagtgcccttctgcagtcatcactttcaccagctaataatgaaggacggaagagagatcgtcgtgccatgtcggaatcaggatgagctggttggcagggcacgagtgtctcagggtgccgggtggagcctccgtgaaacggcgtgcttgggaaaatcctacgctcaaatgtggcagctgatgtatttccatagacgcgaccttcggctggccgcaaacgccatttgttcagctgtccctgtggattggatccccaccagcaggacaacttggtctattcacgcccatcaccagtggatgaccacagaggacatgctctccgtatggaatagagtttggatcgaagagaacccatggatggaagataagactcatataagtagctggggcgacgtgccctacttaggcaaacgcgaggaccaatggtgcgggtcgctgatcggattgaccgcacgggctacgtgggccacaaatattcaggtcgcgatcaaccaggtgaggcgactgattggtaatgagaactacctcgattatatgacctccatgaagagatttaaaaatgaatctgaccctgagggcgctctttggtga

SEQ ID NO: 13268 - RNA, 9879 nt, synthetic construct
  misc_feature 1..9879: note = derived and/or modified CDS sequence (opt3) from DENV-1__GQ868636__SS-prME
  source 1..9879: mol_type = other RNA
agcgtgaccatgctgctcatgcttatgcccacagcactggctttccacttgactacgagaggaggggaacctcatatgatcgtcaccaagcaggaaaggggaaaatccttactgtttaagacatctgccggtgttaatatgtgcactctaattgcaatggacctcggagaactgtgtgaagataccatgacatacaaatgcccacggataaccgaagcggaaccggacgatgtggactgttggtgcaatgctactgatacatgggtaacctatgggacgtgttcacaaactggagagcaccgccgagacaagcgtagtgtggcccttgcaccccatgtcggcctgggtttggagaccagaacagaaacttggatgagctccgagggggcctggaaacagatccagagggtggaaacctgggctctccggcaccctggattcacagttattgcactgtttctggcccatgctatcggcacctctattacgcagaagggcatcattttcatcctcttaatgctggtgactccatcgatggccatgcgctgcgtcgggattggatcaagagattttgtggagggtcttagcggcgcgacatgggtagacgttgtgttggagcacgggagttgtgtcaccactatggcaaaggataaacccacactggacatcgaactactcaagaccgaggtgacgaaccctgccgtgctgaggaaactttgcattgaagctaagatctccaataccacaactgattctcggtgtccaacccaaggagaggccacactgatggaagaacaagacgcaaacttcgtctgccgccgaacttttgttgatagaggctggggtaatgggtgtggattgttcggcaaaggcagcctcataacctgcgctaagtttaagtgcgtgacaaaactggaggggaagattgtacagtacgaaaacttaaaatattccgtgatcgtcaccgtgcacactggagaccagcatcaagttggtaatgagtcaacggaacacggcacaaccgccactattacaccccaggcgcctacaagtgagatccagctgaccgactacggggccctcactcttgattgtagcccaaggacaggactggacttcaacgaaatggtgttgctaacgatgaaggagaaatcttggctggtccataagcagtggtttctcgatctgccgcttccctggacctccggcgcatcaactagccaagagacatggaatcggcaggacctgttggtgaccttcaaaacagctcacgccaagaagcaggaagtagttgtgctcggtagtcaagagggggctatgcacactgccctgaccggcgcaacggaaatccagacctctggaacaactaccatttttgccggccatttaaaatgccgtctgaagatggataaactaacactcaaggggatgtcctatgtcatgtgtactggcagcttcaaactggagaaggaagtggctgagacccagcacggtacggtccttgtgcagataaagtacgagggcacagacgcgccttgcaaaatcccattctcgacccaagatgaaaagggggttactcagaacggacgcttgattacagcaaatcccatcgtgaccgacaaagagaagcctgtaaacatagaagccgagccaccctttggcgagtcttatattgtcatcggtgctggggaaaaagccctgaagctctcctggttcaagaaaggctcaagtatcggaaagatgtttgaggcaactgccagaggcgctaggcggatggccattctgggggataccgcatgggacttcggaagcatcggtggcgtgtttacatccgttgggaaacttgtgcatcagattttcggaacggcgtacggcgtcctgttttctggtgtgagctggaccatgaagatagggatcggcgtattgctcacttggctgggattaaattcacgaagtacatccctgagcatgacctgtattgctgtgggcctagttacactctacctgggggtcatggtgcaggccgattctggatgcgtgatcaactggaaaggccgcgaacttaagtgtggttcagggatcttcgtcactaatgaggttcacacctggacggaacaatataagtttcaggcagacagtccgaaaagattgagcgccgctattggaaaggcctgggaggagggcgtgtgcggtataaggtccgcaacacggctggaaaacatcatgtggaaacagatttctaacgagctcaatcatatcctgttagaaaacgacatgaagttcaccgtggtagtcggcgatgtggttgggattctggctcagggcaagaagatgatccgccctcaacccatggagcacaaatactcgtggaaaagctggggcaaggccaagataatcggggcggacgtgcagaatactacctttattatcgatggaccaaacacacctgaatgtcccgacgatcagagagcctggaatatttgggaggtcgaggactatggcttcggtatctttactaccaacatatggcttaagttgagggattcctacacacaggtgtgcgaccaccgtctcatgtcagctgcaattaaagatagtaaggccgttcatgctgacatggggtattggatcgaatctgagaaaaatgaaacgtggaagctggcccgggccagcttcattgaggtgaagacctgtatctggccaaaatcccacactctatggtcaaacggagtactggaaagcgagatgataatccccaagatttacggcggtcctatctctcaacataattatcgaccaggctacttcacacagaccgcggggccgtggcacctcggaaaactggagcttgattttgacttgtgcgaaggcactacagtcgtggtggatgagcactgcgggaacagaggaccctccctgaggaccacgactgtcaccggcaagattatccatgaatggtgttgccgcagttgtacattacctccactccggttcaaaggtgaggacgggtgctggtacggaatggagataagacccgttaaggaaaaggaggaaaatctggtgaaaagcatggtatctgccggccttggtgaggtggactccttttcactgggcttgctctgtattagtatcatgatcgaagaggtcatgaggagccgctggtcgcgaaagatgctgatggctgggaccctagccgtgttcctgctcctgattatgggacagcttacttggaacgatttgatccggctgtgcattatggttggcgcaaatgcttccgaccgtatggggatgggaacaacctatttagccctcatggcaacatttaaaatgagacctatgttcgccgtgggcctgctttttaggcgcctgacttctcgggaggtcctactcctgaccataggtttgagcctggtggcttcagttgaattaccaaacagtctcgaggaactgggggatggacttgcgatgggcatcatgattctgaagttgctcacggacttccaatcccaccagctgtgggccacactactgtctcttacctttatcaaaactaccctcagcctgcatcacgcatggaagacaatggctatggtgttgtccattgtctcactgttccccttatgtctcagcactaccagtcagaagacgacatggctgccggtacttctgggctctttggggtgcaaacctctcaccatgtttctgatcgccgagaataagatatggggaagaaaatcctggccactaaacgaaggtatcatggccgtgggcgttgtgagcattctgctttcgtcactcctgaagaacgatgtccccttggctgggcctttaatcgcaggaggcatgctgattgcctgttacgtgatctctggtagttccgcggacctcagcctggagaaagctgccgaggtatcttgggaagaggaagcagagcatagcggggcctcccacaatatacttgtggaagtccaggatgacggaactatgaagattaaagatgaggagagggacgatacactgaccatcttgctaaaggctactctgctcgcaatctcaggcgtttatcccctgagtattccagccacacttttcgtgtggtacttttggcaaaagaaaaagcagcgaagcggcgtgttatgggacaccccttctcccccagaagtcgagcgcgcggtgctggatgacgggatatatcggatcatgcagagaggactcttgggtaggtcccaggttggcgtaggggtgttccaagaaaacgtcttccacacgatgtggcatgtgactcgtggagctgttctgatgtaccagggcaaacgcctcgagccgtcatgggccagtgtgaagaaagacctgattagctatggtgggggatggcggcttcagggctcctggaataccggcgaggaagtccaggtgatcgcagtagagcctgggaagaaccccaagaatgtccaaacagccccaggaacctttaaaacacccgaaggtgaggtgggcgctattgccctggatttcaagcctgggacttctggatcgccaatcgttaacagagaaggcaaaatagtgggtttgtacgggaatggagtcgtgaccacgagcggcacatacgtttcagcaatcgctcaggccaaggcgtcccaggagggccccctacctgagattgaagacgaggtgtttaggaaacgaaacctgactatcatggatctccacccggggagtggaaagacccggcgctatttaccagccattgtcagagaagcaatcaagaggaaactgcggacacttatactggctcccacccgagtggtagcctctgagatggctgaagcactcaagggtatgcctattagataccaaactaccgccgtgaaaagcgagcatacaggcaaggagatcgttgacttgatgtgccacgccacgttcactatgcgcctgctctccccagtcagggtgcccaattataacatgatcattatggatgaagctcattttaccgacccttcatctatcgcggcacgtgggtacataagcacacgggtgggaatgggcgaggccgctgccattttcatgaccgcaactccgcccggtagtgtcgaagcctttccacagtccaatgctgtaatccaggatgaggaaagagacattcctgagaggagctggaactctgggtatgagtggatcacagatttccccggaaaaaccgtgtggtttgttccatcaataaagtccggcaatgacattgcgaactgtctgcgcaagaatggcaaacgagtgatccagcttagtagaaagacgttcgatactgaataccagaaaaccaagaacaacgactgggactatgtcgtgaccaccgatatcagcgagatgggggccaattttcgggcagacagggttattgatcctcgccgttgcctaaaacccgtgatcctgaaggacggaccagaaagagtcattttggctggtccgatgcctgtgactgtagcctcggcagcccagcggaggggccgcatagggcgaaaccacaataaggagggagatcagtacatctacatgggccagcccttaaacaatgacgaggatcacgctcattggacagaagccaaaatgctgctcgacaacattaataccccagagggtatcatccccgcgctgttcgaacctgagagagaaaagtctgcagccattgatggggagtatcggcttaggggcgaggctcgcaaaacattcgtggaactgatgagaaggggagacctcccagtttggttgtcctacaaggtcgccagcgagggctttcaatattcagatcggcgttggtgcttcgacggggaacgcaacaatcaggtgctggaggaaaacatggatgtggagatatggactaaagagggagaacgaaagaaactaagacccaggtggctggacgctcggacgtacagtgaccctctcgcacttcgcgagtttaaggagttcgccgctggtagaaggtctgtctccggcgatctgatcttagagattgggaagttgccgcagcacctgacccagcgggcccaaaatgcactcgacaacctggttatgcttcataatagcgaacagggaggccgagcgtatagacacgccatggaggagctgccagatacaatcgaaactctcatgttgctggctttaattgccgtgctaaccggtggggtaacactgtttttcctctcaggccgcggacttggcaaaaccagtatcgggctgttgtgtgtgatggcaagctccgtcctgctctggatggcttctgtggagccccactggatagccgcaagcatcattctggaatttttccttatggttctcctgatccctgagcccgacaggcagcggactccacaggataaccaattggcctacgtggtcattggactgttatttatgatcctaacggtagctgcgaatgagatgggtctgctcgaaaccacaaagaaagaccttggcatagggcatgtggccgttgagaaccaccatcacgcaactatgctggatgtggacttgcatcctgcttccgcctggaccctgtatgccgtcgcaacaaccattatcactcccatgatgcgtcacacaattgaaaacacgaccgctaatatctcactcactgccatagcgaaccaggctgccatcctgatgggacttgataagggctggccaatttctaaaatggacatcggtgtgcctttactggcactcgggtgctacagtcaggtcaatccgttgacactgaccgccgctgtgctaatgctggttgcacactacgccattatcggccccggactccaagcgaaggctaccagagaggcccagaagaggacagcagccggcataatgaaaaacccaactgtggatgggattgtagctatcgaccttgatcctgtggtctatgacgccaagttcgaaaaacagctgggacagatcatgttgctgattctctgtacgtcgcaaatcctgttaatgcgcaccacatgggcactttgcgagagcataactctggctaccggccccctcacaaccctatgggagggttccccagggaagttttggaatactacgattgccgtttctatggcgaacatcttccggggatcatacctggccggcgcaggtttggcttttagcctgatgaaatccctcggcgggggacgaagaggcacaggggcccagggagaaacccttggcgagaagtggaagaggcagctgaatcagttgagtaaatctgagttcaacatttataagcgcagcggtatcatggaggtggaccggtcagaagcaaaagaggggctgaagagaggagagactacccgtcatgctgtctccaggggcacagccaaactccggtggttcgtggaacgcaatttagtaaagcctgagggtaaggtgatagatctgggctgtgggcgaggaggctggagttactattgcgccgggcttaaaaaggttactgaagtgaaaggatacaccaagggcggtcccgggcacgaggaaccgatcccaatggcgacatatggatggaacctggtcaaactacatagcggcaaggacgtgtttttcacgcctcccgagagatgtgataccctcctgtgcgacattggcgagtcttccccaaatcccactatcgaagaggggaggacattgcgggtcctgaaaatggtggaaccttggctccgcggaaaccaattttgtattaagatccttaatccgtacatgccctcagttgtagagaccctggagcagatgcagagaaagcacggtggcatgttagtgaggaacccactgagccgaaattcgactcacgaaatgtactgggtctcttgcgggacaggaaacattgtgagtgctgttaatatgacctcccggatgttgctcaaccgtttcacgatggcacatagaaaacctacctatgagcgcgatgtggacctgggcgccggtacaaggcacgtcgctgtggaacccgaggtagccaacctagatatcatagggcagcggattgaaaatatcaagcatgagcacaaaagcacttggcattacgacgaggataacccttataagacctgggcataccacggatcatatgaagtgaaaccatccggctctgccagcagtatggttaatggcgtcgtgaaacttctgacaaagccctgggacgtgatccctatggtcactcaaattgctatgaccgatacaaccccatttgggcagcagagagttttcaaagagaaggtggacactcgcacgcccaaagcgaagaggggaacagcccaaataatggaagtaaccgcacgatggctctggggttttctgtcccggaacaaaaagccgagaatctgtactagggaggagttcacccgcaaggtgcgtagcaatgctgccattggcgcagtctttgtggacgagaaccagtggaactctgccaaagaggctgttgaagatgagcggttctgggacttggtgcagaaggaaagagagctgcacaaacaggggaagtgcgccacatgcgtctacaacatgatgggaaaaagggaaaagaagctcggcgagtttggtaaagcgaaggggtcacgcgcaatctggtatatgtggcttggagcccgattcctggagtttgaggctttaggcttcatgaatgaggatcattggttcagtcgggaaaactccctgagcggcgtggagggggagggattgcacaaactcggttacattctgagagacatctctaagatacctggcgggaatatgtacgccgatgacacggcaggatgggataccaggatcactgaagacgatctacaaaacgaggctaaaattacagacatcatggaaccagagcatgcccttctggctacctcgatttttaagctcacttatcagaataaagtagttcgcgtgcagagacccgccaagaacggcacagtcatggatgtgatctcacggagggaccagcgtggtagcgggcaagtgggaacctacggcctgaatacattcactaacatggaagcacagttgatacgacagatggagtccgagggcatatttttacctagtgaactggagaccccaaacctcgcggaacgcgtccttgattggctggagaagcacggggttgaaagactaaaacggatggccatctctggagacgactgtgtggtaaagcccatcgatgacaggttcgctacggccctgaccgcactcaatgatatgggtaaagtgcgcaaggacattccgcagtgggagcctagcaaaggctggaacgattggcaacaggtccccttttgctcccaccatttccaccagttgataatgaaggacgggagagagatcgtggttccatgtcggaatcaggatgaactggtgggaagggctcgagtctcacaaggcgccggttggagtcttcgtgagacagcatgcctggggaagtcttatgcccagatgtggcagctcatgtactttcatagacgcgacttacggctggcggctaacgccatttgtagcgcagtgcctgtagattgggttcccacttccaggaccacatggtcaatccacgcccatcaccaatggatgactaccgaagacatgttgagcgtgtggaatagagtctggattgaggaaaacccatggatggaggataaaacgcacgtgtcttcctggggagacgttccctatctgggcaagcgcgaggaccagtggtgcggcagtctcatcgggcttacagctcgggccacctgggcaagcaatatacaggtggctatcaaccaggtcaggcgactgattggaaatgaaaactacctagattatatgacttcgatgaaaagattcaagaatgagggtgaccctgaaggcgccctgtggtga

SEQ ID NO: 13269 - RNA, 9879 nt, synthetic construct
  misc_feature 1..9879: note = derived and/or modified CDS sequence (opt3) from DENV-1__GU131922__SS-prME
  source 1..9879: mol_type = other RNA
tccgtgatcatgctgctcatgcttatgcccaccgcactggctttccacttgacaactagaggaggggagcctcatatgattgtctccaagcaggaaagaggaaaatctttactgtttaagacgtcagccggtgttaatatgtgcaccttgatagccatggacctcggcgagctgtgtgaagatacaatgacttacaaatgcccacggatcaccgaggcggaaccggacgatgtggactgttggtgcaatgctacagatacctgggtaacttatgggacatgtagtcaaaccggagagcaccgccgagacaagcgtagcgtggcccttgcaccccatgtcggcctgggtttggagacgagaactgaaacctggatgtcctctgagggggcctggaaacagattcagagggtggaaacatgggctctccggcaccctggattcactgttatcgcactgtttctggcccatgctattggcacctcgatcacacagaagggcataatcttcattctcttaatgctggtgaccccatcaatggccatgcgctgcgtcgggatcggaagcagagattttgtggagggtcttagtggcgcgacgtgggtagacgttgtgttggagcacgggtcctgtgtcactacaatggcaaaggataaacccaccctggacattgaactactcaagactgaggtgacaaaccctgccatcctgaggaaactttgcatagaagctaagatttctaataccacgaccgatagccggtgtccaacacaaggagaggccactctggtggaagaacaagacgcaaacttcgtctgccgccgaacctttgttgatagaggctggggtaatgggtgtggattgttcggcaaaggctccctcatcacatgcgctaagtttaagtgcgtgactaaactggaggggaagattgtacagtacgaaaacttaaaatattcagtgatcgtcaccgtgcacacaggagaccagcatcaagttggtaatgagagtaccgaacacggcactacggccacaatcactccccaagcgcctaccaccgagattcagctgacagactacggggccctcacccttgattgtagcccaaggactggactggacttcaacgaaatggtgttgctaacaatgaaggagaaatcttggctggtccataagcagtggtttctcgatctgccgcttccctggacgtccggcgcatcaaccagccaagagacttggaatcggcaggacctgttggtgacattcaaaaccgctcacgccaagaagcaggaagtagttgtgctcggtagtcaagagggggctatgcacacagccctgactggcgcaaccgaaatacagacgtctggaaccacaactatctttgccggccatttaaaatgccgtctgaagatggataaactaaccctcaaggggatgtcctatgtcatgtgtacaggttcgttcaaactggagaaggaagtggctgagactcagcacggtaccgtccttgtgcagattaagtacgagggcacggacgcgccttgcaaaatcccattctcgacacaagatgaaaagggggttacccagaacggacgcttgataactgcaaatcccattgtgacagacaaagagaagcctgtaaacatcgaagccgagccaccctttggcgagtcttatatcgtcattggtgctggggaaaaagccctgaagctctcctggttcaagaaaggctcaagtatcggaaagatgtttgaggcaaccgccagaggcgctaggcggatggccattctgggggatactgcatgggacttcggaagcataggtggcgtgtttacctccgttgggaaacttgtgcatcagatcttcggaacagcgtacggcgtcctgttttctggtgtgagctggacgatgaagattgggatcggcgtattgctcacctggctgggattaaattcacgaagtacttccctgagcatgacatgtatcgctgtgggcctagttaccctctacctgggggtcatggtgcaggccgattctggatgcgtgattaactggaaaggccgcgaacttaagtgtggttcagggatattcgtcacaaatgaggttcacacttggaccgaacaatataagtttcaggcagacagtccgaaaagattgagcgccgctatcggaaaggcctgggaggagggcgtgtgcggtattaggtccgcaacgcggctggaaaacatcatgtggaaacagatttctaacgagctcaatcatatcctgttagaaaacgacatgaagttcacagtggtagtcggcgatgtggctgggatactggcccagggcaagaagatgatccgccctcaacccatggagtacaaatattcgtggaaaagctggggcaaggcgaagattatcggggccgacgttcagaataccacttttattatcgatggaccaaacacccctgaatgtcccgacgatcagagagcttggaatatatgggaggtggaggactacggcttcggtatttttacaactaacatctggcttaagttgagggattcctatacccaggtctgcgaccaccgtctcatgtcagcagccattaaagatagtaaggctgtgcacgccgacatggggtactggatcgaatctgagaaaaatgaaacatggaagctggcacgggcgagcttcatagaggttaagacgtgtatctggccaaaatcccataccctatggtcaaacggagtgctggaaagcgagatgattatccccaagatttatggcggtcctatctctcaacacaattaccgaccaggctacttcactcagacagccgggccgtggcatctcggaaaactggagcttgattttgacttgtgcgaaggcaccactgtagtcgtggatgagcactgcgggaacagaggaccctccctgaggacaaccacggtgactggcaagataattcacgaatggtgttgccgcagttgtaccttacctccactccggttcagaggtgaggacgggtgctggtatggaatggagatcaggcccgtcaaagaaaaggaggaaaatctggttaagagcatggtgtctgctggctccggtgaggtagactcatttagtcttggcctgttgtgtatcagcattatgatcgaagaggtgatgcgctcgcgatggtcccggaaaatgctcatgacagggaccctggccgtcttcctactgctcattatgggacagctgacttggaacgatcttatacgtttgtgcatcatggtgggcgcaaatgcttctgacagaatggggatgggaacaacctacctggccttaatggcaacatttaagatgaggcctatgttcgccgttggcctcctgtttcgccggcttactagcagagaggtgctgctactcaccattggtctgtcattggtcgctagtgtggaactgccaaactccttagaggaactcggggatggactggcgatgggcatcatgattcttaaactgttgacggacttccaatctcatcagctctgggccacactgctaagcctgacctttatcaagactaccttctcccttcactatgcatggaaaacaatggctatggttctctcaatagtgagcctgtttcccttgtgtctgagtactacctctcagaagacgacatggttaccggtcctcctgggctcccttgggtgcaagcctctgaccatgttcttgatcgccgagaataaaatttggggaaggcgaagctggccactcaacgaaggtatcatggccgtaggcattgtgtcgatcctgctatcatctctgcttaagaacgatgttcccctcgctgggcctctgatagcaggaggcatgttgattgcctgttacgtgatcagtggttccagcgcggacttatctctggagaaagctgccgaggtcagctgggaagaggaagcagagcattccggggcctcacacaatatcctcgtggaagtacaggatgacggaactatgaagattaaagatgaggagcgcgacgatacactgaccatacttctgaaggctactttgctagcagtgagtggcgtctatcccctgagcatcccagccacactctttgtttggtacttctggcagaaaaagaagcagcggtctggcgtgctgtgggacaccccttcacccccagaagtggagagagcggtccttgatgacgggatttataggatcatgcagcgtggattactgggtcgcagccaggtgggcgttggggtattccaagaaaacgtgtttcatacgatgtggcacgtcactcggggagctgtgctcatgtaccagggcaaaagattggagccgagttgggccagcgttaagaaagacctgatttcctacggtgggggatggaggctccagggctcttggaataccggcgaggaagtgcaggtcatcgcagtggagcctgggaagaaccccaaaaatgtacaaacagccccaggaaccttcaagacacccgaaggtgaggtcggcgctatagccctggattttaagcctgggacttcgggaagcccaatcgtgaaccgagaaggcaaaattgttggtctttatgggaatggagtggtcaccacgtcaggcacatacgtgtccgcaatcgctcaggccaaggcgagtcaggagggccccctgcctgagattgaagacgaggttttccggaaacgcaacttgactatcatggatctacacccggggtctggaaagaccagaaggtatctgccagccatagtgcgggaagcaattaaacgaaagctcagaacattaatcctggctcccacccgcgtcgtggccagcgagatggctgaagcacttaagggtatgcctatcaggtaccaaactaccgccgtaaaatccgagcatacaggcaaggagattgtggacctgatgtgccacgccacgtttactatgcgtctcttgtcaccagttcgggtccccaattataacatgatcataatggatgaagctcatttcaccgacccttctagcattgcggcaagagggtacatcagtacaagggtgggaatgggcgaggccgctgccatttttatgaccgcaactccgcccggttccgtggaagccttcccacagagcaatgctgtcatccaggatgaggaacgcgacatacctgagcgatcttggaactcagggtatgagtggattacagattttcccggaaaaaccgtatggttcgtgccatccatcaagagtggcaatgacatcgcgaactgtctgaggaaaaatggcaagcgggttattcagctcagcaggaagacgtttgatactgaataccagaaaacaaagaacaacgactgggactacgtggtcaccaccgatatctcggagatgggggccaatttccgcgcagaccgtgtgattgatcctagacggtgcctgaaacccgttatacttaaggacggaccagaaagggtgatcctagctggtccgatgcctgtcactgtggcctctgcagcccagcgccgaggcagaattgggcggaaccacaataaagagggagatcagtatatctacatgggccagcccctgaacaatgacgaggatcatgctcactggacagaagccaagatgttgttagacaacatcaataccccagagggtattatacccgcgctgttcgaacctgagagggaaaagtccgcagccatcgatggggagtatcgcctcagaggcgaggctaggaaaacatttgtagaactgatgcggcgtggagaccttccagtgtggctgagctacaaggttgcctcagagggcttccaatatagtgatcgccgatggtgctttgacggggaaagaaacaatcaggtcctcgaggaaaacatggatgtggagatttggactaaagagggagaaaggaagaaattgcggccccgctggctggacgctagaacgtactctgaccctctagcactgagggagttcaaggaatttgccgctggtcggcgatccgtgagcggcgatctcatccttgagattgggaaactgccgcagcacttaacccagagagcccaaaatgcattggacaacctggtcatgctccataattcagaacagggaggccgcgcgtataggcacgccatggaggagctgccagatacaatcgaaactcttatgctgctcgctttgatagccgttctgaccggtggggtgacattattctttctaagtggccggggactgggcaagaccagcatcgggctcctttgtgtaatggcatcctctgtgctgttgtggatggctagcgtcgagccccattggattgccgcatccatcattctggagttctttctcatggtgctgcttatccctgagcccgaccgtcagagaactccacaggataaccaactcgcctacgttgtgataggactgttgttcatgattctgacggtcgctgcgaatgagatgggtttactagaaaccacaaagaaagacctgggcatcgggcacgtagccgtgggaaaccaccatcacgcagctatgctcgatgttgaccttcatcctgcctcagcctggactctgtacgcagtggctaccacaattatcacccccatgatgaggcacactatagagaacacaacggccaatatctctttgaccgcgattgctaaccaggccgcaatcctgatgggcctcgataagggttggccaattagtaaaatggacatcggggtccctctgcttgccttaggctgctatagccaggtgaatccgctgactctcacagctgcagtcttgatgctggtggcccattacgcgataattggacccggcctacaagctaaggccacccgcgaagcacagaaacggaccgccgctgggatcatgaagaacccaacagttgatggaatcgtggccattgacctggatcctgtagtgtatgacgcaaagtttgagaaacagctcggccagatcatgcttctgatattgtgtactagccaaattctgctcatgcgaacgacctgggctctgtgcgaatccatcacattagccactggtccccttaccacactgtgggaggggtctccaggaaagttctggaataccactattgcggtctcaatggccaacatctttagaggcagctacctcgcaggagctggcctagccttctccctgatgaaaagtctagggggaggcaggcgcgggacgggagcacagggcgagacactgggtgaaaagtggaaacggcagctcaatcagctttctaagagcgagttcaacacctataagagatcagggataatggaagttgaccgttccgaggctaaagaaggactgaagaggggcgagactaccaaacacgccgtgagtcggggtacagccaagttgcgctggtttgtcgagcgaaatctggtgaaacctgaaggcaaggtaatcgatctcgggtgtggaagaggcgggtggagctactattgcgcgggattaaagaaagtgactgaggttaagggctacaccaaaggtgggcccggacacgaagaaccgattccaatggctacatacggctggaacctggtgaaacttcattctggcaaagacgtcttctttatccctcccgaaaagtgtgatacgctgctatgcgacattggggagtcctcaccaaatcccaccatcgaggaaggaaggactctccgggtgctgaaaatggtcgagccttggttgcgcggtaaccaattctgtattaagatcctgaatccgtatatgcccagcgtggttgaaacactcgagcagatgcagagaaagcacggcgggatgcttgtaaggaacccactgtcgcgaaattctacccatgagatgtactgggtgagttgcggaactggcaacatagtctccgcagtgaatatgacaagccggatgttactgaaccgttttaccatggcccacagaaaacctacgtatgaacgcgatgttgacttgggtgctgggaccaggcacgtggccgtcgagcccgaagtggcaaacctcgatattatcggacagcggatcgagaatattaagcatgaacacaaatcaacatggcattacgacgaggataacccttataagacttgggcctaccacggctcctatgaggtaaaaccatctggcagcgctagttccatggtgaatggggttgtcaagctgctaaccaagccctgggacgtgatacctatggtgacacaaatcgcgatgactgataccacaccattcggacagcagagagtctttaaagaaaaggttgacacccgcactcccaaagccaagaggggtacggcacaaattatggaggtgacagctaaatggctttggggcttcctgagccgaaacaagaagccgcggatctgtaccagagaagagtttactaggaaagtacgctctaatgccgcaattggggccgtgttcgtcgacgaaaaccagtggaactcagctaaggaggccgtggaggatgaacgtttttgggacctcgttcataaagagcgggaactgcacaagcagggaaaatgcgcgacctgcgtgtacaacatgatgggcaagagagagaagaaattgggtgagttcgggaaggcaaaaggaagtagggccatctggtacatgtggctgggcgctcgctttctcgagttcgaggcccttggcttcatgaatgaagatcactggttttcccgagagaacagcctgtctggggtcgaaggagagggtttacataagctgggctatatattgcgggacatctcgaaaattcctgggggaaatatgtacgcagatgacacagctggctgggatacgagaatcaccgaggacgatctccagaacgaagccaggattactgacatcatggagccagaacacgctctgctagccaagtcaatattcaaacttacatatcaaaataaggtggtacgcgttcagagacccgcaaagaacggtaccgtgatggatgtcattagccggagggaccagcgtgggtccggacaggtgggcacttacggcctgaatacatttaccaacatggaggcgcaactcatccgacagatggaaagtgaggggatcttctctcctagcgagctggaaacaccaaacttggccgagcgcgtgttagattggctggaaaaatatggagtcgagagactcaagcggatggctatttccggtgacgactgtgttgtgaaacccatagatgacaggtttgccactgcacttaccgctctgaatgatatgggcaaggtacgcaaagacatcccgcagtgggaaccttcaaaggggtggaacgattggcagcaagtgcccttctgcagtcatcactttcaccagctaattatgaaggacggaagagagatcgtcgtgccatgtcggaatcaggatgagctggttggcagggcccgagtgtctcagggtgcagggtggagcctccgtgaaacggcctgcttgggaaaatcctacgcgcaaatgtggcagctgatgtatttccatagacgcgaccttcggctggctgccaacgcaatttgttcagccgtccctgtggattggatccccaccagcaggacaacttggtctatacacgctcatcaccagtggatgaccacagaggacatgctctccgtatggaatagagtttggatcgaagagaacccatggatggaagataagactcatattagtagctggggcgacgtgccctacttaggcaaacgcgaggaccaatggtgcgggtcgctgatcggattgaccgcccgggcaacgtgggctacaaatattcaggtcgccatcaaccaggtgaggcgactgattggtaatgagaactacctcgattatatgacctccatgaagagatttaaaaatgaatctgaccctgagggcgcgctttggtga

SEQ ID NO: 13270 - RNA, 9879 nt, synthetic construct
  misc_feature 1..9879: note = derived and/or modified CDS sequence (opt3) from DENV-1__GU131923__SS-prME
  source 1..9879: mol_type = other RNA
tccgtgaccatgctgctcatgcttatgcccacagcactggctttccacttgactacgagaggaggggaacctcatatgatcgtctccaagcaggaaaggggaaaatctttactgtttaagacctcagccggtgttaatatgtgcacattaattgccatggacctcggcgaactgtgtgaagatactatgacctacaaatgcccacggataacagaggcggaaccggacgatgtggactgttggtgcaatgctaccgatacttgggtaacatatgggacctgtagtcaaacgggagagcaccgccgagacaagcgtagcgtggcccttgcaccccatgtcggcctgggtttggagactagaaccgaaacatggatgtcctctgagggggcctggaaacagatccagagggtggaaacttgggctctccggcaccctggattcaccgttattgcactgtttctggcccatgctatcggcacatcgattacccagaagggcatcatattcatcctcttaatgctggtgacgccatcaatggccatgcgctgcgtcgggattggaagcagagattttgtggagggtcttagtggcgcgacttgggtagacgttgtgttggagcacgggtcctgtgtcacaaccatggcaaaggataaacccactctggacatcgaattgctcaagacagaggtgaccaaccctgccattctgaggaaactttgcatcgaagctaagatatctaatacgaccacagatagccggtgtccaactcaaggagaggccaccctggtggaagaacaggacgcaaacttcgtctgccgccgaacagttgtggatagaggctggggtaatgggtgtggattgtttggcaaaggctccctcattacttgcgctaagttcaagtgcgtaaccaaactggaggggaagatcgtgcagtacgaaaacttaaaatattcagtcattgtgacagttcacaccggagaccagcatcaagtgggtaatgagagtactgaacacggcacgacagccaccatcactccccaggcgcctaccacagagatccagctgaccgactacggggccctcactcttgattgtagcccaaggacaggactggactttaacgaaatggtcttgctaacgatgaaggagaaatcttggctggtgcataagcagtggttcctcgatctgccgcttccctggacctccggcgcatcaactagccaagagacatggaatcggcaggacctgttggtaacctttaaaacagctcacgccaagaagcaggaagttgtggtcctcggtagtcaagagggggctatgcacactgccctgaccggcgcaacggaaattcagacctctggaacaactaccatattcgccggccatttaaaatgccgtctgaagatggataaactaacactcaaggggatgtcctatgtgatgtgtactggtagctttaaactggagaaggaagtcgctgagacccagcacggtacggtgcttgttcagatcaagtacgagggcacagacgcgccttgcaaaattccattctcgacccaagatgaaaaggggatcactcagaacggacgcttgataacagcaaatcccattgtgaccgacaaagagaagcctgtaaacatcgaagccgagccacccttcggcgagtcttatatcgtcattggtgctggggaaaaagccctgaagctctcctggtttaagaaaggctcaagtatcggaaagatgttcgaggcaactgccagaggcgctaggcggatggccattctgggggataccgcatgggactttggaagcataggtggcgtgttcacatccgttgggaaacttgtgcatcagatctttggaacggcgtacggcgtcctgttctctggtgtgagctggaccatgaagattgggatcggcgtattgctcacttggctgggattaaattcacgaagtacatccctgagcatgacctgtatcgctgtgggcctagttacactctacctgggggtcatggtgcaggccgattctggatgcgtgattaactggaaaggccgcgaacttaagtgtggttcagggatatttgtcactaatgaggttcacacctggacggaacaatataagttccaggcagacagtccgaaaagattgagcgccgctatcggaaaggcctgggaggagggcgtgtgcggtattaggtccgcaacacggctggaaaacatcatgtggaaacagatttctaacgagctcaatcatatcctgttagaaaacgacatgaagtttaccgtggtagtcggcgatgtggctgggatactggcccagggcaaaaagatgatccgccctcaacccatggagtacaaatattcgtggaaaagctggggcaaggcgaaaattatcggggccgacgttcagaatactaccttcattatcgatggaccaaacacacctgaatgtcccgacgatcagagagcttggaatatatgggaggtggaggactacggctttggtattttcactaccaacatctggcttaagttgagggattcctatacacaggtctgcgaccaccgtctcatgtcagcagccattaaagatagtaaggctgtgcacgccgacatggggtactggatcgaatctgagaaaaatgaaacgtggaagctggcacgggcgagctttatagaggttaagacctgtatctggccaaaatcccatactctatggtcaaacggagtgctggaaagcgagatgattatccccaagatttatggcggtcctatctctcaacacaattaccgaccaggctacttcacacagaccgccgggccgtggcatctcggaaaactggagcttgatttcgacttgtgcgaaggcactacagtagtcgtggatgagcactgcgggaacagaggaccctccctgaggaccacgactgtgaccggcaagataattcacgaatggtgttgccgcagttgtacattacctccactccggtttagaggtgaggacgggtgctggtatggaatggagatcaggcccgtcaaagaaaaggaggaaaatctggttaagagcatggtgtctgctggctccggtgaggtagactcattcagtcttggcctgttgtgtatcagcattatgatcgaagaggtgatgcgctcgcgatggtcccggaaaatgctcatgaccgggactctggccgtctttctactgctcattatgggacagctgacatggaacgatcttatacgtttgtgcatcatggtgggcgcaaatgcttctgacagaatggggatgggaaccacatacctggccttaatggcaactttcaagatgaggcctatgtttgccgttggcctcctgttccgccggcttaccagcagagaggtgctgctactcacgattggtctgtcattggtcgctagtgtggaactgccaaactccttagaggaactcggggatggactggcgatgggcatcatgattcttaaactgttgacagactttcaatctcatcagctctgggccaccctgctaagcctgactttcatcaagaccacattttcccttcactatgcatggaaaactatggctatggttctctcaatagtgagcctgttccccttgtgtctgagtaccacgtctcagaagacaacctggttaccggtcctcctgggctcccttgggtgcaagcctctgactatgtttttgatcgccgagaataaaatttggggaaagaggagctggccactcaacgaaggtatcatggccgtaggcattgtgtcgatcctgctatcatctctgcttaaaaacgatgttcccctcgctgggcctctgatagcaggaggcatgttgattgcctgttacgtgatcagtggttccagcgcggacttatctctggagaaggctgccgaggtcagctgggaagaggaagcagagcattccggggcctcacacaatatcctcgtggaagtacaggatgacggaacaatgaaaattaaggatgaggagcgagacgataccctgactatacttctgaaagctacattgctagcagtgagtggcgtctatcccctgagcatcccagccaccctcttcgtttggtacttttggcaaaagaagaaacagcgctctggcgtgctgtgggacacgccttcacccccagaagtggagcgggcggtccttgatgacgggatttatagaatcatgcagaggggattactgggtcgtagccaggtgggcgttggggtattccaagaaaacgtgttccatactatgtggcacgtcacccgcggagctgtgctcatgtaccagggcaagcggttggagccgagttgggccagcgttaaaaaggacctgatttcctacggtgggggatggagactccagggctcttggaatacaggcgaggaagtgcaggtcatcgcagtggagcctgggaaaaaccccaagaatgtacaaaccgccccaggaacatttaagactcccgaaggtgaggtcggcgctatagccctggatttcaaacctgggacctcgggaagcccaatcgtgaacagggaaggcaagattgttggtctttatgggaatggagtggtcacgacatcaggcacttacgtgtccgcaatcgctcaggccaaagcgagtcaggagggccccctgcctgagattgaagacgaggtttttcgaaagcggaacttgaccatcatggatctacacccggggtctggaaaaacacgcagatatctgccagccatagtgagggaagcaattaagcggaagctccgaaccttaatcctggctcccactagagtcgtggccagcgagatggctgaagcacttaaaggtatgcctatccgctaccaaaccacagccgtaaagtccgagcatacgggcaaagagattgtggacctgatgtgccacgccactttcaccatgaggctcttgtcaccagttcgtgtccccaattataacatgatcataatggatgaagctcattttacagacccttctagcattgcggcacgggggtacatcagtaccagagtgggaatgggcgaggccgctgccattttcatgactgcaacaccgcccggttccgtggaagcctttccacagagcaatgctgtcatccaggatgaggaaagggacatacctgagcgctcttggaactcagggtatgagtggattaccgatttccccggaaagacggtatggtttgtgccatccatcaaaagtggcaatgacatcgcgaactgtctgcgaaagaatggcaagagagttattcagctcagccggaaaactttcgatacagaataccaaaagaccaaaaacaacgactgggactacgtggtcaccactgatatctcggagatgggggccaattttagggcagaccgcgtgattgatcctcgtagatgcctgaagcccgttatacttaaagacggaccagaacgggtgatcctagctggtccgatgcctgtcacagtggcctctgcagcccagaggcgcggccgaattgggagaaaccacaataaggagggagatcagtatatctacatgggccagcccctgaacaatgacgaggatcatgctcactggaccgaagccaagatgttgttagacaacatcaatacaccagagggtattatacccgcgctgttcgaacctgagcgggaaaaatccgcagccatcgatggggagtataggctccgcggcgaggctagaaagactttcgtagaactgatgaggcggggagaccttccagtgtggctgagctacaaagttgcctcagagggctttcaatatagtgatcgtcgctggtgcttcgacggggaacgaaacaatcaggtcctcgaggaaaacatggatgtggagatttggacgaaggagggagaaaggaaaaagttgaggccccggtggctggacgctcgcacctactctgaccctctagcactgagagagtttaaagagttcgccgctggtaggcggtccgtgagcggcgatctcatccttgagattgggaagctgccgcagcacttaacacagcgagcccaaaatgcattggacaacctggtcatgctccataattcagaacagggaggcagagcgtatcgccacgccatggaggagctgccagatactatcgaaacccttatgctgctcgctttgatagccgttctgacaggtggggtgaccttatttttcctaagtggcaggggactgggcaagactagcatcgggctcctttgtgtaatggcatcctctgtgctgttgtggatggctagcgtcgagccccattggattgccgcatccatcattctggaatttttcctcatggtgctgcttatccctgagcccgaccggcagcgtacgccacaggataaccaactcgcctacgttgtgataggactgttgtttatgattctgaccgtcgctgcgaatgagatgggtttactagaaacaactaaaaaggacctgggcatcgggcacgaggccgtaggaaaccaccatcacgcagctatgctcgatgtggaccttcatcctgcctcagcctggaccctgtacgcagttgctacaaccattatcactcccatgatgagacacacaatagaaaacacgaccgccaatatctctttgactgcgattgctaaccaggccgcaatcctgatgggcctcgataaaggttggccaattagtaagatggacatcggggtgcctctgcttgccttaggctgctattcgcaggtcaatccgctgacactcaccgctgcagtgttgatgctggtcgcccattacgcgataattggacccggcctacaagctaaagccaccagggaggcacagaagcgcacagccgctgggatcatgaagaacccaactgtggatggaatcgttgccattgacctggatcctgtggtatatgacgcaaaattcgaaaagcagctcggccagatcatgcttctgatattgtgtacgagccaaattctgctcatgcggaccacatgggctctgtgcgagtccatcactttagccaccggtccccttacaaccctgtgggaggggtctccaggaaaattttggaatactacgattgcggtgtcaatggccaacatcttccgaggcagctacctcgcaggagctggcctagccttttccctgatgaagagtctagggggaggcagaagggggacaggagcacagggcgaaaccctgggtgagaaatggaagcgccagctcaatcagctttctaagagcgagttcaacacttataaacggtcagggataatggaggtcgacagatccgaagctaaggagggactgaaacgtggcgagaccacaaagcacgccgttagtaggggtactgccaaattgcggtggttcgtggaacgcaatctggtcaagcctgagggcaaggtgatcgatctcgggtgtggacgaggcgggtggagctactattgcgcgggactaaagaaggtaaccgaagtgaaaggctacacaaagggtgggcccggacacgaggaaccgattccaatggctacgtacggctggaacctggttaaacttcattctggcaaggacgtgtttttcatccctcccgagaaatgtgataccctgctatgcgacattggggagtcctcaccaaatcccactatcgaagagggaagaacactcagggtcctgaagatggtggaaccttggttgcggggtaaccaattttgtattaagatcctgaatccgtatatgcccagcgtcgtggagaccctcgagcagatgcagcgcaaacacggcgggatgcttgttagaaacccactgtcgagaaattctactcatgaaatgtactgggtaagttgcggaacaggcaacatagtgtccgcagtcaatatgaccagccgaatgttactgaaccggttcacgatggcccaccgtaagcctacctatgagagagatgtggacttgggtgctgggacacgccacgttgccgtggaacccgaggtcgcaaacctcgatattatcggacagaggatcgaaaatattaaacatgagcacaagtcaacttggcattacgacgaggataacccttataaaacctgggcctaccacggctcctatgaagtgaagccatctggcagcgctagttccatggtaaatggggtggttaagctgctaacaaaaccctgggacgtcatacctatggtgactcaaatcgcgatgaccgatacaaccccatttggacagcagcgggtgttcaaggagaaagtcgacactagaacgcccaaggccaaacgcggtacagcacaaattatggaagttaccgctaagtggctttggggctttctgagcaggaacaagaaaccgcgaatctgtactcgggaggagttcaccagaaaggtgaggtctaatgccgcaattggggccgtatttgtggacgagaaccagtggaactcagctaaagaggccgtcgaagatgagcgcttctgggacctcgtgcatcgtgaacgggagctgcacaagcagggaaaatgcgcgacatgcgtttacaacatgatgggcaagagagaaaagaaattgggtgagtttgggaaggcaaaaggaagtagggccatctggtacatgtggctgggcgctcgcttcctcgagtttgaagcccttggcttcatgaatgaggatcactggttctcccgagaaaacagcctgtctggggtggagggagagggtttacataagctgggctatatattgcgggacatctcgaaaattcctgggggaaatatgtacgcagatgacacggctggctgggataccagaatcactgaagacgatctccagaacgaggccaggattacagacatcatggaaccagagcacgctctgctagccaagtcaatatttaaacttacctatcaaaataaggtcgtgcgcgtacagagacccgcaaagaacggtactgttatggatgtgattagccggagggaccagcgtgggtccggacaggtcggcacatacggcctgaataccttcacaaacatggaagcgcaactcatccgacagatggagagtgaggggatcttttctcctagcgaactggagactccaaacttggccgaacgcgtgttagattggctggagaaatatggagtggaaagactcaagcggatggctatttccggtgacgactgtgtcgttaaacccatagatgacaggttcgccaccgcacttacggctctgaatgatatgggcaaggtgcgcaaagacatcccgcagtgggagccttcaaaggggtggaacgattggcagcaagtacccttttgcagtcatcacttccaccagctaattatgaaggacggaagagagatcgtggtcccatgtcggaatcaggatgaactggtgggcagggcccgagtttctcagggtgcagggtggagcctccgtgagaccgcctgcttgggaaaatcctacgcgcaaatgtggcagctgatgtattttcatagacgcgaccttcggctggctgccaacgcaatttgttcagccgtgcctgtcgattggatccccacaagcaggactacctggtctatacacgctcatcaccagtggatgacaactgaagacatgctctccgtgtggaatagagtatggatcgaggaaaacccatggatggaggataagacccatattagtagctggggcgacgttccctacttaggcaaacgcgaggaccaatggtgcgggtcgctgatcggattgacggcccgggcaacatgggctaccaatattcaggtggccatcaaccaggtcaggcgactgattggtaatgaaaactacctcgattatatgacttccatgaagagattcaaaaatgagtctgaccctgaaggcgcgctttggtga

SEQ ID NO: 13271 - RNA, 9879 nt, synthetic construct
  misc_feature 1..9879: note = derived and/or modified CDS sequence (opt3) from DENV-1__GQ868637__SS-prME
  source 1..9879: mol_type = other RNA
agcgtgacaatgctgctcatgcttatgcccacagcactggctttccacttgactacgagaggaggggaacctcatatgatcgtctccaagcaagaaaggggaaaatctttactgtttaagacctcagccggtgttaacatgtgcacattaattgccatggacctcggcgaactgtgtgaagatactatgacctacaaatgcccacggataacagaggtggaaccggacgatgtagactgttggtgcaataccactgatacatgggtgacctatgggacgtgtagtcaaactggagagcaccgccgagacaagcgtagcgtcgcgcttgctccccatgtgggcctgggtttggagaccagagccgaaacatggatgtcctctgagggggcatggaaacagatccagagggttgaaacttgggccctccggcaccctggattcaccgtgattgctctgtttctggcacatgccatcggcacatcgattacccagaagggcatcatattcatcctcttaatgctggtcacgccatcaatggctatgcgctgcgtggggattggaagcagagattttgtagagggtcttagtggcgccacttgggttgacgtggtcttggagcacgggtcctgtgtgacaaccatggcgaaggataaacccactctggacatcgaactactcaagacagaggtgaccaaccctgcagtcctgaggaaactttgcattgaagccaagatctctaatacgaccacagatagccggtgtccaactcaaggagaggctaccctggttgaagaacaggacgccaacttcgtgtgccgccgaacatttgtagatagaggctggggtaatgggtgtggattgttcggcaaaggctccctcataacttgcgcaaagtttaagtgcgtgaccaaactggaggggaagattgtccagtacgaaaacttaaaatattcagtgatcgttacagtgcacaccggagaccagcatcaagtcggtaatgagagtactgaacacggcacgacagctaccattactccccaggcccctaccagcgagatccagctgacagactacggggcgctcacccttgattgttctccaaggactggactggacttcaacgaaatggtgttgctaacaatgaaggagaaatcctggctggtacataagcagtggtttctcgatctgccgcttccctggacgtcaggcgccagcaccagtcaagagacttggaatcggcaggacctgttggttacattcaaaaccgcacacgctaagaagcaggaagtggtcgtgctcggttctcaagagggggccatgcacacagctctgactggcgccaccgaaatccagacgtccggaaccacaactatttttgcaggccatttaaaatgccgtctgaagatggataaactaaccctcaaggggatgagctatgtcatgtgtacaggatcgttcaaactggagaaggaagtggccgagactcagcacggtaccgttcttgtgcagataaagtacgagggcacggacgctccttgcaaaatcccattctctacacaagatgaaaagggggtaacccagaacggacgcttgattactgcgaatcccatcgtcacagacaaagagaagcctgtgaacatagaagcagagccaccctttggcgagtcctatattgttatcggtgccggggaaaaagctctgaagctctcatggttcaagaaaggcagtagcatcggaaagatgtttgaggccaccgcaagaggcgccaggcggatggctattctgggggatactgcctgggacttcggatccatcggtggcgtgtttacctctgtcgggaaacttgtgcatcagattttcggaacagcatacggcgtactgtttagcggtgtgtcatggacgatgaagatagggatcggcgttttgctcacctggctgggattaaatagtcgatccactagcctgtctatgacatgtattgcggtcggcctagtgaccctctacctgggggtgatggtccaggctgattcaggatgcgttatcaactggaaaggccgcgaacttaagtgtggtagtgggatcttcgtgacaaatgaggtgcacacttggaccgaacaatataagtttcaggccgacagcccgaaaagattgtccgcagccattggaaaggcttgggaggagggcgtatgcggtataaggtctgccacgcggctggaaaacatcatgtggcgccagatttcgaacgagctcaatcatatcctgttagaaaacgacatgaaattcacagtcgtggttggcgatgtggtcgggattctggcacagggaaagaaaatgatcagacctcaacccatggagcacaagtacagctggaaatcctggggcaaggctaagataatcggggccgacgtgcagaataccacttttattatcgatggaccaaacacccctgaatgtcccgacgatcagagggcgtggaatatttgggaggttgaggactatggcttcggtatctttacaactaacatatggcttaaattgcgtgattcatacacccaggtgtgcgaccaccggctcatgagtgccgctattaaggattctaaagcagtacatgccgacatggggtattggatcgaaagcgagaagaatgaaacatggaaactggctcgagcctccttcattgaggtcaagacgtgtatctggccaaagtcacacaccctatggagcaacggagtgctggaatctgagatgataatccccaaaatttacggcggtcctatctcccaacataattatagaccaggctacttcactcagacagcagggccgtggcacctcggaaagctggagcttgattttgacttgtgcgaaggcaccactgtggtcgttgatgagcactgcgggaacaggggacccagtctgcgcacaaccacggtgactggcaaaattatccatgaatggtgttgccggagctgtaccttacctccactcagattcaagggtgaggacgggtgctggtacggaatggagataaggcccgtaaaagaacgcgaggaaaatctggtgaagtctatggtctccgcgggctcaggtgaggtggacagttttagccttggcctgttgtgtatttcgatcatgatcgaagaggttatgcgatcccggtggtctcgtaagatgctcatgacagggaccctggccgtgttctttctactgattatgggacagctcacttggaacgatctgatcagactttgcattatggtcggcgctaatgccagcgacaggatggggatgggaacaacctatttggcactgatggctacattcaaaatgcgccctatgtttgccgtgggcttactcttccggagactgacttcaagggaggttcttctgctaaccataggtctcagtctggtggcatccgtcgaattgccaaactctctggaggaattaggggatggactcgccatgggcatcatgattctgaaacttctgacggactttcaaagccaccagttgtgggctacactcctgtccctaaccttcatcaaaactaccttttcactgcattacgcgtggaagacaatggccatggtacttagcattgtgagtctcctgcccttgtgtctgtctactacctcccagaaaacgacatggttaccggttctcctgggcagccttgggtgcaagcctctgaccatgttcttgatcgcagagaataagatatggggacgaaaatcgtggccactcaacgaaggtatcatggctgtgggcattgtctcaatcctgctatctagtctgcttaagaacgatgtgcccctcgccgggcctctgattgccggaggcatgttgatcgcttgttatgtaatatccggtagctctgcagacttaagcctggagaaagccgcggaggtgtcctgggaagaggaagctgagcactcaggggccagtcataatattctcgtcgaagttcaggatgacggaactatgaagatcaaagatgaggagcgcgacgatacactgaccatccttctgaaggcaactttgctagccgtgagcggcgtgtaccccctgtctattccagctacactctttgtctggtatttctggcagaagaagaagcagcggtccggcgtgctgtgggacaccccttcacccccagaagttgagagagcagtacttgatgacgggatatacaggatcatgcagcgtggattactgggtcgcagtcaggtgggcgtcggggtgttccaagaaaacgtttttcacacgatgtggcacgtgactcggggagccgtcctcatgtatcagggcaaaagattggagccgagctgggcgtccgtgaagaaagacctgatttcttacggtgggggatggaggctccagggctcgtggaataccggcgaggaagtacaggtcatcgctgtggagcctgggaagaaccccaaaaatgttcaaacagccccaggaaccttcaagacacccgaaggtgaggtgggcgcaattgccctggattttaagcctgggactagcggatcaccaatcgtcaaccgagaaggcaaaatagtgggtctttacgggaatggagttgtgaccacgtccggcacatatgtcagtgctatcgcccaggcaaaggcttctcaggagggccccctgcctgagattgaagacgaggtgttccggaaacgcaacttgactatcatggatctacatccggggagcggaaagaccagaaggtacctgccagccattgtacgggaagcgatcaaacgaaagctcagaacattaatactggcccccacccgcgtggttgcatccgagatggctgaagcccttaagggtatgcctattaggtatcaaactaccgctgtcaaatcagagcacacaggccgtgagatcgtggacctgatgtgccatgcaacgtttactatgcggctcttgtctccagtgagagtccccaattacaacatgatcattatggatgaagcccacttcaccgaccctagcagtatcgccgctagggggtatatatccacacgcgtaggaatgggcgaggcggcagccatttttatgaccgctactccgcccggtagcgtggaagccttcccacagtctaatgcagttatccaggatgaggaacgagacattcctgagagatcatggaactccgggtacgagtggatcacagattttcccggaaagaccgtgtggttcgtcccaagtataaaaagcggcaatgacattgccaactgtctgcggaagaatggcaaaagggtgatccagctctcgcgcaagacgtttgatactgaatatcaaaagaccaagaacaacgactgggactacgttgtgaccaccgatatctctgagatgggggctaatttccgtgcggacagagtcattgatcctcggaggtgcctgaagcccgtgatccttaaagacggaccagaacgcgtaattctagccggtccgatgcctgtgactgttgcatccgctgcccagcgaagaggccggatagggaggaaccataataaggagggagatcagtacatctatatgggccagcccctgaacaatgacgaggatcacgcacactggacagaagccaaaatgttgttagacaacattaataccccagagggtatcatccccgctctgttcgaacctgagcgcgaaaagagcgccgcgattgatggggagtacagactcaggggcgaggcacggaagacatttgtcgaactgatgcgtcgcggagaccttccagtgtggctgtcatataaagtggccagtgagggcttccaatactctgatcgaagatggtgctttgacggggaaaggaacaatcaggtcctcgaggaaaacatggatgttgagatatggactaaggagggagaacggaaaaagttgcgccccagatggctggacgctaggacgtattccgaccctctagccctgcgggagttcaaagaatttgctgcaggtcgaagaagcgtgtcaggcgatctcatccttgagattgggaagctgccgcagcatttaacccagcgcgcccaaaatgctttggacaacctggtaatgctccacaatagtgaacagggaggcagggcctaccggcatgcaatggaggagctgccagatacaatcgaaactcttatgctgctcgcgttgattgccgtgctgaccggtggggtcacattattctttctaagcggccgtggactgggcaaaacctccatcgggctcctttgtgtgatggcttctagcgccctgttgtggatggcatccgttgagccccactggatagctgcctcaatcattctggagttctttctcatggtgctgcttatccctgagcccgacagacagaggactccacaggataaccaactcgcatatgtcgtaattggactgttgttcatgatcctgacggtggccgctaatgagatgggtttactagaaaccacaaagaaggacctgggcatagggcacgttgcggtggagaaccatcaccatgccactatgctcgatgtcgaccttcaccctgcatctgcttggaccctgtacgccgtggccacaaccattatcactcccatgatgcgccatacaattgaaaacacgaccgcaaatatcagtttgactgctatagccaaccaggcggctatcctgatgggactcgataaaggctggccaatttcgaagatggacatcggtgtccctctgcttgccttagggtgctacagccaggtgaatccgctgacactcattgcagccgttttgatgctggtggctcactatgcaatcataggccccggactacaagccaaagcgacccgggaggctcagaagcgaaccgccgcaggcattatgaaaaacccaacagtagatgggatcgtggccatcgacctggatcctgtcgtttacgacgctaagtttgaaaagcagctcggacagattatgcttctgatcttgtgtacttcccaaatactgctcatgagaacgacctgggccctgtgcgagtctattacattagcaactggcccccttaccacactgtgggagggttcaccagggaaattctggaataccactatcgctgtgagcatggccaacatttttaggggatcctatctcgcgggcgccggtctagcattcagtctgatgaagtctttgggcgggggacgccggggcacgggggctcagggagaaacactgggcgagaaatggaagagacagctcaatcagcttagcaaatcagagttcaacacctacaagcgttccggtatcatggaggtcgacaggagtgaagccaaggaggggctgcggcgcggagagactaccaaacacgcagtgagccgaggcacagctaagttgagatggtttgtagaaaggaatctggtgaaacctgagggtaaggttatagatctcggctgtgggcggggaggctggtcttattactgcgccgggctgaaaaaggtgactgaagtcaagggatataccaaaggcggtcccgggcatgaggaaccgatcccaatggccacatacggatggaacctagtgaaacttcactccggcaaagacgtcttctttattcctcccgagaagtgtgatacgctgctatgcgacatcggcgagtcaagcccaaatcccaccattgaagaggggcgcactctcagagtgctgaaaatggttgaaccttggttgaggggaaaccaattctgtatcaagattctgaatccgtacatgccctcggtagtggagacactcgagcagatgcagcgaaaacatggtggcatgcttgtccggaacccactgtctcgtaatagtacccacgaaatgtattgggtgtcctgcgggactggaaacatcgttagcgcggtgaatatgacatcaagaatgttactgaaccgctttaccatggctcacaggaagcctacgtacgagcgggatgtcgacttgggcgcaggtaccagacatgtggccgtagaacccgaggtggctaacctcgatataattgggcagcgcatcgaaaatatcaagcacgagcataaatccacatggcactatgacgaggataacccttacaagacttgggcctatcatggatcttacgaagttaaaccaagcggcagtgcatccagcatggtcaatggcgtggtgaagctgctaaccaaaccctgggacgtcattcctatggttacacaaatagccatgactgataccacaccattcgggcagcagagggtgtttaaggagaaggtagacacccgaactcccaaagctaagcggggaacggcgcaaatcatggaagtgacagccagatggctttggggtttcctgtctaggaacaaaaagccgcgcatttgtacccgtgaggaatttactcggaaagtcagatcaaatgcagctatcggcgccgtgttcgttgacgagaaccagtggaatagtgcaaaggaggccgtggaagatgagaggttttgggacctcgtccaccgcgaacgagagctgcacaagcaggggaaatgcgctacctgcgtgtataacatgatgggaaagcgggagaaaaagttgggcgagttcggtaaagccaaggggtccagagcgatttggtacatgtggctgggagcaaggtttctcgagttcgaagcccttggcttcatgaatgaggatcattggtttagccgcgaaaactctctgtcgggcgtagagggggagggattacacaagctgggttacatcttgagagacatatcaaaaatccctggcgggaatatgtatgctgatgacacagccggatgggatacgcggattaccgaagacgatctccagaacgaggcaaagatcactgacattatggaaccagagcatgctctgctagccacaagcatcttcaaacttacctaccaaaataaggttgtgagggtccagcgtcccgctaaaaacggcactgtgatggatgtgatatcccgacgcgaccagagaggtagtgggcaggtcggaacatatggcctgaatacctttacaaacatggaagcccaactcattcggcagatggagtctgagggcatcttcagcccttccgaactggagactccaaacttggcagaaagggttttagattggctggagaagtacggggtggaacgcctcaaaagaatggcgatctcaggagacgactgtgtagtgaagcccattgatgaccggtttgccaccgctcttacggccctgaatgatatgggtaaggtcaggaaagacataccgcagtgggagcctagtaagggctggaacgattggcagcaagtgcccttctgctctcaccactttcatcagctaatcatgaaagacgggcgagagattgttgtgccatgtcgtaatcaggatgaactggtcggcagagcacgcgtgagccagggcgctggttggtccctccgggagaccgcctgcttggggaagtcatatgcacaaatgtggcagctgatgtacttccacaggagagaccttcgcctggccgcgaacgctatctgtagcgccgtacctgttgattgggtgcccacatctcggactacctggtccattcatgcacaccatcagtggatgacaactgaagacatgctcagtgtctggaatagggtgtggatcgatgagaacccatggatggaagacaaaacccacataagctcgtggggagacgttccctatttaggcaagcgagaggatcaatggtgcggctccctgatcgggttgacggccagagctacatgggccaccaatattcaggtggcaatcaaccaggtccggaggctgattggaaatgagaactacctcgactacatgacttctatgaagcgctttaaaaatgaatcagatcctgagggtgctctttggtga

SEQ ID NO: 13272 - RNA, 9879 nt, synthetic construct
  misc_feature 1..9879: note = derived and/or modified CDS sequence (opt3) from DENV-1__GQ868639__SS-prME
  source 1..9879: mol_type = other RNA
agcgtgaccatgctgctcatgcttatgcccaccgcactggctttccacttgactacgagaggaggggaacctcatatgatcgtctccaagcaggaaagggggaaatctttactgtttaagacctcagccggtgttaacatgtgcaccctgattgccatggacctcggagagttctgtgaagatactatgacctacaaatgcccacggataagtgaagcggaaccggacgatgtggactgttggtgcaatgctacagatacctgggtaacttatgggacatgtagccaaaccggagagcaccgccgagacaagcgttccgtggccctggcaccccatgtcggccttggtctggagacgagaactgaaacctggatgtcttcggagggggcctggaaacagatccagagggtggaaacatgggctttgcggcaccctggatttactgttattgcactcttcctggcccatgctatcggcacctcaattacacagaagggcatcatatttatcctgctcatgttagtgaccccaagcatggccatgcgctgcgtcgggattggaagtagagatttcgtggagggtctgtccggcgcgacgtgggtagacgttgtgcttgagcacgggtcttgtgtcactacaatggcaaaggataaacccaccttggacatcgaactgctaaagactgaggtgacaaaccctgccgtgctcaggaaactgtgcattgaagctaagatcagcaataccacgaccgattcccggtgtccaacacaaggagaggccactcttgtcgaagaacaagacgcaaactttgtttgccgccgaaccttcgtggatagaggctggggtaatgggtgtggactgtttggcaaaggctcattgataacatgcgctaagttcaagtgcgtaactaaactcgaggggaagattgtgcagtacgaaaacctgaaatatagtgtcatcgtgaccgttcacacaggagaccagcatcaagtgggtaatgagagcaccgaacacggcactacggccacaattacaccccaggcgccttctactgagatccagttaaccgactacggggccctgacactcgattgttccccaaggaccggacttgactttaacgaaatggtcctgttgactatgaaggagaaatcatggctagtgcataagcagtggttcctggatctcccgctgccctggacaagcggcgcaagtacgtctcaagagacctggaatcggcaggaccttctggtaacttttaaaacagctcacgccaagaagcaggaagttgtggtcttgggttcccaagagggggctatgcacaccgccctcacaggcgcaactgaaatccagaccagcggaacgaccacaattttcgccggccatctgaaatgccgtttaaagatggataaactgactctaaaggggatgtcgtatgtgatgtgtaccggatctttcaaactcgagaaggaagtcgctgagacacagcacggtactgtgctggttcagataaagtacgagggcaccgacgcgccttgcaaaatcccattttccacgcaagatgaaaagggggtgacacagaacggacgccttattaccgcaaatcccatcgtaactgacaaagagaagcctgtcaacatagaagccgagccacccttcggcgagtcatatattgtgatcggtgctggggaaaaagccttgaagctgagttggtttaagaaaggcagctccatcggaaagatgttcgaggcaacagccagaggcgctaggcggatggccattctcggggataccgcatgggactttggatctatcggtggcgttttcactagcgtggggaaactggtccatcagatttttggaaccgcgtacggcgtgcttttctcaggtgtaagttggacaatgaagatagggatcggcgtgctgttgacgtggctcggactaaattcccgaagcacctctttatcaatgacttgtattgctgttggcctggtcacactatacctcggggtgatggtgcaggccgatagtggatgcgtcatcaactggaaaggccgcgaactgaagtgtggtagcgggatctttgttaccaatgaggtgcacacatggactgaacaatataagttccaggcagactccccgaaaagactttctgccgctattggaaaggcctgggaggagggcgtgtgcggtataaggtcggcaacccggttggaaaacatcatgtggaaacagattagcaacgagctgaatcatatcctcctggaaaacgacatgaagtttacggtagtcgtgggcgatgttgctgggattttagcccagggcaagaagatgatccgccctcaacccatggagtacaaatattcctggaagtcatggggcaaggcgaaaataatcggggccgacgtgcagaatacaaccttcattatcgatggaccaaacactcctgaatgtcccgacgatcagagagcttggaatatttgggaggtcgaggactacggctttggtatcttcaccacaaacatatggctgaaacttagggatagttatactcaggtgtgcgaccaccgtttgatgtctgcagccattaaagatagcaaggctgttcacgccgacatggggtactggatcgaatccgagaaaaatgaaacctggaagctcgcacgggcgtcattcattgaggtgaagacatgtatctggccaaaaagccatacgctgtggtctaacggagtactagaatccgagatgataatccccaagatttatggcggtcctatcagtcaacacaattaccgaccaggctactttacccagactgccgggccgtggcatctgggaaaactcgagctggatttcgacctttgcgaaggcacaaccgtcgtggtggatgagcactgcgggaacagaggacccagcttgaggactacaaccgtcacgggcaagattatccacgaatggtgttgccgctcttgtactctgcctccattacggtttaaaggtgaggacgggtgctggtatggaatggagataagacccgttaaggaaaaggaggaaaatctcgtgaaatccatggtatcagctggcagtggtgaggtggacagcttctcgctgggccttctgtgtatttccatcatgatcgaagaggtcatgaggtctcgctggagccgaaagatgttgatgaccgggacactcgccgtgtttttcctgctaattatgggacagctgacctggaacgatctcatccggctgtgcattatggttggcgcaaatgcttcagaccgtatggggatgggaatgacttaccttgccttgatggcaacatttaaaatgagacctatgttcgccgtgggcctgttatttaggcgcctcaccagtcgggaggtcctgcttctgacaataggtctatccctcgtggcttctgttgaactgccaaacagcttggaggaactgggggatggattagcgatgggcatcatgattctcaagctgcttgccgacttccaatcccatcagctgtgggcaactttgctctcactgacctttatcaaaacgacattcagcctacactatgcttggaagaccatggccatggtgctgagtattgtctctctttttcccctctgtctgtccactaccagccagaagacaacttggttgccggtactgttaggctcgctcgggtgcaaacctctgaccatgttccttatcgccgagaataagatatggggaagaaaatcatggccactgaacgaaggtatcatggctgtgggcattgtttctatcttgctcagttccctgctaaagaacgatgtgcccctggcagggcctcttattgccggaggcatgctcatcgcgtgttacgtcataagcggttctagcgctgacctgtccttggagaaagccgcagaggtgtcatgggaagaggaagccgagcatagtggggctagccacaatattttagtagaagtgcaggatgacggaacgatgaagatcaaagatgaggagagggacgatacactgaccatcctcctgaaggcaactcttctggccgtctctggcgtttatcccttgtccattccagcgacactattcgtgtggtacttttggcaaaagaaaaagcagcgatcaggcgtgctgtgggacacccctagtcccccagaagtcgagcgcgctgtgctcgatgacgggatatatcggatcatgcagagaggactgcttggtaggagccaggttggcgtaggggtgttccaagaaaacgtctttcatactatgtggcacgtgacacgtggagccgttttaatgtaccagggcaaacgcctggagccgtcctgggcatctgtgaagaaagacctcatttcgtacggtgggggatggcggttgcagggcagctggaataccggcgaggaagtccaggtgatcgccgtagagcctgggaagaaccccaagaatgtccaaacggctccaggaactttcaaaacctcagaaggtgaggtgggcgccattgcactggattttaagcccgggacatccggaagtcctatcgttaacagagaaggcaaaatagtgggtctctatgggaatggagtcgtgaccacatctggcacttacgttagcgctatcgcccaggcgaaggcctcccaggagggcccactgcccgagattgaagacgaggtgttcaggaaacgaaaccttaccatcatggatctgcaccctgggtcaggaaagacgcggcgctatttgccggcaattgtcagagaagctatcaagaggaaactacggacactgatactcgccccaactcgagtggtagcttctgagatggcagaagccttaaagggtatgcccattagataccaaaccacagccgtgaaaagcgagcataccggcaaggagatcgttgacctgatgtgccacgctacttttaccatgcgccttctgagtcctgtcagggtgccaaattataacatgatcattatggatgaagcgcatttcacagacccctccagcatcgcagcccgtgggtacatatctacgcgggtgggaatgggcgaggctgccgcaatttttatgactgccacccctccgggttcagctgaagcgttcccccagtccaatgccgtcatccaggatgaggaaagagacattccagagaggagttggaacagcgggtatgagtggatcacagattttcctggaaaaaccgtatggttcgtgccctcgataaagtctggcaatgacattgcaaactgtctccgcaagaatggcaaacgagttatccagttgtccagaaagactttcgatacagaataccagaagaccaagaacaacgactgggactacgtggtcacgactgatatcagcgagatgggggctaattttcgggccgacagggtgattgatccacgccgttgcctgaaacctgttatcctcaaggacggacccgaaagagtgattctggcaggtccaatgccggtcacagtggcctcagctgcccagcggaggggccgcatagggcgaaaccacaataaggagggagatcagtatatctacatgggccagcctcttaacaatgacgaggatcatgcgcactggaccgaagcaaaaatgctactggacaacattaatacccccgagggtatcatcccagccttgttcgaacccgagagagaaaagagtgctgccattgatggggagtatcggttaaggggcgaggctcgcaaaacttttgtagaactgatgagaaggggagacctccctgtgtggctgtcttacaaggttgcatccgagggcttccaatatagcgatcggcgttggtgctttgacggggaacgcaacaatcaggtccttgaggaaaacatggatgtggagatatggacaaaagagggagaacgaaagaaactgagaccaaggtggctcgacgcccggacctactcagaccccttggctctgcgcgagttcaaggaatttgccgcaggtagaaggagtgtgagcggcgatctaatcctggagattgggaagctccctcagcaccttacacagcgggcgcaaaatgccctggacaacttagtcatgttgcataattccgaacagggaggccgagcttatagacacgccatggaggagctgccggatactatcgaaacgctcatgctgcttgcactgattgctgttctcaccggtggggtgacattgttctttctgtctggccgcggattaggcaaaactagcatcgggctactgtgtgtaatggcctcctcagtgctcctttggatggcatctgtcgagccacattggatagccgctagtatcattctggagttctttttgatggtgctgctcatccccgagcctgacaggcagcggacaccccaggataaccaactggcgtacgttgtgattggacttctcttcatgatcctgacagtcgccgcaaatgagatgggtttgctggaaaccactaagaaagacttaggcatagggcacgtagctgtggagaaccaccatcacgccgccatgctagatgttgacctgcatccagcatcggcttggacgctctacgccgtggcgaccacaattatcactcctatgatgcgtcacaccattgaaaacacaaccgctaatatcagccttactgccatagcaaaccaggccgctatcctgatgggattggataagggctggcccatttccaaaatggacatcggtgtcccactgctcgcactggggtgctattctcaggtgaatcctcttacattaacggccgcggtcctgatgctcgtggctcattacgccattatcggcccgggattgcaagcaaaggccaccagagaggctcagaagaggactgccgcaggcataatgaaaaaccccacagttgatgggattgtggctatcgacctggatccagtagtgtatgacgccaagtttgaaaaacagctaggacagatcatgctgctcattctttgtacctcacaaatcctgttgatgcgcaccacatgggcgctgtgcgagagcataactctcgccacgggccctctgaccacattatgggagggttcccccgggaagttctggaatactaccattgcagtcagtatggctaacatcttccggggatcttaccttgccggcgcaggtctggcttttagcctcatgaaatcactaggcgggggacgaagaggcacaggggcccagggagaaaccctgggcgagaagtggaagaggcagttgaatcagctgtccaaaagtgagttcaacacttataagcgcagcggtattatggaggttgaccggtctgaagccaaagaggggctcaagagaggagagacgacaaaacacgcggtgtcccgtggcaccgctaaacttaggtggtttgtcgaacggaatctggtgaagccagagggtaaagtaatcgatttgggctgtgggcgcggaggctggtcatactattgcgcagggctgaagaaagtgactgaagttaagggatacaccaaaggcggtcctgggcacgaggaacccataccgatggccacatacggatggaacctcgtgaagttacatagcggcaaagacgtcttctttgtgccacctgagaagtgtgatactctgctttgcgacatcggcgagtcgtctcccaatccaaccattgaagaggggcgaacactgagagtcctaaagatggtggaaccctggctcaggggaaaccaattctgtatcaaaattctgaatccttatatgccgagtgttgtagagacgttggagcagatgcagcggaagcacggtggcatgctggtgcgcaaccccctctccagaaatagcacccatgaaatgtactgggtctcatgcgggactggaaacatcgtgtccgctgttaatatgacatctaggatgcttctgaaccgatttaccatggcccaccggaaaccaacttatgagcgtgatgtggacttaggcgcaggtacaagacacgtcgccgtggaacctgaggtagctaacctggatattatcgggcagcgcatagaaaatattaagcatgagcacaaaagcacctggcattacgacgaggataacccctataagacgtgggcgtaccacggaagttatgaagtgaagccttccggcagcgcctcttcaatggttaatggcgtcgtgaaattgctcaccaagccatgggacgtgatccccatggtcacacaaatcgcaatgactgataccacacctttcgggcagcagagggtttttaaagagaaggtggacactcggaccccaaaagctaagagaggaacagcccaaattatggaagtaaccgcaaagtggctgtggggtttcctaagtcgcaacaaaaagcccaggatatgtactcgagaggaatttacgcggaaagtgagatccaatgccgctatcggcgccgtcttcgtggacgagaaccagtggaatagcgcgaaggaggcagttgaagatgagaggttttgggaccttgtgcatcgcgaacgtgagctgcacaaacaggggaagtgcgccacatgcgtctacaacatgatgggaaagcgggagaaaaagctcggcgagttcggtaaagctaaggggtctagagccatttggtacatgtggctgggagcaaggttcttggagtttgaagctctgggcttcatgaatgaggatcactggttttcgcgcgaaaactcactcagcggcgtggagggggagggacttcataaactgggttatatcttacgagacatttccaagatcagtggcgggaatatgtacgccgatgacaccgctggatgggatactcggataaccgaagacgatctgcagaacgaggccaaaatcacagacattatggaaccggagcacgcattgctcgcgaagtctatcttcaagctgacgtatcaaaataaagtagttagagtgcagaggcctgccaagaacggcaccgtcatggatgtgattagccgcagagaccagcggggttccggacaggtgggaacttacggcctaaatacatttaccaacatggaagctcaacttatcaggcagatggagtcagagggcatattcagtccatctgaactggagactcccaacctcgccgaacgtgcactggattggttggagaaacatggggtcgaacgattaaagcgcatggctattagcggagacgactgtgttgtgaaacctatcgatgacagatttgccacagcactgaccgccctcaatgatatgggtaaggtacggaaggacatcccacagtgggagccctccaaaggctggaacgattggcagcaagtgccgttctgctcacaccactttcatcagcttattatgaaggacgggagggagatagtcgtgccttgtcgcaatcaggatgaactggttggcagagcgcgggtgagccagggcgctggttggtctctaagggagacagcctgcctggggaaatcctatgcacaaatgtggcagctcatgtacttccaccgacgtgacttgagactggccgctaacgccatctgtagtgcagtccccgtggattgggtaccaactagccgcaccacgtggtcgattcatgctcaccatcagtggatgaccacagaagacatgctttccgtttggaatcgggtgtggatcgaggaaaacccttggatggaggataagactcacatttcttcatgggaggacgtcccctatctgggaaaaagggaagaccaatggtgcggcagcctcatcggcttaaccgccagagcgacatgggctactaatatacaggtggccatcaaccaggttcgccggctgattgggaatgagaactacttggattacatgaccagtatgaagaggtttaagaatgaatccgacccagagggagcactgtggtga

SEQ ID NO: 13273 - RNA, 9879 nt, synthetic construct
  misc_feature 1..9879: note = derived and/or modified CDS sequence (opt3) from DENV-1__GU131925__SS-prME
  source 1..9879: mol_type = other RNA
tccgtgaccatgctgctcatgcttatgcccacagcactggctttccacttgactacgagaggaggggagcctcatatgatcgtctccaagcaggaaagaggaaaatctttactgtttaagacctcagccggtgttaatatgtgcacattgattgccatggacctcggcgagctgtgtgaagatactatgacctacaaatgcccacggataacagaggcggaaccggacgatgtggactgttggtgcaatgctaccgatacttgggtaacatatgggacctgtagtcaaacgggagagcaccgccgagacaagcgtagcgtggcccttgcaccccatgtcggcctgggtttggagactagaaccgaaacatggatgtcctctgagggggcctggaaacagatccagagggtggaaacttgggctctccggcaccctggattcaccgttattgcactgtttctggcccatgctatcggcacatcgattacccagaagggcatcatattcatcctcttaatgctggtgacgccatcaatggccatgcgctgcgtcgggattggaagcagagattttgtggagggtcttagtggcgcgacttgggtagacgttgtgttggagcacgggtcctgtgtcacaaccatggcaaaggataaacccactctggacatcgaactactcaagacagaggtgaccaaccctgccattctgaggaaactttgcatcgaagctaagatatctaatacgaccacagatagccggtgtccaactcaaggagaggccaccctggtggaagaacaagacgcaaacttcgtctgccgccgaacatttgttgatagaggctggggtaatgggtgtggattgttcggcaaaggctccctcattacttgcgctaagtttaagtgcgtgaccaaactggaggggaagatcgtacagtacgaaaacttaaaatattcagtgattgtcacagtgcacaccggagaccagcatcaagttggtaatgagagtactgaacacggcacgacagccaccatcactccccaggcgcctaccacagagatccagctgaccgactacggggccctcactcttgattgtagcccaaggacaggactggacttcaacgaaatggtgttgctaacgatgaaggagaaatcttggctggtccataagcagtggtttctcgatctgccgcttccctggacctccggcgcatcaactagccaagagacatggaatcggcaggacctgttggtgaccttcaaaacagctcacgccaagaagcaggaagtagttgtgctcggtagtcaagagggggctatgcacactgccctgaccggcgcaacggaaattcagacctctggaacaactaccatatttgccggccatttaaaatgccgtctgaagatggataaactaacactcaaggggatgtcctatgtcatgtgtactggtagcttcaaactggagaaggaagtggctgagacccagcacggtacggtccttgtgcagatcaagtacgagggcacagacgcgccttgcaaaattccattctcgacccaagatgaaaagggggttactcagaacggacgcttgatcacagcaaatcccatagtgaccgacaaagagaagcctgtaaacattgaagccgagccaccctttggcgagtcttatatcgtcatcggtgctggggaaaaagccctgaagctctcctggttcaagaaaggctcaagtattggaaagatgtttgaggcaactgccagaggcgctaggcggatggccatcctgggggataccgcatgggacttcggaagcattggtggcgtgtttacatccgttgggaaacttgtgcatcagatattcggaacggcgtacggcgtcctgttttctggtgtgagctggaccatgaagatcgggattggcgtattgctcacttggctgggattaaattcacgaagtacatccctgagcatgacctgtatcgctgtgggcctagttacactctacctgggggtcatggtgcaggccgattctggatgcgtgatcaactggaaaggccgcgaacttaagtgtggttcagggattttcgtcactaatgaggttcacacctggacggaacaatataagtttcaggcagacagtccgaaaagattgagcgccgctataggaaaggcctgggaggagggcgtgtgcggtatcaggtccgcaacacggctggaaaacattatgtggaaacagatctctaacgagctcaatcatattctgttagaaaacgacatgaagttcaccgtggtagtcggcgatgtggctgggatcctggcccagggcaagaagatgatacgccctcaacccatggagtacaaatattcgtggaaaagctggggcaaggcgaagatcattggggccgacgttcagaatactacctttatcattgatggaccaaacacacctgaatgtcccgacgatcagagagcttggaatatctgggaggtggaggactacggcttcggtatatttactaccaacatttggcttaagttgagggattcctatacacaggtctgcgaccaccgtctcatgtcagcagccatcaaagatagtaaggctgtgcacgccgacatggggtactggattgaatctgagaaaaatgaaacgtggaagctggcacgggcgagcttcatcgaggttaagacctgtatatggccaaaatcccatactctatggtcaaacggagtgctggaaagcgagatgatcattcccaagatctatggcggtcctatttctcaacacaattaccgaccaggctacttcacacagaccgccgggccgtggcatctcggaaaactggagcttgattttgacttgtgcgaaggcactacagtagtcgtggatgagcactgcgggaacagaggaccctccctgaggaccacgactgtgaccggcaagatcatacacgaatggtgttgccgcagttgtacattacctccactccggttcagaggtgaggacgggtgctggtatggaatggagattaggcccgtcaaagaaaaggaggaaaatctggttaagagcatggtgtctgctggctccggtgaggtagactcatttagtcttggcctgttgtgtatcagcatcatgattgaagaggtgatgcgctcgcgatggtcccggaaaatgctcatgaccgggactctggccgtcttcctactgctcatcatgggacagctgacatggaacgatcttattcgtttgtgcataatggtgggcgcaaatgcttctgacagaatggggatgggaaccacatacctggccttaatggcaacttttaagatgaggcctatgttcgccgttggcctcctgtttcgccggcttaccagcagagaggtgctgctactcacgatcggtctgtcattggtcgctagtgtggaactgccaaactccttagaggaactcggggatggactggcgatgggcattatgatccttaaactgttgacagacttccaatctcatcagctctgggccaccctgctaagcctgacttttattaagaccacattctcccttcactatgcatggaaaactatggctatggttctctcaatcgtgagcctgtttcccttgtgtctgagtaccacgtctcagaagacaacctggttaccggtcctcctgggctcccttgggtgcaagcctctgactatgttcttgatagccgagaataaaatctggggaaggcgaagctggccactcaacgaaggtattatggccgtaggcatcgtgtcgattctgctatcatctctgcttaagaacgatgttcccctcgctgggcctctgatcgcaggaggcatgttgatagcctgttacgtgattagtggttccagcgcggacttatctctggagaaagctgccgaggtcagctgggaagaggaagcagagcattccggggcctcacacaatatcctcgtggaagtacaggatgacggaacaatgaagatcaaagatgaggagcgcgacgataccctgactattcttctgaaggctacattgctagcagtgagtggcgtctatcccctgagcataccagccaccctctttgtttggtacttctggcagaagaagaagcagcggtctggcgtgctgtgggacacgccttcacccccagaagtggagagagcggtccttgatgacgggatctataggattatgcagcgtggattactgggtcgcagccaggtgggcgttggggtattccaagaaaacgtgtttcatactatgtggcacgtcacccggggagctgtgctcatgtaccagggcaaaagattggagccgagttgggccagcgttaagaaagacctgatctcctacggtgggggatggaggctccagggctcttggaatacaggcgaggaagtgcaggtcattgcagtggagcctgggaagaaccccaaaaatgtacaaaccgccccaggaacattcaagactcccgaaggtgaggtcggcgctatcgccctggattttaagcctgggacctcgggaagcccaatagtgaaccgagaaggcaaaatcgttggtctttatgggaatggagtggtcacgacatcaggcacttacgtgtccgcaattgctcaggccaaggcgagtcaggagggccccctgcctgagatcgaagacgaggttttccggaaacgcaacttgaccattatggatctacacccggggtctggaaagacaagaaggtatctgccagccatcgtgcgggaagcaataaaacgaaagctcagaaccttaattctggctcccactcgcgtcgtggccagcgagatggctgaagcacttaagggtatgcctatcaggtaccaaaccacagccgtaaaatccgagcatacgggcaaggagatcgtggacctgatgtgccacgccacttttaccatgcgtctcttgtcaccagttcgggtccccaattataacatgattatcatggatgaagctcatttcacagacccttctagcatagcggcaagagggtacattagtaccagggtgggaatgggcgaggccgctgccatctttatgactgcaacaccgcccggttccgtggaagccttcccacagagcaatgctgtcattcaggatgaggaacgcgacatccctgagcgatcttggaactcagggtatgagtggataaccgattttcccggaaaaacggtatggttcgtgccatccattaagagtggcaatgacatcgcgaactgtctgaggaaaaatggcaagcgggttatccagctcagcaggaagacttttgatacagaataccagaaaaccaagaacaacgactgggactacgtggtcaccactgatatttcggagatgggggccaatttccgcgcagaccgtgtgatcgatcctagacggtgcctgaaacccgttattcttaaggacggaccagaaagggtgatactagctggtccgatgcctgtcacagtggcctctgcagcccagcgccgaggcagaatcgggcggaaccacaataaagagggagatcagtatatttacatgggccagcccctgaacaatgacgaggatcatgctcactggaccgaagccaagatgttgttagacaacatcaatacaccagagggtatcattcccgcgctgttcgaacctgagagggaaaagtccgcagccatagatggggagtatcgcctcagaggcgaggctaggaaaacttttgtagaactgatgcggcgtggagaccttccagtgtggctgagctacaaggttgcctcagagggcttccaatatagtgatcgccgatggtgctttgacggggaaagaaacaatcaggtcctcgaggaaaacatggatgtggagatctggacgaaagagggagaaaggaagaaattgcggccccgctggctggacgctagaacctactctgaccctctagcactgagggagttcaaggaatttgccgctggtcggcgatccgtgagcggcgatctcattcttgagatcgggaaactgccgcagcacttaacacagagagcccaaaatgcattggacaacctggtcatgctccataattcagaacagggaggccgcgcgtataggcacgccatggaggagctgccagatactattgaaacccttatgctgctcgctttgatcgccgttctgacaggtggggtgaccttattctttctaagtggccggggactgggcaagactagcatagggctcctttgtgtaatggcatcctctgtgctgttgtggatggctagcgtcgagccccattggatcgccgcatccattatcctggagttctttctcatggtgctgcttattcctgagcccgaccgtcagagaacgccacaggataaccaactcgcctacgttgtgatcggactgttgttcatgatactgaccgtcgctgcgaatgagatgggtttactagaaacaactaagaaagacctgggcattgggcacgtagccgtgggaaaccaccatcacgcagctatgctcgatgttgaccttcatcctgcctcagcctggaccctgtacgcagtggctacaaccatcattactcccatgatgaggcacacaatcgagaacacgaccgccaatatatctttgactgcgatcgctaaccaggccgcaattctgatgggcctcgataagggttggccaatcagtaaaatggacattggggtccctctgcttgccttaggctgctattcgcaagtgaatccgctgacactcaccgctgcagtcttgatgctggtggcccattacgcgatcataggacccggcctacaagctaaggccacccgcgaagcacagaaacggacagccgctgggattatgaagaacccaactgttgatggaatcgtggccatcgacctggatcctgtagtgtatgacgcaaagtttgagaaacagctcggccagattatgcttctgatcttgtgtacgagccaaatactgctcatgcgaaccacatgggctctgtgcgaatccattactttagccaccggtccccttacaaccctgtgggaggggtctccaggaaagttctggaatactacgatcgcggtctcaatggccaacatttttagaggcagctacctcgcaggagctggcctagccttctccctgatgaaaagtctagggggaggcaggcgcgggacaggagcacagggcgagaccctgggtgaaaagtggaaacggcagctcaatcagctttctaagagcgagttcaacacttataagagatcagggatcatggaagttgaccgttccgaggctaaagaaggactgaagaggggcgagaccacaaaacacgccgtgagtcggggtactgccaagttgcgctggtttgtcgagcgaaatctggtgaaacctgaaggcaaggtaatagatctcgggtgtggaagaggcgggtggagctactattgcgcgggattaaagaaagtgaccgaggttaagggctacacaaaaggtgggcccggacacgaagaaccgatcccaatggctacgtacggctggaacctggtgaaacttcattctggcaaagacgtcttctttattcctcccgaaaagtgtgataccctgctatgcgacatcggggagtcctcaccaaatcccactattgaggaaggaaggacactccgggtgctgaaaatggtcgagccttggttgcgcggtaaccaattctgtatcaagattctgaatccgtatatgcccagcgtggttgaaaccctcgagcagatgcagagaaagcacggcgggatgcttgtaaggaacccactgtcgcgaaattctactcatgagatgtactgggtgagttgcggaacaggcaacatcgtctccgcagtgaatatgaccagccggatgttactgaaccgttttacgatggcccacagaaaacctacctatgaacgcgatgttgacttgggtgctgggacaaggcacgtggccgtcgagcccgaagtggcaaacctcgatataattggacagcggatcgagaatatcaagcatgaacacaaatcaacttggcattacgacgaggataacccttataagacctgggcctaccacggctcctatgaggtaaaaccatctggcagcgctagttccatggtgaatggggttgtcaagctgctaacaaagccctgggacgtgattcctatggtgactcaaatagcgatgaccgatacaaccccattcggacagcagagagtctttaaagaaaaggttgacactcgcacgcccaaagccaagaggggtacagcacaaatcatggaggtgaccgctaaatggctttggggcttcctgagccgaaacaagaagccgcggatttgtactagagaagagtttaccaggaaagtacgctctaatgccgcaatcggggccgtgttcgtcgacgaaaaccagtggaactcagctaaggaggccgtggaggatgaacgtttttgggacctcgttcatcgggagagagaactgcacaaacagggaaagtgcgcgacatgcgtgtacaacatgatgggcaaaagggagaagaagttgggtgagttcgggaaagcaaagggaagtcgcgccatttggtacatgtggctgggcgctcgatttctcgagttcgaggcccttggcttcatgaatgaagatcactggttttcccgggagaacagcctgtctggggtcgaaggagagggtttacataaactgggctatatcttgagagacatatcgaagatccctgggggaaatatgtacgcagatgacacggctggctgggataccaggattactgaggacgatctccagaacgaagcccgcatcacagacattatggagccagaacacgctctgctagccaaatcaatcttcaaacttacctatcaaaataaagtggtaagagttcagcggcccgcaaagaacggtactgtgatggatgtcataagcaggcgtgaccagcgagggtccggacaggtgggcacatacggcctgaatacctttacaaacatggaggcgcaactcattcgccagatggaaagtgaggggatcttctctcctagcgagctggaaactccaaacttggccgagagagtgttagattggctggaaaagtatggagtcgagcggctcaaaaggatggctatctccggtgacgactgtgttgtgaagcccattgatgaccgctttgccaccgcacttacggctctgaatgatatgggcaaagtaagaaaggacataccgcagtgggaaccttcaaaagggtggaacgattggcagcaagtgcccttctgcagtcatcactttcaccagctaatcatgaaggacggacgggagattgtcgtgccatgtaggaatcaggatgagctggttggccgagcccgtgtgtctcagggtgcagggtggagcctcagagaaaccgcctgcttgggaaagtcctacgcgcaaatgtggcagctgatgtatttccatcgccgggaccttaggctggctgccaacgcaatctgttcagccgtccctgtggattggattcccacaagcagaactacctggtctatccacgctcatcaccagtggatgacaactgaggacatgctctccgtatggaatcgcgtttggatagaagagaacccatggatggaagataaaacccatatcagtagctggggcgacgtgccctacttaggcaagcgggaggaccaatggtgcgggtcgctgattggattgacggccagggcaacatgggctaccaatatccaggtcgccattaaccaggtgcgaagactgatcggtaatgagaactacctcgattatatgacttccatgaaacggtttaagaatgaatctgaccctgagggcgcgctttggtga

SEQ ID NO: 13274 - RNA, 9879 nt, synthetic construct
  misc_feature 1..9879: note = derived and/or modified CDS sequence (opt3) from DENV-1__GU131926__SS-prME
  source 1..9879: mol_type = other RNA
agcgtgaccatgctgctcatgcttatgcccaccgccctggctttccacttgactacgagaggaggggaacctcatatgatcgtctccaagcaggaaaggggaaaatctttactgtttaagacctcagccggtgttaacatgtgcacactaattgccatggacctcggagagttctgtgaagatactatgacctacaaatgcccacggataagtgaagcggaaccggacgatgtggactgttggtgcaatgctacagatacctgggtaacttatgggacatgtagccaaaccggagaacaccgccgagacaagcgttccgtggccctggcaccccatgtcggccttggtctggagacgagaactgaaacctggatgtcttcggagggggcctggaaacagatccagagggtggaaacatgggctttgcggcaccctggatttactgttattgcactcttcctggcccatgctatcggcacctcaattacacagaagggcatcatatttatcctgctcatgttagtgaccccaagcatggccatgcgctgcgtcgggattggaagtagagatttcgtggagggtctgtccggcgcgacgtgggttgacgttgtgcttgagcacgggtcttgtgtcactacaatggcaaaggataaacccaccttggacatcgaactgctaaagactgaggtgacaaaccctgccgtgctcaggaaactgtgcattgaagctaagatcagcaataccacgaccgattcccggtgtccaacacaaggagaggccactcttgtcgaagaacaagacgcaaactttgtttgccgccgaaccttcgtggatagaggctggggtaatgggtgtggactgtttggcaaaggctcattgataacatgcgctaagttcaagtgcgtaactaaactcgaggggaagattgtgcagtacgaaaacctgaaatatagtgtcatcgtgaccgttcacacaggagaccagcatcaagtgggtaatgagagcaccgaacacggcactacggccacaattacaccccaggcgccttctactgagatccagttaaccgactacggggccctgacactcgattgttccccaaggaccggacttgactttaacgaaatggtcctgttgactatgaaggagaaatcatggctagtgcataagcagtggttcctggatctcccgctgccctggacaagcggcgcaagtacgtctcaagagacctggaatcggcaggaccttctggtaacttttaaaacagctcacgccaagaagcaggaagttgtggtcttgggttcccaagagggggctatgcacaccgccctcacaggcgcaactgaaatccagaccagcggaacgaccacaattttcgccggccatctgaaatgccgtttaaagatggataaactgactctaaaggggatgtcgtatgtgatgtgtaccggatctttcaaactcgagaaggaagtcgctgagacacagcacggtactgtgctggttcagataaagtacgagggcaccgacgcgccttgcaaaatcccattttccacgcaagatgaaaagggggtgacacagaacggacgccttattaccgcaaatcccatcgtaactgacaaagagaagcctgtcaacatagaagccgagccacccttcggcgagtcatatattgtgatcggtgctggggaaaaagccttgaagctgagttggtttaagaaaggcagctccatcggaaagatgttcgaggcaacagccagaggcgctaggcggatggccattctcggggataccgcatgggactttggatctatcggtggcgttttcactagcgtggggaaactggtccatcagatttttggaaccgcgtacggcgtgcttttctcaggtgtaagttggacaatgaagatagggatcggcgtgctgttgacgtggctcggagttaattcccgaagcacctctctgtcaatgacttgtattgctgtcggcttagtgacactgtacctaggggtgatggtccaggccgatagtggatgcgttatcaactggaaaggccgcgaactcaagtgtggtagcgggatctttgtgaccaatgaggtgcacacatggactgaacaatataagttccaggcagactccccgaaaagactgtctgccgctattggaaaggcctgggaggagggcgtatgcggtataaggtcggcaacccggcttgaaaacatcatgtggaaacagattagcaacgagttgaatcatatcctgctcgaaaacgacatgaagtttacggtcgtggttggcgatgtggctgggattctggcccagggcaaaaagatgatccgccctcaacccatggagtacaaatattcctggaagtcatggggcaaggcgaaaataatcggggccgacgtccagaatacaaccttcattatcgatggaccaaacactcctgaatgtcccgacgatcagagagcttggaatatttgggaggtggaggactacggctttggtatcttcaccacaaacatatggttaaagctgagggatagttatactcaggtttgcgaccaccgtcttatgtctgcagccattaaagatagcaaggctgtgcacgccgacatggggtactggatcgaatccgagaaaaatgaaacctggaagttggcacgggcgtcattcattgaggtaaagacatgtatctggccaaaaagccatacgctctggtctaacggagtcctggaatccgagatgataatccccaagatttatggcggtcctatcagtcaacacaattaccgaccaggctactttacccagactgccgggccgtggcatctaggaaaactggagctcgatttcgacctgtgcgaaggcacaaccgtggtggtcgatgagcactgcgggaacagaggacccagccttaggactacaaccgttacgggcaagattatccacgaatggtgttgccgctcttgtactttgcctccactgcggtttaaaggtgaggacgggtgctggtatggaatggagataagacccgtgaaggaaaaggaggaaaatttagtaaaatccatggtgtcagctggcagtggtgaggtcgacagcttctcgctcggcctgctttgtatttccatcatgatcgaagaggtgatgaggtctcgctggagccgaaagatgctgatgaccgggacattggccgtatttttcctcctgattatgggacagctaacctggaacgatctgatccggctctgcattatggtgggcgcaaatgcttcagaccgtatggggatgggaatgacttacctggcccttatggcaacatttaaaatgagacctatgttcgccgtcggcttgctgtttaggcgcttaaccagtcgggaggtgctcctgcttacaataggtctgtccctagttgcttctgtggaactcccaaacagcctggaggaattgggggatggactggcgatgggcatcatgattttaaagctcctgactgacttccaatcccatcagctttgggccaccctgttgtcactcacgtttatcaaaacaaccttcagcctgcactatgcatggaagactatggctatggtcctaagtattgtatctctgtttcccctttgtctctccaccacaagccagaagactacctggctgccggtgttgctgggctcgttagggtgcaaacctctcacgatgttcctgatcgccgagaataagatatggggaagaaaatcatggccacttaacgaaggtatcatggccgttggcattgtgtctatcctgttgagttccctcctgaagaacgatgtccccctagctgggcctctgattgcaggaggcatgcttatcgcctgttacgtgataagcggttctagcgcggacctctccctggagaaagctgccgaggtatcatgggaagaggaagcagagcatagtggggccagccacaatattttggtggaagtccaggatgacggaacaatgaagatcaaagatgaggagagggacgataccttaactatcctgctcaaggctacactgcttgcagtttctggcgtgtatcccctgtccattccagccaccttgttcgtgtggtacttttggcaaaagaaaaagcagcgatcaggcgtcctatgggacactcctagtcccccagaagtggagcgcgcggttctggatgacgggatatatcggatcatgcagagaggactcctgggtaggagccaggtaggcgtgggggtcttccaagaaaacgtgtttcatacaatgtggcacgttacccgtggagctgtgcttatgtaccagggcaaacgcttagagccgtcctgggcctctgtcaagaaagacctgatttcgtacggtgggggatggcggctccagggcagctggaatacgggcgaggaagtgcaggtaatcgcagtcgagcctgggaagaaccccaagaatgtgcaaactgccccaggaaccttcaaaacatcagaaggtgaggttggcgctattgccttggattttaagcccgggacctccggaagtcctatcgtgaacagagaaggcaaaatagtcggtctgtatgggaatggagtggttacaacttctggcacctacgtgagcgcaatcgctcaggccaaggcgtcccaggagggcccactccccgagattgaagacgaggtcttcaggaaacgaaacctgacgatcatggatcttcaccctgggtcaggaaagacacggcgctatctgccggccattgtgagagaagcaatcaagaggaaattgcggactctaatactggctccaacccgagtagtggcctctgagatggctgaagcactcaagggtatgcccattagataccaaacaaccgccgttaaaagcgagcatactggcaaggagatcgtcgacttaatgtgccacgccacctttacaatgcgcctgcttagtcctgtgagggtgccaaattataacatgatcattatggatgaagctcatttcacggacccctccagcatcgcggcacgtgggtacatatctactcgggtcggaatgggcgaggccgctgccatttttatgaccgcaacacctccgggttcagccgaggctttcccccagtccaatgcggtaatccaggatgaggaaagagacattccagagaggagttggaacagcgggtatgagtggatcaccgattttcctggaaaaactgtgtggttcgttccctcgataaagtctggcaatgacattgccaactgtctgcgcaagaatggcaaacgagtgatccagctctccagaaagacattcgataccgaataccagaaaacgaagaacaacgactgggactacgtcgtgactacagatatcagcgagatgggggcaaattttcgggctgacagggttattgatccacgccgttgcttgaaacctgtgatcctgaaggacggacccgaaagagtcattctcgccggtccaatgccggtgaccgtagcatcagccgctcagcggaggggccgcatagggcgaaaccacaataaggagggagatcagtatatctacatgggccagcctctgaacaatgacgaggatcatgcccactggaccgaagcgaaaatgcttctagacaacattaatactcccgagggtatcatcccagcactgttcgaacccgagagagaaaagagtgccgctattgatggggagtatcggttgaggggcgaggcccgcaaaacatttgtggaattaatgagaaggggagacctgcctgtttggctctcttacaaggtcgcttccgagggcttccaatatagcgatcggcgttggtgctttgacggggaacgcaacaatcaggtgctggaggaaaacatggatgtggagatatggaccaaagagggagaacgaaagaaacttagaccaaggtggctggacgcacggacatactcagaccccctcgccttgcgcgagttcaaggaatttgctgccggtagaaggagtgtcagcggcgatctgatcctagagattgggaagctgcctcagcacctcactcagcgggcacaaaatgcgcttgacaacctggttatgttacataattccgaacagggaggccgagcctatagacacgctatggaggagttgccggatacgatcgaaaccctgatgctcctggcccttattgcagtgctgacaggtggggtaactctcttctttttgtctggccgcggactgggcaaaaccagcatcgggttactatgtgtgatggcttcctcagtcctgctctggatggcctctgtggagccacattggatagcagccagtatcattcttgagttctttctgatggttttgctgatccccgagcctgacaggcagcggacaccccaggataaccaactcgcttacgtggtcattggactgcttttcatgatcctcaccgtagcggccaatgagatgggtctgttggaaactacgaagaaagacctgggcatagggcacgtggcagttgagaaccaccatcacgctgccatgttagatgtggacctacatccagcctcggcatggaccctgtacgctgtcgccacaactattatcacccctatgatgcgtcacacaattgaaaacaccactgcgaatatcagcctcacagctatagccaaccaggcagccatccttatgggactggataagggctggcccatttccaaaatggacatcggtgtgccattgctggctctcgggtgctattctcaggtcaatcctctgacgcttaccgcagccgtgttaatgctggttgcgcattacgctattatcggcccgggactccaagccaaggcaactagagaggcccagaagaggacagctgccggcataatgaaaaaccccaccgtggatgggattgtagcaatcgacttggatccagtggtctatgacgctaagtttgaaaaacagctgggacagatcatgctactgattctctgtacctcacaaatccttctgatgcgcacaacttgggccttgtgcgagagcataacgctggcgaccggccctctcacaactctgtgggagggttcccccgggaagttctggaataccacaattgccgttagtatggcaaacatcttccggggatcttacttagctggcgccggtcttgcatttagcctgatgaaatcactcggcgggggacgaagaggcaccggggctcagggagaaactctaggcgagaagtggaagaggcagctgaatcagttgtccaaaagtgagttcaacacgtataagcgcagcggtattatggaggtggaccggtctgaagccaaagaggggctgaagagaggagagacaaccaaacacgccgtctcccgtggcactgcgaagctcaggtggtttgtggaacggaatcttgtaaagccagagggtaaagtgatcgatctgggctgtgggcgcggaggctggtcatactattgcgctgggttgaagaaagttaccgaagtgaagggatacacaaaaggcggtcctgggcacgaggaacccataccgatggcaacttacggatggaacctggtcaagctccatagcggcaaagacgtgttctttgtcccacctgagaagtgtgataccttactgtgcgacatcggcgagtcgtctcccaatccaacaattgaagaggggcgaacgcttagagtgctgaagatggttgaaccctggctaaggggaaaccaattctgtatcaaaattctcaatccttatatgccgagtgtagtggagaccctggagcagatgcagcggaagcacggtggcatgttggtccgcaaccccctgtccagaaatagcactcatgaaatgtactgggtgtcatgcgggacaggaaacatcgtttccgccgtgaatatgacctctaggatgctccttaaccgatttactatggctcaccggaaaccaacatatgagcgtgatgtcgacctgggcgccggtaccagacacgtggcagtagaacctgaggtggccaacttagatattatcgggcagcgcatagaaaatattaagcatgagcacaaaagcacgtggcattacgacgaggataacccctataagacctgggcttaccacggaagttatgaagttaagccttccggcagcgcgtcttcaatggtcaatggcgtggtgaaactgttgacaaagccatgggacgtcatccccatggttactcaaatcgccatgaccgatacaactcctttcgggcagcagagggtgtttaaagagaaggtagacacccggacaccaaaagcaaagagaggaaccgctcaaattatggaagtgactgccaagtggctctggggtttcctgagtcgcaacaaaaagcccaggatatgtacgcgagaggaatttacacggaaagtcagatccaatgcagccatcggcgctgtgttcgttgacgagaaccagtggaatagcgccaaggaggcggtggaagatgagaggttttgggacctagtccatcgcgaacgtgagcttcacaaacaggggaagtgcgcaacctgcgtgtacaacatgatgggaaagcgggagaaaaagctgggcgagttcggtaaagccaaggggtctagagctatttggtacatgtggctcggagccaggttcctggagtttgaagcattgggcttcatgaatgaggatcactggttttcgcgcgaaaactcactgagcggcgtagagggggagggactccataaacttggttatatcctgcgagacatttccaagatcagtggcgggaatatgtacgctgatgacactgccggatgggatacccggataacagaagacgatttacagaacgaggctaaaatcacggacattatggaaccggagcacgccctgttggcaaagtctatcttcaagctcacctatcaaaataaagttgtgagagtccagaggcctgcgaagaacggcactgtgatggatgtgattagccgcagagaccagcggggttccgggcaggtcggaacatacggcctgaatacctttactaacatggaagcccaactaatcaggcagatggagtcagagggcatattcagtccatctgaacttgagacacccaacctggctgaacgtgccctcgattggctggagaaacatggggttgaacgattgaagcgcatggcaattagcggagacgactgtgtggtaaaacctatcgatgacagatttgctaccgccttaacagcactgaatgatatgggtaaggtgcggaaggacatcccacagtgggagccctccaaaggctggaacgattggcagcaagtcccgttctgctcacaccactttcatcagctcattatgaaggacgggagggagatagtggttccttgtcgcaatcaggatgaacttgtgggcagagcacgggtcagccagggcgcgggttggtctctgagggagactgcttgcctagggaaatcctatgcccaaatgtggcagctgatgtacttccaccgacgtgacctcagattggcagccaacgctatctgtagtgccgtgcccgtagattgggttccaaccagccgcacgacctggtcgattcatgcacaccatcagtggatgacaactgaagacatgctgtccgtgtggaatcgggtctggatcgaggaaaacccttggatggaggataagacccacatttcttcatgggaggacgtgccctatcttggaaaaagggaagaccaatggtgcggcagcctgatcggcctcacagctagagccacttgggcgaccaatatacaggttgctatcaaccaggtgcgccggttaattgggaatgagaactacctggattacatgacgagtatgaagaggtttaagaatgaatccgacccagagggagccttgtggtga

SEQ ID NO: 13275 - RNA, 9879 nt, synthetic construct
  misc_feature 1..9879: note = derived and/or modified CDS sequence (opt3) from DENV-1__FJ639669__SS-prME
  source 1..9879: mol_type = other RNA
agcgtgaccatgctgctcatgcttatgcccacagcactggctttccacttgactacgaggggaggggaacctcatatgatcgtctccaagcaggaaaggggaaaatctttactgtttaagacctcagccggtgttaatatgtgcacattaattgccatggacctcggcgagctgtgtgaagatactatgacctacaaatgcccacggataacagaggcggaaccggacgatgtggactgttggtgcaatgctaccgatacttgggtaacatatgggacctgtagtcaaacgggagagcaccgccgagacaagcgtagcgtggcccttgcaccccatgtcggcctgggtttggagactagaaccgaaacatggatgtcctctgagggggcctggaaacagatccagagggtggaaacttgggctctccggcaccctggattcaccgttattgcactgtttctggcccatgctatcggcacatcgattacccagaagggcatcatattcatcctcttaatgctggtgacgccatcaatggccatgcgctgcgtcgggattggaagcagagattttgtggagggtcttagtggcgcgacttgggtagacgttgtgttggagcacgggtcctgtgtcacaaccatggcaaaggataaacccactctggacatcgaactactcaagacagaggtgaccaaccctgccgtgctgaggaaactttgcattgaagctaagatctctaatacgaccacagatagccggtgtccaactcaaggagaggccaccctggtcgaagaacaggacgcaaacttcgtttgccgccgaacatttgtggatagaggctggggtaatgggtgtggattgttcggcaaaggctccctcataacttgcgctaagtttaagtgcgtaaccaaactggaggggaagattgtgcagtacgaaaacttaaaatattcagtcatcgtgacagttcacaccggagaccagcatcaagtgggtaatgagagtactgaacacggcacgacagccaccattactccccaggcgcctaccacagagatccagctgaccgactacggggccctcactcttgattgtagcccaaggacaggactggacttcaacgaaatggtcttgctaacgatgaaggagaaatcttggctggtgcataagcagtggtttctcgatctgccgcttccctggacctccggcgcatcaactagccaagagacatggaatcggcaggacctgttggtaaccttcaaaacagctcacgccaagaagcaggaagttgtggtcctcggtagtcaagagggggctatgcacactgccctgaccggcgcaacggaaatccagacctctggaacaactaccatttttgccggccatttaaaatgccgtctgaagatggataaactaacactcaaggggatgtcctatgtgatgtgtactgggagcttcaaactggagaaggaagtcgctgagacccagcacggtacggtgcttgttcagataaagtacgagggcacagacgcgccttgcaaaatcccattctcgacccaagatgaaaagggggtgactcagaacggacgcttgattacagcaaatcccatcgtaaccgacaaagagaagcctgtcaacatagaagccgagccaccctttggcgagtcttatattgtgatcggtgctggggaaaaagccctgaagctctcctggttcaagaaaggctcaagtatcggaaagatgtttgaggcaactgccagaggcgctaggcggatggccattctgggggataccgcatgggacttcggaagcatcggtggcgtttttacatccgtggggaaacttgtccatcagattttcggaacggcgtacggcgtgctgttttctggtgtaagctggaccatgaagatagggatcggcgtgttgctcacttggctgggattaaattcacgaagtacatccctgagcatgacctgtattgctgttggcctagtcacactctacctgggggtgatggtgcaggccgattctggatgcgtcatcaactggaaaggccgcgaacttaagtgtggttcagggatcttcgttactaatgaggtgcacacctggacggaacaatataagtttcaggcagacagtccgaaaagattgagcgccgctattggaaaggcctgggaggagggcgtgtgcggtataaggtccgcaacacggctggaaaacatcatgtggaaacagatttctaacgagctcaatcatatcctgttagaaaacgacatgaagctgaccgtagtcgtgggcgatgttgctgggattcttgcccagggcaaaaagatgatccgccctcaacccatggagtacaaatattcgtggaaaagctggggcaaggcgaaaataatcggggccgacgtgcagaatactaccttcattatcgatggaccaaacacacctgaatgtcccgacgatcagagagcttggaatatttgggaggtcgaggactacggctttggtatcttcactaccaacatatggttgaagctcagggattcctatacacaggtgtgcgaccaccgtctgatgtcagcagccattaaagatagtaaggctgttcacgccgacatggggtactggatcgaatctgagaaaaatgaaacgtggaagctagcacgggcgagctttattgaggtgaagacctgtatctggccaaaatcccatactctgtggtcaaacggagtactcgaaagcgagatgataatccccaagatttatggcggtcctatctctcaacacaattaccgaccaggctacttcacacagaccgccgggccgtggcatctgggaaaacttgagttggatttcgacctgtgcgaaggcactacagtcgtggtggatgagcactgcgggaacagaggaccctccttaaggaccacgactgtcaccggcaagattatccacgaatggtgttgccgcagttgtacactccctccactgcggtttagaggtgaggacgggtgctggtatggaatggagataaggcccgttaaagaaaaggaggaaaatcttgtgaagtccatggtatctgctggctccggtgaggtggactcattcagtctgggcttgctctgtattagcatcatgatcgaagaggtcatgcgctcgcgatggtcccggaaaatgctgatgaccgggactctagccgtgtttttcctgctcattatgggacagctgacatggaacgatcttatccgtttgtgcattatggttggcgcaaatgcttctgacagaatggggatgggaaccacatacctggccttaatggcaacttttaagatgaggcctatgttcgccgtgggcctcctgtttcgccggcttaccagcagagaggtcctgctactcacgataggtctgtcattggtggctagtgttgaactgccaaactccttagaggaactcggggatggactggcgatgggcatcatgattcttaaactgttgacagacttccaatctcatcagctctgggccaccctgctaagcctgacttttatcaagaccacattctcccttcactatgcatggaaaactatggctatggtgctctcaattgtcagcctgtttcccttgtgtctgagtaccacgtctcagaagacaacctggttaccggtactcctgggctcccttgggtgcaagcctctgactatgttcttgatcgccgagaataaaatatggggaagaaagagctggccactcaacgaaggtatcatggccgtgggcattgtttcgatcctgctatcatctctgcttaaaaacgatgtgcccctcgctgggcctctgattgcaggaggcatgttgatcgcctgttacgtcataagtggttccagcgcggacttatctctggagaaggctgccgaggtgagctgggaagaggaagcagagcattccggggcctcacacaatattctcgtagaagtgcaggatgacggaacaatgaaaatcaaggatgaggagcgagacgataccctgactatccttctgaaagctacattgctagcagtcagtggcgtttatcccctgagcattccagccaccctctttgtgtggtacttctggcaaaagaagaaacagcgctctggcgtgctgtgggacacgccttcacccccagaagtcgagcgggcggtgcttgatgacgggatatatagaatcatgcagaggggattactgggtcgtagccaggttggcgtaggggtgttccaagaaaacgtctttcatactatgtggcacgtgacccgcggagctgttctcatgtaccagggcaagcggttggagccgagttgggccagcgtgaaaaaggacctgatttcctacggtgggggatggagactccagggctcttggaatacaggcgaggaagtccaggtgatcgcagtagagcctgggaaaaaccccaagaatgtccaaaccgccccaggaacattcaagactcccgaaggtgaggtgggcgctattgccctggattttaaacctgggacctcgggaagcccaatcgttaacagggaaggcaagatagtgggtctttatgggaatggagtcgtgacgacatcaggcacttacgtttccgcaatcgctcaggccaaagcgagtcaggagggccccctgcctgagattgaagacgaggtgttccgaaagcggaacttgaccatcatggatctacacccggggtctggaaaaacacgcagatatctgccagccattgtcagggaagcaatcaagcggaagctccgaaccttaatactggctcccactagagtggtagccagcgagatggctgaagcacttaaaggtatgcctattcgctaccaaaccacagccgtgaagtccgagcatacgggcaaagagatcgttgacctgatgtgccacgccacttttaccatgaggctcttgtcaccagtccgtgtgcccaattataacatgatcattatggatgaagctcatttcacagacccttctagcatcgcggcacgggggtacataagtaccagagtgggaatgggcgaggccgctgccatttttatgactgcaacaccgcccggttccgtcgaagccttcccacagagcaatgctgtaatccaggatgaggaaagggacattcctgagcgctcttggaactcagggtatgagtggatcaccgattttcccggaaagacggtgtggttcgttccatccataaaaagtggcaatgacattgcgaactgtctgcgaaagaatggcaagagagtgatccagctcagccggaaaacttttgatacagaataccaaaagaccaaaaacaacgactgggactacgtcgtgaccactgatatctcggagatgggggccaatttcagggcagaccgcgttattgatcctcgtagatgcctgaagcccgtgatccttaaagacggaccagaacgggtcattctagctggtccgatgcctgtgacagtagcctctgcagcccagaggcgcggccgaatagggagaaaccacaataaggagggagatcagtatatctacatgggccagcccctgaacaatgacgaggatcatgctcactggaccgaagccaagatgttgttagacaacattaatacaccagagggtatcatccccgcgctgttcgaacctgagcgggaaaaatccgcagccattgatggggagtataggctccgcggcgaggctagaaagacttttgtggaactgatgaggcggggagaccttccagtttggctgagctacaaagtcgcctcagagggcttccaatatagtgatcgtcgctggtgctttgacggggaacgaaacaatcaggtgctcgaggaaaacatggatgtggagatatggacgaaggagggagaaaggaaaaagttgaggccccggtggctggacgctcgcacctactctgaccctctagcactgagagagttcaaagaatttgccgctggtaggcggtccgtcagcggcgatctcatccttgagattgggaagctgccgcagcacttaacacagcgagcccaaaatgcattggacaacctggttatgctccataattcagaacagggaggcagagcgtatcgccacgccatggaggagctgccagatactatcgaaacccttatgctgctcgctttgattgccgtgctgacaggtggggtaaccttattctttctaagtggcaggggactgggcaagactagcatcgggctcctttgtgtgatggcatcctctgtcctgttgtggatggctagcgtggagccccattggatagccgcatccatcattctggagttctttctcatggttctgcttatccctgagcccgaccggcagcgtacgccacaggataaccaactcgcctacgtggtcattggactgttgttcatgatcctgaccgtagctgcgaatgagatgggtttactagaaacaactaaaaaggacctgggcatagggcacgtggccgttgagaaccaccatcacgcagctatgctcgatgtggaccttcatcctgcctcagcctggaccctgtacgcagtcgctacaaccattatcactcccatgatgagacacacaattgaaaacacgaccgccaatatctctttgactgcgatagctaaccaggccgcaatcctgatgggactcgataaaggctggccaattagtaagatggacatcggtgtgcctctgcttgccttagggtgctattcgcaggtcaatccgctgacactcaccgctgcagtgttgatgctggttgcccattacgcgattatcggccccggactacaagctaaagccaccagggaggcacagaagcgcacagccgctggcataatgaagaacccaactgtggatgggattgtagccatcgacctggatcctgtggtctatgacgcaaaatttgaaaagcagctcggacagatcatgcttctgattttgtgtacgagccaaatcctgctcatgcggaccacatgggctctgtgcgagtccataactttagccaccggcccccttacaaccctgtgggagggttctccagggaaattctggaatactacgattgcggtttcaatggccaacatctttcgaggaagctacctcgcaggcgctggtctagccttctccctgatgaagagtttgggcgggggaagaaggggcacaggggcacagggagaaaccctgggcgagaaatggaagcgccagctcaatcagctttctaagagcgagttcaacacttataaacggtcaggtattatggaggtggacagatccgaagctaaggaggggctgaaacgtggagagaccacaaagcacgccgtcagtaggggcactgccaaattgcggtggtttgtggaacgcaatctggtaaagcctgagggtaaggtgatcgatctcggctgtgggcgaggaggctggagctactattgcgcggggctaaagaaggttaccgaagtgaaaggatacacaaagggcggtcccgggcacgaggaaccgataccaatggctacgtacggatggaacctggtcaaacttcattctggcaaggacgtgttctttatccctcccgagaaatgtgataccctgctatgcgacattggcgagtcctcaccaaatcccactatcgaagaggggagaacactcagggtcctgaagatggtggaaccttggttgcggggaaaccaattctgtattaagatcctgaatccgtatatgcccagcgttgtagagaccctcgagcagatgcagcgcaaacacggtggcatgcttgtgagaaacccactgtcgagaaattctactcatgaaatgtactgggtcagttgcgggacaggaaacattgtgtccgcagttaatatgaccagccgaatgttactgaaccggtttacgatggcccaccgtaagcctacctatgagagagatgtggacttgggcacaggtactcgccacgtcgctgtggaacccgaggtagccaacctcgatatcatagggcagaggattgaaaatatcaaacatgagcacaagtcaacctggcattacgacgaggataacccttataaaacatgggcataccacggatcctatgaagtgaagccatctggcagcgccagttccatggttaatggcgtcgtgaagctgctaactaaaccctgggacgtgatccctatggtcacccaaattgctatgacagataccactccattcgggcagcagcgggtttttaaggagaaagtggacacgagaacacccaaggcgaaacgcggaaccgcccaaataatggaagtaactgcaaggtggctttggggtttcctgagccgaaacaagaagccgcggatctgtaccagagaggaatttacaaggaaagtgcgctctaatgctgccattggcgcagtcttcgtggacgagaaccagtggaactcagccaaggaggctgttgaagatgagcgtttttgggacctcgtgcatcgggaaagagagctgcacaaacaggggaagtgcgccacgtgcgtctacaacatgatgggaaaaagggaaaagaagttgggcgagttcggtaaagcgaaggggagtcgcgcaatctggtacatgtggctgggagcccgatttctcgagttcgaagctcttggcttcatgaatgaggatcactggttttcccgggaaaacagcctgtctggcgtggagggggagggattacataaactgggttatattttgagagacatctcgaagatacctggcgggaatatgtacgccgatgacaccgcaggatgggatactaggatcacagaagacgatctccagaacgaggctaaaattaccgacatcatggaaccagagcacgccctgctagctaaggccattttcaaacttacttatcaaaataaggtagttcgcgtgcagagacccgcaaagaacggcacagtcatggatgtgatctcacggagggaccagcgtggtagcggacaggtgggaacctacggcctgaatacatttactaacatggaagcgcaactcatacgacagatggagtccgagggcattttcagtccttctgaactggagaccccaaacttggccgaacgcgctttagattggctggagaaatatggggtcgaaagactcaagcggatggccatcagcggagacgactgtgttgtgaaacccatcgatgacaggtttgcaacggctcttaccgccctgaatgatatgggtaaggtacgcaaagacattccgcagtgggagccttccaagggctggaacgattggcagcaagtgcccttctgctcacatcactttcaccagctaataatgaaggacgggagagagatcgtcgtgccatgtcggaatcaggatgaactggttggaagggcacgagtgagtcagggcgccggttggtctctccgtgagacagcgtgcttggggaaaagctacgctcaaatgtggcagctgatgtatttccatagacgcgaccttcggctggccgcaaacgccatttgttccgctgtccctgtggattgggtacccacttcaaggaccacatggagcatccacgcccatcaccagtggatgactaccgaagacatgctctctgtttggaatagagtgtggattgaggaaaacccatggatggaggataagacgcatatctccagttgggaggacgtcccctacttaggaaaacgcgaagaccaatggtgcggcagcctgataggcttgacagcacgggctacctgggccactaatatccaggtggcgattaaccaggttaggcgactgatcgggaatgagaactacctcgattatatgacatcgatgaagagatttaaaaatgaatccgaccctgagggagctctttggtga

SEQ ID NO: 13276 - RNA, 9882 nt, synthetic construct
  misc_feature 1..9882: note = derived and/or modified CDS sequence (opt3) from DENV-1__FJ639670__SS-prME
  source 1..9882: mol_type = other RNA
agcgtgaccatgctgctcatgcttatgcccacagcactggctttccacttgactacgagaggaggggagcctcatatgatcgtctccaagcaggaaaggggaaaatctttactgtttaagacctcagccggtgttaacatgtgcacactaattgccatggacctcggcgagctgtgtgaagatactatgacctacaaatgcccacggataacagaggcggaaccggacgatgtggactgttggtgcaatgctaccgatacttgggtaacatatgggacctgtagtcaaacgggagagcaccgccgagacaagcgtagcgtggcccttgcaccccatgtcggcctgggtttggagactagaaccgaaacatggatgtcctctgagggggcctggaaacagatccagagggtggaaacttgggctctccggcaccctggattcaccgttattgcactgtttctggcccatgctatcggcacatcgattacccagaagggcatcatattcatcctcttaatgctggtgacgccatcaatggccatgcgctgcgtcgggattggaagcagagattttgtggagggtcttagtggcgcgacttgggtagacgttgtgttggagcacgggtcctgtgtcacaaccatggcaaaggataaacccactctggacatcgaactactcaagacagaggtgaccaaccctgccgtgctgaggaaactttgcattgaagctaagatctctaatacgaccacagatagccggtgtccaactcaaggagaggccaccctggtcgaggaacaggacgcaaacttcgtttgccgccgaacatttgtggatagaggctggggtaatgggtgtggattgttcggcaaaggctccctcataacttgcgctaagtttaagtgcgtaaccaaactggaggggaagattgtgcagtacgaaaacttaaaatattcagtcatcgtgacagttcacaccggagaccagcatcaagtgggtaatgagagtactgaacacggcacgacagccaccattactccccaggcgcctaccacagagatccagctgaccgactacggggccctcactcttgattgtagcccaaggacaggactggacttcaacgaaatggtcttgctaacgatgaaggagaaatcttggctggtgcataagcagtggtttctcgatctgccgcttccctggacctccggcgcatcaactagccaagagacatggaatcggcaggacctgttggtaaccttcaaaacagctcacgccaagaagcaggaagttgtggtcctcggtagtcaagagggggctatgcacactgccctgaccggcgcaacggaaatccagacctctggaacaactaccatttttgccggccatttaaaatgccgtctgaagatggataaactaacactcaaggggatgtcctatgtgatgtgtactgggagcttcaaactggagaaggaagtcgctgagacccagcacggtacggtgcttgttcagataaagtacgagggcacagacgcgccttgcaaaatcccattctcgacccaagatgaaaagggggtgactcagaacggacgcttgattacagcaaatcccatcgtaaccgacaaagagaagcctgtcaacatagaagccgagccaccctttggcgagtcttatattgtgatcggtgctggggaaaaagccctgaagctctcctggttcaagaaaggctcaagtatcggaaagatgtttgaggcaactgccagaggcgctaggcggatggccattctgggggataccgcatgggacttcggaagcatcggtggcgtttttacatccgtggggaaacttgtccatcagattttcggaacggcgtacggcgtgctgttttctggtgtaagctggaccatgaagatagggatcggcgtgttgctcacttggctgggattaaattcacgaagtacatccctgagcatgacctgtattgctgttggcctagtcacactctacctgggggtgatggtgcaggccgattctggatgcgtcatcaactggaaaggccgcgaacttaagtgtggttcagggatcttcgttactaatgaggtgcacacctggacggaacaatataagtttcaggcagacagtccgaaaagattgagcgccgctattggaaaggcctgggaggagggcgtgtgcggtataaggtccgcaacacggctggaaaacatcatgtggaaacagatttctaacgagctcaatcatatcctgttagaaaacgacatgaagctgaccgtagtcgtgggcgatgttgctgggattcttgcccagggcaagaagatgatccgccctcaacccatggagtacaaatattcgtggaaaagctggggcaaggcgaagataatcggggccgacgctcagaatactaccttcattatcgatggaccaaacacacctgaatgtcccgacgatcagagagcatggaatatttgggaggtggaggactacggctttggtatcttcactaccaacatatggttgaagctcagggattcctatacacaggtctgcgaccaccgtctgatgtcagccgctattaaagatagtaaggccgtgcacgcagacatggggtactggatcgaatctgagaaaaatgaaacgtggaagctagcgcgggccagctttattgaggttaagacctgtatctggccaaaatcccatactctgtggtcaaacggagtgctcgaaagcgagatgataatccccaagatttatggcggtcctatctctcaacacaattaccgaccaggctacttcacacagaccgctgggccgtggcatctgggaaaacttgagttggatttcgacctgtgcgaaggcactacagtagtcgtggatgagcactgcgggaacagaggaccctccttaaggaccacgactgtgaccggcaagattatccacgaatggtgttgccgcagttgtacactccctccactgcggtttagaggtgaggacgggtgctggtatggaatggagataaggcccgtcaaagaaaaggaggaaaatcttgttaagagcatggtgtctgccggctccggtgaggtagactcattcagtctgggcttgctctgtattagcatcatgatcgaagaggtgatgcgctcgcgatggtcccggaaaatgctgatgaccgggactctagcagtctttttcctgctcattatgggacagctgacatggaacgatcttatccgtttgtgcattatggtgggcgctaatgcctctgacagaatggggatgggaaccacatacctggcattaatggccacttttaagatgaggcctatgttcgctgttggcctcctgtttcgccggcttaccagcagagaggtgctgctactcacgataggtctgtcattggtcgcgagtgtggaactgccaaactccttagaggaactcggggatggactggccatgggcatcatgattcttaaactgttgacagacttccaatctcatcagctctgggcaaccctgctaagcctgacttttatcaagaccacattctcccttcactatgcttggaaaactatggccatggttctctcaattgtgagcctgtttcccttgtgtctgagtaccacgtctcagaagacaacctggttaccggtcctcctgggctcccttgggtgcaagcctctgactatgttcttgatcgccgagaataaaatatggggaagaaagtcctggccactcaacgaaggtatcatggctgtaggcattgtgtcgatcctgctatcatctctgcttaaaaacgatgttcccctcgcagggcctctgattgccggaggcatgttgatcgcgtgttacgtgataagtggttccagcgctgacttatctctggagaaggccgcagaggtcagctgggaagaggaagccgagcattccggggcttcacacaatattctcgtggaagtacaggatgacggaacaatgaaaatcaaggatgaggagcgagacgataccctgactatccttctgaaagcaacattgctagccgtgagtggcgtctatcccctgagcattccagcgaccctctttgtttggtacttctggcaaaagaagaaacagcgctctggcgtgctgtgggacacgccttcacccccagaagtggagcgggctgtccttgatgacgggatatatagaatcatgcagaggggattactgggtcgtagccaggtgggcgttggggtattccaagaaaacgtgtttcatactatgtggcacgtcacccgcggagccgtgctcatgtaccagggcaagcggttggagccgagttgggcaagcgttaaaaaggacctgatttcctacggtgggggatggagactccagggctcttggaatacaggcgaggaagtgcaggtcatcgccgtggagcctgggaaaaaccccaagaatgtacaaaccgctccaggaacattcaagactcccgaaggtgaggtcggcgccattgcactggattttaaacctgggacctcgggaagcccaatcgtgaacagggaaggcaagatagttggtctttatgggaatggagtggtcacgacatcaggcacttacgtgtccgctatcgcccaggcgaaagccagtcaggagggccccctgcctgagattgaagacgaggttttccgaaagcggaacttgaccatcatggatctacacccggggtctggaaaaacacgcagatatctgccagcaattgtgagggaagctatcaagcggaagctccgaaccttaatactggcccccactagagtcgtggctagcgagatggcagaagcccttaaaggtatgcctattcgctaccaaaccacagccgtaaagtccgagcatacgggcaaagagatcgtggacctgatgtgccacgctacttttaccatgaggctcttgtcaccagttcgtgtccccaattataacatgatcattatggatgaagcgcatttcacagacccttctagcatcgcagcccgggggtacataagtaccagagtgggaatgggcgaggctgccgcaatttttatgactgccacaccgcccggttccgtggaggctttcccacagagcaatgcggtcatccaggatgaggaaagggacattcctgagcgctcttggaactcagggtatgagtggatcaccgattttcccggaaagacggtatggttcgtgccatccataaaaagtggcaatgacattgccaactgtctgcgaaagaatggcaagagagttatccagctcagccggaaaacttttgatacagaataccaaaagaccaaaaacaacgactgggactacgtggtcaccactgatatctcggagatgggggcaaatttcagggctgaccgcgtgattgatcctcgtagatgcctgaagcccgttatccttaaagacggaccagaacgggtgattctagccggtccgatgcctgtcacagtggcatctgccgctcagaggcgcggccgaatagggagaaaccacaataaggagggagatcagtatatctacatgggccagcccctgaacaatgacgaggatcatgcccactggaccgaagcgaagatgttgttagacaacattaatacaccagagggtatcatccccgcactgttcgaacctgagcgggaaaaatccgccgctattgatggggagtataggctccgcggcgaggccagaaagacttttgtagaactgatgaggcggggagaccttccagtgtggctgagctacaaagttgcttcagagggcttccaatatagtgatcgtcgctggtgctttgacggggaacgaaacaatcaggtcctcgaggaaaacatggatgtggagatatggacgaaggagggagtgtctaggaagaatttgaggccccggtggctggacgcacgcacctactccgaccctctagccctgagagagttcaaggagtttgctgccggtaggcggagcgtctcaggcgatctcatccttgaaattgggaaactgccgcagcacttaacacagcgagcacaaaacgcgttggacaatctggttatgctccataacagtgagcagggaggcagagcctatcgccacgctatggaagaactgccagatactatcgagacccttatgctgctcgccttgattgcagtgctgacaggtggggtaaccttattctttctaagcggcaggggactgggcaagacttccatcgggctcctttgtgtgatggcttctagcgtcctgttgtggatagcctccgtggaaccccattggatcgcagcctcaattatcctggagttctttctcatggttctgcttattcctgaacccgaccggcagcgtacgccacaggataatcaactcgcttacgtggtcatcggactgttgttcatgatactgaccgtagcggccaacgagatgggtttactagagacaactaagaaagacctgggcattgggcacgtggcagttgaaaaccaccatcacgctgccatgctcgatgtggaccttcatcctgcctctgcatggaccctgtacgctgtcgccacaaccatcattactcccatgatgagacacacaatcgagaatacgaccgcgaacataagtttgactgctatcgccaatcaggcagccattctgatgggactcgataagggctggccaatctcgaaaatggacattggtgtgcctctgcttgctttagggtgctatagccaggtcaacccgctgacactcaccgcagccgtgttgatgctggttgcgcattacgctatcataggccccggactacaagccaaggcaaccagggaagcccagaaacgcacagctgccggcattatgaagaatccaactgtggatgggatcgtagcaatcgacctggatcctgtggtctatgacgctaagtttgagaaacagctcggacagattatgcttctgatcttgtgtacgtcccaaatactgctcatgcggaccacatgggccctgtgcgaatctattactttagcgaccggcccccttacaaccctgtgggagggttcaccagggaagttctggaacactacgatcgccgttagcatggcaaatatttttcgaggatcctacctcgctggcgccggtctagcattcagtctgatgaaatctttgggcgggggaagaaggggcacaggggctcagggagagaccctgggcgaaaagtggaaacgccagctcaaccagcttagcaagtcagagttcaatacttataagcggtccggtatcatggaagtggacagaagtgaggccaaagaagggctgaagcgtggagagaccacaaaacacgccgtcagcaggggcactgcgaagttgcggtggtttgtggagcgcaacctggtaaaacctgaaggtaaggtgatagatctcggctgtgggcgaggaggctggtcttactattgcgctgggttaaagaaagttaccgaggtgaagggatacacaaaaggcggtcccgggcacgaagaaccgatcccaatggcaacgtacggatggaatctggtcaaacttcattccggcaaagacgtgttctttattcctcccgaaaagtgtgataccctgctatgcgacatcggcgagtcaagctcgaacccaactattgaggaagggagaacactcagggtcctgaaaatggtggagccctggttgcggggaaatcaattctgtatcaagattctgaacccttatatgccgtctgttgtagaaaccctcgagcagatgcagcgcaagcacggtggcatgcttgtgagaaatcccctgagtaggaactccactcatgagatgtactgggtcagctgcgggacaggaaatatcgtgtcagccgttaacatgacctcccgaatgttactgaaccggtttacgatggctcaccgtaaaccaacctatgaaagagatgtggacttgggcacaggtactcgccacgtcgccgtggagcctgaagtagcaaatctcgatataattgggcagaggatcgagaacatcaagcatgaacacaaatctacctggcattacgacgaggataatccctataagacatgggcctaccacggaagctatgaggtgaaacctagtggctccgctagctctatggttaacggcgtcgtgaagctgctaactaagccatgggacgtgattcccatggtcacccaaatagcgatgacagataccactcctttcgggcagcagcgggtttttaaagaaaaggtggacacgagaacaccaaaagccaagcgcggaaccgcacaaatcatggaggtaactgctaggtggctttggggtttcctgtcacgaaataaaaagccccggatttgtaccagagaagagtttacaaggaaggtgcgcagtaacgccgcaatcggcgccgtcttcgtggacgaaaatcagtggaactccgctaaagaggccgttgaggatgaacgtttttgggacctcgtgcatcgggagagagaactgcacaagcaggggaaatgcgcgacgtgcgtctacaatatgatgggaaagagggagaaaaagttgggcgagttcggtaaggcaaaagggagccgcgccatttggtacatgtggctgggagctcgatttctcgagttcgaggcccttggcttcatgaacgaagatcactggttttctcgggaaaattcgctgtcaggcgtggaaggggagggattacataagctgggttatatcttgagagacataagcaaaatcccgggcgggaacatgtacgcagatgacaccgctggatgggatactaggattacagaggacgatctccagaatgaagccaagatcaccgacattatggagcctgaacacgctctgctagccaaagcaatcttcaaacttacttatcaaaacaaagtagttcgcgtgcagagaccagcgaagaatggcacagtcatggatgtgatatcccggagggaccagcgtggtagtggacaggtgggaacctacggcctgaacacatttactaacatggaggcccaactcattcgacagatggaatctgagggcatcttcagcccctccgagctggaaacccctaatttggctgagcgcgccttagattggctggaaaagtatggggtcgagagactcaaacggatggcaatctcaggagacgactgtgttgtgaagccaattgatgacaggtttgctacggcccttaccgcactgaacgatatgggtaaagtacgcaaggacataccccagtgggaaccgagtaaaggctggaatgattggcagcaagtgcctttctgctctcatcactttcaccagctaatcatgaaggacgggagagagattgtcgtgccctgtcggaaccaggatgagctggttggaagggcccgagtgagccagggcgcgggttggtccctccgtgaaacagcttgcttggggaagtcatacgcccaaatgtggcagctgatgtatttccatagacgcgaccttcggctggcagccaatgctatctgtagcgccgtcccagtggattgggtacctacttctaggaccacatggtccattcacgcacatcaccagtggatgactaccgaggacatgctcagtgtttggaacagagtgtggatcgaagagaatccctggatggaagataaaacgcatataagctcgtgggaggacgtcccatacttaggaaagcgcgaggaccaatggtgcggctccctgatcggcttgacagctcgggccacctgggcgactaacattcaggtggctatcaatcaggttaggcgactgattgggaacgaaaattacctcgattatatgacatctatgaaaagatttaagaacgagtcagaccccgaaggagccctttggtga

SEQ ID NO: 13277 - RNA, 9879 nt, synthetic construct
  misc_feature 1..9879: note = derived and/or modified CDS sequence (opt3) from DENV-1__FJ639671__SS-prME
  source 1..9879: mol_type = other RNA
agcgtgaccatgctgctcatgcttatgcccacagccctggctttccacttgactacgagaggcggggagcctcatatgatcgtctccaagcaggaaaggggaaaatctttactgtttaagacctcagcaggtgttaacatgtgcacactaattgccatggacctcggcgagctgtgtgaagatactcttacctacaaatgcccacggataacagaggtggaaccggacgatgtagactgttggtgcaataccactgatacatgggtgacctatgggacgtgtagtcaaactggagagcaccgccgagacaagcgtagcgtcgcgctggctccccatgtgggcttgggtctcgagaccagagccgaaacatggatgtcctctgagggggcatggaaacagatccagagggttgaaacttgggccctgcggcaccctggattcaccgtgattgctctgtttctcgcacatgccatcggcacatcgattacccagaagggcatcatattcatcttactgatgcttgtcacgccatcaatggctatgcgctgcgtggggattggaagcagagattttgtagagggtttgagtggcgccacttgggttgacgtggtcctggagcacgggtcctgtgtgacaaccatggcgaaggataaacccactctagacatcgaactcctgaagacagaggtgaccaaccctgcagtccttaggaaactgtgcattgaagccaagatctctaatacgaccacagatagccggtgtccaactcaaggagaggctaccttggttgaagagcaggacgccaacttcgtgtgccgccgaacatttgtagatagaggctggggtaatgggtgtggactcttcggcaaaggctccctgataacttgcgcaaagtttaagtgcgtgaccaaattagaggggaagattgtccagtacgaaaacctgaaatattcagtgatcgttacagtgcacaccggagaccagcatcaagtcggtaatgagagtactgaacacggcacgacagctaccattactccccaggcccctaccagcgagatccagctcacagactacggggcgcttaccctggattgttctccaaggactggattggacttcaacgaaatggtgctactgacaatgaaggagaaatcctggctcgtacataagcagtggtttctggatcttccgctgccctggacgtcaggcgccagcaccagtcaagagacttggaatcggcaggacttgctcgttacattcaaaaccgcacacgctaagaagcaggaagtggtcgtgctgggttctcaagagggggccatgcacacagctttaactggcgccaccgaaatccagacgtccggaaccacaactatttttgcaggccatctgaaatgccgtctaaagatggataaactcaccctgaaggggatgagctatgtcatgtgtacaggatcgttcaaacttgagaaggaagtggccgagactcagcacggtaccgttttggtgcagataaagtacgagggcacggacgctccttgcaaaatcccattctctacacaagatgggaagggagtaacccagaacggccgcctgattactgcgaatcccatcgtcacagacaaagaaaagcctgtgaacatagaggcagaaccaccctttggtgagtcctatattgttatcggggccggcgagaaagctctcaagctgtcatggttcaagaaaggaagtagcatcggcaagatgtttgaagccaccgcaagaggggccaggcggatggctattcttggagatactgcctgggacttcggttccgtgggcggggtctttacctctgtgggaaaactggtacatcagatcttcggcacagcatacggtgtgttgtttagcggggtttcatggacgatgaagattggcataggagtcctcctgacctggttaggcctgaatagtcgatccactagcctatctatgacatgtatcgcggtggggctcgtgaccctgtaccttggagtcatggttcaggctgattcaggctgcgtgattaactggaaaggtcgcgagttgaagtgtgggagtggaatcttcgtgacaaatgaagtacacacttggaccgagcaatataagtttcaggccgacagcccgaaaagactgtccgcagccatcggcaaggcttgggaagagggtgtctgcggcattaggtctgccacgcggctcgagaacgtgatgtggcgccagatatcgaacgaactgaatcatatcttactggagaacgacatgaaattcacagttgtggtcggggatgtggttggaattcttgcacagggcaagaaaatgatcagacctcaacccatggaacacaagtacagctggaaatcctgggggaaggctaagattatcggagccgacgtgcagaataccacttttataatcgatggcccaaacacctcagagtgtcctgacgatcagagggcgtggaatatttgggaagtagaggactatggtttcgggatctttacaactaacatttggttgaaactccgtgatagttacacccaggtctgcgaccaccggctgatgtctgccgctatcaaggatagccgagcagtgcatgccgacatgggatattggatagagtccgaaaaaaatgagacatggaagctagctagagcctcattcattgaagtgaaaacgtgtatctggcccaagagccacaccctgtggtctaacggcgtcctcgagtccgaaatgattatcccaaagatatacggtggccccatcagtcaacataattataggcctgggtacttcactcagacagcaggaccatggcacctgggcaaacttgagttggattttgacctgtgcgaggggaccactgttgtggtagatgaacactgcggaaaccgcggcccgagcttacggacaaccacggtgactggtaagattatccatgagtggtgttgcagatcttgtaccctcccccctctgaggttcaaaggggaagacggatgctggtacggcatggagattcgcccagtcaaggagaaagaagagaatcttgtgaagtccatggtttcagcgggtagtggcgaagtggacagcttttcgctggggttgctctgtatctccataatgattgaggaagtcatgcgatctcggtggagccgtaagatgctgatgacaggaaccctagccgtgttctttctgctcatcatgggccagctgacttggaacgatcttatcagattgtgcattatggttggggctaatgcctcagacaggatgggaatgggcacaacctatctggcattaatggctacattcaaaatgcgccccatgtttgccgtgggtctcctgttccggagacttactagtagggaggtcctgctactcaccatcgggctgtccttggtagcatctgtggagctgcctaacagcttagaagagctcggagatggcctggccatgggcattatgatacttaagctgttgacggactttcaatcctaccagctctgggctacactgctatcactgaccttcatcaaaactacctttagccttcactatgcgtggaagacaatggccatggttctcagtattgtgtctctgttgccactgtgtttatccactaccagccagaaaacgacatggctccccgtcctgcttgggtcgctgggatgcaagccgttgaccatgttcctcatcgcagaaaataagatttggggtcgaaaatcatggcctctgaacgagggcatcatggctgtggggatagtatctatcctactgagttcccttctcaagaacgatgtgccactggccggacccttgattgccggcggtatgttaatcgcttgttacgtcattagcgggtctagcgcagacctgtccctcgaaaaagccgcggaggtttcatgggaggaagaggctgaacatagtggagccagccacaatatcctggtggaggtgcaggatgacggcactatgaagataaaagatgaagagcgcgacgatacacttaccattctgttgaaggcaactctactggccgtctctggcgtgtatcctctctccatccccgctacactgtttgtttggtacttctggcaaaaaaagaagcagcggtcaggggtactttgggacaccccaagtcctcccgaggtggaaagagcagtcttagatgacggaatctataggattatgcagcgtggtctgctcggccgcagccaggtgggggttggagtgttccaagagaacgtctttcatacgatgtggcacgtgactcggggcgccgtattgatgtaccagggtaaaagactggaaccatcctgggcgtctgtcaagaaagacctcatatcgtacgggggaggctggaggctgcagggcagctggaataccggggaggaggtgcaggttatcgctgtggaaccgggaaagaaccctaaaaatgtccaaacagcccccggtaccttcaagacaccagagggcgaagtgggggcaattgcccttgattttaagcccggaacttcaggctcccctatcgttaaccgagagggtaaaattgtggggctgtatggaaatggcgtcgtgaccacgagtggcacatacgtatctgctatcgcccaggcaaaggctagccaggaagggccattgcccgagatagaggacgaagtgttccggaaacgcaacctaactatcatggatctgcaccctggatccggtaagaccagaaggtatctcccggccattgttcgggaggcgatcaaacgaaagttaagaacactgattcttgccccaacccgcgtcgtggcatcagaaatggctgaggccctgaagggcatgcccatcaggtaccaaactaccgctgtgaaatctgaacatacagggcgtgagatagtcgacctcatgtgccacgcaacgtttactatgcggttgctgagccctgtaagagtgccaaattataacatgattatcatggatgaggcccatttcaccgaccccagttccatcgccgctaggggatacattagcacacgcgttggcatgggtgaagcggcagccatctttatgaccgctactcctccggggtctgtggaggccttcccccagtcaaatgcagtcatacaggatgaagagcgagacattccagaaagatcctggaacagtggatatgagtggatcacagattttcctggcaagaccgtgtggttcgttcccagcattaaatcgggcaatgacatcgccaactgtctccggaagaatgggaaaagggtgatacagctgtctcgcaagacgtttgatactgagtaccaaaagacaaaaaacaacgactgggactacgtcgtgaccaccgatatttccgaaatgggagctaatttccgtgcggacagagtaatcgatccacggaggtgccttaagcctgtgatcctaaaagacggtcccgagcgcgttattctggccggcccaatgccggtcactgtggcaagcgctgcccagcgaagagggcggatcggaaggaaccacaataaggaaggcgatcagtatatttacatgggtcagcctttgaacaatgacgaggatcatgcacactggacagaggccaaaatgttactggacaacataaatacccccgaagggatcattccagctctcttcgagcccgaacgcgagaagtcagccgcgatcgatggcgaatatagactgaggggagaggcacggaagacatttgtggagcttatgcgtcgcggcgacctgcctgtctggctcagttacaaagttgcctctgaagggttccaatattccgatcgaagatggtgctttgacggagagaggaacaatcaggtgttggaagagaacatggatgtagaaatctggactaaggagggtgagcggaaaaagctgcgcccaagatggctagacgctaggacgtacagcgaccccctggccctccgggaattcaaagagtttgctgcaggccgaagatcagtgagtggggatcttattctggaaataggaaagttacctcagcacttgacccagcgcgcccaaaatgctctggacaacctcgtcatgctgcataatagcgagcagggcggtagggcctatcggcacgcaatggaagagcttccggagacaatcgaaactctgatgctcttggcgctgattgccgtgttaaccgggggcgttacactattctttctgtccggacgtggcctcgggaaaacctctatcggacttctgtgtgtgatggctagctccgccttgctgtggatggcatcagtcgagccacattggattgctgcctctatcatactcgaattctttctgatggtacttctcatccccgagcctgatagacagaggactccccaggacaaccaactggcatacgtggttattggtttgctgttcatgatcttaacggtggccgctaatgagatgggcctactggaaaccacaaagaaggatctcgggattggacacgtcgcggtggagaaccaccatcacgccactatgcttgacgtcgatctgcatccagcaagtgcttggaccttgtacgccgtggccacaaccatcataactcctatgatgcgccacacaattgaaaacacgaccgcaaatatctcgctgactgctattgccaaccaggcggctatcctcatgggcctggacaaaggttggcccataagcaagatggatatcggggttccacttttagccctgggctgctattcccaggtgaatcctctcacattgaccgcagccgtactgatgctagtggctcattacgcaattatcggaccgggcctgcaagccaaagcgacccgggaggctcagaagcgaacagccgcagggattatgaaaaaccccactgtcgacggaatcgttgccatagatctcgacccagtggtctatgatgctaagtttgaaaagcagcttggccagattatgctgttgatcctgtgtacgtctcaaatcctcctgatgagaaccacatgggccttatgcgagtcaattactcttgcaaccggtcctctgacaaccctctgggaggggagccccggaaaattctggaatactacgatcgctgtgtccatggccaacatatttaggggcagttacctagcgggtgccggcctggcattctctttgatgaagagcctggggggaggccgccgggggacaggagctcagggcgaaaccctcggtgagaaatggaagagacagcttaatcagctgtcaaaatccgaattcaacacttataagcgtagtgggattatggaggtagacaggagcgaagccaaggagggattgcggcgcggcgagaccacaaaacacgcagtgtctcgaggtactgctaagctgagatggtttgttgaaaggaatctcgtgaaaccagagggcaaggtcatcgacttagggtgtggacggggcgggtggtcctactattgcgccggactgaaaaaggtgaccgaagtcaagggctacacaaaaggtgggcctggacacgaggaacccattccgatggccacgtacggctggaaccttgtgaagctgcattcaggcaaagatgttttctttatcccacctgagaagtgtgacaccctactctgcgatataggggagagctcgcccaatccaactatcgaagagggacgcacactgagagtattgaaaatggtggaaccctggctgaggggtaaccaattctgtattaagatcctcaatccttatatgccgtctgtcgtggagacccttgagcagatgcagcgaaaacacggcgggatgctggttcggaaccccttaagtcgtaattccactcatgaaatgtactgggtgagctgcggaacaggcaacattgtctcagcggtgaatatgacctccagaatgctgttgaaccgctttacgatggctcacaggaagccaacctatgagcgggacgtagatctcggtgcagggacaagacacgtggccgttgaacctgaggtcgctaacctggacatcattggacagcgcatcgaaaatataaagcatgagcacaaatctacttggcattacgatgaggacaacccctataagacctgggcctaccacggcagctatgaagtgaaacctagtggctccgcaagctctatggtgaatggggtcgttaagctacttacaaaaccatgggatgtgattcccatggtaactcaaatcgccatgaccgacacaacccctttcggacagcagagggtgtttaaggagaaggtcgatactcgaacgccaaaagctaagcggggtacagcgcaaatcatggaagtgaccgccagatggctgtggggcttcctctcaaggaacaaaaagccccgcatttgtactcgtgaggaatttacccggaaagttagaagtaatgcagctataggggccgtgttcgtcgacgagaaccagtggaattccgcaaaggaggccgtggaagacgagaggttttgggatctggtacatcgcgaacgagagttgcacaagcagggaaaatgcgctacatgcgtttacaacatgatgggcaagcgggaaaaaaagctgggtgagttcgggaaagccaagggaagcagagcgatctggtacatgtggctcggcgcaaggtttcttgagttcgaagccctgggcttcatgaatgaggaccactggttttctcgcgaaaactcgttatcaggggtggagggagagggtctgcataagttgggctatattctcagagatatcagcaaaattccggggggaaatatgtacgctgacgatacggccggctgggacacccggatcactgaagatgacctgcagaacgaggcaaagataacagatatcatggaacctgagcacgctctacttgccacctccattttcaaactgacttatcaaaataaggtcgtgagggtgcagcgtccagctaaaaacggtacagtcatggacgttatcagtcgacgcgatcagagagggtctggacaggtgggcacctacggcctcaatacatttactaacatggaagcccaactgattcggcagatggagagcgaggggatcttctccccctcagaattggagacccctaacttagcagaaagggtactggactggctcgagaagtatggagtggaacgccttaaaagaatggcgataagtggtgatgactgtgtcgtgaagccaattgacgatcggtttgccacggctctgaccgccctaaatgacatgggcaaggttaggaaagatatcccccagtgggagccgtctaaggggtggaacgactggcagcaagtgcctttctgcagccatcactttcaccagctgatcatgaaagatggacgagagattgtcgtgccctgtcgtaatcaggacgaactcgtaggcagagcacgcgtttcccagggtgctgggtggtcattgcgggagacagcctgcctgggaaagagctacgcacaaatgtggcagcttatgtatttccataggagagatctgcgcctcgccgcgaacgctatatgttctgccgtgccagtcgactgggtgcctacttcccggaccacatggagtatccacgcacatcaccagtggatgactaccgaagatatgttaagcgtttggaatagggtgtggattgaggaaaacccctggatggaggacaaaacgcatatctcgtcctggggcgatgtcccatacctgggcaagcgagaggaccaatggtgcgggtctttgattggactgacagccagagctacctgggccactaatatccaggtggcaataaaccaggtacggaggctcatcggtaatgaaaactaccttgactatatgacatcaatgaagcgctttaaaaatgagagcgatcccgaaggcgctctgtggtga

SEQ ID NO: 13278 - RNA, 9879 nt, synthetic construct
  misc_feature 1..9879: note = derived and/or modified CDS sequence (opt3) from DENV-1__JN819423__SS-prME
  source 1..9879: mol_type = other RNA
agcgtgaccatgctgctcatgcttatgcccacagccctggctttccacttgactacgagaggcggggagcctcatatgatcgtctccaagcaggaaaggggaaaatctttactgtttaagacctcagcaggtgttaacatgtgcacactaattgccatggacctcggcgagctgtgtgaagatactcttacctacaaatgcccacggataacagaggtggaaccggacgatgtagactgttggtgcaataccactgatacatgggtgacctatgggacgtgtagtcaaactggagagcaccgccgagacaagcgtagcgtcgcgctggctccccatgtgggcttgggtctcgagaccagagccgaaacatggatgtcctctgagggggcatggaaacagatccagagggttgaaacttgggccctgcggcaccctggattcaccgtgattgctctgtttctcgcacatgccatcggcacatcgattacccagaagggcatcatattcatcttactgatgcttgtcacgccatcaatggctatgcgctgcgtggggattggaagcagagattttgtagagggtttgagtggcgccacttgggttgacgtggtcctggagcacgggtcctgtgtgacaaccatggcgaaggataaacccactctagacatcgaactcctgaagacagaggtgaccaaccctgcagtccttaggaaactgtgcattgaagccaagatctctaatacgaccacagatagccggtgtccaactcaaggagaggctaccttggttgaagagcaggacgccaacttcgtgtgccgccgaacatttgtagatagaggctggggtaatgggtgtggactcttcggcaaaggctccctgataacttgcgcaaagtttaagtgcgtgaccaaattagaggggaagattgtccagtacgaaaacctgaaatattcagtgatcgttacagtgcacaccggagaccagcatcaagtcggtaatgagagtactgaacacggcacgacagctaccattactccccaggcccctaccagcgagatccagctcacagactacggggcgcttaccctggattgttctccaaggactggattggacttcaacgaaatggtgctactgacaatgaaggagaaatcctggctcgtacataagcagtggtttctggatcttccgctgccctggacgtcaggcgccagcaccagtcaagagacttggaatcggcaggacttgctcgttacattcaaaaccgcacacgctaagaagcaggaagtggtcgtgctgggttctcaagagggggccatgcacacagctttaactggcgccaccgaaatccagacgtccggaaccacaactatttttgcaggccatctgaaatgccgtctaaagatggataaactcaccctgaaggggatgagctatgtcatgtgtacaggatcgttcaaacttgagaaggaagtggccgagactcagcacggtaccgttttggtgcagataaagtacgagggcacggacgctccttgcaaaatcccattctctacacaagatgggaagggagtaacccagaacggccgcctgattactgcgaatcccatcgtcacagacaaagaaaagcctgtgaacatagaggcagaaccaccctttggtgagtcctatattgttatcggggccggcgagaaagctctcaagctgtcatggttcaagaaaggaagtagcatcggcaagatgtttgaagccaccgcaagaggggccaggcggatggctattcttggagatactgcctgggacttcggttccgtgggcggggtctttacctctgtgggaaaactggtacatcagatcttcggcacagcatacggtgtgttgtttagcggggtttcatggacgatgaagattggcataggagtcctcctgacctggttaggcctgaatagtcgatccactagcctatctatgacatgtatcgcggtggggctcgtgaccctgtaccttggagtcatggttcaggctgattcaggctgcgtgattaactggaaaggtcgcgagttgaagtgtgggagtggaatcttcgtgacaaatgaagtacacacttggaccgagcaatataagtttcaggccgacagcccgaaaagactgtccgcagccatcggcaaggcttgggaagagggtgtctgcggcattaggtctgccacgcggctcgagaacgtgatgtggcgccagatatcgaacgaactgaatcatatcttactggagaacgacatgaaattcacagttgtggtcggggatgtggttggaattcttgcacagggcaagaaaatgatcagacctcaacccatggaacacaagtacagctggaaatcctgggggaaggctaagattatcggagccgacgtgcagaataccacttttataatcgatggcccaaacacctcagagtgtcctgacgatcagagggcgtggaatatttgggaagtagaggactatggtttcgggatctttacaactaacatttggttgaaactccgtgatagttacacccaggtctgcgaccaccggctgatgtctgccgctatcaaggatagccgagcagtgcatgccgacatgggatattggatagagtccgaaaaaaatgagacatggaagctagctagagcctcattcattgaagtgaaaacgtgtatctggcccaagagccacaccctgtggtctaacggcgtcctcgagtccgaaatgattatcccaaagatatacggtggccccatcagtcaacataattataggcctgggtacttcactcagacagcaggaccatggcacctgggcaaacttgagttggattttgacctgtgcgaggggaccactgttgtggtagatgaacactgcggaaaccgcggcccgagcttacggacaaccacggtgactggtaagattatccatgagtggtgttgcagatcttgtaccctcccccctctgaggttcaaaggggaagacggatgctggtacggcatggagattcgcccagtcaaggagaaagaagagaatcttgtgaagtccatggtttcagcgggtagtggcgaagtggacagcttttcgctggggttgctctgtatctccataatgattgaggaagtcatgcgatctcggtggagccgtaagatgctgatgacaggaaccctagccgtgttctttctgctcatcatgggccagctgacttggaacgatcttatcagattgtgcattatggttggggctaatgcctcagacaggatgggaatgggcacaacctatctggcattaatggctacattcaaaatgcgccccatgtttgccgtgggtctcctgttccggagacttactagtagggaggtcctgctactcaccatcgggctgtccttggtagcatctgtggagctgcctaacagcttagaagagctcggagatggcctggccatgggcattatgatacttaagctgttgacggactttcaatcctaccagctctgggctacactgctatcactgaccttcatcaaaactacctttagccttcactatgcgtggaagacaatggccatggttctcagtattgtgtctctgttgccactgtgtttatccactaccagccagaaaacgacatggctccccgtcctgcttgggtcgctgggatgcaagccgttgaccatgttcctcatcgcagaaaataagatttggggtcgaaaatcatggcctctgaacgagggcatcatggctgtggggatagtatctatcctactgagttcccttctcaagaacgatgtgccactggccggacccttgattgccggcggtatgttaatcgcttgttacgtcattagcgggtctagcgcagacctgtccctcgaaaaagccgcggaggtttcatgggaggaagaggctgaacatagtggagccagccacaatatcctggtggaggtgcaggatgacggcactatgaagataaaagatgaagagcgcgacgatacacttaccattctgttgaaggcaactctactggccgtctctggcgtgtatcctctctccatccccgctacactgtttgtttggtacttctggcaaaaaaagaagcagcggtcaggggtactttgggacaccccaagtcctcccgaggtggaaagagcagtcttagatgacggaatctataggattatgcagcgtggtctgctcggccgcagccaggtgggggttggagtgttccaagagaacgtctttcatacgatgtggcacgtgactcggggcgccgtattgatgtaccagggtaaaagactggaaccatcctgggcgtctgtcaagaaagacctcatatcgtacgggggaggctggaggctgcagggcagctggaataccggggaggaggtgcaggttatcgctgtggaaccgggaaagaaccctaaaaatgtccaaacagcccccggtaccttcaagacaccagagggcgaagtgggggcaattgcccttgattttaagcccggaacttcaggctcccctatcgttaaccgagagggtaaaattgtggggctgtatggaaatggcgtcgtgaccacgagtggcacatacgtatctgctatcgcccaggcaaaggctagccaggaagggccattgcccgagatagaggacgaagtgttccggaaacgcaacctaactatcatggatctgcaccctggatccggtaagaccagaaggtatctcccggccattgttcgggaggcgatcaaacgaaagttaagaacactgattcttgccccaacccgcgtcgtggcatcagaaatggctgaggccctgaagggcatgcccatcaggtaccaaactaccgctgtgaaatctgaacatacagggcgtgagatagtcgacctcatgtgccacgcaacgtttactatgcggttgctgagccctgtaagagtgccaaattataacatgattatcatggatgaggcccatttcaccgaccccagttccatcgccgctaggggatacattagcacacgcgttggcatgggtgaagcggcagccatctttatgaccgctactcctccggggtctgtggaggccttcccccagtcaaatgcagtcatacaggatgaagagcgagacattccagaaagatcctggaacagtggatatgagtggatcacagattttcctggcaagaccgtgtggttcgttcccagcattaaatcgggcaatgacatcgccaactgtctccggaagaatgggaaaagggtgatacagctgtctcgcaagacgtttgatactgagtaccaaaagacaaaaaacaacgactgggactacgtcgtgaccaccgatatttccgaaatgggagctaatttccgtgcggacagagtaatcgatccacggaggtgccttaagcctgtgatcctaaaagacggtcccgagcgcgttattctggccggcccaatgccggtcactgtggcaagcgctgcccagcgaagagggcggatcggaaggaaccacaataaggaaggcgatcagtatatttacatgggtcagcctttgaacaatgacgaggatcatgcacactggacagaggccaaaatgttactggacaacataaatacccccgaagggatcattccagctctcttcgagcccgaacgcgagaagtcagccgcgatcgatggcgaatatagactgaggggagaggcacggaagacatttgtggagcttatgcgtcgcggcgacctgcctgtctggctcagttacaaagttgcctctgaagggttccaatattccgatcgaagatggtgctttgacggagagaggaacaatcaggtgttggaagagaacatggatgtagaaatctggactaaggagggtgagcggaaaaagctgcgcccaagatggctagacgctaggacgtacagcgaccccctggccctccgggaattcaaagagtttgctgcaggccgaagatcagtgagtggggatcttattctggaaataggaaagttacctcagcacttgacccagcgcgcccaaaatgctctggacaacctcgtcatgctgcataatagcgagcagggcggtagggcctatcggcacgcaatggaagagcttccggagacaatcgaaactctgatgctcttggcgctgattgccgtgttaaccgggggcgttacactattctttctgtccggacgtggcctcgggaaaacctctatcggacttctgtgtgtgatggctagctccgccttgctgtggatggcatcagtcgagccacattggattgctgcctctatcatactcgaattctttctgatggtacttctcatccccgagcctgatagacagaggactccccaggacaaccaactggcatacgtggttattggtttgctgttcatgatcttaacggtggccgctaatgagatgggcctactggaaaccacaaagaaggatctcgggattggacacgtcgcggtggagaaccaccatcacgccactatgcttgacgtcgatctgcatccagcaagtgcttggaccttgtacgccgtggccacaaccatcataactcctatgatgcgccacacaattgaaaacacgaccgcaaatatctcgctgactgctattgccaaccaggcggctatcctcatgggcctggacaaaggttggcccataagcaagatggatatcggggttccacttttagccctgggctgctattcccaggtgaatcctctcacattgaccgcagccgtactgatgctagtggctcattacgcaattatcggaccgggcctgcaagccaaagcgacccgggaggctcagaagcgaacagccgcagggattatgaaaaaccccactgtcgacggaatcgttgccatagatctcgacccagtggtctatgatgctaagtttgaaaagcagcttggccagattatgctgttgatcctgtgtacgtctcaaatcctcctgatgagaaccacatgggccttatgcgagtcaattactcttgcaaccggtcctctgacaaccctctgggaggggagccccggaaaattctggaatactacgatcgctgtgtccatggccaacatatttaggggcagttacctagcgggtgccggcctggcattctctttgatgaagagcctggggggaggccgccgggggacaggagctcagggcgaaaccctcggtgagaaatggaagagacagcttaatcagctgtcaaaatccgaattcaacacttataagcgtagtgggattatggaggtagacaggagcgaagccaaggagggattgcggcgcggcgagaccacaaaacacgcagtgtctcgaggtactgctaagctgagatggtttgttgaaaggaatctcgtgaaaccagagggcaaggtcatcgacttagggtgtggacggggcgggtggtcctactattgcgccggactgaaaaaggtgaccgaagtcaagggctacacaaaaggtgggcctggacacgaggaacccattccgatggccacgtacggctggaaccttgtgaagctgcattcaggcaaagatgttttctttatcccacctgagaagtgtgacaccctactctgcgatataggggagagctcgcccaatccaactatcgaagagggacgcacactgagagtattgaaaatggtggaaccctggctgaggggtaaccaattctgtattaagatcctcaatccttatatgccgtctgtcgtggagacccttgagcagatgcagcgaaaacacggcgggatgctggttcggaaccccttaagtcgtaattccactcatgaaatgtactgggtgagctgcggaacaggcaacattgtctcagcggtgaatatgacctccagaatgctgttgaaccgctttacgatggctcacaggaagccaacctatgagcgggacgtagatctcggtgcagggacaagacacgtggccgttgaacctgaggtcgctaacctggacatcattggacagcgcatcgaaaatataaagcatgagcacaaatctacttggcattacgatgaggacaacccctataagacctgggcctaccacggcagctatgaagtgaaacctagtggctccgcaagctctatggtgaatggggtcgttaagctacttacaaaaccatgggatgtgattcccatggtaactcaaatcgccatgaccgacacaacccctttcggacagcagagggtgtttaaggagaaggtcgatactcgaacgccaaaagctaagcggggtacagcgcaaatcatggaagtgaccgccagatggctgtggggcttcctctcaaggaacaaaaagccccgcatttgtactcgtgaggaatttacccggaaagttagaagtaatgcagctataggggccgtgttcgtcgacgagaaccagtggaattccgcaaaggaggccgtggaagacgagaggttttgggatctggtacatcgcgaacgagagttgcacaagcagggaaaatgcgctacatgcgtttacaacatgatgggcaagcgggaaaaaaagctgggtgagttcgggaaagccaagggaagcagagcgatctggtacatgtggctcggcgcaaggtttcttgagttcgaagccctgggcttcatgaatgaggaccactggttttctcgcgaaaactcgttatcaggggtggagggagagggtctgcataagttgggctatattctcagagatatcagcaaaattccggggggaaatatgtacgctgacgatacggccggctgggacacccggatcactgaagatgacctgcagaacgaggcaaagataacagatatcatggaacctgagcacgctctacttgccacctccattttcaaactgacttatcaaaataaggtcgtgagggtgcagcgtccagctaaaaacggtacagtcatggacgttatcagtcgacgcgatcagagagggtctggacaggtgggcacctacggcctcaatacatttactaacatggaagcccaactgattcggcagatggagagcgaggggatcttctccccctcagaattggagacccctaacttagcagaaagggtactggactggctcgagaagtatggagtggaacgccttaaaagaatggcgataagtggtgatgactgtgtcgtgaagccaattgacgatcggtttgccacggctctgaccgccctaaatgacatgggcaaggttaggaaagatatcccccagtgggagccgtctaaggggtggaacgactggcagcaagtgcctttctgcagccatcactttcaccagctgatcatgaaagatggacgagagattgtcgtgccctgtcgtaatcaggacgaactcgtaggcagagcacgcgtttcccagggtgctgggtggtcattgcgggagacagcctgcctgggaaagagctacgcacaaatgtggcagcttatgtatttccataggagagatctgcgcctcgccgcgaacgctatatgttctgccgtgccagtcgactgggtgcctacttcccggaccacatggagtatccacgcacatcagcaatggatgactaccgaagatatgttaagcgtttggaatagggtgtggattgaggaaaacccctggatggaggacaaaacgcacatctcgtcctggggcgatgtcccatacctgggcaagcgagaggaccagtggtgcgggtctttgattggactgacagccagagctacctgggccactaatatccaggtggcaataaaccaggtacggaggctcatcggtaatgaaaactaccttgactatatgacatcaatgaagcgctttaaaaatgagagcgatcccgaaggcgctctgtggtga

SEQ ID NO: 13279 - RNA, 9879 nt, synthetic construct
  misc_feature 1..9879: note = derived and/or modified CDS sequence (opt3) from DENV-1__FJ639672__SS-prME
  source 1..9879: mol_type = other RNA
agcgtgaccatgctgctcatgcttatgcccactgcactggctttccacttgactacgagaggaggggaacctcatatgatcgtctccaagcaggaaagaggaaaatctttactgtttaagacctcagccggtgttaacatgtgcacactaattgccatggacctcggagaactgtgtgaagatactatgacctacaaatgcccacggataacagaggcggaaccggacgatgtggactgttggtgcaatgctaccgatacttgggtaacatatgggacctgtagtcagacgggagagcaccgccgagacaagcgtagcgtggcccttgcaccccatgtcggcctgggtttggagactagaaccgaaacatggatgtcctctgagggggcctggaaacagatccagagggtggaaacttgggctctccggcaccctggattcaccgttattgcactgtttctggcccatgctatcggcacatcgattacccagaagggcatcatattcatcctcttaatgctggtgacgccatcaatggccatgcgctgcgtcgggattagcagtagagattttgtggagggactttccggtgcgacttgggtagacgttgtgttggagcacggctcttgtgtcacaaccatggcaaaggataaacccactctggacatcgaactactcaagacagaggtgaccaaccctgccgtgctgaggaaactttgcattgaagctaagatcagcaatacgaccacagattcccggtgtccaactcaaggggaggccaccctggtcgaagaacaggacgcaaacttcgtttgccgccgaacatttgtggatagaggatggggcaatggttgtgggttgttcggaaaaggctcactcataacttgcgctaagtttaagtgcgtaaccaaactggagggcaagattgtgcagtacgaaaacttaaaatatagtgtcatcgtgacagttcacaccggggaccagcatcaagtgggaaatgagagcactgaacacggtacgacagccaccattactccccaggcgcctaccacagagatccagctgaccgactacggcgccctcactcttgattgttctccaaggacagggctggacttcaacgaaatggtcttgctaacgatgaaggagaaatcctggctggtgcataagcagtggtttctcgatctgccgcttccctggacctcaggagcaagcacaagtcaagagacatggaatcggcaggacctgttggtaaccttcaaaacagctcacgccaagaagcaggaagttgtggtcctcggctctcaagagggtgctatgcacactgccctgaccggggcaacggaaatccagacctccggcacaactaccatttttgccggacatttaaaatgccgtctgaagatggataaactaacactcaagggcatgagctatgtgatgtgtactgggtcgttcaaactggagaaggaagtcgctgagacccagcacggaacggtgcttgttcagataaagtacgagggtacagacgcgccttgcaaaatcccattctctacccaagatgaaaagggcgtgactcagaacgggcgcttgattacagcaaatcccatcgtaaccgacaaagagaagcctgtcaacatagaagccgagccaccctttggagagtcctatattgtgatcggcgctggtgaaaaagccctgaagctctcatggttcaagaaagggagtagcatcggcaagatgtttgaggcaactgccagaggagctaggcggatggccattctgggcgataccgcatgggacttcgggtccatcggaggtgtttttacatctgtgggcaaacttgtccatcagattttcgggacggcgtacggagtgctgtttagcggcgtatcatggaccatgaagataggtatcggggtgttgctcacttggctgggcttaaatagtcgatccacaagcctgtctatgacctgtattgctgttggcttagtcacactctacctgggcgtgatggtgcaggccgattcagggtgcgtcatcaactggaaaggacgcgaacttaagtgtggcagtggtatcttcgttactaatgaggtgcacacctggacggaacaatataagtttcaggcagacagcccgaaaagattgtccgccgctattgggaaggcctgggaggagggagtgtgcggcataaggtctgcaacacggctggaaaacatcatgtggaaacagatttcgaacgagctcaatcatatcctgttagaaaacgacatgaagctgaccgtagtcgtgggtgatgttgctggcattcttgcccaggggaaaaagatgatccgccctcaacccatggagtacaaatatagctggaagtcctggggaaaggcgaaaataatcggcgccgacgtgcagaatactaccttcattatcgatgggccaaacacacctgaatgtcccgacgatcagagagcttggaatatttgggaggtcgaggactacggatttggcatcttcactaccaacatatggttgaagctcagggattcatatacacaggtgtgcgaccaccgtctgatgagtgcagccattaaagattctaaggctgttcacgccgacatgggttactggatcgaaagcgagaaaaatgaaacgtggaagctagcacgggcgtcctttattgaggtgaagacctgtatctggccaaaatcacatactctgtggagcaacggggtactcgaatctgagatgataatccccaagatttatggaggccctatctcccaacacaattaccgaccaggttacttcacacagaccgccggcccgtggcatctggggaaacttgagttggatttcgacctgtgcgaaggaactacagtcgtggtggatgagcactgcggcaacagagggcccagtttaaggaccacgactgtcaccggaaagattatccacgaatggtgttgccgcagctgtacactccctccactgcggtttagaggcgaggacggttgctggtatgggatggagataaggcccgttaaagaaaaggaggaaaatcttgtgaagtctatggtatccgctggatcaggcgaggtggacagtttcagcctgggtttgctctgtatttcgatcatgatcgaagaggtcatgcgctcccgatggtctcggaaaatgctgatgaccggcactctagccgtgtttttcctgctcattatggggcagctgacatggaacgatcttatccgtttgtgcattatggttggagcaaatgctagcgacagaatgggcatggggaccacatacctggccttaatggcaacttttaagatgaggcctatgttcgccgtgggactcctgtttcgccggcttacctcaagagaggtcctgctactcacgataggcctgagtttggtggcttccgttgaactgccaaactctttagaggaactcggtgatgggctggcgatgggaatcatgattcttaaactgttgacagacttccaaagccatcagctctgggccaccctgctatccctgacttttatcaagaccacattctcacttcactatgcatggaaaactatggctatggtgctcagcattgtcagtctgtttcccttgtgtctgtctaccacgtcccagaagacaacctggttaccggtactcctgggcagccttggctgcaagcctctgactatgttcttgatcgccgagaataaaatatgggggaggaagtcgtggccactcaacgaaggaatcatggccgtgggtattgtttcaatcctgctatctagtctgcttaaaaacgatgtgcccctcgctggccctctgattgcagggggaatgttgatcgcctgttacgtcatatccggcagctctgcggacttaagcctggagaaggctgccgaggtgtcctgggaagaggaagcagagcattcaggtgccagtcacaatattctcgtagaagtgcaggatgacgggacaatgaaaatcaaggatgaggagcgagacgataccctgactatccttctgaaagctacattgctagcagtcagcggagtttatcccctgtctattccagccaccctctttgtgtggtacttctggcaaaagaagaaacagcgctccggcgtgctgtgggacacgccttcacccccagaagtcgagcgggcggtgcttgatgacggcatatatagaatcatgcagagggggttactgggacgtagtcaggttggtgtaggcgtgttccaagaaaacgtctttcatactatgtggcacgtgacccgcggggctgttctcatgtaccagggaaagcggttggagccgagctgggcctccgtgaaaaaggacctgatttcttacggcggtgggtggagactccagggatcgtggaatacaggcgaggaagtccaggtgatcgcagtagagcctggcaaaaaccccaagaatgtccaaaccgccccagggacattcaagactcccgaaggagaggtgggtgctattgccctggattttaaacctggcaccagcgggtcaccaatcgttaacagggaaggaaagatagtgggcctttatggtaatggggtcgtgacgacatccggaacttacgttagtgcaatcgctcaggccaaagcgtctcaggagggccccctgcctgagattgaagacgaggtgttccgaaagcggaacttgaccatcatggatctacacccgggcagcgggaaaacacgcagatatctgccagccattgtcagggaagcaatcaagcggaagctccgaaccttaatactggctcccactagagtggtagcctccgagatggctgaagcacttaaaggaatgcctattcgctaccaaaccacagccgtgaagtcagagcatacgggtaaagagatcgttgacctgatgtgccacgccacttttaccatgaggctcttgtctccagtccgtgtgcccaattataacatgatcattatggatgaagctcatttcacagaccctagcagtatcgcggcacggggctacatatccaccagagtggggatgggagaggccgctgccatttttatgactgcaacaccgcccggcagcgtcgaagccttcccacagtctaatgctgtaatccaggatgaggaaagggacattcctgagcgctcatggaactccggttatgagtggatcaccgattttcccgggaagacggtgtggttcgttccaagtataaaaagcggaaatgacattgcgaactgtctgcgaaagaatggcaagagagtgatccagctctcgcggaaaacttttgatacagaataccaaaagaccaaaaacaacgactgggactacgtcgtgaccactgatatctctgagatgggcgccaatttcagggcagaccgcgttattgatcctcgtagatgcctgaagcccgtgatccttaaagacgggccagaacgggtcattctagctggaccgatgcctgtgacagtagcctccgcagcccagaggcgcggtcgaataggcagaaaccacaataaggagggggatcagtatatctacatgggacagcccctgaacaatgacgaggatcatgctcactggaccgaagccaagatgttgttagacaacattaatacaccagagggcatcatccccgcgctgttcgaacctgagcgggagaaaagcgcagccattgatggtgagtataggctccgcggggaggctagaaagacttttgtggaactgatgaggcggggcgaccttccagtttggctgtcatacaaagtcgccagtgagggattccaatattctgatcgtcgctggtgctttgacggcgaacgaaacaatcaggtgctcgaggaaaacatggatgtggagatatggacgaaggagggggaaaggaaaaagttgaggccccggtggctggacgctcgcacctactccgaccctctagcactgagagagttcaaagaatttgccgctggaaggcggagcgtctcaggtgatctcatccttgagattggcaagctgccgcagcacttaacacagcgagcccaaaatgcattggacaacctggttatgctccataatagtgaacaagggggcagagcgtatcgccacgccatggaggagctgccagatactatcgaaacccttatgctgctcgctttgattgccgtgctgacaggcggtgtaaccttattctttctaagcgggaggggcctgggaaagacttccatcggcctcctttgtgtgatggcatctagcgtcctgttgtggatggcttccgtggagccccattggatagccgcatcaatcattctggagttctttctcatggttctgcttatccctgagcccgaccggcagcgtacgccacaggataaccaactcgcctacgtggtcattgggctgttgttcatgatcctgaccgtagctgcgaatgagatgggattactagaaacaactaaaaaggacctgggtataggccacgtggccgttgagaaccaccatcacgcagctatgctcgatgtggaccttcatcctgcctctgcctggaccctgtacgcagtcgctacaaccattatcactcccatgatgagacacacaattgaaaacacgaccgccaatatcagtttgactgcgatagctaaccaggccgcaatcctgatggggctcgataaaggatggccaatttcgaagatggacatcggcgtgcctctgcttgccttaggttgctatagccaggtcaatccgctgacactcaccgctgcagtgttgatgctggttgcccattacgcgattatcgggcccggcctacaagctaaagccaccagggaggcacagaagcgcacagccgctggaataatgaagaacccaactgtggatggcattgtagccatcgacctggatcctgtggtctatgacgcaaaatttgaaaagcagctcgggcagatcatgcttctgattttgtgtacgtcccaaatcctgctcatgcggaccacatgggctctgtgcgagtctataactttagccaccggaccccttacaaccctgtgggagggctcaccaggtaaattctggaatactacgattgcggttagcatggccaacatctttcgagggtcctacctcgcaggagctggcctagccttcagtctgatgaagtctttgggtggcgggagaaggggaacaggcgcacagggggaaaccctgggagagaaatggaagcgccagctcaatcagcttagcaagtcagagttcaacacttataaacggtccggcattatggaggtggacagaagtgaagctaaggagggtctgaaacgtggggagaccacaaagcacgccgtcagcaggggaactgccaaattgcggtggtttgtggaacgcaatctggtaaagcctgagggcaaggtgatcgatctcggttgtggccgagggggatggtcttactattgcgcgggcctgaaaaaggttaccgaagtgaaagggtacacaaagggaggccccggtcacgaggaaccgataccaatggctacgtacgggtggaacctagtcaaacttcattccggaaaggacgcattctttatccctcccgagaaatgtgataccctgctatgcgacattggcgagtcaagcccaaatcccactatcgaagagggcagaacactcagggtgctgaagatggtcgaaccttggttgcgggggaaccaattctgtattaagatcctgaatccgtatatgccctcggtggttgagaccctcgagcagatgcagcgcaaacacggaggtatgcttgtaagaaacccactgtctaggaatagtactcatgaaatgtactgggtgtcctgcggcacagggaacattgtcagcgccgtgaatatgacctcacgaatgttactgaaccggtttacgatggctcaccgtaagcctacctatgagagagatgttgacttgggaacaggcactcgccacgtggccgtcgaacccgaggtggcaaacctcgatatcataggtcagaggattgaaaatatcaaacatgagcacaagtccacctggcattacgacgaggataacccttataaaacatgggcctaccacgggtcttatgaagtaaagccaagcggaagtgcttccagcatggtgaatggcgttgtcaagctgctaactaaaccctgggacgtgatccctatggtgacccaaattgcgatgacagataccactccattcggccagcagcgggtctttaaggagaaagttgacacgagaacacccaaggccaaacgcgggaccgcacaaataatggaagtgactgctaggtggctttggggattcctgtctcgaaacaagaagccgcggatctgtaccagagaggaatttacaaggaaagtacgctcaaatgccgcaattggtgccgtgttcgtcgacgagaaccagtggaatagtgctaaggaggccgtggaagatgagcgtttttgggacctcgttcatcgggaaagagagctgcacaaacagggcaagtgcgcgacgtgcgtgtacaacatgatggggaaaagggaaaagaagttgggagagttcggcaaagcaaagggttcccgcgccatctggtacatgtggctgggggctcgatttctcgagttcgaagcccttggattcatgaatgaggatcactggtttagccgggaaaactctctgtcgggcgtcgagggcgaggggttacataaactgggatatattttgagagacatctcaaagatacctggtggcaatatgtacgcagatgacaccgctgggtgggatactaggatcacagaagacgatctccagaacgaggccaaaattaccgacatcatggaaccagagcacgctctgctagccaaggcaattttcaaacttacttatcaaaataaggtggtacgcgttcagagacccgcgaagaacggaacagtgatggatgtcatcagccggagggaccagcgtggctccggtcaggtggggacctacggactgaatacatttactaacatggaagcccaactcatacgacagatggagagtgagggcattttctctcctagcgaactggagaccccaaacttggctgaacgcgccttagattggctggagaaatatggcgtggaaagactcaagcggatggcaatctccggggacgactgtgtcgttaaacccatcgatgacaggtttgctacggcccttaccgcactgaatgatatgggaaaggtgcgcaaagacattccgcagtgggagccttcaaagggttggaacgattggcagcaagtacccttctgcagtcatcactttcaccagctaataatgaaggacggcagagagatcgtggtcccatgtcggaatcaggatgaactggtggggagggcccgagtttctcagggagcgggctggagcctccgtgagacagcttgcttgggtaaatcctacgcccaaatgtggcagctgatgtatttccatagacgcgaccttcggctggcagccaacgctatttgttcagccgtgcctgtcgattgggtgcccactagcaggaccacatggtctatccacgcacatcaccagtggatgactaccgaagacatgctctccgtatggaatagagtttggattgaggaaaacccatggatggaggataagacgcatatcagtagctgggaggacgtgccctacttagggaaacgcgaagaccaatggtgcggatcgctgataggcttgacagctcgggccacctgggcgactaatatccaggtcgctattaaccaggtgaggcgactgatcggcaatgagaactacctcgattatatgacatccatgaagagatttaaaaatgaatctgaccctgagggggccctttggtga

SEQ ID NO: 13280 - RNA, 9879 nt, synthetic construct
  misc_feature 1..9879: note = derived and/or modified CDS sequence (opt3) from DENV-1__FJ639673__SS-prME
  source 1..9879: mol_type = other RNA
agcgtgaccatgctgctcatgcttatgcccacagcactggctttccacttgactacgcggggcggggagcctcatatgatcgtatccaagcaggaaagaggaaaatctttactgtttaagacctcagccggtgttaatatgtgcacactaattgccatggacctcggcgagctgtgtgaagatactatgacctacaaatgcccacggataacagaggtggaaccggacgatgtagactgttggtgcaataccactgatacatgggtgacctatgggacgtgtagtcaaactggagagcaccgccgagacaagcgtagcgtcgcgcttgctccccatgtgggcctgggtttggagaccagagccgaaacatggatgtcctctgagggggcatggaaacagatccagagggttgaaacttgggccctccggcaccctggattcaccgtgattgctctgtttctggcacatgccatcggcacatcgattacccagaagggcatcatattcatcctcttaatgctggtcacgccatcaatggctatgcgctgcgtggggattggaagcagagattttgtagagggtcttagtggcgccacttgggttgacgtggtcttggagcacgggtcctgtgtgacaaccatggcgaaggataaacccactctggacatcgaactactcaagacagaggtgaccaaccctgcagtcctgaggaaactttgcattgaagccaagatctctaatacgaccacagatagccggtgtccaactcaaggagaggctaccctggttgaagaacaggacgccaacttcgtgtgccgccgaacatttgtagatagaggctggggtaatgggtgtggattgttcggcaaaggctccctcataacttgcgcaaagtttaagtgcgtgaccaaactggaggggaagattgtccagtacgaaaacttaaaatattcagtgatcgttacagtgcacaccggagaccagcatcaagtcggtaatgagagtactgaacacggcacgacagctaccattactccccaggcccctaccagcgagatccagctgacagactacggggcgctcacccttgattgttctccaaggactggactggacttcaacgaaatggtgttgctaacaatgaaggagaaatcctggctggtacataagcagtggtttctcgatctgccgcttccctggacgtcaggcgccagcaccagtcaagagacttggaatcggcaggacctgttggttacattcaaaaccgcacacgctaagaagcaggaagtggtcgtgctcggttctcaagagggggccatgcacacagctctgactggcgccaccgaaatccagacgtccggaaccacaactatttttgcaggccatttaaaatgccgtctgaagatggataaactaaccctcaaggggatgagctatgtcatgtgtacaggatcgttcaaactggagaaggaagtggccgagactcagcacggtaccgttcttgtgcagataaagtacgagggcacggacgctccttgcaaaatcccattctctacacaagatgaaaagggggtaacccagaacggacgcttgattactgcgaatcccatcgtcacagacaaagagaagcctgtgaacatagaagcagagccaccctttggcgagtcctatattgttatcggtgccggggaaaaagctctgaagctctcatggttcaagaaaggcagtagcatcggaaagatgtttgaggccaccgcaagaggcgccaggcggatggctattctgggggatactgcctgggacttcggatccatcggtggcgtgtttacctctgtcgggaaacttgtgcatcagattttcggaacagcatacggcgtactgtttagcggtgtgtcatggacgatgaagatagggatcggcgttttgctcacctggctgggattaaatagtcgatccactagcctgtctatgacatgtattgcggtcggcctagtgaccctctacctgggggtgatggtccaggctgattcaggatgcgttatcaactggaaaggccgcgaacttaagtgtggtagtgggatcttcgtgacaaatgaggtgcacacttggaccgaacaatataagtttcaggccgacagcccgaaaagattgtccgcagccattggaaaggcttgggaggagggcgtatgcggtataaggtctgccacgcggctggaaaacatcatgtggcgccagatttcgaacgagctcaatcatatcctgttagaaaacgacatgaaattcacagtcgtggttggcgatgtggtcgggattctggcacagggaaagaaaatgatcagacctcaacccatggagcacaagtacagctggaaatcctggggcaaggctaagataatcggggccgacgtgcagaataccacttttattatcgatggaccaaacacccctgaatgtcccgacgatcagagggcgtggaatatttgggaggttgaggactatggcttcggtatctttacaactaacatatggcttaaattgcgtgattcatacacccaggtgtgcgaccaccggctcatgagtgccgctattaaggattctaaagcagtacatgccgacatggggtattggatcgaaagcgagaagaatgaaacatggaaactggctcgagcctccttcattgaggtcaagacgtgtatctggccaaagtcacacaccctatggagcaacggagtgctggaatctgagatgataatccccaaaatttacggcggtcctatctcccaacataattatagaccaggctacttcactcagacagcagggccgtggcacctcggaaagctggagcttgattttgacttgtgcgaaggcaccactgtggtcgttgatgagcactgcgggaacaggggacccagtctgcgcacaaccacggtgactggcaaaattatccatgaatggtgttgccggagctgtaccttacctccactcagattcaagggtgaggacgggtgctggtacggaatggagataaggcccgtaaaagaaaaggaggaaaatctggtgaagtctatggtctccgcgggctcaggtgaggtggacagttttagccttggcctgttgtgtatttcgatcatgatcgaagaggttatgcgctcccgatggtctcggaaaatgctcatgacagggaccctggccgtgttctttctactgattatgggacagctcacttggaacgatctgatccgtagctgcattatggtcggcgctaatgcctcagacagaatggggatgggaacaacctatcttgcattgatggctacattcaagatgaggcctatgtttgccgtgggcctgttattccgccggctcacaagtagagaggttctgcttctgaccataggtctatccctcgtggcatctgtcgaactgccaaacagcttggaggaactgggggatggattagccatgggcatcatgattctcaaactgcttacggactttcaatcctaccagctgtgggctacattgctctcactgaccttcatcaagactacctttagcctacactatgcgtggaaaacaatggccatggtactgagtattgtgtctcttctccccctgtgtttgtccactaccagccagaagacgacatggctgccggttttactcggctcgctggggtgcaagcctcttaccatgttcctgatcgcagagaataaaatatggggaaggaagtcatggccattgaacgaaggtatcatggctgtgggcattgtctctatcctcctgagttccctactgaaaaacgatgtgccccttgccgggcctctcattgccggaggcatgctgatcgcttgttacgtaataagcggttctagcgcagacttgtccttagagaaggccgcggtggtctcatgggaggaagaggctgaacatagtggggccagccacaatattctggttgaggtgcaggatgacggaactatgaaaatcaaggatgaagaacgagacgatacactcaccatcctgcttaaagcaactctgttggccgtgtctggcgtctatcccctatccattccagctacactgtttgtgtggtacttctggcaaaagaagaaacagcgctcaggcgttctctgggacacccctagtcccccagaggtagaacgggcagtgctggatgacgggatatatagaatcatgcagaggggacttttaggtcgtagccaggtcggcgtgggggttttccaagagaacgtgtttcatacgatgtggcacgtcactcgcggagccgtgctgatgtaccagggcaagcggctcgaaccgtcctgggcgtctgtcaaaaaggacttgatttcgtacggtgggggatggagactgcagggcagctggaataccggcgaggaggtccaggtgatcgctgttgaacctgggaaaaaccccaagaatgtgcaaacagccccaggaaccttcaagacacccgagggtgaagtcggcgcaattgccctcgattttaaacctgggacttcaggatccccaatcgtgaacagggagggcaagatagttggtctgtatgggaatggagtggtcaccacgagtggcacatacgtgtctgctatcgcccaggcaaaagctagccaggaaggcccccttcctgagattgaggacgaagtattccgaaagcggaacctgactatcatggatttgcacccggggtccggaaaaacccgcagatatctaccagccattgtgagggaggcgatcaagcggaagctgcgaacactcatattagcccccaccagagttgtcgcatcagaaatggctgaggccctgaaaggtatgcctattcgctaccaaactaccgctgtgaagtctgaacatacaggcagggagatcgtggaccttatgtgccacgcaacgtttactatgcgtctgctcagcccagtccgggtacccaattataacatgatcattatggatgaggcccatttcaccgaccctagttccatcgccgctagagggtacataagcacaagggtgggaatgggcgaagcggcagccatttttatgaccgctactccgcccggttctgttgaggccttcccacagtcaaatgcagtgatccaggatgaggaacgcgacattcctgaacgatcctggaacagtgggtatgagtggatcacagattttcccggaaaaaccgtctggttcgtgccaagcataaagtcgggcaatgacattgccaactgtttgaggaaaaatggcaagcgggttatccagctgtctaggaagacgtttgatactgagtaccagaaaactaagaacaacgactgggactacgtggtcaccaccgatatctccgaaatgggggctaatttccgcgcggaccgtgtgattgatcctagacggtgcctcaaacccgtaatcctgaaggacggaccagagagggtgattcttgccggtccgatgcctgttactgtcgcaagcgctgcccaacgccgaggcagaatagggcggaaccacaataaagaaggagatcagtatatctacatgggccagcccctaaacaatgacgaggatcatgcacactggacagaggccaagatgctgttggacaacattaataccccagaaggtatcatccccgctttattcgagcctgaaagggagaagtcagccgcgattgatggggaatatcgcctgagaggcgaggcaaggaaaacatttgtggagctcatgcggcgtggagacctgccagtgtggcttagttacaaggtcgcctctgaaggcttccaatattccgatcgccgatggtgctttgacggggagagaaacaatcaggttctggaagagaacatggatgtggaaatatggactaaagagggagagaggaagaaactccggccccgctggttggacgctagaacgtacagcgaccctctggccctaagggagttcaaggagtttgctgcaggtcggcgatcagtaagtggcgatctgatcctcgaaattgggaaacttccgcagcacctgacccagagagcccaaaatgctttagacaacttggtgatgctgcataatagcgagcagggaggccgcgcctataggcacgcaatggaggaactcccagatacaatcgagactctgatgcttctggcgctcattgccgtcttgaccggtggggtgacactgttctttttatccggccggggactaggcaagacctctatcgggctgctctgtgttatggctagctccgcccttctgtggatggcatcagtggaaccccattggatagctgcctctatcattttggagttctttctgatggtcctcctgatccctgaacccgaccgtcagagaactccacaggataaccaacttgcatacgtagtgattggactcctgttcatgatcttgacggttgccgctaatgagatgggtctgttagagaccacaaagaaagacctaggcatagggcacgtggcggtcgaaaaccaccatcacgccactatgctggatgtggacctccatcctgcaagtgcttggaccctttacgccgtcgccacaaccattatcactcccatgatgaggcacacaattgagaacacgaccgcaaatatctcgctgactgctatagccaaccaggcggctatcttgatgggactggataagggctggccaattagcaaaatggacatcggtgtgcctctcctggcccttgggtgctattcccaggttaatccgttaacactgaccgcagccgtgctcatgttggtagctcattacgcaattatcggccccggactgcaagccaaggcgacccgcgaagctcagaaacggacagccgcaggcataatgaagaacccaactgtggatgggattgtcgccatcgacctagatcctgttgtgtatgacgctaagtttgagaaacagctgggacagatcatgctccttattctgtgtacgtctcaaatcttgctgatgcgaaccacatgggccctctgcgaatcaataactctggcaaccggccccttaacaaccctttgggagggtagcccagggaagttctggaatactacgattgctgtctccatggccaacatctttagaggaagttacctggcgggcgccggtctcgcattctctctaatgaaaagcctgggcgggggaaggcgcggcacaggggctcagggagagaccttgggcgaaaagtggaaacggcagctgaatcagctctcaaagtccgagttcaacacttataagagaagtggtattatggaagtggaccgtagcgaggccaaagaagggcttaggcggggagagaccacaaagcacgcagtatctcgcggcactgctaaactgcgatggtttgtggagagaaatttggttaagcctgaaggtaaagtgatcgatctgggctgtgggaggggaggctggtcctactattgcgccgggctcaagaaggtcaccgaggtgaaaggatacacaaagggcggtcccgggcacgaggaaccgataccaatggccacgtacggatggaacttagtcaaactgcattcaggcaaggacgtgttctttatccctcccgaaaaatgtgatacccttctgtgcgacattggcgagagctcgccaaatcccactatcgaggaagggcggacactacgcgttctcaagatggtagagccttggctgagaggaaaccaattctgtattaaaatcttgaatccgtatatgccctctgtggtcgaaaccctggagcagatgcagaggaagcacggtggcatgctcgtgcgaaacccacttagtagaaattccactcatgagatgtactgggttagctgcgggacaggaaacattgtgtcagcggtcaatatgacctcccgtatgctgttaaacagatttacgatggctcaccgcaagcctacctatgaaagggatgtggacctgggcgcaggtacacggcacgtagccgtggagcccgaagttgctaacttggatatcatagggcagagaattgagaatatcaaacatgaacacaagtctacttggcattacgacgaggataacccttataaaacctgggcctaccacggaagctatgaggtcaagccaagtggctccgcaagctctatggtgaatggcgtggtcaaactcctgacaaagccctgggacgttatccctatggtgactcaaattgccatgaccgatacaaccccattcgggcagcagcgcgtatttaaggaaaaagtggacactaggacgcccaaggctaaacgaggaacagcgcaaataatggaggtcaccgcccggtggctatggggtttcctttcaagaaacaagaaaccgaggatctgtactcgcgaagagtttacccgtaaggtgcggagtaatgcagctattggcgccgttttcgtggacgaaaaccagtggaactccgcaaaggaggccgtcgaggatgaaagattttgggacctggtgcatagggagcgcgaactccacaaacaggggaagtgcgctacatgcgtatacaacatgatgggaaaacgagagaagaaactgggcgagttcggtaaggccaaggggagccgggcgatctggtacatgtggttgggagcaagatttctggagttcgaggccctcggcttcatgaatgaagatcactggttttctagggagaactcgctttcaggcgttgaaggggagggactgcataaattaggttatattctgcgcgacatcagcaagatacctggcgggaatatgtacgctgatgacacggccggatgggataccagaatcactgaggacgatttgcagaacgaagcaaaaattacagacatcatggagccagaacacgctctcctggccacctccattttcaagctaacttatcaaaataaagtggtccgggtgcagaggcccgctaagaacggcacagtgatggatgtcatcagtcgtcgagaccagcgcggttctgggcaggttggaacctacggccttaatacatttactaacatggaggcccaactgataagacagatggaaagcgagggcattttctccccttcagagctcgaaaccccaaacctggcagagcgggtgttggattggttagaaaaatatggggtagagaggctgaagcgcatggcgatcagtggagacgactgtgtggtcaagcccatcgatgacagatttgccacggctctcaccgcccttaatgatatgggtaaagtgcggaaggacattccgcagtgggaaccttctaaaggctggaacgattggcagcaagttcccttctgcagccatcactttcaccagctgataatgaaggacgggagggagatcgtggtcccatgtcgaaatcaggatgagctagtgggacgtgcaagagtatcccagggcgctggttggtcactgcgcgaaacagcctgcctcgggaaaagctacgcacaaatgtggcagttgatgtatttccatcggagggacctgagacttgccgcgaacgctatttgttctgccgttcctgtggattgggtccccacttcccgcaccacatggagtatccacgcacatcaccagtggatgactaccgaggacatgctgagcgtgtggaatcgggtttggattgaagagaacccatggatggaagataagacgcatatctcgtcctggggagacgtgccctacctcggcaagagggaggaccaatggtgcggctctttaatagggctgacagcccgagctacctgggccactaatatccaggtcgcaattaaccaggtgagacggttgatcggaaatgagaactacctggattatatgacatcaatgaaaaggtttaagaatgaaagcgaccctgagggtgctctctggtga

SEQ ID NO: 13281 - RNA, 9879 nt, synthetic construct
  misc_feature 1..9879: note = derived and/or modified CDS sequence (opt3) from DENV-1__FJ639674__SS-prME
  source 1..9879: mol_type = other RNA
agcgtgaccatgctgctcatgcttatgcccaccgcactggctttccacttgactacgagaggaggggaacctcatatgatcgtctccaagcaggaaaggggaaaatctttactgtttaagacctcagccggtgttaatatgtgcacactaattgccatggacctcggcgagttctgtgaagatactatgacctacaaatgcccacggataacagaagcggaaccggacgatgtggactgttggtgcaatgctaccgatacttgggtaacatatgggacctgtagtcaaacgggagagcaccgccgagacaagcgtagcgtggccctggcaccccatgtcggccttggtctggagactagaaccgaaacatggatgtcctctgagggggcctggaaacagatccagagggtggaaacttgggctttgcggcaccctggatttaccgttattgcactcttcctggcccatgctatcggcacatcgattacccagaagggcatcatatttatcctgctcatgttagtgacgccatcaatggccatgcgctgcgtcgggattggaagcagagatttcgtggagggtctgagtggcgcgacttgggtagacgttgtgcttgagcacgggtcctgtgtcacaaccatggcaaaggataaacccactttggacatcgaactgctaaagacagaggtgaccaaccctgccgtgctcaggaaactgtgcattgaagctaagatctctaatacgaccacagatagccggtgtccaactcaaggagaggccacccttgtcgaagaacaagacgcaaactttgtttgccgccgaacattcgtggatagaggctggggtaatgggtgtggactgtttggcaaaggctccttgataacttgcgctaagttcaagtgcgtaaccaaactcgaggggaagattgtgcagtacgaaaacctgaaatattcagtcatcgtgacagttcacaccggagaccagcatcaagtgggtaatgagagtactgaacacggcacgacagccaccattactccccaggcgcctagcaccgagatccagttaacagactacggggccctgaccctcgattgttctccaaggactggacttgactttaacgaaatggtcctgttgacaatgaaggagaaatcctggctagtgcataagcagtggttcctggatctcccgctgccctggacgtcaggcgcaagcaccagtcaagagacttggaatcggcaggaccttctggtaacatttaaaaccgctcacgccaagaagcaggaagttgtggtcttgggttctcaagagggggctatgcacacagccctcactggcgcaaccgaaatccagacgtccggaaccacaactattttcgccggccatctgaaatgccgtttaaagatggataaactgaccctaaaggggatgagctatgtgatgtgtacaggatcgttcaaactcgagaaggaagtcgctgagactcagcacggtaccgtgctggttcagataaagtacgagggcacggacgcgccttgcaaaatcccattttctacacaagatgaaaagggggtgacccagaacggacgccttattactgcaaatcccatcgtaacagacaaagagaagcctgtcaacatagaagccgagccacccttcggcgagtcctatattgtgatcggtgctggggaaaaagccttgaagctgtcatggtttaagaaaggcagtagcatcggaaagatgttcgaggcaaccgccagaggcgctaggcggatggccattctcggggatactgcatgggactttggatccatcggtggcgttttcacctctgtggggaaactggtccatcagatttttggaacagcgtacggcgtgcttttcagcggtgtatcatggacgatgaagatagggatcggcgtgctgttgacctggctcggactgaatagtcgatccatgagcttatctatgacttgtattgctgttggcctggtcacactatacctcggggtgatggtgcaggccgattcaggatgcgtcatcaactggaaaggccgcgaactgaagtgtggtagtgggatctttgttaccaatgaggtgcacacatggactgaacaatataagttccaggcagacagcccgaaaagactttccgccgctattggaaaggcctgggaggagggcgtgtgcggtataaggtctgcaacccggttggaaaacatcatgtggaaacagatttcgaacgagctgaatcatatcctcctggaaaacgacatgaagtttacggtagtcgtgggcgatgttgctgggattttagcccagggcaagaagatgatccgccctcaacccatggagtacaaatatagctggaagtcctggggcaaggcgaaaataatcggggccgacgtgcagaatacaaccttcattatcgatggaccaaacactcctgaatgtcccgacgatcagagagcttggaatatttgggaggtcgaggactacggctttggtatcttcaccacaaacatatggctgaaacttagggattcatatactcaggtgtgcgaccaccgtttgatgagtgcagccattaaagattctaaggctgttcacgccgacatggggtactggatcgaaagcgagaaaaatgaaacctggaagctcgcacgggcgtccttcattgaggtgaagacatgtatctggccaaaatcacatacgctgtggagcaacggagtactagaatctgagatgataatccccaagatttatggcggtcctatctcccaacacaattaccgaccaggctactttacccagactgccgggccgtggcatctgggaaaactcgagctggatttcgacctttgcgaaggcacaaccgtcgtggtggatgagcactgcgggaacagaggacccagtttgaggactacaaccgtcacgggcaagattatccacgaatggtgttgccgcagctgtactctgcctccattacggtttaaaggtgaggacgggtgctggtatggaatggagataagacccgttaaggaaaaggaggaaaatctcgtgaaatctatggtatccgctggctcaggtgaggtggacagtttcagcctgggccttctgtgtatttcgatcatgatcgaagaggtcatgaggtcccgctggtctcgaaagatgttgatgaccgggacactcgccgtgtttttcctgctaattatgggacagctgacctggaacgatctcatccggctgtgcattatggttggcgcaaatgctagcgaccgtatggggatgggaactacataccttgccttgatggcaacctttaaaatgagacctatgttcgccgtgggcctgttatttaggcgcctcacatcacgggaggtcctgcttctgactataggtctaagtctcgtggcttccgttgaactgccaaactctttggaggaactgggggatggattagcgatgggcatcatgattctcaagctgcttaccgacttccaaagccatcagctgtgggccacgttgctctccctgacatttatcaaaaccactttctcactacactatgcatggaagaccatggctatggtgctgagcattgtcagtctttttcccctctgtctgtctacaacttcccagaagaccacgtggttgccggtactgttaggcagcctcgggtgcaaacctctgacaatgttccttatcgccgagaataagatatggggaagaaaatcgtggccactgaacgaaggtatcatggccgtgggcattgtttcaatcttgctctctagtctgctaaagaacgatgtgcccctggctgggcctcttattgcaggaggcatgctcatcgcctgttacgtcatatccggtagctctgcggacctgagcttggagaaagctgccgaggtgtcctgggaagaggaagcagagcattcaggggccagtcacaatattttagtagaagtgcaggatgacggaaccatgaagatcaaagatgaggagagggacgatactctgacaatcctcctgaaggctacccttctggcagtcagcggcgtttatcccttgtctattccagccactctattcgtgtggtacttttggcaaaagaaaaagcagcgatccggcgtgctgtgggacacaccttcacccccagaagtcgagcgcgcggtgctcgatgacgggatatatcggatcatgcagagaggactgcttggtaggagtcaggttggcgtaggggtgttccaagaaaacgtctttcataccatgtggcacgtgacgcgtggagctgttttaatgtaccagggcaaacgcctggagccgagctgggcctccgtgaagaaagacctcatttcttacggtgggggatggcggttgcagggctcgtggaatactggcgaggaagtccaggtgatcgcagtagagcctgggaagaaccccaagaatgtccaaaccgccccaggaacattcaaaaccagcgaaggtgaggtgggcgctattgccctggattttaagcccgggacatcaggatcccctatcgttaacagagaaggcaaaatagtgggtctctatgggaatggagtcgtgactaccagtggcacgtacgtttctgcaatcgctcaggccaaggcgagccaggagggcccactgcccgagattgaagacgaggtgttcaggaaacgaaaccttacaatcatggatctgcaccctgggtccggaaagactcggcgctatttgccggccattgtcagagaagcaatcaagaggaaactacggaccctgatactcgctccaacacgagtggtagcctcagagatggctgaagcattaaagggtatgcccattagataccaaaccactgccgtgaaatctgagcataccggcaaggagatcgttgacctgatgtgccacgccacatttacgatgcgccttctgagccctgtcagggtgccaaattataacatgatcattatggatgaagctcatttcactgaccccagttccatcgcggcacgtgggtacataagcacccgggtgggaatgggcgaggccgctgccatttttatgacagcaacccctccgggttctgtcgaagccttcccccagtcaaatgctgtaatccaggatgaggaaagagacattccagagaggtcctggaacagtgggtatgagtggatcactgattttcctggaaaaacagtgtggttcgttcccagcataaagtcgggcaatgacattgcgaactgtctccgcaagaatggcaaacgagtgatccagttgtctagaaagaccttcgatacggaataccagaagactaagaacaacgactgggactacgtcgtgacaaccgatatctccgagatgggggccaattttcgggcagacagggttattgatccacgccgttgcctgaaacctgtgatcctcaaggacggacccgaaagagtcattctggctggtccaatgccggtgaccgtagccagcgcagcccagcggaggggccgcatagggcgaaaccacaataaggagggagatcagtatatctacatgggccagcctcttaacaatgacgaggatcatgctcactggactgaagccaaaatgctactggacaacattaatacacccgagggtatcatcccagcgttgttcgaacccgagagagaaaagtcagcagccattgatggggagtatcggttaaggggcgaggctcgcaaaacctttgtggaactgatgagaaggggagacctccctgtttggctgagttacaaggtcgcctctgagggcttccaatattccgatcggcgttggtgctttgacggggaacgcaacaatcaggtgcttgaggaaaacatggatgtggagatatggacaaaagagggagaacgaaagaaactgagaccaaggtggctcgacgctcggacttacagcgaccccttggcactgcgcgagttcaaggaatttgccgctggtagaaggtcagtcagtggcgatctaatcctggagattgggaagctccctcagcaccttacgcagcgggcccaaaatgcactggacaacttagttatgttgcataatagcgaacagggaggccgagcgtatagacacgccatggaggagctgccggataccatcgaaacactcatgctgcttgctctgattgccgtgctcactggtggggtaaccttgttctttctgtccggccgcggattaggcaaaacatctatcgggctactgtgtgtgatggcaagctccgtcctcctttggatggcttcagtggagccacattggatagccgcatctatcattctggagttctttttgatggttctgctcatccccgagcctgacaggcagcggacaccccaggataaccaactggcctacgtggtcattggacttctcttcatgatcctgactgtagctgcgaatgagatgggtttgctggaaacgaccaagaaagacttaggcatagggcacgtggccgttgagaaccaccatcacgcagctatgctagatgtggacctgcatccagccagtgcctggacactctacgcagtcgctactaccattatcacacctatgatgcgtcacaccattgaaaacactacagccaatatctcgcttacggcgatagctaaccaggccgcaatcctgatgggattggataagggctggcccattagcaaaatggacatcggtgtgccactgctcgccctggggtgctattcccaggtcaatcctcttaccttaactgctgcagtgctgatgctcgttgcccattacgcgattatcggcccgggattgcaagctaaggccacaagagaggcacagaagaggaccgccgctggcataatgaaaaaccccaccgtggatgggattgtagccatcgacctggatccagtggtctatgacgcaaagtttgaaaaacagctaggacagatcatgctgctcattctttgtacatctcaaatcctgttgatgcgcactacgtgggctctgtgcgagtcaataaccctcgccacaggccctctgactaccttatgggagggtagccccgggaagttctggaatacaaccattgcggtttccatggccaacatcttccggggaagttaccttgcaggcgctggtctggccttttctctcatgaaaagcctaggcgggggacgaagaggcactggggcacagggagaaacgctgggcgagaagtggaagaggcagttgaatcagctgtcaaaatccgagttcaacacatataagcgcagtggtattatggaggtggaccggagcgaagctaaagaggggctcaagagaggagagaccactaaacacgccgtctctcgtggcaccgccaaacttaggtggtttgtggaacggaatctggtaaagccagagggtaaagtgatcgatttgggctgtgggcgcggaggctggtcctactattgcgcggggctgaagaaagttacagaagtgaagggatacactaaaggcggtcctgggcacgaggaacccataccgatggctacctacggatggaacctcgtcaagttacattcaggcaaagacgtgttctttatcccacctgagaagtgtgatacactgctttgcgacattggcgagagctcgcccaatccaacgatcgaagaggggcgaaccctgagagtcctaaagatggtggaaccctggctcaggggaaaccaattctgtattaaaatcctgaatccttatatgccgtctgttgtagagactttggagcagatgcagcggaagcacggtggcatgctggtgcgcaaccccctcagtagaaattccacacatgaaatgtactgggtcagctgcgggaccggaaacattgtgtcagcagttaatatgacttccaggatgcttctgaaccgatttacaatggcccaccggaaaccaacctatgagcgtgatgtggacttaggcgctggtacgagacacgtcgccgtggaacctgaggtagcaaacctggatatcatagggcagcgcattgaaaatatcaagcatgagcacaaatctacctggcattacgacgaggataacccctataagacatgggcctaccacggaagctatgaagtgaagcctagtggctccgctagctctatggttaatggcgtcgtgaaattgctcactaagccatgggacgtgatccccatggtcacccaaattgcgatgacagatactacccctttcgggcagcagagggtttttaaagagaaggtggacacacggaccccaaaagccaagagaggaactgcacaaataatggaagtaacggctaagtggctgtggggtttcctatcacgcaacaaaaagcccaggatctgtacacgagaggaatttacccggaaagtgagaagtaatgccgcaattggcgccgtcttcgtggacgagaaccagtggaactccgctaaggaggccgttgaagatgagaggttttgggaccttgtgcatcgcgaacgtgagctgcacaaacaggggaagtgcgcgacttgcgtctacaacatgatgggaaagcgggagaaaaagctcggcgagttcggtaaagcaaaggggagcagagccatctggtacatgtggctgggagctaggttcttggagtttgaagccctgggcttcatgaatgaggatcactggttttctcgcgaaaactcgctctcaggcgtggagggggagggacttcataaactgggttatattttacgagacatcagcaagataccgggcgggaatatgtacgcagatgacaccgctggatgggatacacggatcacggaagacgatctgcagaacgaggccaaaattaccgacatcatggaacctgagcacgctttgctcgccaagtccattttcaagctgacttatcaaaataaagtagttagagtgcagaggccagtcaagaacggcacagtgatggatgtgatcagtcgcagagaccagcggggttctgggcaggtcggaacctacggcctaaatacttttacaaacatggaagcacaacttataaggcagatggagagcgagggcattttctccccctcagaactggagacccctaacctcgcggggcgtgttctggattggttggaaaaacatggagtggagcgattaaagcgcatggccatcagtggtgacgactgtgtagtgaaaccaatcgatgacagatttgctacagccctgactgcactcaatgatatgggcaaggtccggaaggacattccccagtgggaaccgtctaaagggtggaacgattggcagcaagtgcctttctgcagccaccactttcatcagcttataatgaaggacggaagggagatcgttgtgccctgtcgcaatcaggatgagctggtcggcagagctcgggtgtcccagggtgccgggtggtcactaagggaaaccgcatgcctgggaaaaagctatgcccaaatgtggcagctcatgtacttccaccgacgtgacttgagactggcggctaacgccatttgttctgcagtaccagttgattgggtgcctacgtcccgcaccacatggagtatccatgcccaccatcagtggatgactaccgaggacatgcttagcgtctggaatcgggtgtggattgaagagaacccctggatggaagataagacacacatctcgtcctggggcgacgttccatatctgggcaaaagggaggaccaatggtgcgggtctctcataggattaactgctagagccacctgggcaacgaatatccaggtggctattaaccaggtccgccggctgatcggtaatgagaactacttggattacatgacatcaatgaagaggtttaagaatgaaagcgaccccgagggcgccctgtggtga

SEQ ID NO: 13282 - RNA, 9879 nt, synthetic construct
  misc_feature 1..9879: note = derived and/or modified CDS sequence (opt3) from DENV-1__FJ639675__SS-prME
  source 1..9879: mol_type = other RNA
agcgtgaccatgctgctcatgcttatgcccaccgcactggctttccacttgactacgagaggaggggaacctcatatgatcgtctccaagcaggaaagggggaaatctttactgtttaagacctcagccggtgttaatatgtgcacactaattgccatggacctcggagagttctgtgaagatactatgacctacaaatgcccacggataacagaagcggaaccggacgatgtggactgttggtgcaatgctaccgatacttgggtaacatatgggacctgtagtcaaacgggagaacaccgccgagacaagcgtagcgtggccctggcaccccatgtcggccttggtctggagactagaaccgaaacatggatgtcctctgagggggcctggaaacagatccagagggtggaaacttgggctttgcggcaccctggatttaccgttattgcactcttcctggcccatgctatcggcacatcgattacccagaagggcatcatatttatcctgctcatgttagtgacgccatcaatggccatgcgctgcgtcgggattggaagcagagatttcgtggagggtctgagtggcgcgacttgggtagacgttgtgcttgagcacgggtcctgtgtcacaaccatggcaaaggataaacccactttggacatcgaactgctaaagacagaggtgaccaaccctgccgtgctcaggaaactgtgcattgaagctaagatctctaatacgaccacagatagccggtgtccaactcaaggagaggccacccttgtcgaagaacaagacgcaaactttgtttgccgccgaacattcgtggatagaggctggggtaatgggtgtggactgtttggcaaaggctccttgataacttgcgctaagttcaagtgcgtaaccaaactcgaggggaagattgtgcagtacgaaaacctgaaatattcagtcatcgtgacagttcacaccggagaccagcatcaagtgggtaatgagagtactgaacacggcacgacagccaccattactccccaggcgcctagcaccgagatccagttaacagactacggggccctgaccctcgattgttctccaaggactggacttgactttaacgaaatggtcctgttgacaatgaaggagaaatcctggctagtgcataagcagtggttcctggatctcccgctgccctggacgtcaggcgcaagcaccagtcaagagacttggaatcggcaggaccttctggtaacatttaaaaccgctcacgccaagaagcaggaagttgtggtcttgggttctcaagagggggctatgcacacagccctcactggcgcaaccgaaatccagacgtccggaaccacaactattttcgccggccatctgaaatgccgtttaaagatggataaactgaccctaaaggggatgagctatgtgatgtgtacaggactcttcaaactggagaaggaagtcgctgagactcagcacggtaccgtgcttgttcagataaagtacgagggcacggacgcgccttgcaaaatcccattttcgacacaagatgaaaagggggtgacccagaacggacgcttgattactgcaaatcccatcgtaacagacaaagagaagcctgtcaacatagaagccgagccacccttcggcgagtcttatattgtgatcggtgctggggaaaaagccctgaagctctcctggtttaagaaaggctcaagtatcggaaagatgttcgaggcaaccgccagaggcgctaggcggatggccattctgggggatactgcatgggactttggaagcatcggtggcgttttcacctccgtggggaaacttgtccatcagatttttggaacagcgtacggcgtgctgttctctggtgtaagctggacgatgaagatagggatcggcgtgttgctcacctggctgggattaaattcacgaagtacttccctgagcatgacatgtattgctgttggcctagtcaccctctacctgggggtgatggtgcaggccgattctggatgcgtcatcaactggaaaggccgcgaacttaagtgtggttcagggatctttgttacaaatgaggtgcacacttggaccgaacaatataagttccaggcagacagtccgaaaagattgagctccgccattggaaaggcttgggaggagggcgtgtgcggtataaggtctgccacgcggctggaaaacatcatgtggaaacagatttcgaacgagctcaatcatatcctgttagaaaacgacatgaagtttacagtagtcgtgggcgatgttgcagggattctggctcagggcaagaagatgatccgccctcaacccatggagtacaaatatagctggaagtcctggggcaaggccaaaataatcggggcggacgtgcagaataccactttcattatcgatggaccaaacacccctgaatgtcccgacgatcagagagcctggaatatttgggaggtcgaggactacggctttggtatcttcacaactaacatatggcttaagttgagggattcatatacccaggtgtgcgaccaccgtctcatgagtgctgcaattaaagattctaaggccgttcacgctgacatggggtactggatcgaaagcgagaaaaatgaaacatggaagctggcccgggcatccttcattgaggtgaagacgtgtatctggccaaaatcacataccctatggagcaacggagtactggaatctgagatgataatccccaagatttatggcggtcctatctcccaacacaattaccgaccaggctactttactcagacagcggggccgtggcatctcggaaaactggagcttgatttcgacttgtgcgaaggcaccactgtcgtggtggatgagcactgcgggaacagaggacccagtctgaggacaaccacggtcactggcaagattatccacgaatggtgttgccgcagctgtaccttacctccactccggtttaaaggtgaggacgggtgctggtatggaatggagataagacccgttaaggaaaaggaggaaaatctggtgaaatctatggtatccgccggctcaggtgaggtggacagtttcagccttggcctgttgtgtatttcgatcatgatcgaagaggtcatgaggtcccgctggtctcgaaagatgctcatgacagggaccctggctgtgtttttcctactgattatgggacagctcacttggaacgatctgatccggctttgcattatggttggcgccaatgcaagcgaccgtatggggatgggaatgacatacttggctctgatggccacctttaaaatgagacctatgttcgcagtgggcttactctttaggcgcctgacatcacgggaggtccttctgctaactataggtctcagtctggtggcctccgttgaattgccaaactctctggaggaattaggggatggactcgctatgggcatcatgattctgaaacttctgaccgacttccaaagccatcagttgtgggcgacgctcctgtccctaacatttatcaaaaccactttctcactgcactatgcctggaagaccatggcaatggtgcttagcattgtcagtctctttcccctgtgtttgtctacaacttcccagaagaccacgtggctgccggtattactcggcagcctggggtgcaaacctcttacaatgttcctgatcgctgagaataagatatggggaagaaaatcgtggccattgaacgaaggtatcatggccgtgggcattgtttcaatcctcctgtctagtctactgaagaacgatgtgccccttgccgggcctctcattgctggaggcatgctgatcgcatgttacgtcatatccggtagctctgccgacttgagcttagagaaagcggctgaggtgtcctgggaagaggaagccgagcattcaggggcaagtcacaatattctggtagaagtgcaggatgacggaaccatgaagatcaaagatgaggagagggacgatactctcacaatcctgcttaaggccaccctgttggctgtcagcggcgtttatcccctatctattccagcaactctgttcgtgtggtacttttggcaaaagaaaaagcagcgatccggcgtgctctgggacacaccttcacccccagaagtcgagcgcgccgtgctggatgacgggatatatcggatcatgcagagaggacttttaggtaggagtcaggttggcgtaggggtgttccaagaaaacgtctttcataccatgtggcacgtgacgcgtggagcggttctgatgtaccagggcaaacgcctcgagccgagctgggcttccgtgaagaaagacttgatttcttacggtgggggatggcggctgcagggctcgtggaatactggcgaggaagtccaggtgatcgccgtagagcctgggaagaaccccaagaatgtccaaaccgcaccaggaacattcaaaaccagcgaaggtgaggtgggcgccattgctctcgattttaagcccgggacatcaggatcccctatcgttaacagagaaggcaaaatagtgggtctgtatgggaatggagtcgtgactaccagtggcacgtacgtttctgccatcgcacaggctaaggccagccaggagggcccacttcccgagattgaagacgaggtgttcaggaaacgaaacctgacaatcatggatttgcaccctgggtccggaaagactcggcgctatctaccggcgattgtcagagaagccatcaagaggaaactgcggaccctcatattagcaccaacacgagtggtagcttcagagatggccgaagctctgaagggtatgcccattagataccaaaccactgcagtgaaatctgagcataccggcaaggagatcgttgaccttatgtgccacgccacatttacgatgcgcctgctcagccctgtcagggtgccaaattataacatgatcattatggatgaagcccatttcactgaccccagttccatcgctgcgcgtgggtacataagcacccgggtgggaatgggcgaggcagccgctatttttatgacagccacccctccgggttctgtcgaagcattcccccagtcaaatgccgtaatccaggatgaggaaagagacattccagagaggtcctggaacagtgggtatgagtggatcactgattttcctggaaaaacagtgtggttcgttcccagcataaagtcgggcaatgacattgctaactgtttgcgcaagaatggcaaacgagtgatccagctgtctagaaagaccttcgatacggaataccagaagactaagaacaacgactgggactacgtcgtgacaaccgatatctccgagatgggggcgaattttcgggccgacagggttattgatccacgccgttgcctcaaacctgtgatcctgaaggacggacccgaaagagtcattcttgcaggtccaatgccggtgaccgtagctagcgccgcacagcggaggggccgcatagggcgaaaccacaataaggagggagatcagtatatctacatgggccagcctctaaacaatgacgaggatcatgcccactggactgaagctaaaatgctgttggacaacattaatacacccgagggtatcatcccagccttattcgaacccgagagagaaaagtcagcggcaattgatggggagtatcggctgaggggcgaggcccgcaaaacctttgtggaactcatgagaaggggagacctgcctgtttggcttagttacaaggtcgcttctgagggcttccaatattccgatcggcgttggtgctttgacggggaacgcaacaatcaggtgctggaggaaaacatggatgtggagatatggacaaaagagggagaacgaaagaaactcagaccaaggtggttggacgcccggacttacagcgaccccctggctctacgcgagttcaaggaatttgcagccggtagaaggtcagtcagtggcgatctgatcctcgagattgggaaacttcctcagcacctgacgcagcgggctcaaaatgccttagacaacttggttatgctgcataatagcgaacagggaggccgagcatatagacacgcgatggaggagctcccggataccatcgaaacactgatgcttctggccctcattgctgtgttgactggtggggtaaccctgttctttttatccggccgcggactaggcaaaacatctatcgggctgctctgtgtgatggccagctccgtccttctgtggatggcatcagtggagccacattggatagctgcctctatcattttggagttctttctgatggttctcctgatccccgagcctgacaggcagcggacaccccaggataaccaacttgcatacgtggtcattggactcctgttcatgatcttgactgtagccgctaatgagatgggtctgttagaaacgaccaagaaagacctaggcatagggcacgtggcggttgagaaccaccatcacgccgcaatgctggatgtggacctccatccagctagtgcctggacactttacgccgtcgcaactaccattatcacacctatgatgcgtcacaccattgaaaacactacagctaatatctcgctgacggccatagcgaaccaggctgccatcttgatgggactggataagggctggcccattagcaaaatggacatcggtgtgccactcctggcacttgggtgctattcccaggtcaatcctttaaccctgactgccgctgtgctcatgttggttgcacattacgccattatcggcccgggactgcaagcgaaggctacaagagaggcccagaagaggaccgcagccggcataatgaaaaaccccaccgtggatgggattgtagctatcgacctagatccagtggtctatgacgccaagtttgaaaaacagctgggacagatcatgctccttattctgtgtacatctcaaatcttgctgatgcgcactacgtgggcactctgcgagtcaataaccctggctacaggccctttaactaccctttgggagggtagccccgggaagttctggaatacaaccattgccgtttccatggcgaacatcttccggggaagttacctggccggcgcaggtctcgctttttctctaatgaaaagcctgggcgggggacgaagaggcactggggcccagggagaaacgttgggcgagaagtggaagaggcagctgaatcagctctcaaaatccgagttcaacacatataagcgcagtggtattatggaggtggaccggagcgaagcaaaagaggggcttaagagaggagagaccactaaacacgctgtctctcgtggcaccgccaagctgaggtggtttgtggaacggaatttggtaaagccagagggtaaagtgatcgatctgggctgtgggcgcggaggctggtcctactattgcgccgggctcaagaaagttacagaagtgaagggatacactaaaggcggtcctgggcacgaggaacccataccgatggcgacctacggatggaacttagtcaagctgcattcaggcaaagacgtgttctttatcccacctgagaagtgtgatacacttctgtgcgacattggcgagagctcgcccaatccaacgatcgaagaggggcgaaccctaagagtcctcaagatggtggaaccctggctgaggggaaaccaattctgtattaaaatcttgaatccttatatgccgtctgttgtagagactctggagcagatgcagcggaagcacggtggcatgctcgtgcgcaacccccttagtagaaattccacacatgaaatgtactgggtcagctgcgggaccggaaacattgtgtcagctgttaatatgacttccaggatgctgttaaaccgatttacaatggcacaccggaaaccaacctatgagcgtgatgtggacctgggcgccggtacgagacacgtcgctgtggaacctgaggtagccaacttggatatcatagggcagcgcattgaaaatatcaagcatgagcacaaatctacctggcattacgacgaggataacccctataagacatgggcataccacggaagctatgaagtgaagcctagtggctccgccagctctatggttaatggcgtcgtgaaactcctgactaagccatgggacgtgatccccatggtcacccaaattgctatgacagatactacccctttcgggcagcagagggtttttaaagagaaggtggacacacggaccccaaaagcgaagagaggaactgcccaaataatggaagtaacggcaaagtggctatggggtttcctttcacgcaacaaaaagcccaggatctgtacacgagaggaatttacccggaaagtgagaagtaatgctgccattggcgcagtcttcgtggacgagaaccagtggaactccgccaaggaggctgttgaagatgagaggttttgggacctggtgcatcgcgaacgtgagctccacaaacaggggaagtgcgccacttgcgtctacaacatgatgggaaagcgggagaaaaagctgggcgagttcggtaaagcgaaggggagcagagcaatctggtacatgtggttgggagccaggttcctggagtttgaagctctcggcttcatgaatgaggatcactggttttctcgcgaaaactcgctttcaggcgtggagggggagggactgcataaattaggttatattctgcgagacatcagcaagataccgggcgggaatatgtacgccgatgacaccgcaggatgggatacacggatcacggaagacgatttgcagaacgaggctaaaattaccgacatcatggaacctgagcacgccctcctggctaagtccattttcaagctaacttatcaaaataaagtagttagagtgcagaggccagccaagaacggcacagtcatggatgtgatcagtcgcagagaccagcggggttctggacaggtgggaacctacggccttaatacttttacaaacatggaagcacaactgataaggcagatggagagcgagggcattttctccccctcagaactcgagacccctaacctggcggaacgtgtcttggattggttagagaaacatggggttgaacgactgaagcgcatggccatcagtggagacgactgtgtggtaaaaccaatcgatgacagatttgctacagccctcactgcacttaatgatatgggtaaggtgcggaaggacattccccagtgggagccgtctaaaggctggaacgattggcagcaagtccctttctgcagccaccactttcatcagctgataatgaaggacgggagggagatcgtggttccctgtcgcaatcaggatgagctagtgggcagagctcgggtctcccagggcgccggttggtcactgagggagaccgcatgcctcgggaaaagctatgcccaaatgtggcagttgatgtacttccaccgacgtgacctgagacttgcggctaacgccatttgttctgcagtgccagtagattgggttcctacgtcccgcaccacatggagtatccatgcccaccatcagtggatgactaccgaagacatgctgagcgtgtggaatcgggtctggattgaggaaaacccctggatggaggataagacacacatctcgtcctggggagacgtgccatatctcggcaaaagggaggaccaatggtgcggctctttaatagggctgactgctagagccacctgggcaacgaatatccaggttgctattaaccaggtgcgccggttgatcggaaatgaaaactacctggattacatgacatcaatgaagaggtttaagaatgagagcgaccccgaaggtgccctctggtga

SEQ ID NO: 13283 - RNA, 9879 nt, synthetic construct
  misc_feature 1..9879: note = derived and/or modified CDS sequence (opt3) from DENV-1__FJ639676__SS-prME
  source 1..9879: mol_type = other RNA
agcgtgaccatgctgctcatgcttatgcccacagccctggctttccacttgactacgagaggcggggagcctcatatgatcgtctccaagcaggaaaggggaaaatctttactgtttaagacctcagcaggtgttaacatgtgcacactaattgccatggacctcggcgagctgtgtgaagatactatgacctacaaatgcccacggataacagaggtggaaccggacgatgtagactgttggtgcaataccactgatacatgggtgacctatgggacgtgtagtcaaactggagagcaccgccgagacaagcgtagcgtcgcgcttgctccccatgccggcctgggtttggagaccagagcagaaacatggatgtcctctgagggggcctggaaacagatccagagggtggaaacttgggctctccggcaccctggattcaccgttattgcactgtttctggcccatgtgatcggcacatcgattacccagaagggcatcatattcatcctcttaatgctggtcacgccatcaatggctatgcgctgcgtggggattggaagcagagattttgtagagggtcttagtggcgccacttgggttgacgtggtcttggagcacgggtcctgtgtgacaaccatggcgaaggataaacccactctggacatcgaactactcaagacagaggtgaccaaccctgcagtcctgaggaaactttgcattgaagccaagatctctaatacgaccacagatagccggtgtccaactcaaggagaggctaccctggttgaagagcaggacgccaacttcgtgtgccgccgaacatttgtagatagaggctggggtaatgggtgtggattgttcggcaaaggctccctcataacttgcgcaaagtttaagtgcgtgaccaaactggaggggaagattgtccagtacgaaaacttaaaatattcagtgatcgttacagtgcacaccggagaccagcatcaagtcggtaatgagagtactgaacacggcacgacagctaccattactccccaggcccctaccagcgagatccagctgacagactacggggcgctcacccttgattgttctccaaggactggactggacttcaacgaaatggtgttgctaacaatgaaggagaaatcctggctggtacataagcagtggtttctcgatctgccgcttccctggacgtcaggcgccagcaccagtcaagagacttggaatcggcaggacctgttggttacattcaaaaccgcacacgctaagaagcaggaagtggtcgtgctcggttctcaagagggggccatgcacacagctctgactggcgccaccgaaatccagacgtccggaaccacaactatttttgcaggccatttaaaatgccgtctgaagatggataaactaaccctcaaggggatgagctatgtcatgtgtacaggatcgttcaaactggagaaggaagtggccgagactcagcacggtaccgttcttgtgcagataaagtacgagggcacggacgctccttgcaaaatcccattctctacacaagatgaaaagggggtaacccagaacggacgcttgattactgcgaatcccatcgtcacagacaaagagaagcctgtgaacatagaagcagagccaccctttggcgagtcctatattgttatcggtgccggggaaaaagctctgaagctctcatggttcaagaaaggcagtagcatcggaaagatgtttgaggccaccgcaagaggcgccaggcggatggctattctgggggatactgcctgggacttcggatccatcggtggcgtgtttacctctgtcgggaaacttgtgcatcagattttcggaacagcatacggcgtactgtttagcggtgtgtcatggacgatgaagatagggatcggcgttttgctcacctggctgggattaaatagtcgatccactagcctgtctatgacatgtattgcggtcggcctagtgaccctctacctgggggtgatggtccaggctgattcaggatgcgttatcaactggaaaggccgcgaacttaagtgtggtagtgggatcttcgtgacaaatgaggtgcacacttggaccgaacaatataagtttcaggccgacagcccgaaaagattgtccgcagccattggaaaggcttgggaggagggcgtatgcggtataaggtctgccacgcggctggaaaacatcatgtggcgccagatttcgaacgagctcaatcatatcctgttagaaaacgacatgaaattcacagtcgtggttggcgatgtggtcgggattctggcacagggaaagaaaatgatcagacctcaacccatggagcacaagtacagctggaaatcctggggcaaggctaagataatcggggccgacgtgcagaataccacttttattatcgatggaccaaacacccctgaatgtcccgacgatcagagggcgtggaatatttgggaggttgaggactatggcttcggtatctttacaactaacatatggcttaaattgcgtgattcatacacccaggtgtgcgaccaccggctcatgagtgccgctattaaggattctaaagcagtacatgccgacatggggtattggatcgaaagcgagaagaatgaaacatggaaactggctcgagcctccttcattgaggtcaagacgtgtatctggccaaagtcacacaccctatggagcaacggagtgctggaatctgagatgataatccccaaaatttacggcggtcctatctcccaacataattatagaccaggctacttcactcagacagcagggccgtggcacctcggaaagctggagcttgattttgacttgtgcgaaggcaccactgtggtcgttgatgagcactgcgggaacaggggacccagtctgcgcacaaccacggtgactggcaaaattatccatgaatggtgttgccggagctgtaccttacctccactcagattcaagggtgaggacgggtgctggtacggaatggagataaggcccgtaaaagaaaaggaggaaaatctggtgaagtctatggtctccgcgggctcaggtgaggtggacagttttagccttggcctgttgtgtatttcgatcatgatcgaagaggttatgcgctcccgatggtctcggaaaatgctcatgacagggaccctggccgtgttctttctactgattgtcggacagctcacttggaacgatctgatccgtctttgcattatggtgggcgctaatgccagcgacagaatggggatgggaacaacctatttggcactgatggctacattcaagatgaggcctatgtttgccgttggcttactcttccgccggctgacttcaagagaggtgcttctgctaaccataggtctcagtctggtcgcatccgtagaattgccaaactctctggaggaattaggggatggactcgccatgggcatcatgattctgaaacttctgacggactttcaaagctaccagttgtgggctacactcctgtccctaaccttcatcaagactaccttttcactgcactatgcgtggaaaacaatggccatggtgcttagcattgttagtctcctgcccttgtgtctgtctactacctcccagaagacgacatggttaccggtgctcctgggcagccttgggtgcaagcctctgaccatgttctttatcgcagagaataaaatatggggaaggaagtcgtggccattgaacgaaggtatcatggctgtcggcattgtgtcaatcctcctgtctagtctactgaaaaacgatgtaccccttgccgggcctctcattgccggaggcatgctgatcgcttgttacgtgatatccggtagctctgcagacttgagcttagagaaggccgcggaggtctcctgggaagaggaagctgagcattcaggggccagtcacaatattctggttgaagtgcaggatgacggaactatgaaaatcaaggatgaggagcgagacgatacactcaccatcctgcttaaagcaactctgttggccgtgagcggcgtctatcccctatctattccagctacactgttcgtgtggtacttctggcaaaagaagaaacagcgctccggcgttctctgggacaccccttcacccccagaagtagagcgggcagtgctggatgacgggatatatagaatcatgcagaggggacttttaggtcgtagtcaggtcggcgtgggggtttttcaagaaaacgtgttccatacgatgtggcacgtcactcgcggagccgtgctgatgtaccagggcaagcggctcgagccgagctgggcgtccgtaaaaaaggacttgatttcttacggtgggggatggagactgcagggctcgtggaataccggcgaggaagtccaggtgatcgctgttgagcctgggaaaaaccccaagaatgtgcaaacagccccaggaacctttaagacacccgaaggtgaggtcggcgcaattgccctcgatttcaaacctgggactagcggatcaccaatcgtgaacagggaaggcaagatagttggtctgtatgggaatggagtggtcaccacgtccggcacatacgtgagtgctatcgcccaggcaaaagcttctcaggagggcccccttcctgagattgaagacgaggtatttcgaaagcggaacctgactatcatggatttgcacccggggagcggaaaaacccgcagatatctaccagccattgtgagggaagcgatcaagcggaagctgcgaacactcatattagcccccaccagagttgtcgcatccgagatggctgaagccctgaaaggtatgcctattcgctaccaaactaccgctgtgaagtcagagcatacaggcagggagatcgtggaccttatgtgccacgcaacgttcactatgcgtctgctctctccagtccgggtacccaattataacatgatcattatggatgaagcccattttaccgaccctagcagtatcgccgctagagggtacatatccacaagggtgggaatgggcgaggcggcagccattttcatgaccgctactccgcccggtagcgttgaagcctttccacagtctaatgcagtgatccaggatgaggaacgcgacattcctgagcgatcatggaactccgggtatgagtggatcacagatttccccggaaaaaccgtctggtttgtgccaagtataaagagcggcaatgacattgccaactgtttgagaaaaaatggcaagcgggttatccagctgtcgaggaagacgttcgatactgaataccaaaaaacaaagaacaacgactgggactacgtggtcaccaccgatatctctgagatgggggctaatttccgcgcggaccgtgtgattgatcctagacggtgcctcaaacccgtaatcctgaaggacggaccagaaagggtgattcttgccggtccgatgcctgttactgtcgcatccgctgcccagcgccgaggcagaatagggcggaaccacaataaagagggagatcagtatatctacatgggccagcccctaaacaatgacgaggatcatgcacactggacagaagccaagatgctgttggacaacattaataccccagagggtatcatccccgctttatttgaacctgagagggaaaagagcgccgcgattgatggggagtatcgcctgagaggcgaggcaaggaaaacattcgtggaactcatgcggcgtggagacctgccagtgtggctttcatacaaggtcgccagtgagggctttcaatattctgatcgccgatggtgcttcgacggggaaagaaacaatcaggttctggaggaaaacatggatgtggagatatggactaaagagggagaaaggaagaaactccggccccgctggttggacgctagaacgtactccgaccctctggccctaagggagtttaaggaattcgctgcaggtcggcgaagcatctcaggcgatctgattctcgagatcgggaaacttccgcagcacctgacccagagagcccaaaatgctttagacaacttggtaatgctgcataatagtgaacagggaggccgcgcctataggcacgcaatggaggagctcccagatacaattgaaactctgatgcttctggcgctcatcgccgtgttgaccggtggggtcacactgtttttcttaagcggccggggactaggcaagacctccatagggctgctctgtgtgatggcttctagcgcccttctgtggatggcatccgttgagccccattggatcgctgcctcaattatcttggaatttttcctgatggtgctcctgattcctgagcccgaccgtcagagaactccacaggataaccaacttgcatacgtcgtaatcggactcctgtttatgatattgacggtggccgctaatgagatgggtctgttagaaaccacaaagaaagacctaggcattgggcacgttgcggtggagaaccaccatcacgccactatgctggatgtcgacctccatcctgcatctgcttggaccctttacgccgtggccacaaccatcattactcccatgatgaggcacacaatcgaaaacacgaccgcaaatataagtctgactgctatcgccaaccaggcggctattttgatgggactggataagggctggccaatctcgaaaatggacattggtgtccctctcctggcccttgggtgctatagccaggtgaatccgttaacactgaccgcagccgttctcatgttggtggctcattacgcaatcataggccccggactgcaagccaaggcgacccgcgaggctcagaaacggacagccgcaggcattatgaagaacccaactgtagatgggatcgtggccatcgacctagatcctgtcgtttatgacgctaagttcgaaaaacagctgggacagattatgctccttatcctgtgtacgtcccaaatattgctgatgcgaaccacatgggccctctgcgagtctattactctggcaaccggccccttaacaaccctttgggagggttcaccagggaagttttggaatactacgatcgctgtgagcatggccaacattttcagaggatcctacctggcgggcgccggtctcgcattcagtctaatgaaatctctgggcgggggaaggcgcggcacaggggctcagggagaaaccttgggcgagaagtggaaacggcagctgaatcagctcagcaagtcagaatttaacacttataagagatccggtatccttgaggtcgaccgtagtgaagccaaagaggggctgaggcggggagagaccacaaagcacgcagtgagccgcggcactgctaaattgcgatggttcgtagaaagaaatctggtgaagcctgagggtaaagttatagatctcggctgtgggaggggaggctggtcttactattgcgccgggttaaagaaggtgaccgaagtcaaaggatacacaaagggcggtcccgggcacgaggaaccgatcccaatggccacgtacggatggaacctggtgaaacttcattccggcaaggacgtctttttcattcctcccgagaaatgtgataccctgctatgcgacatcggcgagtcaagcccaaatcccactattgaagaggggcggacactccgcgtgctgaagatggttgaaccttggttgagaggaaaccaattttgtatcaaaattctgaatccgtatatgccctcggtagtggagaccctcgagcagatgcagaggaagcacggtggcatgcttgtccgaaacccactgtctcggaatagtactcatgaaatgtactgggtgtcctgcgggacaggaaacatcgttagcgcggtgaatatgacctcacgtatgttactgaacagattcacgatggctcaccgcaagcctacctatgagagggatgtcgacttgggcgcaggtacacggcacgtggccgtagaacccgaggtggctaacctcgatataattgggcagagaatcgaaaatatcaaacatgagcacaagtccacttggcattacgacgaggataacccttataaaacctgggcctaccacggatcttatgaagttaagccaagcggcagtgcatccagcatggtcaatggcgtggtgaaactgctaacaaagccctgggacgtcattcctatggttactcaaatagccatgaccgatacaaccccatttgggcagcagcgcgtgttcaaggagaaagtagacactaggacgcccaaggctaaacgaggaacagcgcaaatcatggaagtgaccgcccggtggctttggggttttctgtctagaaacaagaaaccgaggatttgtactcgcgaggaattcacccgtaaggtccggtcaaatgcagctatcggcgccgtgtttgttgacgagaaccagtggaatagtgcaaaggaggccgtggaagatgagagattctgggacctcgtccatagggaacgcgagctgcacaaacaggggaagtgcgctacatgcgtgtacaacatgatgggaaaacgagaaaagaaattgggcgagtttggtaaggccaaggggtcccgggcgatttggtacatgtggctgggagcaagattcctcgagttcgaagcccttggctttatgaatgaggatcactggttcagcagggaaaactctctgtcgggcgtagagggggagggattacataaactgggttatatcttgcgcgacatatcaaagatccctggcgggaatatgtacgctgatgacacggccggatgggataccagaattactgaagacgatctccagaacgaggcaaaaatcacagacattatggaaccagagcacgctctgctagccaccagcatctttaagcttacttatcaaaataaagttgtgcgggtccagaggcccgctaagaacggcacagtgatggatgtgatatcccgtcgagaccagcgcggtagtgggcaggtcggaacctacggcctgaatacattcactaacatggaagcccaactcattagacagatggagtctgagggcatctttagcccttccgaactggagaccccaaacttggcagaacgggttttagattggctggagaaatatggggtggaaaggctcaagcgcatggcgatctcaggagacgactgtgtagtgaagcccattgatgacagattcgccacggctcttaccgccctgaatgatatgggtaaagtccggaaggacataccgcagtgggagcctagtaaaggctggaacgattggcagcaagtgcccttttgctctcatcacttccaccagctaatcatgaaggacgggagggagattgttgtgccatgtcgaaatcaggatgaactggtcggacgtgcaagagtgagccagggcgctggttggtccctccgcgagacagcctgcttggggaaatcatacgcacaaatgtggcagctgatgtattttcatcggagggaccttagactggccgcgaacgctatctgtagcgccgtacctgttgattgggtgcccacttctcgcaccacatggtccattcacgcacatcaccagtggatgactaccgaagacatgctcagtgtctggaatcgggtgtggatcgaggaaaacccatggatggaggataagacgcatataagctcgtgggaggacgttccctacttaggaaagagggaagaccaatggtgcggctccctgatcggcttgacagcccgagctacctgggccactaatattcaggtggcaatcaaccaggtcagacggctgattgggaatgagaactacctcgatttcatgacatctatgaaaaggtttaagaatgaatcagacaccgagggagctctttggtga

SEQ ID NO: 13284 - RNA, 9879 nt, synthetic construct
  misc_feature 1..9879: note = derived and/or modified CDS sequence (opt3) from DENV-1__FJ639677__SS-prME
  source 1..9879: mol_type = other RNA
agcgtgaccatgctgctcatgcttatgcccacagcactggctttccacttgactacgaggggaggggaacctcatatgatcgtctccaagcaggaaaggggaaagtctttactgtttaagacctcagccggtgttaacatgtgcacactaattgccatggacctcggcgaactgtgtgaagatactatgacctacaaatgcccacgggtgacagaggcggaaccggacgatgtagactgttggtgcaatgctaccgatacttgggtgacatatgggacctgtagtcaaacgggagagcaccgccgagacaagcgtagcgtcgcccttgcaccccatgtgggcctgggtttggagactagaaccgaaacatggatgtcctctgagggggcctggaaacagatacagagggttgaaacttgggctctccggcaccctggattcaccgtgatcgcactgtttctggcccatgctattggcacatcgatcacccagaagggcattatcttcatactcttaatgctggtcacgccatcaatggccatgcgctgcgtggggatcggaagcagggattttgtagagggtcttagtggcgcgacttgggttgacgtggtcttggagcacgggtcctgtgtgacaaccatggcaaaggataaacccactctggacattgaactactcaagacagaggtgaccaaccctgccgtcctgaggaaactttgcatcgaagctaagatttctaatacgaccacagatagccggtgtccaactcaaggagaggccaccctggttgaagaacaggacgcaaacttcgtgtgccgccgaacatttgtagatagaggctggggtaatgggtgtggattgttcggcaaaggctccctcatcacttgcgctaagtttaagtgcgtgaccaaactggaggggaagatagtccagtacgaaaacttaaaatattcagtgattgttacagtgcacaccggagaccagcatcaagtcggtaatgagagtactgaacacggcacgacagccaccatcactccccaggcgcctaccacagagattcagctgaccgactacggggccctcactcttgattgtagcccaaggacaggactggacttcaacgaaatggtgttgctaacgatgaaggagaaatcttggctggtacataagcagtggtttctcgatctgccgcttccctggacctccggcgcatcaactagccaagagacatggaatcggcaggacctgttggttaccttcaaaacagctcacgccaagaagcaggaagtggtcgtgctcggtagtcaagagggggctatgcacactgccctgaccggcgcaacggaaatccagacctctggaacaactaccatctttgccggccatttaaaatgccgtctgaagatggataaactaacactcaaggggatgtcctatgtcatgtgtactgggtcgttcaaactggagaaggaagtggctgagacccagcacggtacggttcttgtgcagattaagtacgagggcacagacgcgccttgcaaaataccattctcgacccaagatgaaaagggggtaactcagaacggacgcttgatcacagcaaatcccattgtcaccgacaaagagaagcctgtgaacatcgaagccgagccaccctttggcgagtcttatatagttattggtgctggggaaaaagccctgaagctctcctggttcaagaaaggctcaagtatcggaaagatgtttgaggcaactgccagaggcgctaggcggatggccatcctgggggataccgcatgggacttcggaagcattggtggcgtgtttacatccgtcgggaaacttgtgcatcagatcttcggaacggcgtacggcgtactgttttctggtgtgagctggaccatgaagattgggataggcgttttgctcacttggctgggattaaattcacgaagtacatccctgagcatgacctgtatcgctgtcggcctagtgacactctacctgggggtgatggtccaggccgattctggatgcgttattaactggaaaggccgcgaacttaagtgtggttcagggatcttcgtgactaatgaggtgcacacctggacggaacaatataagtttcaggcagacagtccgaaaagattgagcgccgctatcggaaaggcctgggaggagggcgtatgcggtattaggtccgcaacacggctggaaaacataatgtggaaacagatctctaacgagctcaatcatattctgttagaaaacgacatgaagctgaccgtcgtggttggcgatgtggctgggatccttgcccagggcaagaagatgattcgccctcaacccatggagtacaaatattcgtggaaaagctggggcaaggcgaagatcataggggccgacgctcagaatactaccttcatcattgatggaccaaacacacctgaatgtcccgacgatcagagagcatggaatatctgggaggtcgaggactacggctttggtattttcactaccaacatctggttgaagctcagggattcctatacacaggtgtgcgaccaccgtctgatgtcagccgctataaaagatagtaaggccgttcacgcagacatggggtactggattgaatctgagaaaaatgaaacgtggaagctagcgcgggccagctttatcgaggtgaagacctgtatttggccaaaatcccatactctgtggtcaaacggagtactcgaaagcgagatgatcatacccaagatctatggcggtcctatttctcaacacaattaccgaccaggctacttcacacagaccgctgggccgtggcatctgggaaaacttgagttggatttcgacctgtgcgaaggcactacagtcgtggtggatgagcactgcgggaacagaggaccctccttaaggaccacgactgtcaccggcaagatcattcacgaatggtgttgccgcagttgtacactccctccactgcggtttagaggtgaggacgggtgctggtatggaatggagatcaggcccgttaaagaaaaggaggaaaatcttgtgaagtccatggtatctgccggctccggtgaggtggactcattcagtctgggcttgctctgtataagcattatgatcgaagaggtcatgcgctcgcgatggtcccggaaaatgctgatgaccgggactctagcagtgtttttcctgctcatcatgggacagctgacatggaacgatcttattcgtttgtgcatcatggttggcgctaatgcctctgacagaatggggatgggaaccacatacctggcattaatggccacttttaagatgaggcctatgttcgctatgggcctcctgtttcgccggcttaccagcagagaggtgctgctactcacgattggtctgtcattggtcgcgagtgtggaactgccaaactccttagaggaactcggggatggactggccatgggcataatgatccttaaactgttgacagacttccaatctcatcagctctgggcaaccctgctaagcctgacttttattaagaccacattctcccttcactatgcttggaaaactatggccatggttctctcaatcgtgagcctgtttcccttgtgtctgagtaccacgtctcagaagacaacctggttaccggtcctcctgggctcccttgggtgcaagcctctgactatgttcttgattgccgagaataaaatctggggaagaaagagctggccactcaacgaaggtataatggctgtaggcatcgtgtcgattctgctatcatctctgcttaaaaacgatgttcccctcgcagggcctctgatcgccggaggcatgttgattgcgtgttacgtgatcagtggttccagcgctgacttatctctggagaaggccgcagaggtcagctgggaagaggaagccgagcattccggggcttcacacaatatactcgtggaagtacaggatgacggaacaatgaaaattaaggatgaggagcgagacgataccctgactatccttctgaaagcaacattgctagccgtgagtggcgtctatcccctgagcatcccagcgaccctctttgtttggtacttctggcaaaagaagaaacagcgctctggcgtgctgtgggacacgccttcacccccagaagtggagcgggctgtccttgatgacgggatttatagaataatgcagaggggattactgggtcgtagccaggtgggcgttggggtattccaagaaaacgtgtttcatactatgtggcacgtcacccgcggagccgtgctcatgtaccagggcaagcggttggagccgagttgggcaagcgttaaaaaggacctgatctcctacggtgggggatggagactcaaaggctcttggaatacaggcgaggaagtgcaggtcattgccgtggagcctgggaagaaccccaagaatgtacagaccgctccaggaacattcaaaactcccgaaggtgaggtcggcgccatcgcactggattttaagcctgggacctcgggaagcccaattgtgaacagggaaggcaaaatcgttggtctttatgggaatggagtggtcacgacatcaggcacttacgtgtccgctatagcccaagcgaaggccagtcaggagggccccctgcctgagatcgaagacgaggttttccgaaaacggaacttgaccattatggatctacacccggggtctggaaagacacgcagatatctgccagcaatcgtgagggaagctattaagcggaaactccgaaccttaatcctggcccccactagagtcgtggctagcgagatggcagaagcccttaagggtatgcctatacgctaccagaccacagccgtaaaatccgagcatacgggcaaggagattgtggacctgatgtgccacgctacttttaccatgaggctcttgtcaccagttcgtgtccccaattataacatgatcatcatggatgaagcgcatttcacagacccttctagcattgcagcccgggggtacatcagtaccagagtgggaatgggcgaggctgccgcaatatttatgactgccacaccgcccggttccgtggaggctttcccacaaagcaatgcggtcattcaggatgaggaaagggacatccctgagcgctcttggaactcagggtatgagtggattaccgattttcccggaaaaacggtatggttcgtgccatccatcaagagtggcaatgacatagccaactgtctgcgaaagaatggcaaaagagttattcagctcagccggaagacttttgatacagaataccagaaaaccaagaacaacgactgggactacgtggtcaccactgatatctcggagatgggggcaaatttcagggctgaccgcgtgatcgatcctcgtagatgcctgaaacccgttattcttaaggacggaccagaacgggtgatcctagccggtccgatgcctgtcacagtggcatctgccgctcaaaggcgcggccgaattgggagaaaccacaataaggagggagatcagtatatatacatgggccagcccctgaacaatgacgaggatcatgcccactggaccgaagcgaaaatgttgttagacaacatcaatacaccagagggtattatccccgcactgttcgaacctgagcgggaaaagtccgccgctatcgatggggagtataggctccgcggcgaggccagaaaaacttttgtagaactgatgaggcggggagaccttccagtgtggctgagctacaaggttgcttcagagggcttccagtatagtgatcgtcgctggtgctttgacggggaacgaaacaatcaagtcctcgaggaaaacatggatgtggagatttggacgaaagagggagaaagaaagaaattgaggccccggtggctggacgcacgcacctactctgaccctctagccctgagagagttcaaggaatttgctgccggtaggcggtccgtgagcggcgatctcatacttgagatcgggaagctgccgcagcacttaacacagcgagcacagaatgcgttggacaacctggtcatgctccataattcagaacaaggaggcagagcctatcgccacgctatggaggagctgccagatactattgaaacccttatgctgctcgccttgatcgcagttctgacaggtggggtgaccttattctttctaagtggcaggggactgggcaaaactagcattgggctcctttgtgtaatggcttcctctgtgctgttgtggatggccagcgtcgagccccattggatcgcagcctccataatcctggagttctttctcatggtgctgcttattcctgagcccgaccggcagcgtacgccacaggataaccagctcgcttacgttgtgatcggactgttgttcatgattctgaccgtcgcggccaatgagatgggtttactagaaacaactaagaaagacctgggcatcgggcacgtagcagtggagaaccaccatcacgctgccatgctcgatgttgaccttcatcctgcctcagcatggaccctgtacgctgtggccacaaccataattactcccatgatgagacacacaatcgaaaacacgaccgcgaatatttctttgactgctatcgccaaccaagcagccatactgatgggactcgataagggctggccaatcagtaaaatggacattggtgtccctctgcttgctttagggtgctatagccaggtgaatccgctgacactcaccgcagccgtcttgatgctggtggcgcattacgctatcattggccccggactacaggccaaggcaaccagggaggcccaaaagcgcacagctgccggcatcatgaaaaacccaactgttgatgggatagtggcaattgacctggatcctgtagtgtatgacgctaagtttgaaaaacagctcggacagatcatgcttctgatcttgtgtacgagccagattctgctcatgcggaccacatgggccctgtgcgagtccatcactttagcgaccggcccccttacaaccctgtgggagggttctccagggaagttctggaatactacgatagccgtctcaatggcaaacatttttcgaggaagctacctcgctggcgccggtctagcattctccctgatgaaaagtttgggcgggggaagaaggggcacaggggctcaaggagaaaccctgggcgagaagtggaagcgccagctcaatcagctttctaaaagcgagttcaacacttataagcggtcaggtatcatggaggttgacagatccgaagccaaagaggggctgaagcgtggagagaccacaaaacacgccgtgagtaggggcactgcgaagttgcggtggtttgtcgaacgcaatctggtgaagcctgagggtaaagtaattgatctcggctgtgggcgaggaggctggagctactattgcgctgggttaaagaaagtgaccgaagttaagggatacacaaaaggcggtcccgggcacgaggaaccgatcccaatggcaacgtacggatggaacctggtgaaacttcattctggcaaagacgtcttctttatacctcccgagaagtgtgataccctgctatgcgacatcggcgagtcctcaccaaatcccactattgaagaggggagaacactcagggtgctgaagatggtcgaaccttggttgcggggaaaccagttctgtatcaaaattctgaatccgtatatgcccagcgtggttgagaccctcgagcaaatgcagcgcaagcacggtggcatgcttgtaagaaacccactgtcgagaaattctactcatgaaatgtactgggtgagttgcgggacaggaaacatcgtctccgccgtgaatatgaccagccgaatgttactgaaccggtttacgatggctcaccgtaaacctacctatgagagagatgttgacttgggcacaggtactcgccacgtggccgtcgaacccgaggtggcaaacctcgatattatcgggcagaggatagaaaatattaagcatgagcacaaatcaacctggcattacgacgaggataacccttataagacatgggcctaccacggatcctatgaagtaaagccatctggcagcgctagttccatggtgaatggcgttgtcaaactgctaactaagccctgggacgtgatccctatggtgacccagatcgcgatgacagataccactccattcgggcaacagcgggtctttaaagagaaggttgacacgagaacacccaaagccaagcgcggaaccgcacagattatggaagtgactgctaggtggctttggggtttcctgagccgatctaagaaaccgcggatatgtaccagagaggaatttatcaggaaggtacgctcaaacgccgcaattggcgccgtgttcgtcgacgagaatcaatggaacagtgctaaagaggccgtggaagatgagcgtttttgggacctcgttcatcgggaaagagagctgcacaagcaggggaaatgcgcgacatgcgtgtacaatatgatgggaaagagggaaaagaaattgggcgagttcggtaaggcaaaagggtcccgcgccatctggtacatgtggctgggagctcgatttctcgagttcgaagcccttggcttcatgaacgaggatcactggtttagccgggaaaattctctgtcgggcgtcgagggggagggattacataagctgggttatattttgagagacatctcaaaaatacctggcgggaacatgtacgcagatgacacggctggatgggataccaggatcactgaagacgatctccagaatgaggccaagattacagacatcatggaaccagagcacgctctgctagccaaagcaattttcaaacttacctatcagaacaaggtggtacgcgttcaaagacccgcgaaaaatggcactgtgatggatgtcatcagccggagggaccagcgtggttccggacaggtgggaacatacggcctgaacacctttacaaatatggaagcccagctcatacgacaaatggagagtgagggcattttctctcctagcgaactggagactccaaacttggctgaacgcgccttagattggctggagaagtatggggtggaaagactcaaacggatggcaatctccggagacgactgtgtcgttaagcccatcgatgacaggtttgctaccgcccttacggcactgaacgatatgggtaaagtgcgcaaggacattccgcagtgggagccttcaaagggctggaatgattggcagcaggtacccttctgcagtcatcactttcaccaactaataatgaaagacgggagagagatcgtggtcccatgtcggaaccaggatgaactggtgggaagggcccgagtttctcagggcgcgggttggagcctccgtgagaccgcttgcttggggaagtcctacgcccagatgtggcaactgatgtatttccatagacgcgaccttcggctggcagccaatgctatttgttcagccgtgcctgtcgattgggtgcccacaagcaggactacctggtctatccacgcacatcaccagtggatgacaactgaagacatgctctccgtatggaacagagtttggattgaggaaaatccatggatggaggataaaacccatatcagtagctgggaggacgtgccctacttaggaaagcgcgaagaccagtggtgcggctcgctgataggcttgacggctcgggccacatgggcgaccaacatccaagtcgctattaatcaggtgaggcgactgatcgggaacgagaattacctcgattatatgacttccatgaaaagatttaagaacgaatctgaccctgagggagccctttggtga

SEQ ID NO: 13285 - RNA, 9879 nt, synthetic construct
  misc_feature 1..9879: note = derived and/or modified CDS sequence (opt3) from DENV-1__GQ868618__SS-prME
  source 1..9879: mol_type = other RNA
agcgtgaccatgctgctcatgcttatgcccacagccctggctttccacttgactacgagaggaggggaacctcatatgatcgtctccaagcaggaaagggggaaatctttactgtttaagacctcagccggtgttaatatgtgcacactaattgccatggacctcggagagttctgtgaagatactatgacctacaaatgcccacggataacagaagcggaaccggacgatgtggactgttggtgcaatgctaccgatacttgggtaacatatgggacctgtagtcaaacgggagagcaccgccgagacaagcgtagcgtggccctggcaccccatgtcggccttggtctggagactagaaccgaaacatggatgtcctctgagggggcctggaaacagatccagagggtggaaacttgggctttgcggcaccctggatttaccgttattgcactcttcctggcccatgctatcggcacatcgattacccagaagggcatcatatttatcctgctcatgttagtgacgccatcaatggccatgcgctgcgtcgggattggaagcagagatttcgtggagggtctgagtggcgcgacttgggtagacgttgtgcttgagcacgggtcctgtgtcacaaccatggcaaaggataaacccactttggacatcgaactgctaaagacagaggtgaccaaccctgccgtgctcaggaaactgtgcattgaagctaagatctctaatacgaccacagatagccggtgtccaactcaaggagaggccacccttgtcgaagaacaagacgcaaactttgtttgccgccgaacattcgtggatagaggctggggtaatgggtgtggactgtttggcaaaggctccttgataacttgcgctaagttcaagtgcgtaaccaaactcgaggggaagattgtgcagtacgaaaacctgaaatattcagtcatcgtgacagttcacaccggagaccagcatcaagtgggtaatgagagtactgaacacggcacgacagccaccattactccccaggcgcctagcaccgagatccagttaacagactacggggccctgaccctcgattgttctccaaggactggacttgactttaacgaaatggtcctgttgacaatgaaggagaaatcctggctagtgcataagcagtggttcctggatctcccgctgccctggacgtcaggcgcaagcaccagtcaagagacttggaatcggcaggaccttctggtaacatttaaaaccgctcacgccaagaagcaggaagttgtggtcttgggttctcaagagggggctatgcacacagccctcactggcgcaaccgaaatccagacgtccggaaccacaactattttcgccggccatctgaaatgccgtttaaagatggataaactgaccctaaaggggatgagctatgtgatgtgtacaggatcgttcaaactcgagaaggaagtcgctgagactcagcacggtaccgtgctggttcagataaagtacgagggcacggacgcgccttgcaaaatcccattttctacacaagatgaaaagggggtgacccagaacggacgccttattactgcaaatcccatcgtaacagacaaagagaagcctgtcaacatagaagccgagccacccttcggcgagtcctatattgtgatcggtgctggggaaaaagccttgaagctgtcatggtttaagaaaggcagtagcatcggaaagatgttcgaggcaaccgccagaggcgctaggcggatggccattctcggggatactgcatgggactttggatccatcggtggcgttttcacctctgtggggaaactggtccatcagatttttggaacagcgtacggcgtgcttttcagcggtgtatcatggacgatgaagatagggatcggcgtgctgttgacctggctcggactgaatagtcgatccactagcttatctatgacatgtattgctgttggcctggtcaccctatacctcggggtgatggtgcaggccgattcaggatgcgtcatcaactggaaaggccgcgaactgaagtgtggtagtgggatctttgttacaaatgaggtgcacacttggaccgaacaatataagttccaggcagacagcccgaaaagactttccgccgctattggaaaggcctgggaggagggcgtgtgcggtataaggtctgcaacgcggttggaaaacatcatgtggaaacagatttcgaacgagctgaatcatatcctcctggaaaacgacatgaagtttacagtagtcgtgggcgatgttgctgggattttagcccagggcaagaagatgatccgccctcaacccatggagtacaaatatagctggaagtcctggggcaaggcgaaaataatcggggccgacgtgcagaataccactttcattatcgatggaccaaacacccctgaatgtcccgacgatcagagagcttggaatatttgggaggtcgaggactacggctttggtatcttcacaactaacatatggctgaaacttagggattcatatacccaggtgtgcgaccaccgtttgatgagtgcagccattaaagattctaaggctgttcacgccgacatggggtactggatcgaaagcgagaaaaatgaaacatggaagctcgcacgggcgtccttcattgaggtgaagacgtgtatctggccaaaatcacataccctgtggagcaacggagtactagaatctgagatgataatccccaagatttatggcggtcctatctcccaacacaattaccgaccaggctactttactcagacagccgggccgtggcatctgggaaaactcgagctggatttcgacctttgcgaaggcaccactgtcgtggtggatgagcactgcgggaacagaggacccagtttgaggacaaccacggtcactggcaagattatccacgaatggtgttgccgcagctgtaccctgcctccattacggtttaaaggtgaggacgggtgctggtatggaatggagataagacccgttaaggaaaaggaggaaaatctcgtgaaatctatggtatccgctggctcaggtgaggtggacagtttcagcctgggccttctgtgtatttcgatcatgatcgaagaggtcatgaggtcccgctggtctcgaaagatgttgatgacagggaccctcgccgtgtttttcctgctaattatgggacagctgacttggaacgatctcatccggctgtgcattatggttggcgcaaatgctagcgaccgtatggggatgggaacaacctaccttgccttgatggcaacatttaaaatgagacctatgttcgccgtgggcctgttatttaggcgcctcacttcacgggaggtcctgcttctgaccataggtctaagtctcgtggcttccgttgaactgccaaactctttggaggaactgggggatggattagcgatgggcatcatgattctcaagctgcttacggacttccaaagccatcagctgtgggccacattgctctccctgacctttatcaaaactaccttctcactacactatgcatggaagacaatggctatggtgctgagcattgtcagtctttttcccctctgtctgtctactacctcccagaagacgacatggttgccggtactgttaggcagcctcgggtgcaaacctctgaccatgttccttatcgccgagaataagatatggggaagaaaatcgtggccactgaacgaaggtatcatggccgtgggcattgtttcaatcttgctctctagtctgctaaagaacgatgtgcccctggctgggcctcttattgcaggaggcatgctcatcgcctgttacgtcatatccggtagctctgcggacctgagcttggagaaagctgccgaggtgtcctgggaagaggaagcagagcattcaggggccagtcacaatattttagtagaagtgcaggatgacggaactatgaagatcaaagatgaggagagggacgatacactgaccatcctcctgaaggctactcttctggcagtcagcggcgtttatcccttgtctattccagccacactattcgtgtggtacttttggcaaaagaaaaagcagcgatccggcgtgctgtgggacaccccttcacccccagaagtcgagcgcgcggtgctcgatgacgggatatatcggatcatgcagagaggactgcttggtaggagtcaggttggcgtaggggtgttccaagaaaacgtctttcatacgatgtggcacgtgactcgtggagctgttttaatgtaccagggcaaacgcctggagccgagctgggcctccgtgaagaaagacctcatttcttacggtgggggatggcggttgcagggctcgtggaataccggcgaggaagtccaggtgatcgcagtagagcctgggaagaaccccaagaatgtccaaacagccccaggaaccttcaaaacaagcgaaggtgaggtgggcgctattgccctggattttaagcccgggacttcaggatcccctatcgttaacagagaaggcaaaatagtgggtctctatgggaatggagtcgtgaccacgagtggcacatacgtttctgcaatcgctcaggccaaggcgagccaggagggcccactgcccgagattgaagacgaggtgttcaggaaacgaaaccttactatcatggatctgcaccctgggtccggaaagacccggcgctatttgccggccattgtcagagaagcaatcaagaggaaactacggacactgatactcgctccaacccgagtggtagcctcagagatggctgaagcattaaagggtatgcccattagataccaaactaccgccgtgaaatctgagcatacaggcaaggagatcgttgacctgatgtgccacgccacgtttactatgcgccttctgagccctgtcagggtgccaaattataacatgatcattatggatgaagctcatttcaccgaccccagttccatcgcggcacgtgggtacataagcacacgggtgggaatgggcgaggccgctgccatttttatgaccgcaactcctccgggttctgtcgaagccttcccccagtcaaatgctgtaatccaggatgaggaaagagacattccagagaggtcctggaacagtgggtatgagtggatcacagattttcctggaaaaaccgtgtggttcgttcccagcataaagtcgggcaatgacattgcgaactgtctccgcaagaatggcaaacgagtgatccagttgtctagaaagacgttcgatactgaataccagaagacaaagaacaacgactgggactacgtcgtgaccaccgatatctccgagatgggggccaattttcgggcagacagggttattgatccacgccgttgcctgaaacctgtgatcctcaaggacggacccgaaagagtcattctggctggtccaatgccggtgactgtagccagcgcagcccagcggaggggccgcatagggcgaaaccacaataaggagggagatcagtatatctacatgggccagcctcttaacaatgacgaggatcatgctcactggacagaagccaaaatgctactggacaacattaatacccccgagggtatcatcccagcgttgttcgaacccgagagagaaaagtcagcagccattgatggggagtatcggttaaggggcgaggctcgcaaaacatttgtggaactgatgagaaggggagacctccctgtttggctgagttacaaggtcgcctctgagggcttccaatattccgatcggcgttggtgctttgacggggaacgcaacaatcaggtgcttgaggaaaacatggatgtggagatatggactaaagagggagaacgaaagaaactgagaccaaggtggctcgacgctcggacgtacagcgaccccttggcactgcgcgagttcaaggaatttgccgctggtagaaggtcagtcagtggcgatctaatcctggagattgggaagctccctcagcaccttacccagcgggcccaaaatgcactggacaacttagttatgttgcataatagcgaacagggaggccgagcgtatagacacgccatggaggagctgccggatacaatcgaaactctcatgctgcttgctctgattgccgtgctcaccggtggggtaacattgttctttctgtccggccgcggattaggcaaaacctctatcgggctactgtgtgtgatggcaagctccgtcctcctttggatggcttcagtggagccacattggatagccgcatctatcattctggagttctttttgatggttctgctcatccccgagcctgacaggcagcggactccccaggataaccaactggcctacgtggtcattggacttctcttcatgatcctgacggtagctgcgaatgagatgggtttgctggaaaccacaaagaaagacttaggcatagggcacgtggccgttgagaaccaccatcacgcagctatgctagatgtggacctgcatccagccagtgcctggactctctacgcagtcgctaccacaattatcacccctatgatgcgtcacactattgaaaacacaacggccaatatctcgcttaccgcgatagctaaccaggccgcaatcctgatgggattggataagggctggcccattagcaaaatggacatcggtgtgccactgctcgccctggggtgctattcccaggtcaatcctcttactttaacagctgcagtgctgatgctcgttgcccattacgcgattatcggcccgggattgcaagctaaggccaccagagaggcacagaagaggaccgccgctggcataatgaaaaaccccacagtggatgggattgtagccatcgacctggatccagtggtctatgacgcaaagtttgaaaaacagctaggacagatcatgctgctcattctttgtacttctcaaatcctgttgatgcgcacgacctgggctctgtgcgagtcaataacactcgccactggccctctgaccacattatgggagggtagccccgggaagttctggaataccactattgcggtttccatggccaacatcttccggggaagttaccttgcaggcgctggtctggccttttctctcatgaaaagcctaggcgggggacgaagaggcacgggggcacagggagaaacactgggcgagaagtggaagaggcagttgaatcagctgtcaaaatccgagttcaacacctataagcgcagtggtattatggaggtggaccggagcgaagctaaagaggggctcaagagaggagagactaccaaacacgccgtctctcgtggcacagccaaacttaggtggtttgtggaacggaatctggtaaagccagagggtaaagtgatcgatttgggctgtgggcgcggaggctggtcctactattgcgcggggctgaagaaagttactgaagtgaagggatacaccaaaggcggtcctgggcacgaggaacccataccgatggctacatacggatggaacctcgtcaagttacattcaggcaaagacgtgttctttatcccacctgagaagtgtgatacgctgctttgcgacattggcgagagctcgcccaatccaaccatcgaagaggggcgaactctgagagtcctaaagatggtggaaccctggctcaggggaaaccaattctgtattaaaatcctgaatccttatatgccgtctgttgtagagacattggagcagatgcagcggaagcacggtggcatgctggtgcgcaaccccctcagtagaaattccacccatgaaatgtactgggtcagctgcgggactggaaacattgtgtcagcagttaatatgacatccaggatgcttctgaaccgatttaccatggcccaccggaaaccaacgtatgagcgtgatgtggacttaggcgctggtaccagacacgtcgccgtggaacctgaggtagcaaacctggatatcatagggcagcgcattgaaaatatcaagcatgagcacaaatctacatggcattacgacgaggataacccctataagacttgggcctaccacggaagctatgaagtgaagcctagtggctccgctagctctatggttaatggcgtcgtgaaattgctcaccaagccatgggacgtgatccccatggtcacacaaattgcgatgactgataccacacctttcgggcagcagagggtttttaaagagaaggtggacacccggactccaaaagccaagagaggaacggcacaaataatggaagtaacagctaagtggctgtggggtttcctatcacgcaacaaaaagcccaggatctgtacccgagaggaatttactcggaaagtgagaagtaatgccgcaattggcgccgtcttcgtggacgagaaccagtggaactccgctaaggaggccgttgaagatgagaggttttgggaccttgtgcatcgcgaacgtgagctgcacaaacaggggaagtgcgcgacctgcgtctacaacatgatgggaaagcgggagaaaaagctcggcgagttcggtaaagcaaaggggagcagagccatctggtacatgtggctgggagctaggttcttggagtttgaagccctgggcttcatgaatgaggatcactggttttctcgcgaaaactcgctctcaggcgtggagggggagggacttcataaactgggttatattttacgagacatcagcaagataccgggcgggaatatgtacgcagatgacacagctggatgggatacgcggatcaccgaagacgatctgcagaacgaggccaaaattactgacatcatggaacctgagcacgctttgctcgccaagtccattttcaagctgacatatcaaaataaagtagttagagtgcagaggccagcaaagaacggcaccgtcatggatgtgatcagtcgcagagaccagcggggttctggacaggtgggaacttacggcctaaatacatttaccaacatggaagcgcaacttataaggcagatggagagcgagggcattttctccccctcagaactggagacacctaacctcgccgaacgtgtcctggattggttggagaaacatggggttgaacgattaaagcgcatggctatcagtggagacgactgtgtggtaaaaccaatcgatgacagatttgccactgcactgaccgctctcaatgatatgggtaaggtgcggaaggacattccccagtgggagccgtctaaaggctggaacgattggcagcaagtccctttctgcagccaccactttcatcagcttataatgaaggacgggagggagatcgtggttccctgtcgcaatcaggatgaactggtgggcagagcacgggtctcccagggcgcaggttggtcactaagggagacggcctgcctggggaaaagctatgcgcaaatgtggcagctcatgtacttccaccgacgtgacttgagactggctgccaacgcaatttgttctgccgtgccagtagattgggttcctacctcccgcacaacttggagtatccatgctcaccatcagtggatgaccacagaagacatgcttagcgtgtggaatcgggtctggattgaggaaaacccctggatggaggataagactcacatctcgtcctggggagacgtgccatatctgggcaaaagggaggaccaatggtgcggctctctcatagggttaaccgccagagcaacgtgggctacaaatatccaggttgccattaaccaggtgcgccggctgatcggaaatgaaaactacttggattacatgacctcaatgaagaggtttaagaatgagagcgaccccgaaggtgcgctgtggtga

SEQ ID NO: 13286 - RNA, 9879 nt, synthetic construct
  misc_feature 1..9879: note = derived and/or modified CDS sequence (opt3) from DENV-1__GQ868619__SS-prME
  source 1..9879: mol_type = other RNA
agcgtgacaatgctgctcatgcttatgcccacagcactggctttccacttgactacgaggggaggggaacctcatatgatcgtctccaagcaggaaaggggaaaatctttactgtttaagacctcagccggtgttaatatgtgcacattaattgccatggacctcggcgagctgtgtgaagatactatgacctacaaatgcccacggataacagaggcggaaccggacgatgtggactgttggtgcaatgctaccgatacttgggtaacatatgggacctgtagtcaaacgggagagcaccgccgagacaagcgtagcgtggcccttgcaccccatgtcggcctgggtttggagactagaaccgaaacatggatgtcctctgagggggcctggaaacagatccagagggtggaaacttgggctctccggcaccctggattcaccgttattgcactgtttctggcccatgctatcggcacatcgattacccagaagggcatcatattcatcctcttaatgctggtgacgccatcaatggccatgcgctgcgtcgggattggaagcagagattttgtggagggtcttagtggcgcgacttgggtagacgttgtgttggagcacgggtcctgtgtcacaaccatggcaaaggataaacccactctggacatcgaattgctcaagacagaggtgaccaaccctgccgtgctgaggaaactttgcattgaagctaagatctctaatacgaccacagatagccggtgtccaactcaaggagaggccaccctggtcgaagaacaggacgcaaacttcgtttgccgccgaacatttgtggatagaggctggggtaatgggtgtggattgttcggcaaaggctccctcataacttgcgctaagtttaagtgcgtaaccaaactggaggggaagattgtgcagtacgaaaacttaaaatattcagtcatcgtgacagttcacaccggagaccagcatcaagtgggtaatgagagtactgaacacggcacgacagccaccattactccccaggcgcctaccacagagatccagctgaccgactacggggccctcactcttgattgtagcccaaggacaggactggacttcaacgaaatggtcttgctaacgatgaaggagaaatcttggctggtgcataagcagtggtttctcgatctgccgcttccctggacctccggcgcatcaactagccaagagacatggaatcggcaggacctgttggtaaccttcaaaacagctcacgccaagaagcaggaagttgtggtcctcggtagtcaagagggggctatgcacactgccctgaccggcgcaacggaaatccagacctctggaacaactaccatttttgccggccatttaaaatgccgtctgaagatggataaactaacactcaaggggatgtcctatgtgatgtgtactggttcgttcaaactggagaaggaagtcgctgagacccagcacggtacggtgcttgttcagataaagtacgagggcacagacgcgccttgcaaaatcccattctcgacccaagatgaaaagggggtgactcagaacggacgcttgattacagcaaatcccatcgtaaccgacaaagagaagcctgtcaacatagaagccgagccaccctttggcgagtcttatattgtgatcggtgctggggaaaaagccctgaagctctcctggttcaagaaaggctcaagtatcggaaagatgtttgaggcaactgccagaggcgctaggcggatggccattctgggggataccgcatgggacttcggaagcatcggtggcgtttttacatccgtggggaaacttgtccatcagattttcggaacggcgtacggcgtgctgttttctggtgtaagctggaccatgaagatagggatcggcgtgttgctcacttggctgggattaaattcacgaagtacatccctgagcatgacctgtattgctgttggcctagtcacactctacctgggggtgatggtgcaggccgattctggatgcgtcatcaactggaaaggccgcgaacttaagtgtggttcagggatcttcgttactaatgaggtgcacacctggacggaacaatataagtttcaggcagacagtccgaaaagattgagcgccgctattggaaaggcctgggaggagggcgtgtgcggtataaggtccgcaacacggctggaaaacatcatgtggaaacagatttctaacgagctcaatcatatcctgttagaaaacgacatgaagctgaccgtagtcgtgggcgatgttgctgggattcttgcccagggcaaaaagatgatccgccctcaacccatggagtacaaatattcgtggaaaagctggggcaaggcgaaaataatcggggccgacgctcagaatactaccttcattatcgatggaccaaacacacctgaatgtcccgacgatcagagagcatggaatatttgggaggtggaggactacggctttggtatcttcactaccaacatatggttgaagctcagggattcctatacacaggtctgcgaccaccgtctgatgtcagccgctattaaagatagtaaggccgtgcacgcagacatggggtactggatcgaatctgagaaaaatgaaacgtggaagctagcgcgggccagctttattgaggttaagacctgtatctggccaaaatcccatactctgtggtcaaacggagtgctcgaaagcgagatgataatccccaagatttatggcggtcctatctctcaacacaattaccgaccaggctacttcacacagaccgctgggccgtggcatctgggaaaacttgagttggatttcgacctgtgcgaaggcactacagtagtcgtggatgagcactgcgggaacagaggaccctccttaaggaccacgactgtgaccggcaagattatccacgaatggtgttgccgcagttgtacactccctccactgcggtttagaggtgaggacgggtgctggtatggaatggagataaggcccgtcaaagaaaaggaggaaaatcttgttaagagcatggtgtctgccggctccggtgaggtagactcattcagtctgggcttgctctgtattagcatcatgatcgaagaggtgatgcgctcgcgatggtcccggaaaatgctgatgaccgggactctagtcgtgtttttcctgctcattatgggacagctgacatggaacgatcttatccgtttgtgcattatggttggcgcaaatgcttctgacagaatggggatgggaaccacatacctggccttaatggcaacttttaagatgaggcctatgttcgccgtgggcctcctgtttcgccggcttaccagcagagaggtcctgctactcacgataggtctgtcattggtggctagtgttgaactgccaaactccttagaggaactcggggatggactggcgatgggcatcatgattcttaaactgttgacagacttccaatctcatcagctctgggccaccctgctaagcctgacttttatcaagaccacattctcccttcactatgcatggaaaactatggctatggtgctctcaattgtcagcctgtttcccttgtgtctgagtaccacgtctcagaagacaacctggttaccggtactcctgggctcccttgggtgcaagcctctgactatgttcttgatcgccgagaataaaatatggggaagaaagtcctggccactcaacgaaggtatcatggccgtgggcattgtttcgatcctgctatcatctctgcttaaaaacgatgtgcccctcgctgggcctctgattgcaggaggcatgttgatcgcctgttacgtcataagtggttccagcgcggacttatctctggagaaggctgccgaggtgagctgggaagaggaagcagagcattccggggcctcacacaatattctcgtagaagtgcaggatgacggaacaatgaaaatcaaggatgaggagcgagacgataccctgactatccttctgaaagctacattgctagcagtcagtggcgtttatcccctgagcattccagccaccctctttgtgtggtacttctggcaaaagaagaaacagcgctctggcgtgctgtgggacacgccttcacccccagaagtcgagcgggcggtgcttgatgacgggatatatagaatcatgcagaggggattactgggtcgtagccaggttggcgtaggggtgttccaagaaaacgtctttcatactatgtggcacgtgacccgcggagctgttctcatgtaccagggcaagcggttggagccgagttgggccagcgtgaaaaaggacctgatttcctacggtgggggatggagactccagggctcttggaatacaggcgaggaagtccaggtgatcgcagtagagcctgggaaaaaccccaagaatgtccaaaccgccccaggaacattcaagactcccgaaggtgaggtgggcgctattgccctggattttaaacctgggacctcgggaagcccaatcgttaacagggaaggcaagatagtgggtctttatgggaatggagtcgtgacgacatcaggcacttacgtttccgcaatcgctcaggccaaagcgagtcaggagggccccctgcctgagattgaagacgaggtgttccgaaagcggaacttgaccatcatggatctacacccggggtctggaaaaacacgcagatatctgccagccattgtcagggaagcaatcaagcggaagctccgaaccttaatactggctcccactagagtggtagccagcgagatggctgaagcacttaaaggtatgcctattcgctaccaaaccacagccgtgaagtccgagcatacgggcaaagagatcgttgacctgatgtgccacgccacttttaccatgaggctcttgtcaccagtccgtgtgcccaattataacatgatcattatggatgaagctcatttcacagacccttctagcatcgcggcacgggggtacataagtaccagagtgggaatgggcgaggccgctgccatttttatgactgcaacaccgcccggttccatggaagccttcccacagagcaatgctgtcatccaggatgaggaaagggacattcctgagcgctcttggaactcagggtatgagtggatcaccgattttcccggaaagacggtatggttcgtgccatccataaaaagtggcaatgacattgcgaactgtctgcgaaagaatggcaagagagttatccagctcagccggaaaacttttgatacagaataccaaaagaccaaaaacaacgactgggactacgtggtcaccactgatatctcggagatgggggccaatttcagggcagaccgcgtgattgatcctcgtagatgcctgaagcccatcattcttaaagacggaccagaacgggttatactagctggtccgatgcctgtgacagtcgcctctgcagcccagaggcgcggccgaatcgggagaaaccacaataaggagggagatcagtatatttacatgggccagcccctgaacaatgacgaggatcatgctcactggaccgaagccaagatgttgttagacaacatcaatacaccagagggtatcattcccgcgctgttcgaacctgagcgggaaaaatccgcagccatagatggggagtataggctccgcggcgaggctagaaagacttttgtggaactgatgaggcggggagaccttccagtatggctgagctacaaagtggcctcagagggcttccaatatagtgatcgtcgctggtgctttgacggggaacgaaacaatcaggttctcgaggaaaacatggatgtcgagatctggacgaaggagggagaaaggaaaaagttgaggccccggtggctggacgctcgcacctactctgaccctctagcactgagagagttcaaagaatttgccgctggtaggcggtccgtgagcggcgatctcattcttgagatcgggaagctgccgcagcacttaacacagcgagcccaaaatgcattggacaacctggtgatgctccataattcagaacagggaggcagagcgtatcgccacgccatggaggagctgccagatactattgaaacccttatgctgctcgctttgatcgccgtcctgacaggtggggttatgttattctttctaagtggcaggggactgggcaagaccagcatagggctcctttgtgtgatggcatcctctggactgttgtggatggctagcgtagagccccattggatcgccgcatccattatcctggagttctttctcatggtgctgcttattcctgagcccgaccggcagcgtactccacaggataaccaactcgcctacgtcgtgatgggtctgttgttcatgatcctgacggttgctgcgaatgagatgggcttactagaaaccaccaaaaaggacctggggataggacacgtggccgtcgagaaccaccatcacgcagctatgctcgatgtagaccttcatcctgcctcagcctggactctgtacgcagtggctaccacaattatcacccccatgatgagacacactattgaaaacacaacggccaatatctctttgaccgcgatagctaaccaggccgcaatcctgatgggcctcgataaaggttggccaattagtaagatggacatcggggttcctctgcttgccttaggctgctatagccaggtgaatccgctgactctcacagctgcagtcttgatgctggtggcccattacgcgattatcggacccggcctacaagctaaagccaccagggaggcacagaagcgcaccgccgctgggataatgaagaacccaacagtcgatggaattgtggccatcgacctggatcctgttgtgtatgacgcaaaatttgaaaagcagctcggccagatcatgcttctgattttgtgtactagccaaatcctgctcatgcggacgacctgggctctgtgcgagtccataacattagccactggtccccttaccacactgtgggaggggtctccaggaaaattctggaataccactattgcggtatcaatggccaacatctttcgaggcagctacctcgcaggagctggcctagccttctccctgatgaagagtctagggggaggcagaagggggacgggagcacagggcgaaacactgggtgagaaatggaagcgccagctcaatcagctttctaagagcgagttcaacacctataaacggtcagggattatggaggtggacagatccgaagctaaggagggactgaaacgtggcgagactaccaagcacgccgtcagtaggggtacagccaaattgcggtggtttgttgaacgcaatctggtgaagcctgagggcaaggtcatcgatctcgggtgtggacgaggcgggtggagctactattgcgcgggactaaagaaggtgactgaagtaaaaggctacaccaagggtgggcccggacacgaggaaccgataccaatggctacatacggctggaacctggtgaaacttcattctggcaaggacgttttctttatccctcccgagaaatgtgatacgctgctatgcgacattggggagtcctcaccaaatcccaccatcgaagagggaagaactctcagggtgctgaagatggtcgaaccttggttgcggggtaaccaattctgtattaagatcctgaatccgtatatgcccagcgtggtcgagacactcgagcagatgcagcgcaaacacggcgggatgcttgtgagaaacccactgtcgagaaattctacccatgaaatgtactgggttagttgcggaactggcaacattgtatccgcagtgaatatgacaagccgaatgttactgaaccggtttaccatggcccaccgtaagcctacgtatgagagagatgtcgacttgggtaccgggacacgccacgtggctgttgaacccgaggtggccaacctcgatatcataggacagaggattgaaaatatcaaacatgagcacaagtcaacttggcattacgacgaggataacccttataaaacctgggcataccacggctcctatgaagtcaagccatctggcagcgccagttccatggtgaatggggtagtgaagctgctaacaaaaccctgggacgttatccctatggtcactcaaattgctatgaccgatacaaccccattcggacagcagcgggtgtttaaggagaaagtggacactagaacgcccaaggcgaaacgcggtacagcccaaataatggaagtcaccgcaaggtggctttggggcttcctgagccgaaacaagaagccgcggatctgtactagagaggaatttaccaggaaagttcgctctaatgctgccattggggcagtgttcgtagacgagaaccagtggaactcagccaaggaggctgtggaagatgagcgtttttgggacctcgtccatcgggaaagagagctgcacaaacagggaaagtgcgccacatgcgtgtacaacatgatgggcaaaagggaaaagaagttgggtgagttcgggaaagcgaagggaagtcgcgcaatctggtacatgtggctgggcgcccgatttctcgagttcgaagctcttggcttcatgaatgaggatcactggttttcccgggaaaacagcctgtctggggttgagggagagggtttacataaactgggctatattttgagagacatctcgaagatacctgggggaaatatgtacgccgatgacacggcaggctgggataccaggatcactgaagacgatctccagaacgaggctaaaattacagacatcatggaaccagagcacgccctgctagctaaggccattttcaaacttacctatcaaaataaggtggtccgcgtgcagagacccgcaaagaacggtactgtaatggatgttatctcacggagggaccagcgtgggagcggacaggtgggcacatacggcctgaatacctttacaaacatggaagcgcaactcatacgacagatggagtccgaggggattttcagtccttctgaactggagactccaaacttggccgaacgcgctttagattggctggagaaatatggagtcgaaagactcaagcggatggccatcagcggtgacgactgtgtggtgaaacccatcgatgacaggtttgcaaccgctcttacggccctgaatgatatgggcaaggtccgcaaagacattccgcagtgggagccttccaaggggtggaacgattggcagcaagttcccttctgctcacatcactttcaccagctaataatgaaggacggaagagagatcgtggtaccatgtcggaatcaggatgaactggtgggcagggcacgagtcagtcagggtgccgggtggtctctccgtgagaccgcgtgcttgggaaaaagctacgctcaaatgtggcagctgatgtatttccatagacgcgaccttcggctggccgcaaacgccatttgttccgctgtgcctgttgattgggtgcccacatcaaggactacctggagcatccacgcccatcaccagtggatgacaactgaagacatgctctctgtctggaatagagtgtggattgaggaaaacccatggatggaggataagacccatatctccagttgggaggacgtaccctacttaggcaaacgcgaagaccaatggtgcggcagcctgatagggttgacggcacgggctacatgggccaccaatatccaggttgcgattaaccaggtgaggcgactgatcggaaatgagaactacctcgattatatgacttcgatgaagagatttaaaaatgaatccgaccctgagggtgctctttggtga

SEQ ID NO: 13287 - RNA, 9879 nt, synthetic construct
  misc_feature 1..9879: note = derived and/or modified CDS sequence (opt3) from DENV-1__FJ639678__SS-prME
  source 1..9879: mol_type = other RNA
agcgtgaccatgctgctcatgcttatgcccacagccctggctttccacttgactacgagaggcggggagcctcatatgatcgtctccaagcaggaaaggggaaaagcattactgtttaagacctctgccggtgttaacatgtgcacactaattgcgatggacctcggcgagctgtgtgaagatactatgacctacaaatgcccacggataacagaggtggaaccggacgatgtagactgttggtgcaatgctaccgatacttgggtgacatatgggacctgtccccaaacgggagagcaccgccgagaccgtagatcagtcgcccttgcacctcatgtgggcctgggtttggagactagggccgaaacctggatgagtagcgagggggcttggaagcagatccagcgggttgaaacatgggcactccgccacccaggattcactgtgattgccctgtttctggctcatgccatcggcacctccattacacagaaaggcatcatattcatcctcttaatgctggtcaccccctctatggcgatgagatgcgtggggattggaaacagggattttgtagagggtctttcgggcgcaacgtgggttgacgtggtcttggagcacgggtcatgtgtgactacaatggccaaggataagcctaccctggacatcgaactactcaaaactgaggtgacaaatccagctgtcctgcggaagctttgcattgaagccaaaatcagcaacaccacgaccgatagtcgctgtcccacacaaggagaggcaactctggttgaagagcaggacgctaatttcgtgtgccgaagaacctttgtagataggggctggggtaacgggtgtggattgttcggcaagggctccctcataacatgcgccaaatttaagtgcgtgactaagctggaggggaaaattgtccagtacgaaaatttaaagtattctgtgatcgttaccgtgcacacaggagaccagcatcaagtcggtaacgagagcaccgaacacggcactacggcgacaattacccctcaggccccaacttccgagatccagctgaccgactacggggcactcacacttgattgttcaccgcggaccggactggacttcaatgaaatggtgttgctaactatgaaagagaagagttggctggtacataaacagtggtttctcgatctgccccttccttggacaagcggcgcttctacgtcccaagagacctggaaccgtcaggacctgttggttactttcaagacagcccacgctaaaaagcaggaagtggtcgtgctcggttcacaagagggggccatgcacaccgcactgacaggcgccactgaaatccagaccagcggaacgaccacaatttttgctggccatttaaagtgccgcctgaaaatggataagctaactctcaaagggatgagttatgtcatgtgtaccggatctttcaagctggagaaagaagtggcggagacacagcacggtactgttcttgtgcagataaagtacgagggcaccgacgcaccatgcaagatccccttctccacgcaagatgaaaaaggggtaacacagaatggaagattgattaccgccaaccctatcgtcactgacaaggagaaaccagtgaatatagaagctgagcccccgtttggcgagagctatattgttatcggtgccggggaaaaggcactgaaactctcgtggttcaagaagggctcttccatcggaaaaatgtttgaggccacagctaggggcgcccggcgaatggcaattctgggggataccgcgtgggacttcggatcaatcggtggcgtgtttactagtgtcgggaagcttgtgcatcagattttcggaaccgcttacggcgtactgtttagcggtgtgtcctggacaatgaaaatagggatcggcgttttgctcacgtggctgggattaaactctcgcagcacctcactgagtatgacttgtattgccgtcggcctagtgacactctacctgggggtgatggtccaggcagattccggatgcgttatcaattggaagggcagagaacttaaatgtggtagcgggatcttcgtgaccaacgaggtgcacacatggactgaacaatataagtttcaggccgactctcctaagaggttgtcagctgccattggaaaagcatgggaggagggcgtatgcggtatacggagtgctacccgcctggaaaacatcatgtggaagcagattagcaatgagctcaaccatatcctgttagaaaatgacatgaaattcacggtcgtggttggcgatgtggtcgggattctggcccagggaaagaaaatgatcagaccccaaccaatggagtacaagtattcctggaaatcttggggcaaggcgaagataatcggggccgacattcagaacacaacctttatcattgatggacctaatactcccgaatgtccagacgatcagagggcttggaacatctgggaggtggaggactacggcttcggtatatttaccacaaatatttggcttaaattgcgtgattcgtatactcaggtttgcgaccaccggctcatgagcgcagccatcaaggattccaaagctgtgcacgccgacatggggtactggattgaatcagagaagaacgaaacctggaaactggcacgagcgagtttcatcgaggtaaagacatgtatatggcccaagtctcatacgctatggagcaatggagtcctggaatccgagatgatcattcctaaaatctatggcggtccaatttcacaacacaactacagaccgggctacttcacccagactgccgggccctggcatctcggaaagctggagcttgattttgacttgtgcgaaggcacaaccgtggtggtcgatgagcactgcgggaataggggacctagcctgcgcactacaaccgttacgggcaaaatcatacacgaatggtgttgccggtcttgtactttaccacccctcagattcaagggtgaggacgggtgctggtatggaatggagattaggcctgtgaaagaaaaggaggaaaacctggtaaagtccatggtgagtgctggcagcggtgaggtcgactctttttcccttggcctgttgtgtatctcaatcatgattgaagaggtgatgcgcagtcgatggagccggaaaatgctcatgaccgggacactggccgttttctttctactgatcatgggacagctcacctggaatgatctgattcgtctttgcataatggtgggcgcaaacgcttcggacagaatggggatgggaactacatacttggccctgatggcaaccttcaagatgaggccaatgtttgccgtcggcttactcttccgccggctgacatccagagaggtgcttctgctaactatcggtctctctctggttgctagcgtggaattgcccaattcactggaggaattaggggatggactcgcgatgggcattatgatcctgaaacttctgaccgactttcaaagtcatcagttgtgggccacgctcctgtccctaacattcattaagaccactttttctctgcactatgcatggaaaaccatggctatggtccttagcatcgtatccctcctgccgttgtgtctgtcaacaactagccagaagaccacgtggttacctgtgctcctgggcagtcttgggtgcaagccactgacaatgttcttgatagccgagaacaaaatctggggaaggaagtcttggcccctcaacgaaggtattatggccgttggcatcgtgtccattctgctaagctcgctgcttaaaaatgatgtccctctcgctgggcccctgatcgcaggaggcatgttgatagcctgttacgtgatttcaggttctagtgcggacttatccctggagaaggctgccgaggtaagctgggaagaggaagcagagcattctggggccagccacaacatcctcgtggaagtccaggatgacggaaccatgaaaatcaaggatgaggagcgagacgatactctgacaattcttctgaaagctaccttgctagcagtttccggcgtgtatccactgtcaatacctgccactctctttctgtggtacttctggcaaaagaagaaacagcgcagtggcgtgctttgggacacacccagcccaccggaagtcgagcgggcggtgttagatgacgggatctatagaattatgcagaggggactgctcggtcgttctcaggttggcgtaggggtgttccaagaaaatgtctttcataccatgtggcacgtgacgcgcggagctgttttgatgtaccagggcaagcggctggagccttcctgggcctcagtgaaaaaggacctcatcagttacggtgggggatggagactgcagggcagctggaacactggcgaggaagtccaggtgattgcagtagagcccgggaaaaatccaaagaacgtccaaaccgcccccggaacattcaagacccctgaaggtgaggtgggcgctatcgcccttgattttaaaccagggacatccggatctcccatagttaatagggaaggcaagatcgtgggtctgtatgggaacggagtcgtgactacctcgggcacgtacgttagcgcaattgctcaggccaaagcgtcacaggagggccctttgccggagatcgaagacgaggtgttccgaaagcggaatctaacaattatggatctgcacccagggtccggaaaaactcgcagatatctccccgccatcgtcagggaagcaataaagcggaagttacgaaccctgattcttgctcctacaagagtggtagccagtgagatggctgaagcactgaaaggtatgccaatccgctaccaaaccactgccgtgaagtctgagcataccggcaaagagatcgttgacctcatgtgccacgccacatttacgatgaggttgctgagccccgtccgtgtgcctaactataatatgattatcatggatgaagctcatttcactgacccgtcctcaatagcggcacgggggtacatttctaccagagtgggaatgggcgaggccgctgccatctttatgacagcaacccccccaggtagcgtcgaagccttccctcagagtaacgctgtaattcaggatgaggaaagggacatccccgagcgctcctggaatagcgggtatgagtggataactgattttccaggaaagacagtgtggttcgttccttctattaaatcaggcaacgacatcgcgaattgtctccgaaagaacggcaagagagtgatccagctgtcccggaaaacctttgatacggaataccaaaagactaaaaacaatgactgggactacgtcgtgacaaccgatattagtgagatgggggccaacttcagggcagaccgcgttatcgatccccgtagatgccttaagccagtgattctaaaagacggacaggaacgggtcatactggctggtccgatgcctgtgaccgtagccagcgcagcccagaggcgcggccgaatcgggagaaatcacaacaaggagggagatcagtatatttacatgggccaacccttgaataacgacgaggatcatgctcactggactgaagccaagatgttactggacaatatcaacacaccagagggtatcattcccgcgctcttcgaacctgagcgggaaaaatcggcagccatagatggggagtataggctgcgcggcgaggctagaaagacctttgtggaacttatgaggcggggagacctgccagtttggctctcttacaaagtcgcctccgagggcttccagtatagcgatcgtcgctggtgctttgacggggaacgaaataaccaggtgttggaggaaaatatggatgtggagatctggacaaaggagggagaaagaaaaaagctgaggccccggtggctagacgctcgcacttactcagaccctctggcactcagagagttcaaagaatttgccgctggtaggcggagtgtctctggcgatcttattctggagatcgggaagttaccgcagcacttgacgcaaaaggcccagaacgcactggacaatctcgttatgctgcataactccgaacagggaggccgagcgtatagacacgccatggaggagcttccagataccattgaaacactgatgctcttggctctgatcgccgtgttaactggtggggtaaccctattctttctgagcggccgcggactcggcaaaacatcaatagggcttctgtgtgtgatggcaagtagcgctttgctgtggatggcctccgtcgagccccattggatcgcagcctctattatcctcgaattctttctgatggtgcttctcattcctgagcccgacaggcagcggaccccacaagataatcagctggcttacgttgtgatcggattgctgttcatgatattaactgtcgcggccaacgagatgggtctactggaaacgaccaagaaagacctcggcattgggcacgtagcagtggagaaccaccatcacgctacaatgcttgatgttgacctgcatcctgccagcgcctggactttgtacgcagtggctaccacaatcattacccccatgatgcgtcacactatcgaaaatacaacggccaacatatccctgaccgcgatcgctaatcaggccgcaattctcatgggactggataagggctggccaatctcaaaaatggacattggtgtccctcttttagccctggggtgctattctcaagtgaacccgctcactttgacagctgcagtcctgatgctagtggcccattacgcgatcataggccccggactgcaggctaaggccaccagagaggcacagaagaggaccgccgctggcattatgaaaaatccaacagttgatgggatcgtggccatcgacctcgatcctgtagtgtatgacgcaaagtttgaaaaacagcttggacaaattatgctgttgatcctgtgtactagtcagatactcctgatgcgcacgacctgggctttatgcgagtcgattacacttgccactggccccctgaccacactctgggagggtagcccagggaagttctggaacaccactatcgcggtctccatggccaatatttttcggggatcttacctagcaggcgctggtctggccttctcattgatgaaaagcctgggcgggggacgaagaggcacgggggcacagggagaaacactcggcgagaagtggaagaggcagcttaaccaactgtccaaaagtgaattcaatacctataagcgctctggtatcatggaggttgaccggagcgaagctaaagaggggttgaagagaggagagactacccgtcacgccgtgtcaaggggcacagccaaactgcggtggtttgtcgaacgcaacctcgtgaagcctgagggtaaggtaatagatttaggctgtgggcgaggaggctggtcctactattgcgcggggctgaaaaaggtgactgaagttaaaggatacaccaagggcggtcccgggcacgaggaaccgatcccaatggctacatacggatggaatcttgtgaaactgcatagtggcaaggacgtcttctttattcctcccgagaaatgtgatacgctactctgcgacatcggcgagagctctccaaaccccaccattgaagaggggagaactctgagggtgttgaagatggtcgaaccttggctgcggggaaatcagttctgtatcaagattctcaacccgtatatgccctccgtggttgagacacttgagcagatgcagcgcaaacacggtggcatgctggtaagaaatccattatcaaggaacagcacccatgaaatgtactgggtgtcgtgcgggactggaaatatcgtctctgcagtgaacatgacaagtcgaatgctgttgaaccggtttaccatggcccaccgtaagcctacgtatgagagagatgttgacctcggcgctggtacccgccacgtggccgtcgaacccgaggtggcaaatctggatataattgggcaaaggatcgaaaacatcaaacatgagcacaagtccacatggcattacgacgaggataatccttataaaacttgggcctaccacggaagctatgaagtaaagccatcaggctccgcttctagcatggtgaacggcgttgtcaagctacttaccaaaccctgggacgtgattcctatggtgacacagatagcgatgactgataccacaccattcgggcagcaacgggtctttaaggagaaagttgacaccagaactcccaaggccaaacagggaacggcacagatcatggaagtgacagctcgctggctgtggggtttcctcagtaggaataagaagccgcgaatttgtacccgggaggaatttactagaaaagtaaggtccaacgccgcaatcggcgccgtgttcgtcgacgagaatcagtggaacagcgctaaggaggccgtggaagatgagcgcttttgggacctggttcatcgtgaacgggagttgcacaaacaagggaagtgcgcgacctgcgtgtacaatatgatgggaaaaagagaaaagaagctgggcgagttcggtaaagcaaaggggtctagggccatttggtacatgtggctcggagctcgctttcttgagttcgaagccctgggcttcatgaacgaggatcactggttttcacgagaaaatagtttatccggcgtcgagggggagggactgcataaattgggttatatcctccgggacataagcaagatccctggcgggaacatgtacgcagatgacacagctggatgggatacgagaattaccgaagacgatctgaggaatgaggccaaaatcactgacattatggaaccagagcacgctctacttgccacatctatcttcaagctgacctatcagaacaaagtggtacgcgttcagagacccgcaaagaatggcactgtgatggatgtcatatcgcggagggaccagcgtggttcagggcaagtgggaacatacggcctcaacacctttacaaacatggaagcgcagctgattcgacagatggagagcgagggcatcttctcccctagtgaattggagactccaaatttagccgaacgcgtgctggattggctcgagaagtatggggtcgaaagacttaaacggatggctatctctggagacgactgtgttgtgaagcccattgatgacaggtttgccaccgcactgacggctctaaacgatatgggtaaagtacgcaaggacataccgcagtgggagcctagcaaaggctggaatgattggcaacaggtgcccttctgctcccatcactttcaccagctgatcatgaaggacgggagagagattgtcgtgccatgtcggaaccaggatgaactcgttggaagggcccgagtgtcacaaggcgcaggttggagtttgcgtgagaccgcctgcctggggaagtcttacgcgcagatgtggcagcttatgtatttccatagacgcgacctgcggctcgctgccaatgcaatctgtagcgccgtccctgtggattgggtacccacatccaggactacctggtcaattcacgctcatcaccaatggatgacaactgaagacatgttaagcgtttggaacagagtgtggatcgaggaaaatccatggatggaggataaaacccatatatcttcctgggaggacgtcccctacctgggaaagcgcgaagaccagtggtgcggcagtttgatcggcctgacggcccgggcaacatgggctaccaacattcaggtggccatcaatcaggttaggcgactcattgggaacgagaattaccttgattatatgactagcatgaaaagatttaagaacgaatcggaccctgagggagcgctgtggtga

SEQ ID NO: 13288 - RNA, 9879 nt, synthetic construct
  misc_feature 1..9879: note = derived and/or modified CDS sequence (opt3) from DENV-1__FJ639679__SS-prME
  source 1..9879: mol_type = other RNA
tccgtgaccatgctgctcatgcttatgcccacagcactggctttccacttgactacgagaggaggggagcctcatatgatcgtctccaagcaggaaagaggaaaatctttactgtttaagacctcagccggtgttaatatgtgcacattgattgccatggacctcggcgagctgtgtgaagatactatgacctacaaatgcccacggataacagaggcggaaccggacgatgtggactgttggtgcaatgctaccgatacttgggtaacatatgggacctgtagtcaaacgggagagcaccgccgagacaagcgtagcgtggcccttgcaccccatgtcggcctgggtttggagactagaaccgaaacatggatgtcctctgagggggcctggaaacagatccagagggtggaaacttgggctctccggcaccctggattcaccgttattgcactgtttctggcccatgctatcggcacatcgattacccagaagggcatcatattcatcctcttaatgctggtgacgccatcaatggccatgcgctgcgtcgggattggaagcagagattttgtggagggtcttagtggcgcgacttgggtagacgttgtgttggagcacgggtcctgtgtcacaaccatggcaaaggataaacccactctggacatcgaactactcaagacagaggtgaccaaccctgccattctgaggaaactttgcatcgaagctaagatatctaatacgaccacagatagccggtgtccaactcaaggagaggccaccctggtggaagaacaagacgcaaacttcgtctgccgccgaacatttgttgatagaggctggggtaatgggtgtggattgttcggcaaaggctccctcattacttgcgctaagtttaagtgcgtgaccaaactggaggggaagatcgtacagtacgaaaacttaaaatattcagtgattgtcacagtgcacaccggagaccagcatcaagttggtaatgagagtactgaacacggcacgacagccaccatcactccccaggcgcctaccacagagatccagctgaccgactacggggccctcactcttgattgtagcccaaggacaggactggacttcaacgaaatggtgttgctaacgatgaaggagaaatcttggctggtccataagcagtggtttctcgatctgccgcttccctggacctccggcgcatcaactagccaagagacatggaatcggcaggacctgttggtgaccttcaaaacagctcacgccaagaagcaggaagtagttgtgctcggtagtcaagagggggctatgcacactgccctgaccggcgcaacggaaattcagacctctggaacaactaccatatttgccggccatttaaaatgccgtctgaagatggataaactaacactcaaggggatgtcctatgtcatgtgtactggtagcttcaaactggagaaggaagtggctgagacccagcacggtacggtccttgtgcagatcaagtacgagggcacagacgcgccttgcaaaattccattctcgacccaagatgaaaagggggttactcagaacggacgcttgatcacagcaaatcccatagtgaccgacaaagagaagcctgtaaacattgaagccgagccaccctttggcgagtcttatatcgtcatcggtgctggggaaaaagccctgaagctctcctggttcaagaaaggctcaagtattggaaagatgtttgaggcaactgccagaggcgctaggcggatggccatcctgggggataccgcatgggacttcggaagcattggtggcgtgtttacatccgttgggaaacttgtgcatcagatattcggaacggcgtacggcgtcctgttttctggtgtgagctggaccatgaagatcgggattggcgtattgctcacttggctgggattaaattcacgaagtacatccctgagcatgacctgtatcgctgtgggcctagttacactctacctgggggtcatggtgcaggccgattctggatgcgtgatcaactggaaaggccgcgaacttaagtgtggttcagggattttcgtcactaatgaggttcacacctggacggaacaatataagtttcaggcagacagtccgaaaagattgagcgccgctataggaaaggcctgggaggagggcgtgtgcggtatcaggtccgcaacacggctggaaaacattatgtggaaacagatctctaacgagctcaatcatattctgttagaaaacgacatgaagttcaccgtggtagtcggcgatgtggctgggatcctggcccagggcaagaagatgatacgccctcaacccatggagtacaaatattcgtggaaaagctggggcaaggcgaagatcattggggccgacgttcagaatactacctttatcattgatggaccaaacacacctgaatgtcccgacgatcagagagcttggaatatctgggaggtggaggactacggcttcggtatatttactaccaacatttggcttaagttgagggattcctatacacaggtctgcgaccaccgtctcatgtcagcagccatcaaagatagtaaggctgtgcacgccgacatggggtactggattgaatctgagaaaaatgaaacgtggaagctggcacgggcgagcttcatcgaggttaagacctgtatatggccaaaatcccatactctatggtcaaacggagtgctggaaagcgagatgatcattcccaagatctatggcggtcctatttctcaacacaattaccgaccaggctacttcacacagaccgccgggccgtggcatctcggaaaactggagcttgattttgacttgtgcgaaggcactacagtagtcgtggatgagcactgcgggaacagaggaccctccctgaggaccacgactgtgaccggcaagatcatacacgaatggtgttgccgcagttgtacattacctccactccggttcagaggtgaggacgggtgctggtatggaatggagattaggcccgtcaaagaaaaggaggaaaatctggttaagagcatggtgtctgctggctccggtgaggtagactcatttagtcttggcctgttgtgtatcagcatcatgattgaagaggtgatgcgctcgcgatggtcccggaaaatgctcatgaccgggactctggccgtcttcctactgctcatcatgggacagctgacatggaacgatcttattcgtttgtgcataatggtgggcgcaaatgcttctgacagaatggggatgggaaccacatacctggccttaatggcaacttttaagatgaggcctatgttcgccgttggcctcctgtttcgccggcttaccagcagagaggtgctgctactcacgatcggtctgtcattggtcgctagtgtggaactgccaaactccttagaggaactcggggatggactggcgatgggcattatgatccttaaactgttgacagacttccaatctcatcagctctgggccaccctgctaagcctgacttttattaagaccacattctcccttcactatgcatggaaaactatggctatggttctctcaatcgtgagcctgtttcccttgtgtctgagtaccacgtctcagaagacaacctggttaccggtcctcctgggctcccttgggtgcaagcctctgactatgttcttgatagccgagaataaaatctggggaaggcgaagctggccactcaacgaaggtattatggccgtaggcatcgtgtcgattctgctatcatctctgcttaagaacgatgttcccctcgctgggcctctgatcgcaggaggcatgttgatagcctgttacgtgattagtggttccagcgcggacttatctctggagaaagctgccgaggtcagctgggaagaggaagcagagcattccggggcctcacacaatatcctcgtggaagtacaggatgacggaacaatgaagatcaaagatgaggagcgcgacgataccctgactattcttctgaaggctacattgctagcagtgagtggcgtctatcccctgagcataccagccaccctctttgtttggtacttctggcagaagaagaagcagcggtctggcgtgctgtgggacacgccttcacccccagaagtggagagagcggtccttgatgacgggatctataggattatgcagcgtggattactgggtcgcagccaggtgggcgttggggtattccaagaaaacgtgtttcatactatgtggcacgtcacccggggagctgtgctcatgtaccagggcaaaagattggagccgagttgggccagcgttaagaaagacctgatctcctacggtgggggatggaggctccagggctcttggaatacaggcgaggaagtgcaggtcattgcagtggagcctgggaagaaccccaaaaatgtacaaaccgccccaggaacattcaagactcccgaaggtgaggtcggcgctatcgccctggattttaagcctgggacctcgggaagcccaatagtgaaccgagaaggcaaaatcgttggtctttatgggaatggagtggtcacgacatcaggcacttacgtgtccgcaattgctcaggccaaggcgagtcaggagggccccctgcctgagatcgaagacgaggttttccggaaacgcaacttgaccattatggatctacacccggggtctggaaagacaagaaggtatctgccagccatcgtgcgggaagcaataaaacgaaagctcagaaccttaattctggctcccactcgcgtcgtggccagcgagatggctgaagcacttaagggtatgcctatcaggtaccaaaccacagccgtaaaatccgagcatacgggcaaggagatcgtggacctgatgtgccacgccacttttaccatgcgtctcttgtcaccagttcgggtccccaattataacatgattatcatggatgaagctcatttcacagacccttctagcatagcggcaagagggtacattagtaccagggtgggaatgggcgaggccgctgccatctttatgactgcaacaccgcccggttccgtggaagccttcccacagagcaatgctgtcattcaggatgaggaacgcgacatccctgagcgatcttggaactcagggtatgagtggataaccgattttcccggaaaaacggtatggttcgtgccatccattaagagtggcaatgacatcgcgaactgtctgaggaaaaatggcaagcgggttatccagctcagcaggaagacttttgatacagaataccagaaaaccaagaacaacgactgggactacgtggtcaccactgatatttcggagatgggggccaatttccgcgcagaccgtgtgatcgatcctagacggtgcctgaaacccgttattcttaaggacggaccagaaagggtgatactagctggtccgatgcctgtcacagtggcctctgcagcccagcgccgaggcagaatcgggcggaaccacaataaagagggagatcagtatatttacatgggccagcccctgaacaatgacgaggatcatgctcactggaccgaagccaagatgttgttagacaacatcaatacaccagagggtatcattcccgcgctgttcgaacctgagagggaaaagtccgcagccatagatggggagtatcgcctcagaggcgaggctaggaaaacttttgtagaactgatgcggcgtggagaccttccagtgtggctgagctacaaggttgcctcagagggcttccaatatagtgatcgccgatggtgctttgacggggaaagaaacaatcaggtcctcgaggaaaacatggatgtggagatctggacgaaagagggagaaaggaagaaattgcggccccgctggctggacgctagaacctactctgaccctctagcactgagggagttcaaggaatttgccgctggtcggcgatccgtgagcggcgatctcattcttgagatcgggaaactgccgcagcacttaacacagagagcccaaaatgcattggacaacctggtcatgctccataattcagaacagggaggccgcgcgtataggcacgccatggaggagctgccagatactattgaaacccttatgctgctcgctttgatcgccgttctgacaggtggggtgaccttattctttctaagtggccggggactgggcaagactagcatagggctcctttgtgtaatggcatcctctgtgctgttgtggatggctagcgtcgagccccattggatcgccgcatccattatcctggagttctttctcatggtgctgcttattcctgagcccgaccgtcagagaacgccacaggataaccaactcgcctacgttgtgatcggactgttgttcatgatactgaccgtcgctgcgaatgagatgggtttactagaaacaactaagaaagacctgggcattgggcacgtagccgtgggaaaccaccatcacgcagctatgctcgatgttgaccttcatcctgcctcagcctggaccctgtacgcagtggctacaaccatcattactcccatgatgaggcacacaatcgagaacacgaccgccaatatatctttgactgcgatcgctaaccaggccgcaattctgatgggcctcgataagggttggccaatcagtaaaatggacattggggtccctctgcttgccttaggctgctattcgcaagtgaatccgctgacactcaccgctgcagtcttgatgctggtggcccattacgcgatcataggacccggcctacaagctaaggccacccgcgaagcacagaaacggacagccgctgggattatgaagaacccaactgttgatggaatcgtggccatcgacctggatcctgtagtgtatgacgcaaagtttgagaaacagctcggccagattatgcttctgatcttgtgtacgagccaaatactgctcatgcgaaccacatgggctctgtgcgaatccattactttagccaccggtccccttacaaccctgtgggaggggtctccaggaaagttctggaatactacgatcgcggtctcaatggccaacatttttagaggcagctacctcgcaggagctggcctagccttctccctgatgaaaagtctagggggaggcaggcgcgggacaggagcacagggcgagaccctgggtgaaaagtggaaacggcagctcaatcagctttctaagagcgagttcaacacttataagagatcagggatcatggaagttgaccgttccgaggctaaagaaggactgaagaggggcgagaccacaaaacacgccgtgagtcggggtactgccaagttgcgctggtttgtcgagcgaaatctggtgaaacctgaaggcaaggtaatagatctcgggtgtggaagaggcgggtggagctactattgcgcgggattaaagaaagtgaccgaggttaagggctacacaaaaggtgggcccggacacgaagaaccgatcccaatggctacgtacggctggaacctggtgaaacttcattctggcaaagacgtcttctttattcctcccgaaaagtgtgataccctgctatgcgacatcggggagtcctcaccaaatcccactattgaggaaggaaggacactccgggtgctgaaaatggtcgagccttggttgcgcggtaaccaattctgtatcaagattctgaatccgtatatgcccagcgtggttgaaaccctcgagcagatgcagagaaagcacggcgggatgcttgtaaggaacccactgtcgcgaaattctactcatgagatgtactgggtgagttgcggaacaggcaacatcgtctccgcagtgaatatgaccagccggatgttactgaaccgttttacgatggcccacagaaaacctacctatgaacgcgatgttgacttgggtgctgggacaaggcacgtggccgtcgagcccgaagtggcaaacctcgatataattggacagcggatcgagaatatcaagcatgaacacaaatcaacttggcattacgacgaggataacccttataagacctgggcctaccacggctcctatgaggtaaaaccatctggcagcgctagttccatggtgaatggggttgtcaagctgctaacaaagccctgggacgtgattcctatggtgactcaaatagcgatgaccgatacaaccccattcggacagcagagagtctttaaagaaaaggttgacactcgcacgcccaaagccaagaggggtacagcacaaatcatggaggtgaccgctaaatggctttggggcttcctgagccgaaacaagaagccgcggatttgtactagagaagagtttaccaggaaagtacgctctaatgccgcaatcggggccgtgttcgtcgacgaaaaccagtggaactcagctaaggaggccgtggaggatgaacgtttttgggacctcgttcatcgggagagagaactgcacaaacagggaaagtgcgcgacatgcgtgtacaacatgatgggcaaaagggagaagaagttgggtgagttcgggaaagcaaagggaagtcgcgccatttggtacatgtggctgggcgctcgatttctcgagttcgaggcccttggcttcatgaatgaagatcactggttttcccgggagaacagcctgtctggggtcgaaggagagggtttacataaactgggctatatcttgagagacatatcgaagatccctgggggaaatatgtacgcagatgacacggctggctgggataccaggattactgaggacgatctccagaacgaagcccgcatcacagacattatggagccagaacacgctctgctagccaaatcaatcttcaaacttacctatcaaaataaagtggtaagagttcagcggcccgcaaagaacggtactgtgatggatgtcataagcaggcgtgaccagcgagggtccggacaggtgggcacatacggcctgaatacctttacaaacatggaggcgcaactcattcgccagatggaaagtgaggggatcttctctcctagcgagctggaaactccaaacttggccgctagagtgttagattggctggagaagtatggagtcgaacggctcaaaaggatggccatctccggtgacgactgtgttgtgaagcccattgatgaccgctttgcaaccgctcttacggccctgaatgatatgggcaaagtaagaaaggacataccgcagtgggagccttcaaaagggtggaacgattggcagcaagtgcccttctgcagtcatcactttcaccagctaatcatgaaggacggacgggaaattgtcgtgccatgtaggaatcaggatgagctggttggccgagcacgtgtgtctcagggtgccgggtggagcctcagagagaccgcgtgcttgggaaagtcctacgctcaaatgtggcagctgatgtatttccatcgccgggaccttaggctggccgcaaacgccatctgttcagctgtccctgtggattggattcccacaagcagaactacctggtctatccacgcccatcaccagtggatgacaactgaagacatgctctccgtatggaatcgcgtttggatagaggaaaacccatggatggaggataaaacccatatcagtagctggggcgacgtgccctacttaggcaagcgggaagaccaatggtgcgggtcgctgattggattgacggcaagggctacatgggccaccaatatccaggtcgcgattaaccaggtgcgaagactgatcggtaatgagaactacctcgattatatgacttccatgaaacggtttaagaatgagtctgaccctgaaggcgctctttggtga

SEQ ID NO: 13289 - RNA, 9879 nt, synthetic construct
  misc_feature 1..9879: note = derived and/or modified CDS sequence (opt3) from DENV-1__FJ850069__SS-prME
  source 1..9879: mol_type = other RNA
tccgtgaccatgctgctcatgcttatgcccacagccctggctttccacttgactacgcggggaggggaacctcatatgatcgtcggaaagcaggaaaggggtaaatccttactgtttaagacctctgcaggagttaacatgtgcacactgattgccatggacctcggggagctgtgtgaagatactatgacctacaaatgcccacggataacagaggtggaaccggacgatgtagactgttggtgcaataccactgatacatgggtgacctatggaacgtgttcacaaactggcgagcaccgccgagacaagcgtagtgtcgcgcttgctccccatgtgggtctggggttggagaccagagccgaaacatggatgagctccgagggagcatggaaacagatccagagggttgaaacttgggccctccggcaccctggcttcaccgtgattgctctgtttctggcacatgtcatcggcacatctattacccagaaggggatcatattcatcctcttaatgctggtgacgccatcgatggccatgcgctgcgtaggaattggttcaagagattttgttgagggccttagcggggctacttgggtggacgtcgtgttggagcacggaagttgtgtgacaaccatggccaaggataaacccactctggacatcgaactactcaagacagaggtcaccaaccctgcggttctgaggaaactttgcattgaagcaaagatctccaatacgaccacagattctcggtgtccaactcaaggcgaggccaccctggtggaagaacaagacgctaacttcgtatgccgccgaacatttgtggatagaggttgggggaatggatgtggcttgttcggcaaagggagcctcataacttgcgccaagtttaagtgcgtcaccaaactggagggaaagattgtgcagtacgaaaacttaaaatattccgttatcgtgacagtccacaccggtgaccagcatcaagtgggcaatgagtcaactgaacacgggacgacagcaaccattactccccaggctcctaccagtgagatccagctgacagactacggagccctcacccttgattgtagcccaaggactggcctggacttcaacgaaatggtattgctaacaatgaaggagaaatcttggctggttcataagcagtggtttctcgatctgccgcttccctggacgtccggtgcgtcaaccagccaagagacttggaatcggcaggacctgttggtgacattcaaaaccgcccacgcaaagaagcaggaagtcgtggtcctcgggagtcaagagggcgctatgcacacagccctgactggagctaccgaaatccagacgtctggcaccacaactatttttgccgggcatttaaaatgccgtctgaagatggataaactaaccctcaagggaatgtcctatgtgatgtgtacaggtagcttcaaactggagaaggaagttgcagagactcagcacggcaccgtgcttgtacagataaagtacgaggggacggacgccccttgcaaaatcccattctcgacacaagatgaaaagggagtcacccagaacggccgcttgattactgctaatcccatcgtgacagacaaagagaagcctgttaacatagaagcggagccaccctttggtgagtcttatattgtgatcggggcaggcgaaaaagccctgaagctctcctggttcaagaaaggatcaagtatcggcaagatgtttgaggctaccgccagaggggcaaggcggatggccattctgggagatactgcttgggacttcggtagcatcggcggggtctttacctccgtgggaaaacttgtacatcagattttcggcacagcctacggtgtgctgttttctggggttagctggacgatgaagataggcatcggagtcttgctcacctggctgggcttaaattcacgaagtacttccctgagcatgacatgtattgcagtggggctagtgaccctctacctgggagtcatggttcaggcggattctggctgcgtgatcaactggaaaggtcgcgaacttaagtgtgggtcaggaatcttcgtgacaaatgaggtacacacttggaccgaacaatataagtttcaggctgacagtccgaaaagattgagcgccgcaattggcaaggcctgggaggagggtgtctgcggcataaggtccgctacgcggctggaaaacatcatgtggcgccagatttctaacgagctcaatcatatcctgttagaaaacgacatgaaattcacagtggttgtgggggatgtcgtgggcattctggcccagggcaagaaaatgatcagacctcaacccatggagcacaagtactcgtggaaaagctgggggaaggcaaagataatcggagctgacgttcagaataccacttttattatcgatggcccaaacacccctgaatgtcccgacgatcagagggcctggaatatttgggaggtggaggactatggtttcgggatctttacaactaacatatggcttaaattgcgtgattcctacacccaggtatgcgaccaccggctcatgtcagcggccattaaggatagtaaagctgtccatgcagacatgggatattggatcgaatctgagaagaatgaaacatggaaactggcccgagctagcttcattgaggtgaagacgtgtatctggccaaagtcccacaccctatggtcaaacggcgtgctggaaagcgagatgataatccccaaaatttacggtggccctatctctcaacataattatagaccagggtacttcactcagacagccggaccgtggcacctcggcaagctggagcttgattttgacttgtgcgaagggaccactgtcgttgtggatgagcactgcggaaacaggggcccctccctgcgcacaaccacggtaactggtaaaattatccatgaatggtgttgccggagttgtaccttacctccactcagattcaagggggaggacggatgctggtacggcatggagataaggcccgtgaaagaaaaggaggaaaatctggtcaagagcatggtgtctgcaggttccggcgaggttgactcatttagtcttgggctgttgtgtattagcatcatgatcgaagaggtgatgcgctcgcgatggtcccggaaaatgctcatgacaggaaccctggcggtcttctttctactgattatgggccagctcacttggaacgatctgatccgtctttgcattatggtgggggccaatgcttctgacagaatgggaatgggcacaacctatttggccctgatggcaacattcaagatgaggcctatgtttgctgttggtttactcttccgccggctgactagcagagaggtgcttctgctaaccatagggctctcactggtcgccagtgtagaattgccaaactccctggaggaattaggagatggcctcgcaatgggcatcatgattctgaaacttctgacggactttcaatcttaccagttgtgggtgacactcctgagcctaaccttcatcaagactaccttttccctgcactatgcctggaaaacaatggctatggttctttcaattgtgagcctcctgcccttgtgtctgagtactacctctcagaagacgacatggttaccggtcctcctggggtcccttggatgcaagcctctgaccatgttctttatcgcggagaataaaatatggggtagaaagagctggccattgaacgaaggcatcatggccgtggggattgtatcgatcctcctgtcatctctactgaaaaacgatgtgccccttgcaggacctctcattgctggcggtatgctgatcgcctgttacgtcataagtgggtccagcgccgacttgtctttagagaaggctgcagaggttagctgggaagaggaagccgagcattccggagcgtcacacaatattctggtggaagtgcaggatgacggcactatgaaaatcaaggatgaggagcgagacgatacactcaccatcctgcttaaagctactctgttggccgtcagtggcgtgtatcccctaagcattccagcaacactgttcgtttggtacttctggcaaaagaagaaacagcgctctggggtactctgggacaccccttcacccccagaagtggagcgggccgtcctggatgacggaatatatagaatcatgcagaggggtcttttaggccgtagccaggtgggggttggagtgtttcaagaaaacgtcttccatacgatgtggcacgtgactcgcggcgctgtactgatgtaccagggtaagcggctcgagccgagttgggcaagcgtcaaaaaggacttgatttcctacgggggaggctggagactgcagggctcttggaataccggggaggaagtgcaggttatcgccgtggagcctggcaagaatcccaagaatgtccaaacagcgccaggtacctttaagacacccgaaggcgaggtgggggctattgccctcgatttcaaacctggaacttcgggcagcccaatcgttaacagggaaggtaagatagtggggctgtatggaaatggcgtcgtgaccacgtcaggcacatacgtatccgcaatcgcccaggctaaagccagtcaggaggggccccttcctgagattgaagacgaggtgtttcgaaagcggaacctgactatcatggatttgcacccgggatctggtaaaacccgcagatatctaccagcaattgttagggaagctatcaagcggaagctgcgaacactcatattagcccccaccagagtcgtggcgagcgagatggccgaagcactgaaaggcatgcctattcgctaccaaactaccgctgtgaagtccgagcatacagggagggagatcgtcgaccttatgtgccacgccacgttcactatgcgtctgctctcaccagtacgggtgcccaattataacatgatcattatggatgaagctcattttaccgacccttctagcatcgcagccagaggatacataagtacaagggttggcatgggtgaggccgctgcgattttcatgaccgcaactccgcccgggtccgtggaagcctttccacagagcaatgctgtcatccaggatgaggaacgcgacattcctgagcgatcttggaactcaggatatgagtggatcacagatttccccggcaaaaccgtgtggtttgttccatccataaagagtggcaatgacattgccaactgtttgaggaaaaatgggaagcgggtgatccagctgagcaggaagacgttcgatactgaataccagaaaacaaagaacaacgactgggactacgtcgtgaccaccgatatctcggagatgggagcaaatttccgcgccgaccgtgtaattgatcctagacggtgcctcaaacccgtgatcctgaaggacggtccagaaagggttattcttgctggcccgatgcctgtcactgtggcgtctgccgcacagcgccgagggagaataggacggaaccacaataaagagggcgatcagtatatctacatgggtcagcccctaaacaatgacgaggatcatgctcactggacagaagccaagatgctgttggacaacattaataccccagaggggatcatccccgcattatttgaacctgagagggaaaagtccgccgctattgatggcgagtatcgcctgagaggagaggccaggaaaacattcgtggaactcatgcggcgtggcgacctgccagtctggcttagctacaaggttgcgtcagaggggtttcaatatagtgatcgccgatggtgcttcgacggagaaagaaacaatcaggtgctggaggaaaacatggatgtagagatatggactaaagagggtgaaaggaagaaactccggccccgctggttggacgcaagaacgtactctgaccctctggccctaagggagtttaaggagttcgctgccggccggcgatccatcagcggggatctgattctcgagatcggaaaacttccgcagcacctgacccagagagctcaaaatgcattagacaacttggtgatgctgcataattcagaacagggcggtcgcgcctataggcacgctatggaggagctcccagatacaattgaaactctgatgcttctggccctcatcgcagtcttgaccgggggcgtgacactgtttttcttaagtggacggggcctagggaagaccagcataggactgctctgtgttatggcgtcctctgcccttctgtggatggctagcgtggagccccattggatcgccgcatccattatcttggaatttttcctgatggtcctcctgattcctgagcccgaccgtcagagaactccacaggataaccaacttgcttacgtagtgatcggtctcctgtttatgatattgacggttgccgcaaatgagatgggcctgttagaaaccacaaagaaagacctagggattggacacgtggccgtcgagaaccaccatcacgctactatgctggatgtggacctccatcctgcgtcagcctggaccctttacgcagtcgctacaaccatcattactcccatgatgaggcacacaatcgaaaacacgaccgccaatatatctctgactgccatcgcaaaccaggctgccattttgatgggcctggataagggttggccaatcagtaaaatggacattggggtgcctctcctggcgcttggctgctattcgcaggttaatccgttaacactgaccgctgccgtgctcatgttggtagcacattacgccatcataggacccggcctgcaagctaaggcaacccgcgaggcccagaaacggacagcggctgggattatgaagaacccaactgtggatggaatcgtcgccatcgacctagatcctgttgtgtatgacgcaaagttcgaaaaacagctgggccagattatgctccttatcctgtgtacgagccaaatattgctgatgcgaaccacatgggccctctgcgagtccattactctggctaccggtcccttaacaaccctttgggaggggtctccaggaaagttttggaatactacgatcgccgtctcaatggcaaacattttcagaggcagctacctggctggtgccggcctcgcgttctccctaatgaaaagtctagggggaggcaggcgcgggacaggagcccagggcgaaaccttgggtgagaagtggaaacggcagctgaatcagctctctaagagcgaatttaacacttataagagatcagggatccttgaggtggaccgttccgaagcaaaagagggactgaggcggggcgagaccacaaagcacgctgtaagtcgcggtactgccaaattgcgatggttcgtggaaagaaatctggttaagcctgagggcaaagtgatagatctcgggtgtggaaggggcgggtggagctactattgcgcaggattaaagaaggtcaccgaagtgaaaggctacacaaagggtgggcccggacacgaggaaccgatcccaatggctacgtacggctggaacctggtcaaacttcattctggcaaggacgtgtttttcattcctcccgagaaatgtgataccctgctatgcgacatcggggagtcctcaccaaatcccactattgaagagggacggacactccgcgttctgaagatggtagaaccttggttgagaggtaaccaattttgtatcaaaattctgaatccgtatatgcccagcgtggtcgagaccctcgagcagatgcagaggaagcacggcgggatgcttgtgcgaaacccactgtcgagaaattctactcatgaaatgtactgggttagttgcggaacaggcaacatcgtgtccgccgtcaatatgaccagccgtatgttactgaacagattcacgatggcccaccgcaagcctacctatgagagggatgtggacttgggtgcggggacacggcacgtagctgtggaacccgaggttgcaaacctcgatataattggacagagaatcgaaaatatcaaacatgagcacaagtcaacttggcattacgacgaggataacccttataaaacctgggcctaccacggctcctatgaagtcaagccatctggcagcgctagttccatggtgaatggggtggtcaaactgctaacaaagccctgggacgttattcctatggtgactcaaatagccatgaccgatacaaccccatttggacagcagcgcgtattcaaggagaaagtggacactaggacgcccaaggcaaaacgaggtacagcccaaatcatggaagtcaccgctggctggctttgggggtttctgagccggaacaagaaaccgagaatttgtactagggaggagttcacccgcaaggtgcgttctaatgcggccatcggagcagtttttgtggacgagaaccagtggaactcagctaaggaggccgtcgaagatgagcggttctgggacctcgtgcatagagaaagggagctgcacaaacagggcaagtgcgcaacatgcgtatacaacatgatgggtaaacgcgaaaagaaattgggggagtttggaaaggccaagggcagtcgagctatttggtacatgtggctgggcgcccggttcctcgagttcgaagcgcttgggtttatgaatgaggatcactggttctccagagaaaacagcctgtctggagttgagggtgagggcttacataaactggggtatatcttgagggacatatcgaagatccctggaggcaatatgtacgcagatgacacggccggttgggatacccgcattactgaagacgatctccagaacgaggctaaaatcacagacattatggaaccagagcacgccctgctagcaacctcaatctttaaacttacttatcaaaataaagtggtcagagtgcagcggcccgctaagaacgggacagtgatggatgtcataagcaggcgtgaccagcgaggatccggccaggttggcacctacgggctgaatacattcactaacatggaagcccaactcattcgccagatggagagtgagggaatcttttctcctagcgaactggagaccccaaacttggctgaaagagtgttagattggctggagaaatatggtgtagaacggctcaagaggatggccatctccggcgacgactgtgtggtcaagcccattgatgaccgcttcgcaacggcgcttaccgccctgaatgatatggggaaagtgagaaaggacataccgcagtgggagccttcaaaaggatggaacgattggcagcaagttcccttttgcagtcatcacttccaccagctaatcatgaaggacggccgggagattgtggtcccatgtaggaatcaggatgaactggtgggtcgagctcgtgtatctcagggggccggatggagcctcagagagacagcatgcttgggcaaatcctacgctcaaatgtggcagctgatgtattttcatcgccgggaccttaggctggccgcaaacgccatctgttcagcggttcctgtggattgggtccccactagcagaaccacatggtctattcacgctcatcaccagtggatgactaccgaagacatgctctccgtgtggaatcgcgtttggatcgaggaaaacccatggatggaggataagacgcatataagtagctgggaggacgtgccctacttaggcaagcgggaagaccaatggtgcgggtcgctgatcggattgacagccagggcaacctgggccactaatattcaggtcgctatcaaccaggtgcgaagactgattggtaatgagaactacctcgattatatgacatccatgaaacggttcaagaatgaatctgacaccgagggcgccctttggtga

SEQ ID NO: 13290 - RNA, 9879 nt, synthetic construct
  misc_feature 1..9879: note = derived and/or modified CDS sequence (opt3) from DENV-1__FJ639680__SS-prME
  source 1..9879: mol_type = other RNA
agcgtgaccatgctgctcatgcttatgcccacagcactggctttccacttgactacgagaggaggggaacctcatatgatcgtctccaagcaggaaaggggaaaatctttactgtttaagacctcagccggtgttaacatgtgcacattaattgccatggacctcggcgaactgtgtgaagatactatgacctacaaatgcccacggataacagaggcggaaccggacgatgtggactgttggtgcaatgctaccgatacttgggtaacatatgggacctgtagtcaaacgggagagcaccgccgagacaagcgtagcgtggcccttgcaccccatgtcggcctgggtttggagactagaaccgaaacatggatgtcctctgagggggcctggaaacagatccagagggtggaaacttgggctctccggcaccctggattcaccgttattgcactgtttctggcccatgctatcggcacatcgattacccagaagggcatcatattcatcctcttaatgctggtgacgccatcaatggccatgcgctgcgtcgggattggaagcagagattttgtggagggtcttagtggcgcgacttgggtagacgttgtgttggagcacgggtcctgtgtcacaaccatggcaaaggataaacccactctggacatcgaactactcaagacagaggtgaccaaccctgccgtgctgaggaaactttgcattgaagctaagatctctaatacgaccacagatagccggtgtccaactcaaggagaggccaccctggtcgaagaacaggacgcaaacttcgtttgccgccgaacatttgtggatagaggctggggtaatgggtgtggattgttcggcaaaggctccctcataacttgcgctaagtttaagtgcgtaaccaaactggaggggaagattgtgcagtacgaaaacttaaaatattcagtcatcgtgacagttcacaccggagaccagcatcaagtgggtaatgagagtactgaacacggcacgacagccaccattactccccaggcgcctaccacagagatccagctgaccgactacggggccctcactcttgattgtagcccaaggacaggactggacttcaacgaaatggtcttgctaacgatgaaggagaaatcttggctggtgcataagcagtggtttctcgatctgccgcttccctggacctccggcgcatcaactagccaagagacatggaatcggcaggacctgttggtaaccttcaaaacagctcacgccaagaagcaggaagttgtggtcctcggtagtcaagagggggctatgcacactgccctgaccggcgcaacggaaatccagacctctggaacaactaccatttttgccggccatttaaaatgccgtctgaagatggataaactaacactcaaggggatgtcctatgtgatgtgtactgggtcgttcaaactggagaaggaagtcgctgagacccagcacggtacggtgcttgttcagataaagtacgagggcacagacgcgccttgcaaaatcccattctcgacccaagatgaaaagggggtgactcagaacggacgcttgattacagcaaatcccatcgtaaccgacaaagagaagcctgtcaacatagaagccgagccaccctttggcgagtcttatattgtgatcggtgctggggaaaaagccctgaagctctcctggttcaagaaaggctcaagtatcggaaagatgtttgaggcaactgccagaggcgctaggcggatggccattctgggggataccgcatgggacttcggaagcatcggtggcgtttttacatccgtggggaaacttgtccatcagattttcggaacggcgtacggcgtgctgttttctggtgtaagctggaccatgaagatagggatcggcgtgttgctcacttggctgggattaaattcacgaagtacatccctgagcatgacctgtattgctgttggcctagtcacactctacctgggggtgatggtgcaggccgattctggatgcgtcatcaactggaaaggccgcgaacttaagtgtggttcagggatcttcgttactaatgaggtgcacacctggacggaacaatataagtttcaggcagacagtccgaaaagattgagcgccgctattggaaaggcctgggaggagggcgtgtgcggtataaggtccgcaacacggctggaaaacatcatgtggaaacagatttctaacgagctcaatcatatcctgttagaaaacgacatgaagctgaccgtagtcgtgggcgatgttgctgggattcttgcccagggcaaaaagatgatccgccctcaacccatggagtacaaatattcgtggaaaagctggggcaaggcgaaaataatcggggccgacgctcagaatactaccttcattatcgatggaccaaacacacctgaatgtcccgacgatcagagagcatggaatatttgggaggtggaggactacggctttggtatcttcactaccaacatatggttgaagctcagggattcctatacacaggtctgcgaccaccgtctgatgtcagccgctattaaagatagtaaggccgtgcacgcagacatggggtactggatcgaatctgagaaaaatgaaacgtggaagctagcgcgggccagctttattgaggttaagacctgtatctggccaaaatcccatactctgtggtcaaacggagtgctcgaaagcgagatgataatccccaagatttatggcggtcctatctctcaacacaattaccgaccaggctacttcacacagaccgctgggccgtggcatctgggaaaacttgagttggatttcgacctgtgcgaaggcactacagtagtcgtggatgagcactgcgggaacagaggaccctccttaaggaccacgactgtgaccggcaagattatccacgaatggtgttgccgcagttgtacactccctccactgcggtttagaggtgaggacgggtgctggtatggaatggagataaggcccgtcaaagaaaaggaggaaaatcttgttaagagcatggtgtctgccggctccggtgaggtagactcattcagtctgggcttgctctgtattagcatcatgatcgaagaggtgatgcgctcgcgatggtcccggaaaatgctgatgaccgggactctagcagtctttttcctgctcattatgggacagctgacatggaacgatcttatccgtttgtgcattatggtgggcgctaatgcctctgacagaatggggatgggaaccacatacctggcattaatggccacttttaagatgaggcctatgttcgctgttggcctcctgtttcgccggcttaccagcagagaggtgctgctactcacgataggtctgtcattggtcgcgagtgtggaactgccaaactccttagaggaactcggggatggactggccatgggcatcatgattcttaaactgttgacagacttccaatctcatcagctctgggcaaccctgctaagcctgacttttatcaagaccacattctcccttcactatgcttggaaaactatggccatggttctctcaattgtgagcctgtttcccttgtgtctgagtaccacgtctcagaagacaacctggttaccggtcctcctgggctcccttgggtgcaagcctctgactatgttcttgatcgccgagaataaaatatggggaagaaagtcctggccactcaacgaaggtatcatggctgtaggcattgtgtcgatcctgctatcatctctgcttaaaaacgatgttcccctcgcagggcctctgattgccggaggcatgttgatcgcgtgttacgtgataagtggttccagcgctgacttatctctggagaaggccgcagaggtcagctgggaagaggaagccgagcattccggggcttcacacaatattctcgtggaagtacaggatgacggaacaatgaaaatcaaggatgaggagcgagacgataccctgactatccttctgaaagcaacattgctagccgtgagtggcgtctatcccctgagcattccagcgaccctctttgtttggtacttctggcaaaagaagaaacagcgctctggcgtgctgtgggacacgccttcacccccagaagtggagcgggctgtccttgatgacgggatatatagaatcatgcagaggggattactgggtcgtagccaggtgggcgttggggtattccaagaaaacgtgtttcatactatgtggcacgtcacccgcggagccgtgctcatgtaccagggcaagcggttggagccgagttgggcaagcgttaaaaaggacctgatttcctacggtgggggatggagactccagggctcttggaatacaggcgaggaagtgcaggtcatcgccgtggagcctgggaaaaaccccaagaatgtacaaaccgctccaggaacattcaagactcccgaaggtgaggtcggcgccattgcactggattttaaacctgggacctcgggaagcccaatcgtgaacagggaaggcaagatagttggtctttatgggaatggagtggtcacgacatcaggcacttacgtgtccgctatcgcccaggcgaaagccagtcaggagggccccctgcctgagattgaagacgaggttttccgaaagcggaacttgaccatcatggatctacacccggggtctggaaaaacacgcagatatctgccagcaattgtgagggaagctatcaagcggaagctccgaaccttaatactggcccccactagagtcgtggctagcgagatggcagaagcccttaaaggtatgcctattcgctaccaaaccacagccgtaaagtccgagcatacgggcaaagagatcgtggacctgatgtgccacgctacttttaccatgaggctcttgtcaccagttcgtgtccccaattataacatgatcattatggatgaagcgcatttcacagacccttctagcatcgcagcccgggggtacataagtaccagagtgggaatgggcgaggctgccgcaatttttatgactgccacaccgcccggttccgtggaggctttcccacagagcaatgcggtcatccaggatgaggaaagggacattcctgagcgctcttggaactcagggtatgagtggatcaccgattttcccggaaagacggtatggttcgtgccatccataaaaagtggcaatgacattgccaactgtctgcgaaagaatggcaagagagttatccagctcagccggaaaacttttgatacagaataccaaaagaccaaaaacaacgactgggactacgtggtcaccactgatatctcggagatgggggcaaatttcagggctgaccgcgtgattgatcctcgtagatgcctgaagcccgttatccttaaagacggaccagaacgggtgattctagccggtccgatgcctgtcacagtggcatctgccgctcagaggcgcggccgaatagggagaaaccacaataaggagggagatcagtatatctacatgggccagcccctgaacaatgacgaggatcatgcccactggaccgaagcgaagatgttgttagacaacattaatacaccagagggtatcatccccgcactgttcgaacctgagcgggaaaaatccgccgctattgatggggagtataggctccgcggcgaggccagaaagacttttgtagaactgatgaggcggggagaccttccagtgtggctgagctacaaagttgcttcagagggcttccaatatagtgatcgtcgctggtgctttgacggggaacgaaacaatcaggtcctcgaggaaaacatggatgtggagatatggacgaaggagggagaaaggaaaaagttgaggccccggtggctggacgcacgcacctactctgaccctctagccctgagagagttcaaagaatttgctgccggtaggcggtccgtgagcggcgatctcatccttgagattgggaagctgccgcagcacttaacacagcgagcacaaaatgcgttggacaacctggtcatgctccataattcagaacagggaggcagagcctatcgccacgctatggaggagctgccagatactatcgaaacccttatgctgctcgccttgattgcagttctgacaggtggggtgaccttattctttctaagtggcaggggactgggcaagactagcatcgggctcctttgtgtaatggcttcctctgtgctgttgtggatggccagcgtcgagccccattggatagcagcctccatcattctggagttctttctcatggtgctgcttatccctgagcccgaccggcagcgtacgccacaggataaccaactcgcttacgttgtgattggactgttgttcatgatcctgaccgtcgcggccaatgagatgggtttactagaaacaactaaaaaggacctgggcatagggcacgtagcagtggagaaccacaaccatgctgccatgctcgatgttgaccttcaccctgcctcagcatggaccctgtacgctgtggccacaaccattatcactcccatgatgagacatacaattgaaaatacgaccgcgaacatctctttgactgctatagccaatcaggcagccatcctgatgggactcgataaaggctggccaattagtaagatggacatcggtgtccctctgcttgctttagggtgctatagccaggtgaacccgctgacactcaccgcagccgtcttgatgctggtggcgcactacgctattatcggccccggactacaagccaaagcaaccagggaggcccagaagcgcacagctgccggcataatgaagaatccaactgttgatgggattgtggcaatcgacctggatcctgtagtgtatgacgctaaatttgaaaagcagctcggacagatcatgcttctgattttgtgtacgagccaaatcctgctcatgcggaccacatgggccctgtgcgagtccataactttagcgaccggcccccttacaaccctgtgggagggttctccagggaaattctggaacactacgattgccgtctcaatggcaaatatctttcgaggaagctacctcgctggcgccggtctagcattctccctgatgaagagtttgggcgggggaagaaggggcacaggggctcagggagaaaccctgggcgagaaatggaagcgccagctcaaccagctttctaagagcgagttcaatacttataaacggtcaggtattatggaggttgacagatccgaagccaaggaggggctgaaacgtggagagaccacaaagcatgccgtgagtaggggcactgcgaaattgcggtggtttgtcgaacgcaacctggtgaagcctgagggtaaggtaatcgatctcggctgtgggcgaggaggctggagctactattgcgctgggctaaagaaggtgaccgaagttaaaggatacacaaagggcggtcccgggcacgaggaaccgataccaatggcaacgtacggatggaatctggtgaaacttcactctggcaaggacgtcttctttatccctcccgagaaatgtgataccctgctatgcgacattggcgagtcctcaccaaaccccactatcgaagaggggagaacactcagggtgctgaagatggtcgaaccttggttgcggggaaatcaattctgtattaagatcctgaacccgtatatgcccagcgtggttgagaccctcgagcagatgcagcgcaaacatggtggcatgcttgtaagaaatccactgtcgaggaactctactcacgaaatgtactgggtgagttgcgggacaggaaatattgtctccgccgtgaacatgaccagccgaatgttactgaaccggtttacgatggctcatcgtaagcctacctatgagagagatgttgacttgggcacaggtactcgccacgtggccgtcgaacccgaggtggcaaatctcgatatcatagggcagaggattgaaaacatcaaacacgagcataagtcaacctggcactacgacgaggataatccttataaaacatgggcctaccatggatcctatgaagtaaagccatctggcagcgctagttccatggtgaacggcgttgtcaagctgctaactaaaccctgggacgtgatccctatggtgacccaaattgcgatgacagataccactccattcgggcagcagcgggtctttaaggagaaagttgacacgagaacacccaaggccaaacgcggaaccgcacaaataatggaagtgactgctaggtggctttggggtttcctgagccgaaataagaagccgcggatctgtaccagagaggaatttacaaggaaagtacgctctaacgccgcaattggcgccgtgttcgtcgacgagaatcagtggaactcagctaaggaggccgtggaagatgagcgtttttgggacctcgttcaccgggaaagagagctgcataaacaggggaagtgcgcgacgtgcgtgtacaatatgatgggaaaaagggaaaagaagttgggcgagttcggtaaagcaaaggggagtcgcgccatctggtacatgtggctgggagctcgatttctcgagttcgaagcccttggcttcatgaacgaggatcactggttttcccgggaaaatagcctgtctggcgtcgagggggagggattacacaaactgggttatattttgagagacatctcgaagatacctggcgggaacatgtacgcagatgacaccgctggatgggatactaggatcacagaagacgatctccagaatgaggccaaaattaccgacatcatggaaccagagcatgctctgctagccaaggcaattttcaaacttacttatcaaaacaaggtggtacgcgttcagagacccgcgaagaatggcacagtgatggatgtcatctcacggagggaccagcgtggtagcggacaggtgggaacctacggcctgaacacatttactaacatggaagcccaactcatacgacagatggagtccgagggcattttcagtccttctgaactggagaccccaaatttggctgaacgcgccttagattggctggagaaatatggggtggaaagactcaagcggatggcaatcagcggagacgactgtgtcgttaaacccatcgatgacaggtttgctacggcccttaccgcactgaacgatatgggtaaggtgcgcaaagacattccgcagtgggagccttccaagggctggaatgattggcagcaagtacccttctgctcacaccattttcaccagctaataatgaaggacgggagagagatcgtggtcccatgtcggaaccaggatgaactggtgggaagggcccgagttagtcagggcgcgggttggtctctccgtgagacagcttgcttggggaaaagctacgcccaaatgtggcagctgatgtatttccacagacgcgaccttcggctggcagccaatgctatttgttccgccgtgcctgtcgattgggtgcccacttcaaggaccacatggagcatccatgcacaccatcagtggatgactaccgaagacatgctctctgtatggaacagagtttggattgaggaaaatccatggatggaggataagacgcacatctccagttgggaggacgtgccctacttaggaaaacgcgaagaccaatggtgcggcagcctgataggcttgacagctcgggccacctgggcgactaacatccaggtcgctattaatcaggtgaggcgactgatcgggaacgagaattacctcgattatatgacatcgatgaagagatttaaaaacgaatccgaccctgagggagccctttggtga

SEQ ID NO: 13291 - RNA, 9879 nt, synthetic construct
  misc_feature 1..9879: note = derived and/or modified CDS sequence (opt3) from DENV-1__FJ639682__SS-prME
  source 1..9879: mol_type = other RNA
agcgtgaccatgctgctcatgcttatgcccacagccctggctttccacttgactacgaggggaggggaacctcatatgatcgtctccaagcaggaaaggggaaaatctttactgtttaagacctcagcgggtgttaatatgtgcacactaattgccatggacctcggcgaactgtgtgaagatactatgacctacaaatgcccacggataacagaggcggaaccggacgatgtggactgttggtgcaatgctaccgatacttgggtaacatatgggacctgtagtcaaacgggagagcaccgccgagacaagcgtagcgtggcccttgctccccatgtcggcctgggtttggagactagaaccgaaacatggatgtcctctgagggggcctggaaacagatccagagggtggaaacttgggccctccggcaccctggattcaccgttattgcactgtttctggcccatgctatcggcacatcgattacccagaagggcatcatattcatcctcttaatgctggtgacgccatcaatggccatgcgctgcgtcgggattggaagcagagattttgtggagggtcttagtggcgcgacttgggtagacgttgtgttggagcacgggtcctgtgtcacaaccatggcaaaggataaacccactctggacatcgaactactcaagacagaggtgaccaaccctgccgtgctgaggaaactttgcattgaagctaagatctctaatacgaccacagatagccggtgtccaactcaaggagaggccaccctggtcgaagaacaggacgcaaacttcgtttgccgccgaacatttgtggatagaggctggggtaatgggtgtggattgttcggcaaaggctccctcataacttgcgctaagtttaagtgcgtaaccaaactggaggggaagattgtgcagtacgaaaacttaaaatattcagtcatcgtgacagttcacaccggagaccagcatcaagtgggtaatgagagtactgaacacggcacgacagccaccattactccccaggcgcctaccacagagatccagctgaccgactacggggccctcactcttgattgtagcccaaggacaggactggacttcaacgaaatggtcttgctaacgatgaaggagaaatcttggctggtgcataagcagtggtttctcgatctgccgcttccctggacctccggcgcatcaactagccaagagacatggaatcggcaggacctgttggtaaccttcaaaacagctcacgccaagaagcaggaagttgtggtcctcggtagtcaagagggggctatgcacactgccctgaccggcgcaacggaaatccagacctctggaacaactaccatttttgccggccatttaaaatgccgtctgaagatggataaactaacactcaaggggatgtcctatgtgatgtgtactgggtcgttcaaactggagaaggaagtcgctgagacccagcacggtacggtgcttgttcagataaagtacgagggcacagacgcgccttgcaaaatcccattctcgacccaagatgaaaagggggtgactcagaacggacgcttgattacagcaaatcccatcgtaaccgacaaagagaagcctgtcaacatagaagccgagccaccctttggcgagtcttatattgtgatcggtgctggggagaaaactctgaagctctcctggttcaagaaaggctcaagtatcggaaagatgtttgaggccaccgcaagaggcgccaggcggatggctattctgggggatacagcctgggacttcggaagcatcggtggcgtttttacgtccgtggggaaacttgtccatcagattttcggaaccgcatacggcgtgctgttttctggtgtaagctggactatgaagatagggatcggcgtgttgctcacatggctgggattaaattcacgaagtacctccctgagcatgacatgtattgcggttggcctagtcactctctacctgggggtgatggtgcaggctgattctggatgcgtcatcaactggaaaggccgcgaacttaagtgtggttcagggatcttcgttaccaatgaggtgcacacgtggacagaacaatataagtttcaggccgacagtccgaaaagattgagcgcagccattggaaaggcttgggaggagggcgtgtgcggtataaggtccgccacccggctggaaaacatcatgtggaaacagatttctaacgagctcaatcatatcctgttagaaaacgacatgaagctgactgtagtcgtgggcgatgttgcagggattcttgctcagggcaaaaagatgatccgccctcaacccatggagtacaaatattcgtggaaaagctggggcaaggccaagataatcggggcggacgcccagaataccacattcattatcgatggaccaaacactcctgaatgtcccgacgatcagagagcttggaatatttgggaggtggaggactacggctttggtatcttcaccacaaacatatggttgaagctcagggattcctatacgcaggtctgcgaccaccgtctgatgtcagcagccattaaagatagtaaggctgtgcacgccgacatggggtactggatcgaatctgagaaaaatgaaacctggaagctagcacgggcgagctttattgaggttaagacttgtatctggccaaaatcccatacactgtggtcaaacggagtgctcgaaagcgagatgataatccccaagatttatggcggtcctatctctcaacacaattaccgaccaggctacttcacccagactgccgggccgtggcatctgggaaaacttgagttggatttcgacctgtgcgaaggcacaaccgtagtcgtggatgagcactgcgggaacagaggaccctccttaaggacgactaccgtgacaggcaagattatccacgaatggtgttgccgcagttgtaccctccctccactgcggtttagaggtgaggacgggtgctggtatggaatggagataaggcccgtcaaagaaaaggaggaaaatcttgttaagagcatggtgtctgctggctccggtgaggtagactcattcagtctgggcttgctctgtattagcatcatgatcgaagaggtgatgcgctcgcgatggtcccggaaaatgctgatgactgggacactagccgtctttttcctgctcattatgggacagctgacctggaacgatcttatccgtttgtgcattatggtgggcgcaaatgcttctgacagaatggggatgggaacaacttacctggccttaatggcaacctttaagatgaggcctatgttcgccgttggcctcctgtttcgccggcttacgagcagagaggtgctgctactcacaataggtctgtcattggtcgctagtgtggaactgccaaactccttagaggaactcggggatggactggcgatgggcatcatgattcttaaactgttgaccgacttccaatctcatcagctctgggccactctgctaagcctgacctttatcaagacaactttctcccttcactatgcatggaaaaccatggctatggttctctcaattgtgagcctgtttcccttgtgtctgagtacgacatctcagaagaccacttggttaccggtcctcctgggctcccttgggtgcaagcctctgacaatgttcttgatcgccgagaataaaatatggggaagaaagtcctggccactcaacgaaggtatcatggccgtaggcattgtgtcgatcctgctatcatctctgcttaaaaacgatgttcccctcgctgggcctctgattgcaggaggcatgttgatcgcctgttacgtgttaagtggttccagcgcggacctgtctctcgagaaggctgccgaggtcagctgggaagaggaagcagagcattccggggcctcacacaatatactggtggaagtacaggatgacggaaccatgaaaattaaggatgaggagcgagacgatactcttacaatcctgttgaaagctaccctactggcagtgagtggcgtctatcccctcagcatcccagccacgctgtttgtttggtacttctggcaaaagaagaaacagcgctctggcgtgctttgggacactccttcacccccagaagtggagcgggcggtcttagatgacgggatttatagaataatgcagaggggactgctcggtcgtagccaggtgggcgttggggtattccaagaaaacgtgtttcataccatgtggcacgtcacacgcggagctgtgttgatgtaccagggcaagcggctggagccgagttgggccagcgttaaaaaggacctcatctcctacggtgggggatggagactgcagggctcttggaataccggcgaggaagtgcaggtcattgcagtggagcctgggaaaaaccccaagaatgtacaaacagccccaggaactttcaagacccccgaaggtgaggtcggcgctatcgcccttgattttaaacctgggacgtcgggaagcccaattgtgaacagggaaggcaagatcgttggtctgtatgggaatggagtggtcacaacttcaggcacctacgtgtccgcaatagctcaggccaaagcgagtcaggagggccccttgcctgagatcgaagacgaggttttccgaaagcggaacctaacaattatggatctgcacccggggtctggaaaaacccgcagatatctcccagccatcgtgagggaagcaattaagcggaagttacgaactctgatccttgctcccaccagagtcgtggccagcgagatggctgaagcactgaaaggtatacctattcgctaccaaacaacggccgtaaagtccgagcatactggcaaagagatcgtggacctcatgtgccacgccacctttacaatgaggttgctgtcaccagttcgtgtccccaattataacatgatcattatggatgaagctcatttcaccgacccttctagcatcgcggcacgggggtacataagtactagagtgggaatgggcgaggccgctgccatttttatgacagcaaccccgcccggttccgtggaagccttcccacagagcaatgctgtcatccaggatgaggaaagggacattcctgagcgctcttggaactcagggtatgagtggatcacggattttcccggaaagactgtatggttcgtgccatccataaaaagtggcaatgacattgcgaactgtctccgaaagaatggcaagagagttatccagctgagccggaaaacatttgataccgaataccaaaagaccaaaaacaacgactgggactacgtggtcactacagatatctcggagatgggggccaatttcagggcagaccgcgtgattgatcctcgtagatgccttaagcccgttatcctaaaagacggaccagaacgggtgattctggctggtccgatgcctgtcaccgtggcctctgcagcccagaggcgcggccgaatagggagaaaccacaataaggagggagatcagtatatctacatgggccagcccttgaacaatgacgaggatcatgctcactggacagaagccaagatgttactggacaacattaatactccagagggtatcatccccgcactcttcgaacctgagcgggaaaaatccgcagccattgatggggagtataggctgcgcggcgaggctagaaagacgtttgtagaacttatgaggcggggagacctgccagtgtggctcagctacaaagttgcctcagagggcttccaatatagtgatcgtcgctggtgctttgacggggaacgaaacaatcaggtcttggaggaaaacatggatgtggagatatggaccaaggagggagaaaggaaaaagctgaggccccggtggctagacgctcgcacatactctgaccctctggcactcagagagttcaaagaatttgccgctggtaggcggtccgtgagcggcgatcttatcctggagattgggaagttaccgcagcacttgactcagcgagcccaaaatgcactggacaacctcgtcatgctgcataattcagaacagggaggcagagcgtatcgccacgccatggaggagcttccagataccatcgaaacactgatgctcttggctctgattgccgttttaaccggtggggtgactctattctttctgagtggcaggggactcggcaagacgagcatcgggcttctgtgtgtaatggcatcctctgtgttgctgtggatggctagcgtcgagccccattggatagccgcatccatcattctcgagttctttctgatggtgcttctcatccctgagcccgaccggcagcgtaccccacaggataaccaactggcctacgttgtgattggattgctgttcatgatcttaacagtcgctgcgaatgagatgggtctactggaaactaccaaaaaggacctcggcatagggcacgtagccgtggagaaccaccatcacgcagctatgcttgatgttgacctgcatcctgcctcagcctggacattgtacgcagtggctaccactattatcacacccatgatgagacacacgattgaaaacaccactgccaatatctctctgacagcgatagctaaccaggccgcaatcctcatgggactggataaaggctggccaattagtaagatggacatcggtgtccctcttttagccctggggtgctatagccaggtgaatccgctcaccttgaccgctgcagtcctgatgctagtggcccattacgcgattatcggccccggactgcaagctaaagccacaagggaggcacagaagcgcactgccgctggcataatgaagaacccaacggttgatgggattgtggccatcgacctcgatcctgtagtgtatgacgcaaaatttgaaaagcagcttggacagatcatgctgttgattctgtgtaccagccaaatcctcctgatgcggacaacttgggctttatgcgagtccataacccttgccacaggccccctgaccactctctgggagggttctccagggaaattctggaatacgacaattgcggtctcaatggccaacatctttcgaggaagctacctagcaggcgctggtctggccttctccttgatgaagagtctgggcgggggaagaaggggcaccggggcacagggagaaactctcggcgagaaatggaagcgccagcttaatcagctgtctaagagcgagttcaacacctataaacggtcaggtattatggaggttgacagatccgaagctaaggaggggttgaaacgtggagagacaactaagcacgccgtgagtaggggcaccgccaaactgcggtggtttgtcgaacgcaatctcgtgaagcctgagggtaaggtaatcgatttaggctgtgggcgaggaggctggagctactattgcgcggggctgaaaaaggtgacagaagttaaaggatacacgaagggcggtcccgggcacgaggaaccgataccaatggctacctacggatggaaccttgtgaaactgcattctggcaaggacgtcttctttatccctcccgagaaatgtgatactctactctgcgacattggcgagtcctcaccaaatcccacaatcgaagaggggagaaccctgagggtgttgaagatggtcgaaccttggctgcggggaaaccaattctgtattaagatcctcaatccgtatatgcccagcgtggttgagactcttgagcagatgcagcgcaaacacggtggcatgctggtaagaaacccattatcgagaaattctacacatgaaatgtactgggtgagttgcgggaccggaaacattgtctccgcagtgaatatgacgagccgaatgctgttgaaccggtttaccatggcccaccgtaagcctacatatgagagagatgttgacctcggcactggtacccgccacgtggctgtcgaacccgaggtggccaacctggatatcatagggcagaggattgaaaatatcaaacatgagcacaagtcaacatggcattacgacgaggataacccttataaaacttgggcataccacggatcctatgaagtaaagccatctggcagcgccagttccatggtgaatggcgttgtcaagctacttaccaaaccctgggacgtgatccctatggtgacacaaattgctatgaccgatactacgccattcgggcagcagcgggtctttaaggagaaagttgacacaagaacccccaaggcgaaacgcggaactgcccaaataatggaagtgaccgcaaggtggctgtggggtttcctcagccgaaacaagaagccgcggatctgtacaagagaggaatttacgaggaaagtacgctctaatgctgccattggcgcagtgttcgtcgacgagaaccagtggaactcagccaaggaggctgtggaagatgagcgtttttgggacctggttcatcgggaaagagagttgcacaaacaggggaagtgcgcaacctgcgtgtacaacatgatgggaaaaagggaaaagaagctgggcgagttcggtaaagcgaaggggagtcgcgcaatctggtacatgtggctcggagcccgatttcttgagttcgaagctctgggcttcatgaatgaggatcactggttttcccgggaaaacagcttatctggcgtcgagggggagggactgcataaattgggttatattctcagagacatctcgaagatacctggcgggaatatgtacgccgatgacactgcaggatgggatacaaggatcaccgaagacgatctgcagaacgaggctaaaattactgacatcatggaaccagagcacgccctacttgctaaggccattttcaaactgacatatcaaaataaggtggtacgcgttcagagacccgcaaagaacggcaccgtgatggatgtcatctcacggagggaccagcgtggtagcggacaggtgggaacatacggcctcaatacttttaccaacatggaagcgcaactgatacgacagatggagtccgagggcattttcagtccttctgaattggagacgccaaacttagccgaacgcgctctggattggctcgagaaatatggggtggaaagacttaagcggatggccatcagcggagacgactgtgtcgttaaacccatcgatgacaggtttgcaaccgctctgacagccctaaatgatatgggtaaggtgcgcaaagacattccgcagtgggagccttccaagggctggaacgattggcagcaagtacccttctgctcacatcactttcaccagctgataatgaaggacgggagagagatcgtggtcccatgtcggaatcaggatgaactcgtgggaagggcacgagttagtcagggcgccggttggtctttgcgtgagactgcgtgcctggggaaaagctacgctcaaatgtggcagcttatgtatttccatagacgcgacctgcggctcgccgcaaacgccatttgttccgctgtgcctgtcgattgggtgcccacctcaaggacaacttggagcatccacgcccatcaccagtggatgaccacggaagacatgttatctgtatggaatagagtttggattgaggaaaacccatggatggaggataagacacatatctccagttgggaggacgtgccctacctgggaaaacgcgaagaccaatggtgcggcagcttgataggcctgaccgcacgggctacttgggccacaaatatccaggtcgcgattaaccaggtgaggcgactcatcgggaatgagaactaccttgattatatgacctcgatgaagagatttaaaaatgaatccgaccctgagggagctctgtggtga

SEQ ID NO: 13292 - RNA, 9879 nt, synthetic construct
  misc_feature 1..9879: note = derived and/or modified CDS sequence (opt3) from DENV-1__JQ287664__SS-prME
  source 1..9879: mol_type = other RNA
agcgtgaccatgctgctcatgcttatgcccacagccctggctttccacttgactacgagaggcggggagcctcatatgatcgtctccaagcaggaaaggggaaaatctttactgtttaagacctcagcaggtgttaacatgtgcacactaattgccatggacctcggcgagctgtgtgaagatactatgacctacaaatgcccacggataacagaggtggaaccggacgatgtagactgttggtgcaataccactgatacatgggtgacctatgggacgtgtagtcaaactggagagcaccgccgagacaagcgtagcgtcgcgcttgctccccatgtgggcctgggtttggagaccagagccgaaacatggatgtcctctgagggggcatggaaacagatccagagggttgaaacttgggccctccggcaccctggattcaccgtgattgctctgtttctggcacatgtcatcggcacatcgattacccagaagggcatcatattcatcctcttaatgctggtgacgccatcaatggccatgcgctgcgtagggattggaagcagagattttgttgagggtcttagtggcgctacttgggtggacgtcgtgttggagcacgggtcctgtgtgacaaccatggccaaggataaacccactctggacatcgaactactcaagacagaggtcaccaaccctgcggttctgaggaaactttgcattgaagcaaagatctctaatacgaccacagatagccggtgtccaactcaaggagaggccaccctggtggaagagcaggacgctaacttcgtatgccgccgaacatttgtggatagaggctggggtaatgggtgtggattgttcggcaaaggctccctcataacttgcgccaagtttaagtgcgtcaccaaactggaggggaagattgtgcagtacgaaaacttaaaatattcagttatcgtgacagtccacaccggagaccagcatcaagtgggtaatgagagtactgaacacggcacgacagcaaccattactccccaggctcctaccagcgagatccagctgacagactacggggccctcacccttgattgttctccaaggactggactggacttcaacgaaatggtattgctaacaatgaaggagaaatcctggctggttcataagcagtggtttctcgatctgccgcttccctggacgtcaggcgcgagcaccagtcaagagacttggaatcggcaggacctgttggtgacattcaaaaccgcccacgcaaagaagcaggaagtcgtggtcctcggttctcaagagggggctatgcacacagccctgactggcgctaccgaaatccagacgtccggaaccacaactatttttgccggccatttaaaatgccgtctgaagatggataaactaaccctcaaggggatgagctatgtgatgtgtacaggatcgttcaaactggagaaggaagttgcagagactcagcacggtaccgtgcttgtacagataaagtacgagggcacggacgccccttgcaaaatcccattctctacacaagatgaaaagggggtcacccagaacggacgcttgattactgctaatcccatcgtgacagacaaagagaagcctgttaacatagaagcggagccaccctttggcgagtcctatattgtgatcggtgcaggggaaaaagccctgaagctctcatggttcaagaaaggcagtagcatcggaaagatgtttgaggctaccgccagaggcgcaaggcggatggccattctgggggatactgcttgggacttcggatccatcggtggcgtctttacctctgtggggaaacttgtacatcagattttcggaacagcctacggcgtgctgtttagcggtgtttcatggacgatgaagatagggatcggcgtcttgctcacctggctgggattaaatagtcgatccactagcctgtctatgacatgtattgcagtgggcctagtgaccctctacctgggggtcatggttcaggcggattcaggatgcgtgatcaactggaaaggccgcgaacttaagtgtggtagtgggatcttcgtgacaaatgaggtacacacttggaccgaacaatataagtttcaggctgacagcccgaaaagattgtccgccgcaattggaaaggcctgggaggagggcgtctgcggtataaggtctgctacgcggctggaaaacatcatgtggcgccagatttcgaacgagctcaatcatatcctgttagaaaacgacatgaaattcacagtggttgtgggcgatgtcgtggggattctggcccagggaaagaaaatgatcagacctcaacccatggagcacaagtacagctggaaatcctggggcaaggcaaagataatcggggctgacgttcagaataccacttttattatcgatggaccaaacacccctgaatgtcccgacgatcagagggcctggaatatttgggaggtggaggactatggcttcggtatctttacaactaacatatggcttaaattgcgtgattcatacacccaggtatgcgaccaccggctcatgagtgcggccattaaggattctaaagctgtccatgcagacatggggtattggatcgaaagcgagaagaatgaaacatggaaactggcccgagcttccttcattgaggtgaagacgtgtatctggccaaagtcacacaccctatggagcaacggagtgctggaatctgagatgataatccccaaaatttacggcggtcctatctcccaacataattatagaccaggctacttcactcagacagccgggccgtggcacctcggaaagctggagcttgattttgacttgtgcgaaggcaccactgtcgttgtggatgagcactgcgggaacaggggacccagtctgcgcacaaccacggtaactggcaaaattatccatgaatggtgttgccggagctgtaccttacctccactcagattcaagggtgaggacgggtgctggtacggaatggagataaggcccgtgaaagaaaaggaggaaaatctggtcaagtctatggtgtccgcaggctcaggtgaggttgacagttttagccttggcctgttgtgtatttcgatcatgatcgaagaggtgatgcgctcccgatggtctcggaaaatgctcatgacagggaccctggcggtcttctttctactgattatgggacagctcacttggaacgatctgatccgtctttgcattatggtgggcgccaatgctagcgacagaatggggatgggaacaacctatttggccctgatggcaacattcaagatgaggcctatgtttgctgttggcttactcttccgccggctgacttcaagagaggtgcttctgctaaccataggtctcagtctggtcgcctccgtagaattgccaaactctctggaggaattaggggatggactcgcaatgggcatcatgattctgaaacttctgacggactttcaaagctaccagttgtgggccacactcctgtccctaaccttcatcaagactaccttttcactgcactatgcttggaaaacaatggcgatggtgcttagcattgttagtctcctgcccttgtgtctgtctactacctcccagaagacgacatggttaccggtgctcctgggcagccttgggtgcaagcctctgaccatgttctttatcgccgagaataaaatatggggaaggaagtcgtggccattgaacgaaggtatcatggcagtcggcattgtgtcaatcctcctgtctagtctactgaaaaacgatgtaccccttgctgggcctctcattgccggaggcatgctgatcgcctgttacgtgatatccggtagctctgctgacttgagcttagagaaggcagccgaggtctcctgggaagaggaagcggagcattcaggggctagtcacaatattctggttgaagtgcaggatgacggaactatgaaaatcaaggatgaggagcgagacgatacactcaccatcctgcttaaagccactctgttggcagtgagcggcgtctatcccctatctattccagccacactgttcgtgtggtacttctggcaaaagaagaaacagcgctccggcgttctctgggacaccccttcacccccagaagtagagcgggctgtgctggatgacgggatatatagaatcatgcagaggggacttttaggtcgtagtcaggtcggcgtgggggtttttcaagaaaacgtgttccatacgatgtggcacgtcactcgcggagcagtgctgatgtaccagggcaagcggctcgagccgagctgggcctccgtaaaaaaggacttgatttcttacggtgggggatggagactgcagggctcgtggaataccggcgaggaagtccaggtgatcgcggttgagcctgggaaaaaccccaagaatgtgcaaacagctccaggaacctttaagacacccgaaggtgaggtcggcgccattgcactcgatttcaaacctgggactagcggatcaccaatcgtgaacagggaaggcaagatagttggtctgtatgggaatggagtggtcaccacgtccggcacatacgtgagtgccatcgctcaggccaaagcatctcaggagggcccccttcctgagattgaagacgaggtatttcgaaagcggaacctgactatcatggatttgcacccggggagcggaaaaacccgcaagtatctaccagctattgtgagagaagccatcaagaggaaactgcggacactcatattagcgcccacccgagttgtcgcctccgagatggcagaagctctgaagggtatgcctattagataccaaactaccgccgtgaaatcagagcatacaggccgcgagatcgtggaccttatgtgccacgctacgttcactatgaggctgctctctccagtccgtgtacccaattataacatgatcattatggatgaagcacattttaccgaccctagcagtatcgccgcccgggggtacatatccacaagagtgggaatgggcgaggctgcggcaattttcatgaccgccactccgcccggtagcgttgaagcttttccacagtctaatgccgtgatccaggatgaggaaagggacattcctgagcgctcatggaactccgggtatgagtggatcacagatttccccggaaagaccgtctggtttgtgccaagtataaaaagcggcaatgacattgcaaactgtttgcgaaagaatggcaagagagttatccagctgtcgcggaaaacgttcgatactgaataccaaaagacaaaaaacaacgactgggactacgtggtcaccaccgatatctctgagatgggggccaatttcagggctgaccgcgtgattgatcctcgtagatgcctcaagcccgtaatcctgaaagacggaccagaacgggtgattcttgcgggtccgatgcctgttactgtcgcctccgcagctcagaggcgcggccgaatagggagaaaccacaataaggagggagatcagtatatctacatgggccagcccctaaacaatgacgaggatcatgcccactggacagaagcaaagatgctgttggacaacattaataccccagagggtatcatccccgccttatttgaacctgagcgggaaaaaagcgctgccattgatggggagtataggctgcgcggcgaggcgagaaagacattcgtggaactcatgaggcggggagacctgccagtgtggctttcatacaaagtcgcaagtgagggctttcaatattctgatcgtcgctggtgcttcgacggggaacgaaacaatcaggttctggaggaaaacatggatgtggagatatggactaaggagggagaaagaaaaaagctcaggccccggtggttggacgcccgcacgtactccgaccctctggctctaagagagtttaaagaattcgccgctggtaggcggagcatctcaggcgatctgattctcgagatcgggaagcttccgcagcacctgacccagcgagcacaaaatgccttagacaacttggtaatgctgcataatagtgaacagggaggcagagcttatcgccacgccatggaggagctcccagatacaattgaaactctgatgcttctggcactcatcgcggtgttgaccggtggggtcacactgtttttcttaagcggcaggggactaggcaagacctccatagggctgctctgtgtgatggcctctagcgctcttctgtggatggcctccgttgagccccattggatcgcagcttcaattatcttggaatttttcctgatggtgctcctgattcctgagcccgaccggcagcgtactccacaggataaccaacttgcctacgtcgtaatcggactcctgtttatgatattgacggtggcagccaatgagatgggtctgttagaaaccacaaaaaaggacctaggcattgggcacgttgctgtggagaaccaccatcacgcgactatgctggatgtcgacctccatcctgcctctgcatggaccctttacgctgtggccacaaccatcattactcccatgatgagacacacaatcgaaaacacgaccgccaatataagtctgactgcaatcgctaaccaggccgcgattttgatgggactggataaaggctggccaatctcgaagatggacattggtgtccctctcctggctcttgggtgctatagccaggtgaatccgttaacactgaccgccgcagttctcatgttggtggcccattacgctatcataggccccggactgcaagcaaaagccaccagggaggcgcagaagcgcacagctgccggcattatgaagaacccaactgtagatgggatcgtggcaatcgacctagatcctgtcgtttatgacgccaaattcgaaaagcagctgggacagattatgctccttatcctgtgtacgtcccaaatattgctgatgcggaccacatgggctctctgcgagtctattactctggccaccggccccttaacaaccctttgggagggttcaccagggaaattttggaatactacgatcgcagtgagcatggctaacattttccgaggatcctacctggccggcgcgggtctcgccttcagtctaatgaagtctctgggcgggggaagaaggggcacaggggcacagggagaaaccttgggcgagaaatggaagcgccagctgaatcagctcagcaagtcagaatttaacacttataaacggtccggtatccttgaggtcgacagaagtgaagctaaggaggggctgcgtaggggagagaccacaaaacacgccgtgagccggggcactgcaaagttgcgctggttcgtagaacgaaatctggtgaaacctgagggtaaggttatagatctcggctgtgggagaggaggctggtcttactattgcgctgggttaaagaaagtgaccgaagtcaagggatacacaaaaggcggtcccgggcacgaggaaccgatcccaatggccacgtacggatggaacctggtgaagcttcattccggcaaagacgtctttttcattcctcccgagaagtgtgataccctgctatgcgacatcggcgagtcaagcccaaatcccactattgaagaggggaggacactccgggtgctgaaaatggttgaaccttggttgcgcggaaaccaattttgtatcaagattctgaatccgtatatgccctcggtagtggagaccctcgagcagatgcagagaaagcacggtggcatgcttgtcaggaacccactgtctcgaaatagtactcatgaaatgtactgggtgtcctgcgggacaggaaacatcgttagcgccgtgaatatgacctcacggatgttactgaaccgtttcacgatggcgcacagaaaacctacctatgagcgcgatgtcgacttgggcgctggtacaaggcacgtggcagtagaacccgaggtggccaacctcgatataattgggcagcggatcgaaaatatcaagcatgagcacaaatccacttggcattacgacgaggataacccttataagacctgggcttaccacggatcttatgaagttaaaccaagcggcagtgcctccagcatggtcaatggcgtggtgaagctgctaacaaagccctgggacgtcattcctatggttactcaaatagcaatgaccgatacaaccccatttgggcagcagagagtgttcaaagagaaggtagacactcgcacgcccaaagccaagaggggaacagctcaaatcatggaagtgaccgcgcgatggctttggggttttctgtctcggaacaaaaagccgagaatttgtactagggaggaattcacccgcaaggtccgttcaaatgccgcaatcggcgctgtgtttgttgacgagaaccagtggaatagtgccaaagaggcagtggaagatgagcggttctgggacctcgtccatagagaaagggagctgcacaagcaggggaaatgcgccacatgcgtgtacaacatgatgggaaagcgcgaaaaaaagttgggcgagtttggtaaggctaaagggtcccgagccatttggtacatgtggctgggagcgcggttcctcgagttcgaagcacttggctttatgaatgaggatcactggttcagcagagaaaactctctgtcgggcgtagagggggagggattacataagctgggttatatcttgagggacatatcaaaaatccctggcgggaatatgtacgccgatgacacggctggatgggatacccgcattactgaagacgatctccagaacgaggccaagatcacagacattatggaaccagagcacgcactgctagctaccagcatctttaaacttacttatcaaaataaggttgtgagagtccagcggcccgccaaaaacggcacagtgatggatgtgatatccaggcgtgaccagcgaggtagtgggcaggtcggaacctacggcctgaatacattcactaacatggaagctcaactcattcgccagatggagtctgagggcatctttagcccttccgaactggagaccccaaacttggccgaaagagttttagattggctggagaagtatggggtggaacggctcaagaggatggcaatctcaggagacgactgtgtagtgaaacccattgatgaccgcttcgcgacggcccttaccgctctgaatgatatgggtaaggtcagaaaagacataccgcagtgggagcctagtaagggctggaacgattggcagcaagtgcccttttgctctcatcacttccaccagctaatcatgaaagacgggcgggagattgttgtgccatgtaggaatcaggatgaactggtcggacgagcccgtgtgagccagggcgcaggttggtccctcagagagacagcttgcttggggaagtcatacgcccaaatgtggcagctgatgtattttcatcgccgggaccttaggctggcagccaacgcgatctgtagcgctgtacctttcgattgggttcccacttctagaaccacatggtccattcacgcccatcaccagtggatgactaccgaagacatgctcagtgtgtggaatcgcgtctggatcgaggaaaacccatggatggaggataagacgcatataagctcgtgggaggacgtgccctacttaggaaaacgggaagaccaatggtgcggctccctgatcggcttgacagcaagggccacctgggctactaatattcaggttgccatcaaccaggtgcgaagactgattgggaatgagaactacctcgattatatgacatctatgaagcggtttaaaaatgaatcagacaccgagggagcactttggtga

SEQ ID NO: 13293 - RNA, 9879 nt, synthetic construct
  misc_feature 1..9879: note = derived and/or modified CDS sequence (opt3) from DENV-1__FJ639683__SS-prME
  source 1..9879: mol_type = other RNA
tccgtgaccatgctgctcatgcttatgcccacagcactggctttccacttgactacgagaggaggggagcctcatatgatcgtctccaagcaggaaagaggaaaatctttactgtttaagacctcagccggtgttaatatgtgcacattgattgccatggacctcggcgagctgtgtgaagatactatgacctacaaatgcccacggattacagaggcggaaccggacgatgtggactgttggtgcaatgctaccgatacttgggtaacatatgggacctgtagtcaaacgggagagcaccgccgagacaagcgtagcgtggcccttgcaccccatgtcggcctgggtttggagactagaaccgaaacatggatgtcctctgagggggcctggaaacagatccagagggtggaaacttgggctctccggcaccctggattcaccgttattgcactgtttctggcccatgctatcggcacatcgattacccagaagggcatcatattcatcctcttaatgctggtgacgccatcaatggccatgcgctgcgtcgggattggaagcagagattttgtggagggtcttagtggcgcgacttgggtagacgttgtgttggagcacgggtcctgtgtcacaaccatggcaaaggataaacccactctggacatcgaactactcaagacagaggtgaccaaccctgccattctgaggaaactttgcatcgaagctaagatatctaatacgaccacagatagccggtgtccaactcaaggagaggccaccctggtggaagaacaagacgcaaacttcgtctgccgccgaacatttgttgatagaggctggggtaatgggtgtggattgttcggcaaaggctccctcattacttgcgctaagtttaagtgcgtgaccaaactggaggggaagatcgtacagtacgaaaacttaaaatattcagtgattgtcacagtgcacaccggagaccagcatcaagttggtaatgagagtactgaacacggcacgacagccaccatcactccccaggcgcctaccacagagatccagctgaccgactacggggccctcactcttgattgtagcccaaggacaggactggacttcaacgaaatggtgttgctaacgatgaaggagaaatcttggctggtccataagcagtggtttctcgatctgccgcttccctggacctccggcgcatcaactagccaagagacatggaatcggcaggacctgttggtgaccttcaaaacagctcacgccaagaagcaggaagtagttgtgctcggtagtcaagagggggctatgcacactgccctgaccggcgcaacggaaattcagacctctggaacaactaccatatttgccggccatttaaaatgccgtctgaagatggataaactaacactcaaggggatgtcctatgtcatgtgtactggtagcttcaaactggagaaggaagtggctgagacccagcacggtacggtccttgtgcagatcaagtacgagggcacagacgcgccttgcaaaattccattctcgacccaagatgaaaagggggttactcagaacggacgcttgatcacagcaaatcccatagtgaccgacaaagagaagcctgtaaacattgaagccgagccaccctttggcgagtcttatatcgtcatcggtgctggggaaaaagccctgaagctctcctggttcaagaaaggctcaagtattggaaagatgtttgaggcaactgccagaggcgctaggcggatggccatcctgggggataccgcatgggacttcggaagcattggtggcgtgtttacatccgttgggaaacttgtgcatcagatattcggaacggcgtacggcgtcctgttttctggtgtgagctggaccatgaagatcgggattggcgtattgctcacttggctgggattaaattcacgaagtacatccttcagcatgacctgtatcgctgtgggcctggttacactatacctcggggtcatggtgcaggccgattctggatgcgtgatcaactggaaaggccgcgaactgaagtgtggttcagggatttttgtcactaatgaggttcacacctggacggaacaatataagttccaggcagacagtccgaaaagacttagcgccgctataggaaaggcctgggaggagggcgtgtgcggtatcaggtccgcaacacggttggaaaacattatgtggaaacagatctctaacgagctgaatcatattctcctggaaaacgacatgaagtttaccgtggtagtcggcgatgtggctgggatcttagcccagggcaagaagatgatacgccctcaacccatggagtacaaatattcgtggaaaagctggggcaaggcgaagatcattggggccgacgttcagaatactaccttcatcattgatggaccaaacacacctgaatgtcccgacgatcagagagcttggaatatctgggaggtggaggactacggctttggtatattcactaccaacatttggctgaaacttagggattcctatacacaggtctgcgaccaccgtttgatgtcagcagccatcaaagatagtaaggctgtgcacgccgacatggggtactggattgaatctgagaaaaatgaaacgtggaagctcgcacgggcgagcttcatcgaggttaagacctgtatatggccaaaatcccatactctgtggtcaaacggagtgctagaaagcgagatgatcattcccaagatctatggcggtcctatttctcaacacaattaccgaccaggctactttacacagaccgccgggccgtggcatctgggaaaactcgagctggatttcgacctttgcgaaggcactacagtagtcgtggatgagcactgcgggaacagaggaccctccttgaggaccacgactgtgaccggcaagatcatacacgaatggtgttgccgcagttgtacactgcctccattacggtttagaggtgaggacgggtgctggtatggaatggagattaggcccgtcaaagaaaaggaggaaaatctcgttaagagcctggtgtctgctggctccggtgaggtagactcattcagtcttggcctgttgtgtatcagcatcatgattgaagaggtgatgcgctcgcgatggtcccggaaaatgctcatgaccgggactctggccgtctttctactgctcatcatgggacagctgacatggaacgatcttattcgtttgtgcataatggtgggcgcaaatgcttctgacagaatggggatgggaaccacatacctggccttaatggcaactttcaagatgaggcctatgtttgccgttggcctcctgttccgccggcttaccagcagagaggtgctgctactcacgatcggtctgtcattggtcgctagtgtggaactgccaaactccttagaggaactcggggatggactggcgatgggcattatgatccttaaactgttgacagactttcaatctcatcagctctgggccaccctgctaagcctgactttcattaagaccacattttcccttcactatgcatggaaaactatggctatggttctctcaatcgtgagcctgttccccttgtgtctgagtaccacgtctcagaagacaacctggttaccggtcctcctgggctcccttgggtgcaagcctctgactatgtttttgatagccgagaataaaatctggggaaggcgaagctggccactcaacgaaggtattatggccgtaggcatcgtgtcgattctgctatcatctctgcttaagaacgatgttcccctcgctgggcctctgatcgcaggaggcatgttgatagcctgttacgtgattagtggttccagcgcggacttatctctggagaaagctgccgaggtcagctgggaagaggaagcagagcattccggggcctcacacaatatcctcgtggaagtacaggatgacggaacaatgaagatcaaagatgaggagcgcgacgataccctgactattcttctgaaggctacattgctagcagtgagtggcgtctatcccctgagcataccagccaccctcttcgtttggtacttctggcagaagaagaagcagcggtctggcgtgctgtgggacacgccttcacccccagaagtggagagagcggtccttgatgacgggatctataggattatgcagcgtggattactgggtcgcagccaggtgggcgttggggtatttcaagaaaacgtgttccatactatgtggcacgtcacccggggagctgtgctcatgtaccagggcaaaagattggagccgagttgggccagcgttaagaaagacctgatctcctacggtgggggatggaggctccagggctcttggaatacaggcgaggaagtgcaggtcattgcagtggagcctgggaagaaccccaaaaatgtacaaaccgccccaggaacatttaagactcccgaaggtgaggtcggcgctatcgccctggatttcaagcctgggacctcgggaagcccaatagtgaaccgagaaggcaaaatcgttggtctttatgggaatggagtggtcacgacatcaggcacttacgtgtccgcaattgctcaggccaaggcgagtcaggagggccccctgcctgagatcgaagacgaggtttttcggaaacgcaacttgaccattatggatctacacccggggtctggaaagacaagaaggtatctgccagccatcgtgcgggaagcaataaaacgaaagctcagaaccttaattctggctcccactcgcgtcgtggccagcgagatggctgaagcacttaagggtatgcctatcaggtaccaaaccacagccgtaaaatccgagcatacgggcaaggagatcgtggacctgatgtgccacgccactttcaccatgcgtctcttgtcaccagttcgggtccccaattataacatgattatcatggatgaagctcattttacagacccttctagcatagcggcaagagggtacattagtaccagggtgggaatgggcgaggccgctgccatcttcatgactgcaacaccgcccggttccgtggaagcctttccacagagcaatgctgtcattcaggatgaggaacgcgacatccctgagcgatcttggaactcagggcacgagtggataaccgatttccccggaaaaacggtatggtttgtgccatccattaagagtggcaatgacatcgcgaactgtctgaggaagaatggcaagcgggttatccagctcagcaggaagactttcgatacagaatatcagaaaaccaagaacaacgactgggactacgtggtcaccactgatatttcggagatgggggccaatttccgcgcagaccgtgtgatcgatcctagacggtgcctgaaacccgttattcttaaggacggaccagaaagggtgatactagctggtccgatgcctgtcacagtggcctctgcagcccagcgccgaggcagaatcgggcggaaccataataaagagggagatcagtacatttatatgggccagcccctgaacaatgacgaggatcacgctcactggaccgaagccaagatgttgttagacaacatcaatacaccagagggtatcattcccgcgctgtttgaacctgagagggaaaagtccgcagccatagatggggagtaccgcctcagaggcgaggctaggaaaactttcgtagaactgatgcggcgtggagaccttccagtgtggctgagctataaggttgcctcagagggctttcaatacagtgatcgccgatggtgcttcgacggggaaagaaacaatcaggtcctcgaggaaaacatggatgtggagatctggacgaaagagggagaaaggaagaaattgcggccccgctggctggacgctagaacctattctgaccctctagcactgagggagtttaaggagttcgccgctggtcggcgatccgtgagcggcgatctcattcttgagatcgggaaactgccgcagcatttaacacagagagcccaaaatgcattggacaacctggtcatgctccacaattcagaacagggaggccgcgcgtacaggcatgccatggaggagctgccagatactattgaaacccttatgctgctcgctttgatcgccgttctgacaggtggggtgaccttatttttcctaagtggccggggactgggcaagactagcatagggctcctttgtgtaatggcatcctctgtgctgttgtggatggctagcgtcgagccccactggatcgccgcatccattatcctggaatttttcctcatggtgctgcttattcctgagcccgaccgtcagagaacgccacaggataaccaactcgcctatgttgtgatcggactgttgtttatgatactgaccgtcgctgcgaatgagatgggtttactagaaacaactaagaaagacctgggcattgggcacgtagccgtgggaaaccatcaccatgcagctatgctcgatgttgaccttcaccctgcctcagcctggaccctgtacgcagtggctacaaccatcattactcccatgatgaggcatacaatcgagaacacgaccgccaatatatctttgactgcgatcgctaaccaggccgcaattctgatgggcctcgataagggttggccaatcagtaaaatggacattggggtccctctgcttgccttaggctgctactcgcaagtgaatccgctgacactcaccgctgcagtcttgatgctggtggcccactatgcgatcataggacccggcctacaagctaaggccacccgcgaagcacagaaacggacagccgctgggattatgaagaacccaactgttgatggaatcgtggccatcgacctggatcctgtagtgtacgacgcaaagttcgagaaacagctcggccagattatgcttctgatcttgtgtacgagccaaatactgctcatgcgaaccacatgggctctgtgcgaatccattactttagccaccggtccccttacaaccctgtgggaggggtctccaggaaagttttggaatactacgatcgcggtctcaatggccaacattttcagaggcagctatctcgcaggagctggcctagccttctccctgatgaaaagtctagggggaggcaggcgcgggacaggagcacagggcgagaccctgggtgaaaagtggaaacggcagctcaatcagctttctaagagcgagtttaacacttacaagagatcagggatcatggaagttgaccgttccgaggctaaagaaggactgaagaggggcgagaccacaaaacacgccgtgagtcggggtactgccaagttgcgctggttcgtcgagcgaaatctggtgaaacctgaaggcaaggtaatagatctcgggtgtggaagaggcgggtggagctattactgcgcgggattaaagaaagtgaccgaggttaagggctatacaaaaggtgggcccggacatgaggaaccgatcccaatggctacgtacggctggaacctggtgaaacttcactctggcaaagacgtctttttcgtgcctcccgaaaagtgtgataccctgctatgcgacattggggagtcctcaccaaatcccactatcgaggaaggaaggacactccgggtcctgaaaatggtggagccttggttgcgcggtaaccaattttgtattaagatcctgaatccgtacatgcccagcgttgtagaaaccctcgagcagatgcagagaaagcatggcgggatgcttgtgaggaacccactgtcgcgaaattctactcacgagatgtattgggtcagttgcggaacaggcaacattgtgtccgcagttaatatgaccagccggatgttactgaaccgtttcacgatggcccacagaaaacctacctacgaacgcgatgtggacttgggtgctgggacaaggcatgtcgccgtggagcccgaagtagcaaacctcgatatcataggacagcggattgagaatatcaagcacgaacataaatcaacttggcactatgacgaggataacccttacaagacctgggcctatcatggctcctacgaggtgaaaccatctggcagcgctagttccatggttaatggggtcgtgaagctgctaacaaagccctgggacgtgatccctatggtcactcaaattgcgatgaccgatacaaccccatttggacagcagagagttttcaaagaaaaggtggacactcgcacgcccaaagccaagaggggtacagcacaaataatggaggtaaccgctaaatggctttggggctttctgagccgaaacaagaagccgcggatctgtactagagaagagttcaccaggaaagtgcgctctaatgccgcaattggggccgtctttgtggacgaaaaccagtggaactcagctaaggaggccgttgaggatgaacgtttctgggacctcgtgcaccgggagagagaactgcacaaacagggaaagtgcgcgacatgcgtctataacatgatgggcaaaagggagaagaagttgggtgaatttgggaaagcaaagggaagtcgcgccatctggtacatgtggctgggcgctcgattcctcgagttcgaggcccttggctttatgaatgaagatcattggttctcccgggagaacagcctgtctggggtggaaggagagggtttacacaaactgggctacattttgagagacatctcgaagatacctgggggaaatatgtatgcagatgacacggctggctgggataccaggatcactgaggacgatctccagaacgaagcccgcattacagacatcatggagccagaacatgctctgctagccaaatcaatttttaaacttacctaccaaaataaagtagttagagtgcagcggcccgcaaagaacggtactgtcatggatgtgatcagcaggcgtgaccagcgagggtccggacaggtgggcacatatggcctgaataccttcacaaacatggaggcgcaactcatacgccagatggaaagtgaggggatattttctcctagcgagctggaaactccaaacttggccgagagagtcttagattggctggaaaagtacggagttgagcggctcaaaaggatggctatctccggtgacgactgtgtggtaaagcccatcgatgaccgcttcgccaccgcacttacggctctgaatgatatgggcaaagtgagaaaggacattccgcagtgggaaccttcaaaagggtggaacgattggcagcaagtccccttttgcagtcaccacttccatcagctaataatgaaggacggacgggagatcgtggttccatgtaggaatcaggatgagctggtgggccgagcccgtgtctctcagggtgcagggtggagcctcagagaaaccgcctgcttgggaaagtcctatgcgcaaatgtggcagctgatgtactttcaccgccgggaccttaggctggctgccaacgcaatttgttcagccgtgcctgtagattggatccccacaagcagaactacctggtctattcatgctcaccatcagtggatgacaactgaggacatgctctccgtttggaatcgcgtgtggatcgaagagaacccatggatggaagataaaacccacataagtagctggggcgacgtcccctatttaggcaagcgggaggaccaatggtgcgggtcgctgatcggattgacggccagggcaacatgggctaccaatattcaggtggccatcaaccaggttcgaagactgattggtaatgagaactacctcgattacatgacttccatgaaacggttcaagaatgaatctgaccctgagggcgcgctttggtga

SEQ ID NO: 13294 - RNA, 9879 nt, synthetic construct
  misc_feature 1..9879: note = derived and/or modified CDS sequence (opt3) from DENV-1__FJ639684__SS-prME
  source 1..9879: mol_type = other RNA
agcgtgaccatgctgctcatgcttatgcccaccgcactggctttccacttgactacgagaggaggggaacctcatatgatcgtctccaagcaggaaaggggaaaatctttactgtttaagacctcagccggtgttaacatgtgcacactgattgccatggacctcggagagttctgtgaagatactatgacctacaaatgcccacggataagtgaagcggaaccggacgatgtggactgttggtgcaatgctacagatacctgggtaacttatgggacatgtagccaaaccggagagcaccgccgagacaagcgttccgtggccctggcaccccatgtcggccttggtctggagacgagaactgaaacctggatgtcttcggagggggcctggaaacagatccagagggtggaaacatgggctttgcggcaccctggatttactgttattgcactcttcctggcccatgctatcggcacctcaattacacagaagggcatcatatttatcctgctcatgttagtgaccccaagcatggccatgcgctgcgtcgggattggaagtagagatttcgtggagggtctgtccggcgcgacgtgggtagacgttgtgcttgagcacgggtcttgtgtcactacaatggcaaaggataaacccaccttggacatcgaactgctaaagactgaggtgacaaaccctgccgtgctcaggaaactgtgcattgaagctaagatcagcaataccacgaccgattcccggtgtccaacacaaggagaggccactcttgtcgaagaacaagacgcaaactttgtttgccgccgaaccttcgtggatagaggctggggtaatgggtgtggactgtttggcaaaggctcattgataacatgcgctaagttcaagtgcgtaactaaactcgaggggaagattgtgcagtacgaaaacctgaaatatagtgtcatcgtgaccgttcacacaggagaccagcatcaagtgggtaatgagagcaccgaacacggcactacggccacaattacaccccaggcgccttctactgagatccagttaaccgactacggggccctgacactcgattgttccccaaggaccggacttgactttaacgaaatggtcctgttgactatgaaggagaaatcatggctagtgcataagcagtggttcctggatctcccgctgccctggacaagcggcgcaagtacgtctcaagagacctggaatcggcaggaccttctggtaacttttaaaacagctcacgccaagaagcaggaagttgtggtcttgggttcccaagagggggctatgcacaccgccctcacaggcgcaactgaaatccagaccagcggaacgaccacaattttcgccggccatctgaaatgccgtttaaagatggataaactgactctaaaggggatgtcgtatgtgatgtgtaccggatctttcaaactcgagaaggaagtcgctgagacacagcacggtactgtgctggttcagataaagtacgagggcaccgacgcgccttgcaaaatcccattttccacgcaagatgaaaagggggtgacacagaacggacgccttattaccgcaaatcccatcgtaactgacaaagagaagcctgtcaacatagaagccgagccacccttcggcgagtcatatattgtgatcggtgctggggaaaaagccttgaagctgagttggtttaagaaaggcagctccatcggaaagatgttcgaggcaacagccagaggcgctaggcggatggccattctcggggataccgcatgggactttggatctatcggtggcgttttcactagcgtggggaaactggtccatcagatttttggaaccgcgtacggcgtgcttttctcaggtgtaagttggacaatgaagatagggatcggcgtgctgttgacgtggctcggactaaattcccgaagcacctctttatcaatgacttgtattgctgttggcctggtcacactatacctcggggtgatggtgcaggccgatagtggatgcgtcatcaactggaaaggccgcgaactgaagtgtggtagcgggatctttgttaccaatgaggtgcacacatggactgaacaatataagttccaggcagactccccgaaaagactttctgccgctattggaaaggcctgggaggagggcgtgtgcggtataaggtcggcaacccggttggaaaacatcatgtggaaacagattagcaacgagctgaatcatatcctcctggaaaacgacatgaagtttacggtagtcgtgggcgatgttgctgggattttagcccagggcaagaagatgatccgccctcaacccatggagtacaaatattcctggaagtcatggggcaaggcgaaaataatcggggccgacgtgcagaatacaaccttcattatcgatggaccaaacactcctgaatgtcccgacgatcagagagcttggaatatttgggaggtcgaggactacggctttggtatcttcaccacaaacatatggctgaaacttagggatagttatactcaggtgtgcgaccaccgtttgatgtctgcagccattaaagatagcaaggctgttcacgccgacatggggtactggatcgaatccgagaaaaatgaaacctggaagctcgcacgggcgtcattcattgaggtgaagacatgtatctggccaaaaagccatacgctgtggtctaacggagtactagaatccgagatgataatccccaagatttatggcggtcctatcagtcaacacaattaccgaccaggctactttacccagactgccgggccgtggcatctgggaaaactcgagctggatttcgacctttgcgaaggcacaaccgtcgtggtggatgagcactgcgggaacagaggacccagcttgaggactacaaccgtcacgggcaagattatccacgaatggtgttgccgctcttgtactctgcctccattacggtttaaaggtgaggacgggtgctggtatggaatggagataagacccgttaaggaaaaggaggaaaatctcgtgaaatccatggtatcagctggcagtggtgaggtggacagcttctcgctgggccttctgtgtatttccatcatgatcgaagaggtcatgaggtctcgctggagccgaaagatgttgatgaccgggacactcgccgtgtttttcctgctaattatgggacagctgacctggaacgatctcatccggctgtgcattatggttggcgcaaatgcttcagaccgtatggggatgggaatgacttaccttgccttgatggcaacatttaaaatgagacctatgttcgccgtgggcctgttatttaggcgcctcaccagtcgggaggtcctgcttctgacaataggtctatccctcgtggcttctgttgaactgccaaacagcttggaggaactgggggatggattagcgatgggcatcatgattctcaagctgcttactgacttccaatcccatcagctgtgggccaccttgctctcactgacgtttatcaaaacaaccttcagcctacactatgcatggaagactatggctatggtgctgagtattgtctctctttttcccctctgtctgtccaccacaagccagaagactacctggttgccggtactgttaggctcgctcgggtgcaaacctctgacgatgttccttatcgccgagaataagatatggggaagaaaatcatggccactgaacgaaggtatcatggccgtgggcattgtttctatcttgctcagttccctgctaaagaacgatgtgcccctggctgggcctcttattgcaggaggcatgctcatcgcctgttacgtcataagcggttctagcgcggacctgtccttggagaaagctgccgaggtgtcatgggaagaggaagcagagcatagtggggccagccacaatattttagtagaagtgcaggatgacggaacaatgaagatcaaagatgaggagagggacgataccctgactatcctcctgaaggctacacttctggcagtctctggcgtttatcccttgtccattccagccaccctattcgtgtggtacttttggcaaaagaaaaagcagcgatcaggcgtgctgtgggacactcctagtcccccagaagtcgagcgcgcggtgctcgatgacgggatatatcggatcatgcagagaggactgcttggtaggagccaggttggcgtaggggtgttccaagaaaacgtctttcatacaatgtggcacgtgacccgtggagctgttttaatgtaccagggcaaacgcctggagccgtcctgggcctctgtgaagaaagacctcatttcgtacggtgggggatggcggttgcagggcagctggaatacgggcgaggaagtccaggtgatcgcagtagagcctgggaagaaccccaagaatgtccaaactgccccaggaaccttcaaaacatcagaaggtgaggtgggcgctattgccctggattttaagcccgggacctccggaagtcctatcgttaacagagaaggcaaaatagtgggtctctatgggaatggagtcgtgacaacttctggcacctacgttagcgcaatcgctcaggccaaggcgtcccaggagggcccactgcccgagattgaagacgaggtgttcaggaaacgaaaccttacgatcatggatctgcaccctgggtcaggaaagacacggcgctatttgccggccattgtcagagaagcaatcaagaggaaactacggactctgatactcgctccaacccgagtggtagcctctgagatggctgaagcattaaagggtatgcccattagataccaaacaaccgccgtgaaaagcgagcatactggcaaggagatcgttgacctgatgtgccacgccacctttacaatgcgccttctgagtcctgtcagggtgccaaattataacatgatcattatggatgaagctcatttcacggacccctccagcatcgcggcacgtgggtacatatctactcgggtgggaatgggcgaggccgctgccatttttatgaccgcaacacctccgggttcagtcgaagccttcccccagtccaatgctgtaatccaggatgaggaaagagacattccagagaggagttggaacagcgggtatgagtggatcaccgattttcctggaaaaactgtgtggttcgttccctcgataaagtctggcaatgacattgcgaactgtctccgcaagaatggcaaacgagtgatccagttgtccagaaagacattcgataccgaataccagaagacgaagaacaacgactgggactacgtcgtgactacagatatcagcgagatgggggccaattttcgggcagacagggttattgatccacgccgttgcctgaaacctgtgatcctcaaggacggacccgaaagagtcattctggctggtccaatgccggtgaccgtagcctcagcagcccagcggaggggccgcatagggcgaaaccacaataaggagggagatcagtatatctacatgggccagcctcttaacaatgacgaggatcatgctcactggaccgaagccaaaatgctactggacaacattaatactcccgagggtatcatcccagcgttgttcgaacccgagagagaaaagagtgcagccattgatggggagtatcggttaaggggcgaggctcgcaaaacatttgtggaactgatgagaaggggagacctccctgtttggctgtcttacaaggtcgcctccgagggcttccaatatagcgatcggcgttggtgctttgacggggaacgcaacaatcaggtgcttgaggaaaacatggatgtggagatatggaccaaagagggagaacgaaagaaactgagaccaaggtggctcgacgctcggacatactcagaccccttggcactgcgcgagttcaaggaatttgccgctggtagaaggagtgtcagcggcgatctaatcctggagattgggaagctccctcagcaccttactcagcgggcccaaaatgcactggacaacttagttatgttgcataattccgaacagggaggccgagcgtatagacacgccatggaggagctgccggatacgatcgaaaccctcatgctgcttgctctgattgccgtgctcacaggtggggtaactttgttctttctgtctggccgcggattaggcaaaaccagcatcgggctactgtgtgtgatggcatcctcagtcctcctttggatggcttctgtggagccacattggatagccgcaagtatcattctggagttctttttgatggttctgctcatccccgagcctgacaggcagcggacaccccaggataaccaactggcctacgtggtcattggacttctcttcatgatcctgaccgtagctgcgaatgagatgggtttgctggaaactacgaagaaagacttaggcatagggcacgtggccgttgagaaccaccatcacgcagctatgctagatgtggacctgcatccagcctcggcctggaccctctacgcagtcgctacaactattatcacccctatgatgcgtcacacaattgaaaacaccactgccaatatcagccttacagcgatagctaaccaggccgcaatcctgatgggattggataagggctggcccatttccaaaatggacatcggtgtgccactgctcgccctggggtgctattctcaggtcaatcctcttacgttaaccgctgcagtgctgatgctcgttgcccattacgcgattatcggcccgggattgcaagctaaggccactagagaggcacagaagaggacagccgctggcataatgaaaaaccccaccgtggatgggattgtagccatcgacctggatccagtggtctatgacgcaaagtttgaaaaacagctaggacagatcatgctgctcattctttgtacctcacaaatcctgttgatgcgcacaacttgggctctgtgcgagagcataacgctcgccaccggccctctgacaactttatgggagggttcccccgggaagttctggaataccacaattgcggttagtatggccaacatcttccggggatcttaccttgcaggcgctggtctggcctttagcctcatgaaatcactaggcgggggacgaagaggcaccggggcacagggagaaactctgggcgagaagtggaagaggcagttgaatcagctgtccaaaagtgagttcaacacgtataagcgcagcggtattatggaggtggaccggtctgaagctaaagaggggctcaagagaggagagacaaccaaacacgccgtctcccgtggcactgccaaacttaggtggtttgtggaacggaatctggtaaagccagagggtaaagtgatcgatttgggctgtgggcgcggaggctggtcatactattgcgcggggctgaagaaagttaccgaagtgaagggatacacaaaaggcggtcctgggcacgaggaacccataccgatggctacttacggatggaacctcgtcaagttacatagcggcaaagacgtgttctttgtcccacctgagaagtgtgataccctgctttgcgacatcggcgagtcgtctcccaatccaacaattgaagaggggcgaacgctgagagtgctaaagatggttgaaccctggctcaggggaaaccaattctgtatcaaaattctgaatccttatatgccgagtgtagtggagaccttggagcagatgcagcggaagcacggtggcatgctggtccgcaaccccctctccagaaatagcactcatgaaatgtactgggtgtcatgcgggacaggaaacatcgtttccgcagtgaatatgacctctaggatgcttctgaaccgatttactatggcccaccggaaaccaacatatgagcgtgatgtcgacttaggcgctggtaccagacacgtggccgtagaacctgaggtggcaaacctggatattatcgggcagcgcatagaaaatattaagcatgagcacaaaagcacgtggcattacgacgaggataacccctataagacctgggcctaccacggaagttatgaagttaagccttccggcagcgcttcttcaatggtcaatggcgtggtgaaattgctcacaaagccatgggacgtcatccccatggttactcaaatcgcgatgaccgatacaactcctttcgggcagcagagggtgtttaaagagaaggtagacacccggacaccaaaagccaagagaggaaccgcacaaattatggaagtgactgctaagtggctgtggggtttcctaagtcgcaacaaaaagcccaggatatgtacgcgagaggaatttacacggaaagtcagatccaatgccgcaatcggcgccgtgttcgttgacgagaaccagtggaatagcgctaaggaggccgtggaagatgagaggttttgggaccttgtccatcgcgaacgtgagctgcacaaacaggggaagtgcgcgacctgcgtgtacaacatgatgggaaagcgggagaaaaagctcggcgagttcggtaaagcaaaggggtctagagccatttggtacatgtggctgggagctaggttcttggagtttgaagccctgggcttcatgaatgaggatcactggttttcgcgcgaaaactcactcagcggcgtagagggggagggacttcataaactgggttatatcttacgagacatttccaagatcagtggcgggaatatgtacgcagatgacactgctggatgggatacccggataacagaagacgatctgcagaacgaggccaaaatcacggacattatggaaccggagcacgctttgctcgccaagtctatcttcaagctgacctatcaaaataaagttgtgagagtccagaggcctgcaaagaacggcactgtgatggatgtgattagccgcagagaccagcggggttccgggcaggtcggaacatacggcctaaatacctttactaacatggaagcgcaacttatcaggcagatggagtcagagggcatattcagtccatctgaactggagacacccaacctcgccgaacgtgctctggattggttggagaaacatggggttgaacgattaaagcgcatggccattagcggagacgactgtgtggtaaaacctatcgatgacagatttgcaaccgctctgacagccctcaatgatatgggtaaggtgcggaaggacatcccacagtgggagccctccaaaggctggaacgattggcagcaagtcccgttctgctcacaccactttcatcagcttattatgaaggacgggagggagatagtggttccttgtcgcaatcaggatgaactggtgggcagagcacgggtcagccagggcgccggttggtctctaagggagactgcgtgcctggggaaatcctatgctcaaatgtggcagctcatgtacttccaccgacgtgacttgagactggccgcaaacgccatctgtagtgctgtgcccgtagattgggttccaaccagccgcacgacctggtcgattcatgcccaccatcagtggatgacaactgaagacatgctttccgtgtggaatcgggtctggatcgaggaaaacccttggatggaggataagacccacatttcttcatgggaggacgtgccctatctgggaaaaagggaagaccaatggtgcggcagcctcatcggcttaacagcaagagctacttgggccaccaatatacaggttgcgatcaaccaggtgcgccggctgattgggaatgagaactacttggattacatgacgagtatgaagaggtttaagaatgaatccgtcccagagggagctctgtggtga

SEQ ID NO: 13295 - RNA, 9879 nt, synthetic construct
  misc_feature 1..9879: note = derived and/or modified CDS sequence (opt3) from DENV-1__FJ639685__SS-prME
  source 1..9879: mol_type = other RNA
tccgtgaccatgctgctcatgcttatgcccacagcactggctttccacttgactacgagaggaggggagcctcatatgatcgtctccaagcaagaaagaggaaaatctttactgtttaagacctcagccggtgttaatatgtgcacactaattgccatggacctcggcgagctgtgtgaagatactatgacctacaaatgcccacggattacagaggcggaaccggacgatgtggactgttggtgcaatgctaccgatacttgggtaacatatgggacctgtagtcaaacgggagagcaccgccgagacaagcgtagcgtggcccttgcaccccatgtcggcctgggtttggagactagaaccgaaacatggatgtcctctgagggggcctggaaacagatccagagggtggaaacttgggctctccggcaccctggattcaccgttattgcactgtttctggcccatgctatcggcacatcgattacccagaagggcatcatattcatcctcttaatgctggtgacgccatcaatggccatgcgctgcgtcgggattggaagcagagattttgtggagggtcttagtggcgcgacttgggtagacgttgtgttggagcacgggtcctgtgtcacaaccatggcaaaggataaacccactctggacatcgaactactcaagacagaggtgaccaaccctgccattctgaggaaactttgcatcgaagctaagatatctaatacgaccacagatagccggtgtccaactcaaggagaggccaccctggtggaagaacaagacgcaaacttcgtctgccgccgaacatttgttgatagaggctggggtaatgggtgtggattgttcggcaaaggctccctcattacttgcgctaagtttaagtgcgtgaccaaactggaggggaagatcgtacagtacgaaaacttaaaatattcagtgattgtcacagtgcacaccggagaccagcatcaagttggtaatgagagtactgaacacggcacgacagccaccatcactccccaggcgcctaccacagagatccagctgaccgactacggggccctcactcttgattgtagcccaaggacaggactggacttcaacgaaatggtgttgctaacgatgaaggagaaatcttggctggtccataagcagtggtttctcgatctgccgcttccctggacctccggcgcatcaactagccaagagacatggaatcggcaggacctgttggtgaccttcaaaacagctcacgccaagaagcaggaagtagttgtgctcggtagtcaagagggggctatgcacactgccctgaccggcgcaacggaaattcagacctctggaacaactaccatatttgccggccatttaaaatgccgtctgaagatggataaactaacactcaaggggatgtcctatgtcatgtgtactggtagcttcaaactggagaaggaagtggctgagacccagcacggaacggtccttgtgcagatcaagtacgagggcacagacgcgccttgcaaaattccattctcgacccaagatgaaaagggggttactcagaacggacgcttgatcacagcaaatcccatagtgaccgacaaagagaagcctgtaaacattgaagccgagccaccctttggcgagtcttatatcgtcatcggtgctggggaaaaagccctgaagctctcctggttcaagaaaggctcaagtattggaaagatgtttgaggcaactgccagaggcgctaggcggatggccatcctgggggataccgcatgggacttcggaagcattggtggcgtgtttacatccgttgggaaacttgtgcatcagatattcggaacggcgtacggcgtcctgttttctggtgtgagctggaccatgaagatcgggattggcgtattgctcacttggctgggattaaattcacgaagtacatccttcagcatgacctgtatcgctgtgggcctggttacactatacctcggggtcatggtgcaggccgattctggatgcgtgatcaactggaaaggccgcgaactgaagtgtggttcagggatttttgtcactaatgaggttcacacctggacggaacaatataagttccaggcagacagtccgaaaagacttagcgccgctataggaaaggcctgggaggagggcgtgtgcggtatcaggtccgcaacacggttggaaaacattatgtggaaacagatctctaacgagctgaatcatattctcctggaaaacgacatgaagtttaccgtggtagtcggcgatgtggctgggatcttagcccagggcaagaagatgatacgccctcaacccatggagtacaaatattcgtggaaaagctggggcaaggcgaagatcattggggccgacgttcagaatactaccttcatcattgatggaccaaacacacctgaatgtcccgacgatcagagagcttggaatatctgggaggtggaggactacggctttggtatattcactaccaacatttggctgaaacttagggattcctatacacaggtctgcgaccaccgtttgatgtcagcagccatcaaagatagtaaggctgtgcacgccgacatggggtactggattgaatctgagaaaaatgaaacgtggaagctcgcacgggcgagcttcatcgaggttaagacctgtatatggccaaaatcccatactctgtggtcaaacggagtgctagaaagcgagatgatcattcccaagatctatggcggtcctatttctcaacacaattaccgaccaggctactttacacagaccgccgggccgtggcatctgggaaaactcgagctggatttcgacctttgcgaaggcactacagtagtcgtggatgagcactgcgggaacagaggaccctccttgaggaccacgactgtgaccggcaagatcatacacgaatggtgttgccgcagttgtacactgcctccattacggtttagaggtgaggacgggtgctggtatggaatggagattaggcccgtcaaagaaaaggaggaaaatctcgttaagagcatggtgtctgctggctccggtgaggtagactcattcagtctgggccttctgtgtatcagcatcatgattgaagaggtgatgcgctcgcgatggtcccggaaaatgttgatgaccgggactctcgccgtctttctgctactgatcatgggacagctcacatggaacgatctgattcgtctttgcataatggtgggcgcaaatgcttctgacagaatggggatgggaaccacatacttggccctgatggcaactttcaagatgaggcctatgtttgccgttggcttactcttccgccggctgaccagcagagaggtgcttctgctaacgatcggtctctcactggtcgctagtgtggaattgccaaactccctggaggaattaggggatggactcgcgatgggcattatgatcctgaaacttctgacagactttcaatctcatcagttgtgggccaccctcctgagcctaactttcattaagaccacattttccctgcactatgcatggaaaactatggctatggttctttcaatcgtgagcctcttccccctgtgtttgagtaccacgtctcagaagacaacctggctgccggtcttactcggctccctggggtgcaagcctcttactatgtttctgatagccgagaataaaatctggggaaggcgaagctggccattgaacgaaggtattatggccgtaggcatcgtgtcgattctcctgtcatctctactgaagaacgatgttccccttgctgggcctctcatcgcaggaggcatgctgatagcctgttacgtgattagtggttccagcgcggacttgtctttagagaaagctgccgaggtcagctgggaagaggaagcagagcattccggggcctcacacaatatcctggtggaagtacaggatgacggaacaatgaagatcaaagatgaggagcgcgacgataccctcactattctgcttaaggctacactgttggcagtgagtggcgtctatcccctaagcataccagccaccctgttcgtttggtacttctggcagaagaagaagcagcggtctggcgtgctctgggacacgccttcacccccagaagtggagagagcggtcctggatgacgggatctataggattatgcagcgtggacttttaggtcgcagccaggtgggcgttggggtatttcaagaaaacgtgttccatactatgtggcacgtcacccggggagctgtgctgatgtaccagggcaaaagactcgagccgagttgggccagcgttaagaaagacttgatctcctacggtgggggatggaggctgcagggctcttggaatacaggcgaggaagtgcaggtcattgcagtggagcctgggaagaaccccaaaaatgtacaaaccgccccaggaacatttaagactcccgaaggtgaggtcggcgctatcgccctcgatttcaagcctgggacctcgggaagcccaatagtgaaccgagaaggcaaaatcgttggtctgtatgggaatggagtggtcacgacatcaggcacttacgtgtccgcaattgctcaggccaaggcgagtcaggagggcccccttcctgagatcgaagacgaggtttttcggaaacgcaacctgaccattatggatttgcacccggggtctggaaagacaagaaggtatctaccagccatcgtgcgggaagcaataaaacgaaagctgagaaccctcattttagctcccactcgcgtcgtggccagcgagatggctgaagcactgaagggtatgcctatcaggtaccaaaccacagccgtaaaatccgagcatacgggcaaggagatcgtggaccttatgtgccacgccactttcaccatgcgtctgctctcaccagttcgggtccccaattataacatgattatcatggatgaagctcattttacagacccttctagcatagcggcaagagggtacattagtaccagggtgggaatgggcgaggccgctgccatcttcatgactgcaacaccgcccggttccgtggaagcctttccacagagcaatgctgtcattcaggatgaggaacgcgacatccctgagcgatcttggaactcagggtatgagtggataaccgatttccccggaaaaacggtatggtttgtgccatccattaagagtggcaatgacatcgcgaactgtttgaggaaaaatggcaagcgggttatccagctgagcaggaagactttcgatacagaataccagaaaaccaagaacaacgactgggactacgtggtcaccactgatatttcggagatgggggccaatttccgcgcagaccgtgtgatcgatcctagacggtgcctcaaacccgttattctgaaggacggaccagaaagggtgatacttgctggtccgatgcctgtcacagtggcctctgcagcccagcgccgaggcagaatcgggcggaaccacaataaagagggagatcagtatatttacatgggccagcccctaaacaatgacgaggatcatgctcactggaccgaagccaagatgctgttggacaacatcaatacaccagagggtatcattcccgcgttatttgaacctgagagggaaaagtccgcagccatagatggggagtatcgcctgagaggcgaggctaggaaaactttcgtagaactcatgcggcgtggagacctgccagtgtggcttagctacaaggttgcctcagagggctttcaatatagtgatcgccgatggtgcttcgacggggaaagaaacaatcaggtcctggaggaaaacatggatgtggagatctggacgaaagagggagaaaggaagaaactccggccccgctggttggacgctagaacctactctgaccctctggcactaagggagtttaaggagttcgccgctggtcggcgatccgtgagcggcgatctgattctcgagatcgggaaacttccgcagcacctgacacagagagcccaaaatgcattagacaacttggtcatgctgcataattcagaacagggaggccgcgcgtataggcacgccatggaggagctcccagatactattgaaaccctgatgcttctggctctcatcgccgttttgacaggtggggtgaccctgtttttcttaagtggccggggactaggcaagactagcatagggctgctctgtgtaatggcatcctctgtgcttctgtggatggctagcgtcgagccccattggatcgccgcatccattatcttggaatttttcctgatggtgctcctgattcctgagcccgaccgtcagagaacgccacaggataaccaacttgcctacgttgtgatcggactcctgtttatgatattgaccgtcgctgcgaatgagatgggtctgttagaaacaactaagaaagacctaggcattgggcacgtagccgcaggaaaccaccatcacgctgccatgctggatgtggacctccatcctgcctcagcatggaccctttacgctgttgccacaaccatcattactcccatgatgaggcacacaatcgagaacacgaccgcgaatatatctctgactgctatcgccaaccaggcagccattttgatgggcctggataagggttggccaatcagtaaaatggacattggggtgcctctcctggctcttggctgctattcgcaggtcaatccgttaacactgaccgcagccgtgctcatgttggtcgcgcattacgctatcataggacccggcctgcaagccaaggcaacccgcgaagcccagaaacggacagctgccgggattatgaagaacccaactgtggatggaatcgttgcaatcgacctagatcctgtggtatatgacgctaagttcgagaaacagctgggccagattatgctccttatcctgtgtacgagccaaatattgctgatgcgaaccacatgggccctctgcgaatccattactctggcgaccggtcccttaacaaccctttgggaggggtctccaggaaagttttggaatactacgatcgccgtgtcaatggcaaacattttcagaggcagctacctggctggtgccggcctcgcattctccgtcatgaaaagtctagggggaggcaggcgcgggacaggagctcagggcgagaccctgggtgaaaagtggaaacggcagttgaatcagctgtctaagagcgagtttaacacttataagagatcagggatcatggaagttgaccgttccgaggccaaagaaggactcaagaggggcgagaccacaaaacacgccgtgagtcggggtactgcgaaacttcgctggttcgtcgagcgaaatctggtgaaacctgaaggcaaggtaatagatttggggtgtggaagaggcgggtggagctactattgcgctggactgaagaaagtgaccgaggttaagggctacacaaaaggtgggcccggacacgaggaaccgatcccaatggcaacgtacggctggaacctcgtgaagttacattctggcaaagacgtctttttcgtgcctcccgaaaagtgtgataccctgctttgcgacattggggagtcctcaccaaatcccactatcgaggaaggaaggacactgcgggtcctaaaaatggtggagccttggctccgcggtaaccaattttgtattaagatcctgaatccgtatatgcccagcgttgtagaaaccttggagcagatgcagagaaagcacggcgggatgctggtgaggaacccactctcgcgaaattctactcatgagatgtactgggtcagttgcggaacaggcaacattgtgtccgccgttaatatgaccagccggatgcttctgaaccgtttcacgatggctcacagaaaacctacctatgaacgcgatgtggacttaggtgccgggacaaggcacgtcgcagtggagcccgaagtagccaacctggatatcataggacagcggattgagaatatcaagcatgaacacaaatcaacttggcattacgacgaggataacccttataagacctgggcttaccacggctcctatgaggtgaaaccatctggcagcgcgagttccatggttaatggggtcgtgaagttgctcacaaagccctgggacgtgatccctatggtcactcaaattgccatgaccgatacaaccccatttggacagcagagagttttcaaagaaaaggtggacactcgcacgcccaaagcaaagaggggtacagctcaaataatggaggtaaccgccaaatggctgtggggctttctaagccgaaacaagaagccgcggatctgtactagagaagagttcaccaggaaagtgcgctctaatgcagccattggggctgtctttgtggacgaaaaccagtggaactcagccaaggaggcggttgaggatgaacgtttctgggaccttgtgcatcgggagagagaactgcacaaacagggaaagtgcgcaacatgcgtctacaacatgatgggcaaaagggagaagaagctcggtgaatttgggaaagccaagggaagtcgcgctatctggtacatgtggctgggcgcccgattcttggagttcgaggcactgggctttatgaatgaagatcactggttctcccgggagaacagcctctctggggtggaaggagagggtcttcataaactgggctatattttaagagacatctcgaagatacctgggggaaatatgtacgctgatgacacggccggctgggataccaggatcactgaggacgatctgcagaacgaagctcgcattacagacatcatggagccagaacacgccttgctcgcaaaatcaatttttaagctgacctatcaaaataaagtagttagagtgcagcggcccgcgaagaacggtactgtcatggatgtgatcagcaggcgtgaccagcgagggtccggacaggtgggcacatacggcctaaataccttcacaaacatggaggcccaacttatacgccagatggaaagtgaggggatattttctcctagcgagctggaaactccaatcctcgctgagagagtcctggattggttggaaaagtatggagttgagcggttaaaaaggatggccatctccggtgacgactgtgtggtaaagcccattgatgaccgcttcgcaaccgctctgacggccctcaacgatatgggcaaagtgagaaaggacataccgcagtgggaaccttcaaaagggtggaatgattggcagcaagtccccttttgcagtcatcacttccaccagcttatcatgaaggacggacgggagattgtggttccatgtaggaaccaggatgagctggtgggccgagcacgtgtctctcagggtgccgggtggagcctaagagaaaccgcgtgcctgggaaagtcctacgctcaaatgtggcagctcatgtattttcatcgccgggacttgaggctggccgcaaatgccatctgttcagctgtgcctgtagattggattcccacaagcagaactacctggtctatccacgcccatcaccagtggatgacaactgaggacatgctttccgtttggaaccgcgtgtggatagaagagaatccatggatggaagataaaacccatatcagtagctggggcgacgtcccctacctgggcaagcgggaggaccaatggtgcgggtcgctcattggattaacggcaagggctacatgggccaccaacatccaggtggcgattaatcaggttcgaagactgatcggtaacgagaattacttggattatatgacttccatgaaacggttcaagaacgaatctgaccctgagggcgctctgtggtga

SEQ ID NO: 13296 - RNA, 9879 nt, synthetic construct
  misc_feature 1..9879: note = derived and/or modified CDS sequence (opt3) from DENV-1__FJ639686__SS-prME
  source 1..9879: mol_type = other RNA
tccgtgaccatgctgctcatgcttatgcccacagcactggctttccacttgactacgagaggaggggagcctcatatgatcgtctccaagcaggaaagaggaaaatctttactgtttaagacctcagccggtgttaacatgtgcacactgattgcaatggacctcggcgagctgtgtgaagatactatgacctacaaatgcccacggataacagaggcggaaccggacgatgtggactgttggtgcaatgctaccgatacttgggtaacatatgggacctgtagtcaaacgggagagcaccgccgagacaagcgtagcgtggcacttgcaccccatgtcggcctgggtttggagactagaaccgaaacatggatgtcctctgagggggcctggaaacagatccagagggtggaaacttgggctctccggcaccctggattcaccgttattgcactgtttctggcccatgctatcggcacatcgattacccagaagggcatcatattcatcctcttaatgctggtgacgccatcaatggccatgcgctgcgtcgggattggaagcagagattttgtggagggtcttagtggcgcgacttgggtagacgttgtgttggagcacgggtcctgtgtcacaaccatggcaaaggataaacccactctggacatcgaactactcaagacagaggtgaccaaccctgccattctgaggaaactttgcatcgaagctaagatatctaatacgaccacagatagccggtgtccaactcaaggagaggccaccctggtggaagaacaagacgcaaacttcgtctgccgccgaacatttgttgatagaggctggggtaatgggtgtggattgttcggcaaaggctccctcattacttgcgctaagtttaagtgcgtgaccaaactggaggggaagatcgtacagtacgaaaacttaaaatattcagtgattgtcacagtgcacaccggagaccagcatcaagttggtaatgagagtactgaacacggcacgacagccaccatcactccccaggcgcctaccacagagatccagctgaccgactacggggccctcactcttgattgtagcccaaggacaggactggacttcaacgaaatggtgttgctaacgatgaaggagaaatcttggctggtccataagcagtggtttctcgatctgccgcttccctggacctccggcgcatcaactagccaagagacatggaatcggcaggacctgttggtgaccttcaaaacagctcacgccaagaagcaggaagtagttgtgctcggtagtcaagagggggctatgcacactgccctgaccggcgcaacggaaattcagacctctggaacaactaccatatttgccggccatttaaaatgccgtctgaagatggataaactaacactcaaggggatgtcctatgtcatgtgtactggatcgttcaaactggagaaggaagtggctgagacccagcacggtacggtccttgtgcagatccgctacgagggcacagacgcgccttgcaagattccattctcgacccaagatgaaagaggggttactcagaacggaaggttgatcacagcaaatcccatagtgaccgacaaagagaagcctgtaaacattgaagccgagccaccctttggcgagtcttatatcgtcatcggtgctggggaaaaagccctgaagctctcctggttcaaaaagggctcaagtattggaaagatgtttgaggcaactgcccggggcgctcgacgcatggccatcctgggggataccgcatgggacttcggaagcattggtggcgtgtttacatccgttgggaaacttgtgcatcagatattcggaacggcgtacggcgtcctgttttctggtgtgagctggaccatgaagatcgggattggcgtattgctcacttggctgggattaaattcaagaagtacatccttcagcatgacctgtatcgctgtgggcctggttacactatacctcggggtcatggtgcaggccgattctggatgcgtgatcaactggaaaggcagggaactgaagtgtggttcagggatttttgtcactaatgaggttcacacctggacggaacaatataaattccaggcagacagtccgaagcggcttagcgccgctataggaaaggcctgggaggagggcgtgtgcggtatccgctccgcaacaagattggaaaacattatgtggaaacagatctctaacgagctgaatcatattctcctggaaaacgacatgaagtttaccgtggtagtcggcgatgtggctgggatcttagcccagggcaagaagatgataaggcctcaacccatggagtacaaatattcgtggcgtagctggggcaaggcgaaaatcattggggccgacgttcagaatactaccttcatcattgatggaccaaacacacctgaatgtcccgacgatcagcgggcttggaatatctgggaggtggaggactacggctttggtatattcactaccaacatttggctgaaacttcgagattcctatacacaggtctgcgaccacagattgatgtcagcagccatcaaggatagtaaagctgtgcacgccgacatggggtactggattgaatctgagaagaatgaaacgtggaaactcgcaagggcgagcttcatcgaggttaagacctgtatatggccaaaatcccatactctgtggtcaaacggagtgctagaaagcgagatgatcattcccaagatctatggcggtcctatttctcaacacaattaccgcccaggctactttacacagaccgccgggccgtggcatctgggaaagctcgagctggatttcgacctttgcgaaggcactacagtagtcgtggatgagcactgcgggaaccggggaccctccttgagaaccacgactgtgaccggcaaaatcatacacgaatggtgttgcaggagttgtacactgcctccattacgctttcgaggtgaggacgggtgctggtatggaatggagattcggcccgtcaaggaaaaagaggaaaatctcgttaagagcatggtgtctgctggctccggtgaggtagactcattcagtctgggccttctgtgtatcagcatcatgattgaagaggtgatgcgttcgagatggtccaggaaaatgttgatgaccgggactctcgccgtctttctgctactgatcatgggacagctcacatggaacgatctgattcgcctttgcataatggtgggcgcaaatgcttctgaccggatggggatgggaaccacatacttggccctgatggcaactttcaagatgagacctatgtttgccgttggcttactcttcaggcgactgaccagccgcgaggtgcttctgctaacgatcggtctctcactggtcgctagtgtggaattgccaaactccctggaggaattaggggatggactcgcgatgggcattatgatcctgaaacttctgacagactttcaatctcatcagttgtgggccaccctcctgagcctaactttcattaaaaccacattttccctgcactatgcatggaagactatggctatggttctttcaatcgtgagcctcttccccctgtgtttgagtaccacgtctcagaaaacaacctggctgccggtcttactcggctccctggggtgcaagcctcttactatgtttctgatagccgagaataaaatctggggacggagaagctggccattgaacgaaggtattatggccgtaggcatcgtgtcgattctcctgtcatctctactgaagaacgatgttccccttgctgggcctctcatcgcaggaggcatgctgatagcctgttacgtgattagtggttccagcgcggacttgtctttagagaaggctgccgaggtcagctgggaagaggaagcagagcattccggggcctcacacaatatcctggtggaagtacaggatgacggaacaatgaaaatcaaggatgaggagagggacgataccctcactattctgcttaaagctacactgttggcagtgagtggcgtctatcccctaagcataccagccaccctgttcgtttggtacttctggcaaaagaaaaagcagcgttctggcgtgctctgggacacgccttcacccccagaagtggagcgcgcggtcctggatgacgggatctatcggattatgcagagaggacttttaggtaggagccaggtgggcgttggggtatttcaagaaaacgtgttccatactatgtggcacgtcacccgaggagctgtgctgatgtaccagggcaaacggctcgagccgagttgggccagcgttaagaaggacttgatctcctacggtgggggatggcgcctgcagggctcttggaatacaggcgaggaagtgcaggtcattgcagtggagcctgggaaaaaccccaagaatgtacaaaccgccccaggaacatttaaaactcccgaaggtgaggtcggcgctatcgccctcgatttcaagcctgggacctcgggaagcccaatagtgaacagagaaggcaaaatcgttggtctgtatgggaatggagtggtcacgacatcaggcacttacgtgtccgcaattgctcaggccaaggcgagtcaggagggcccccttcctgagatcgaagacgaggtttttaggaagcggaacctgaccattatggatttgcacccggggtctggaaaaacacgaagatatctaccagccatcgtgcgcgaagcaataaagaggaaactgcgtaccctcattttagctcccactcgggtcgtggccagcgagatggctgaagcactgaagggtatgcctatcagataccaaaccacagccgtaaaatccgagcatacgggcaaggagatcgtggaccttatgtgccacgccactttcaccatgaggctgctctcaccagttcgcgtccccaattataacatgattatcatggatgaagctcattttacagacccttctagcatagcggcacgagggtacattagtaccagagtgggaatgggcgaggccgctgccatcttcatgactgcaacaccgcccggttccgtggaagcctttccacagagcaatgctgtcattcaggatgaggaacgggacatccctgagaggtcttggaactcagggtatgagtggataaccgatttccccggaaagacggtatggtttgtgccatccattaaaagtggcaatgacatcgcgaactgtttgcgcaagaatggcaaacgtgttatccagctgagcagaaagactttcgatacagaataccagaagaccaagaacaacgactgggactacgtggtcaccactgatatttcggagatgggggccaatttccgggcagacagggtgatcgatcctcgccgatgcctcaagcccgttattctgaaagacggaccagaaagagtgatacttgctggtccgatgcctgtcacagtggcctctgcagcccagcggaggggccgcatcgggagaaaccacaataaggagggagatcagtatatttacatgggccagcccctaaacaatgacgaggatcatgctcactggaccgaagccaaaatgctgttggacaacatcaatacaccagagggtatcattcccgcgttatttgaacctgagagggaaaagtccgcagccatagatggggagtatcggctgcgtggcgaggctcgcaaaactttcgtagaactcatgcgaagaggagacctgccagtgtggcttagctacaaggttgcctcagagggctttcaatatagtgataggcggtggtgcttcgacggggaacgcaacaatcaggtcctggaggaaaacatggatgtggagatctggacgaaggagggagaaaggaagaagctcaggccccggtggttggacgctcgaacctactctgaccctctggcactaagagagtttaaagagttcgccgctggtcgcaggtccgtgagcggcgatctgattctcgagatcgggaaacttccgcagcacctgacacagcgggcccaaaatgcattagacaacttggtcatgctgcataattcagaacagggaggccgtgcgtatagacacgccatggaggagctcccagatactattgaaaccctgatgcttctggctctcatcgccgttttgacaggtggggtgaccctgtttttcttaagtggcaggggactaggcaaaactagcatagggctgctctgtgtaatggcatcctctgtgcttctgtggatggctagcgtcgagccccattggatcgccgcatccattatcttggaatttttcctgatggtgctcctgattcctgagcccgaccgccagcggacgccacaggataaccaacttgcctacgttgtgatcggactcctgtttatgatattgaccgtcgctgcgaatgagatgggtctgttagaaacaactaagaaagacctaggcattgggcacgtagccgtgggaaaccaccatcacgcagctatgctggatgttgacctccatcctgcctcagcctggaccctttacgcagtggctacaaccatcattactcccatgatgcgacacacaatcgagaacacgaccgccaatatatctctgactgcgatcgctaaccaggccgcaattttgatgggcctggataagggttggccaatcagtaagatggacattggggtccctctcctggcccttggctgctatagccaggtgaatccgttaacactgaccgctgcagtcctcatgttggtggcccattacgcgatcataggacccggcctgcaagctaaagccaccagagaagcacagaagaggacagccgctgggattatgaaaaacccaactgttgatggaatcgtggccatcgacctagatcctgtagtgtatgacgcaaagttcgagaaacagctgggccagattatgctccttatcctgtgtacgagccaaatattgctgatgcgcaccacatgggctctctgcgaatccattactctggccaccggtcccttaacaaccctttgggaggggtctccaggaaagttttggaatactacgatcgcggtctcaatggccaacattttccggggcagctacctggccggtgctggcctcgccttctccctaatgaagagtctagggggaggcagacgtgggacaggagcacagggcgagaccttgggtgaaaaatggaagaggcagctgaatcagctctctaaaagcgagtttaacacttataagcggtcagggatcatggaagttgaccgctccgaggctaaagaaggacttaagcgaggcgagataaccaagcacgccgtgagtagaggtacagccaaactgaggtggttcgtcgagcggaatttggtgaagcctgaaggcaaagtaatcgatctggggtgtggacgcggcgggtggagctactattgcgcgggactcaagaaagtgactgaggttaagggctacaccaagggtgggcccggacacgaggaaccgattccaatggctacatacggctggaacttagtgaaactgcattctggcaaggacgtctttttcgtgcctcccgaaaaatgtgatacgcttctgtgcgacatcggggagtcctcaccaaatcccaccattgaggaaggaagaactctaagggtcctcaagatggtggagccttggctgcgaggtaaccaattttgtatcaaaattttgaatccgtatatgcccagcgttgtagaaacactggagcagatgcagcggaagcacggcgggatgctcgtgcgtaacccactttcgagaaattctacccatgagatgtactgggtcagttgcggaactggcaacatcgtgtccgcagttaatatgacaagccgcatgctgttaaacaggttcaccatggcccaccggaaacctacgtatgaaagagatgtggacctgggtgctgggacccgccacgtcgccgtggagcccgaagtagcaaacttggatataattggacagaggatcgagaatatcaagcatgaacacaagtcaacatggcattacgacgaggataacccttataaaacttgggcctaccacggctcctatgaggtgaagccatctggcagcgctagttccatggttaatggggtcgtgaaactcctgaccaagccctgggacgtgattcctatggtcacacaaatagcgatgactgataccacaccatttggacagcagcgagttttcaaagaaaaggtggacacccggactcccaaggccaaaagaggtacggcacaaatcatggaggtaacagctaagtggctatggggctttcttagcaggaacaaaaagccgcgcatttgtacccgtgaagagttcactcggaaagtgagatctaatgccgcaatcggggccgtctttgtggacgaaaaccagtggaactcagctaaggaggccgttgaggatgaaaggttctgggacctggtgcatcgcgagcgagaactccacaagcagggaaaatgcgcgacctgcgtctacaacatgatgggcaagcgggagaaaaagctgggtgaatttgggaaagcaaagggaagtagagccatttggtacatgtggttgggcgctaggttcctggagttcgaggccctcggctttatgaatgaagatcactggttctcccgcgagaacagcctttctggggtggaaggagagggtctgcataagttaggctatatcctgagagacatatcgaaaatccctgggggaaatatgtacgcagatgacacagctggctgggatacgcggattaccgaggacgatttgcagaacgaagccaggatcactgacattatggagccagaacacgctctcctggccaagtcaatctttaaactaacatatcaaaataaggtagttcgtgtgcagcgacccgccaaaaatggtaccgtcatggatgtgataagccgcagagaccagcgggggtccggacaggtgggcacttacggccttaatacattcaccaacatggaggcgcaactgattaggcagatggaaagtgaggggatcttttctcctagcgagctcgaaacaccaaacctggccgagcgcgtcttggattggttagaaaagtatggagttgagagactgaaacggatggctatctccggtgacgactgtgtggtaaagcccattgatgacaggttcgccactgcactcaccgctcttaatgatatgggcaaggtgcgaaaagacataccgcagtgggaaccttcaaaggggtggaacgattggcagcaagtccccttttgcagtcatcacttccaccagctgatcatgaaagacggacgtgagattgtggttccatgtagaaatcaggatgagctagtgggccgcgcccgggtctctcagggtgcagggtggagcctgagggaaacggcctgcctcggaaagtcctacgcgcaaatgtggcagttgatgtattttcatagacgcgacctgcggcttgctgccaacgcaatctgttcagccgtgcctgtagattggattcccaccagcaggacaacttggtctatccacgctcatcaccagtggatgaccacagaggacatgctgtccgtttggaatcgagtgtggatagaagagaacccatggatggaagataaaactcatatcagtagctggggcgacgtcccctacctcggcaagagagaggaccaatggtgcgggtcgttaattggactgaccgcccgggcaacgtgggctacaaatatccaggtggccattaaccaggttaggcgcttgatcggtaatgagaactacctggattatatgacctccatgaagcgtttcaaaaatgaatctgaccctgagggcgcgctctggtga

SEQ ID NO: 13297 - RNA, 9879 nt, synthetic construct
  misc_feature 1..9879: note = derived and/or modified CDS sequence (opt3) from DENV-1__FJ639687__SS-prME
  source 1..9879: mol_type = other RNA
agcgtgaccatgctgctcatgcttatgcccaccgccctggctttccacttgactacgagaggaggggaacctcatatgatcgtctccaagcaggaaagggggaaatctttactgtttaagacctcagccggtgttaacatgtgcacactgattgccatggacctcggagagttctgtgaagatactatgacctacaaatgcccacggataagtgaagcggaaccggacgatgtggactgttggtgcaatgctacagatacctgggtaacttatgggacatgtagccaaaccggagaacaccgccgagacaagcgttccgtggccctggcaccccatgtcggccttggtctggagacgagaactgaaacctggatgtcttcggagggggcctggaaacagatccagagggtggaaacatgggctttgcggcaccctggatttactgttattgcactcttcctggcccatgctatcggcacctcaattacacagaagggcatcatatttatcctgctcatgttagtgaccccaagcatggccatgcgctgcgtcgggattggaagtagagatttcgtggagggtctgtccggcgcgacgtgggtagacgttgtgcttgagcacgggtcttgtgtcactacaatggcaaaggataaacccaccttggacatcgaactgctaaagactgaggtgacaaaccctgccgtgctcaggaaactgtgcattgaagctaagatcagcaataccacgaccgattcccggtgtccaacacaaggagaggccactcttgtcgaagaacaagacgcaaactttgtttgccgccgaaccttcgtggatagaggctggggtaatgggtgtggactgtttggcaaaggctcattgataacatgcgctaagttcaagtgcgtaactaaactcgaggggaagattgtgcagtacgaaaacctgaaatatagtgtcatcgtgaccgttcacacaggagaccagcatcaagtgggtaatgagagcaccgaacacggcactacggccacaattacaccccaggcgccttctactgagatccagttaaccgactacggggccctgacactcgattgttccccaaggaccggacttgactttaacgaaatggtcctgttgactatgaaggagaaatcatggctagtgcataagcagtggttcctggatctcccgctgccctggacaagcggcgcaagtacgtctcaagagacctggaatcggcaggaccttctggtaacttttaaaacagctcacgccaagaagcaggaagttgtggtcttgggttcccaagagggggctatgcacaccgccctcacaggcgcaactgaaatccagaccagcggaacgaccacaattttcgccggccatctgaaatgccgtttaaagatggataaactgactctaaaggggatgtcgtatgtgatgtgtaccggatctttcaaactcgagaaggaagtcgctgagacacagcacggtactgtgctggttcagataaagtacgagggcaccgacgcgccttgcaaaatcccattttccacgcaagatgaaaagggggtgacacagaacggacgccttattaccgcaaatcccatcgtaactgacaaagagaagcctgtcaacatagaagccgagccacccttcggcgagtcatatattgtgatcggtgctggggaaaaagccttgaagctgagttggtttaagaaaggcagctccatcggaaagatgttcgaggcaacagccagaggcgctaggcggatggccattctcggggataccgcatgggactttggatctatcggtggcgttttcactagcgtggggaaactggtccatcagatttttggaaccgcgtacggcgtgcttttctcaggtgtaagttggacaatgaagatagggatcggcgtgctgttgacgtggctcggactaaattcccgaagcacctctttatcaatgacttgtattgctgttggcctggtcacactatacctcggggtgatggtgcaggccgatagtggatgcgtcatcaactggaaaggccgcgaactgaagtgtggtagcgggatctttgttaccaatgaggtgcacacatggactgaacaatataagttccaggcagactccccgaaaagactttctgccgctattggaaaggcctgggaggagggcgtgtgcggtataaggtcggcaacccggttggaaaacatcatgtggaaacagattagcaacgagctgaatcatatcctcctggaaaacgacatgaagtttacggtagtcgtgggcgatgttgctgggattttagcccagggcaagaagatgatccgccctcaacccatggagtacaaatattcctggaagtcatggggcaaggcgaaaataatcggggccgacgtgcagaatacaaccttcattatcgatggaccaaacactcctgaatgtcccgacgatcagagagcttggaatatttgggaggtcgaggactacggctttggtatcttcaccacaaacatatggctgaaacttagggatagttatactcaggtgtgcgaccaccgtttgatgtctgcagccattaaagatagcaaggctgttcacgccgacatggggtactggatcgaatccgagaaaaatgaaacctggaagctcgcacgggcgtcattcattgaggtgaagacatgtatctggccaaaaagccatacgctgtggtctaacggagtactagaatccgagatgataatccccaagatttatggcggtcctatcagtcaacacaattaccgaccaggctactttacccagactgccgggccgtggcatctgggaaaactcgagctggatttcgacctttgcgaaggcacaaccgtcgtggtggatgagcactgcgggaacagaggacccagcttgaggactacaaccgtcacgggcaagattatccacgaatggtgttgccgctcttgtactctgcctccattacggtttaaaggtgaggacgggtgctggtatggaatggagataagacccgttaaggaaaaggaggaaaatctcgtgaaatccatggtatcagctggcagtggtgaggtggacagcttctcgctgggccttctgtgtatttccatcatgatcgaagaggtcatgaggtctcgctggagccgaaagatgttgatgaccgggacactcgccgtgtttttcctgctaattatgggacagctgacctggaacgatctcatccggctgtgcattatggttggcgcaaatgcttcagaccgtatggggatgggaatgacttaccttgccttgatggcaacatttaaaatgagacctatgttcgccgtgggcctgttatttaggcgcctcaccagtcgggaggtcctgcttctgacaataggtctatccctcgtggcttctgttgaactgccaaacagcttggaggaactgggggatggattagcgatgggcatcatgattctcaagctgcttactgacttccaatcccatcagctgtgggccaccttgctctcactgacgtttatcaaaacaaccttcagcctacactatgcatggaagactatggctatggtgctgagtattgtctctctttttcccctctgtctgtccaccacaagccagaagactacctggttgccggtactgttaggctcgctcgggtgcaaacctctgacgatgttccttatcgccgagaataagatatggggaagaaaatcatggccactgaacgaaggtatcatggccgtgggcattgtttctatcttgctcagttccctgctaaagaacgatgtgcccctggctgggcctcttattgcaggaggcatgctcatcgcctgttacgtcataagcggttctagcgcggacctgtccttggagaaagctgccgaggtgtcatgggaagaggaagcagagcatagtggggccagccacaatattttagtagaagtgcaggatgacggaacaatgaagatcaaagatgaggagagggacgataccctgactatcctcctgaaggctacacttctggcagtctctggcgtttatcccttgtccattccagccaccctattcgtgtggtacttttggcaaaagaaaaagcagcgatcaggcgtgctgtgggacactcctagtcccccagaagtcgagcgcgcggtgctcgatgacgggatatatcggatcatgcagagaggactgcttggtaggagccaggttggcgtaggggtgttccaagaaaacgtctttcatacaatgtggcacgtgacccgtggagctgttttaatgtaccagggcaaacgcctggagccgtcctgggcctctgtgaagaaagacctcatttcgtacggtgggggatggcggttgcagggcagctggaatacgggcgaggaagtccaggtgatcgcagtagagcctgggaagaaccccaagaatgtccaaactgccccaggaaccttcaaaacatcagaaggtgaggtgggcgctattgccctggattttaagcccgggacctccggaagtcctatcgttaacagagaaggcaaaatagtgggtctctatgggaatggagtcgtgacaacttctggcacctacgttagcgcaatcgctcaggccaaggcgtcccaggagggcccactgcccgagattgaagacgaggtgttcaggaaacgaaaccttacgatcatggatctgcaccctgggtcaggaaagacacggcgctatttgccggccattgtcagagaagcaatcaagaggaaactacggactctgatactcgctccaacccgagtggtagcctctgagatggctgaagcattaaagggtatgcccattagataccaaacaaccgccgtgaaaagcgagcatactggcaaggagatcgttgacctgatgtgccacgccacctttacaatgcgccttctgagtcctgtcagggtgccaaattataacatgatcattatggatgaagctcatttcacggacccctccagcatcgcggcacgtgggtacatatctactcgggtgggaatgggcgaggccgctgccatttttatgaccgcaacacctccgggttcagccgaggctttcccccagtccaatgcggtcatccaggatgaggaaagagacattccagagaggagttggaacagcgggtatgagtggatcaccgattttcctggaaaaactgtatggttcgtgccctcgataaagtctggcaatgacattgccaactgtctccgcaagaatggcaaacgagttatccagttgtccagaaagacattcgataccgaataccagaagacgaagaacaacgactgggactacgtggtcactacagatatcagcgagatgggggcaaattttcgggctgacagggtgattgatccacgccgttgcctgaaacctgttatcctcaaggacggacccgaaagagtgattctggccggtccaatgccggtcaccgtggcatcagccgctcagcggaggggccgcatagggcgaaaccacaataaggagggagatcagtatatctacatgggccagcctcttaacaatgacgaggatcatgcccactggaccgaagcgaaaatgctactggacaacattaatactcccgagggtatcatcccagcattgttcgaacccgagagagaaaagagtgccgctattgatggggagtatcggttaaggggcgaggcccgcaaaacatttgtagaactgatgagaaggggagacctccctgtgtggctgtcttacaaggttgcttccgagggcttccaatatagcgatcggcgttggtgctttgacggggaacgcaacaatcaggtccttgaggaaaacatggatgtggagatatggaccaaagagggagaacgaaagaaactgagaccaaggtggctcgacgcacggacatactcagaccccttggccctgcgcgagttcaaggaatttgctgccggtagaaggagtgtgagcggcgatctaatcctggagattgggaagctccctcagcaccttactcagcgggcacaaaatgcgctggacaacttagtcatgttgcataattccgaacagggaggccgagcctatagacacgctatggaggagctgccggatacgatcgaaaccctcatgctgcttgccctgattgcagttctcacaggtggggtgactttgttctttctgtctggccgcggattaggcaaaaccagcatcgggctactgtgtgtaatggcttcctcagtgctcctttggatggcctctgtcgagccacattggatagcagccagtatcattctggagttctttttgatggtgctgctcatccccgagcctgacaggcagcggacaccccaggataaccaactggcttacgttgtgattggacttctcttcatgatcctgaccgtcgcggccaatgagatgggtttgctggaaactacgaagaaagacttaggcatagggcacgtagcagtggagaaccaccatcacgctgccatgctagatgttgacctgcatccagcctcggcatggaccctctacgctgtggccacaactattatcacccctatgatgcgtcacacaattgaaaacaccactgcgaatatcagccttacagctatagccaaccaggcagccatcctgatgggattggataagggctggcccatttccaaaatggacatcggtgtcccactgctcgctctggggtgctattctcaggtgaatcctcttacgttaaccgcagccgtcctgatgctcgtggcgcattacgctattatcggcccgggattgcaagccaaggcaactagagaggcccagaagaggacagctgccggcataatgaaaaaccccaccgttgatgggattgtggcaatcgacctggatccagtagtgtatgacgctaagtttgaaaaacagctaggacagatcatgctgctcattctttgtacctcacaaatcctgttgatgcgcacaacttgggccctgtgcgagagcataacgctcgcgaccggccctctgacaactttatgggagggttcccccgggaagttctggaataccacaattgccgtcagtatggcaaacatcttccggggatcttaccttgctggcgccggtctggcatttagcctcatgaaatcactaggcgggggacgaagaggcaccggggctcagggagaaactctgggcgagaagtggaagaggcagttgaatcagctgtccaaaagtgagttcaacacgtataagcgcagcggtattatggaggttgaccggtctgaagccaaagaggggctcaagagaggagagacaaccaaacacgccgtgtcccgtggcactgcgaaacttaggtggtttgtcgaacggaatctggtgaagccagagggtaaagtaatcgatttgggctgtgggcgcggaggctggtcatactattgcgctgggctgaagaaagtgaccgaagttaagggatacacaaaaggcggtcctgggcacgaggaacccataccgatggcaacttacggatggaacctcgtgaagttacatagcggcaaagacgtcttctttgtgccacctgagaagtgtgataccctgctttgcgacatcggcgagtcgtctcccaatccaacaattgaagaggggcgaacgctgagagtcctaaagatggtggaaccctggctcaggggaaaccaattctgtatcaaaattctgaatccttatatgccgagtgttgtagagaccttggagcagatgcagcggaagcacggtggcatgctggtgcgcaaccccctctccagaaatagcactcatgaaatgtactgggtctcatgcgggacaggaaacatcgtgtccgccgttaatatgacctctaggatgcttctgaaccgatttactatggctcaccggaaaccaacatatgagcgtgatgtggacttaggcgccggtaccagacacgtcgcagtggaacctgaggtagccaacctggatattatcgggcagcgcatagaaaatattaagcatgagcacaaaagcacgtggcattacgacgaggataacccctataagacctgggcttaccacggaagttatgaagtgaagccttccggcagcgcgtcttcaatggttaatggcgtcgtgaaattgctcacaaagccatgggacgtgatccccatggtcactcaaatcgccatgaccgatacaactcctttcgggcagcagagggtttttaaagagaaggtggacacccggacaccaaaagcaaagagaggaaccgctcaaattatggaagtaactgccaagtggctgtggggtttcctaagtcgcaacaaaaagcccaggatatgtacgcgagaggaatttacacggaaagtgagatccaatgcagccatcggcgctgtcttcgtggacgagaaccagtggaatagcgccaaggaggcggttgaagatgagaggttttgggaccttgtgcatcgcgaacgtgagctgcacaaacaggggaagtgcgcaacctgcgtctacaacatgatgggaaagcgggagaaaaagctcggcgagttcggtaaagccaaggggtctagagctatttggtacatgtggctgggagccaggttcttggagtttgaagcactgggcttcatgaatgaggatcactggttttcgcgcgaaaactcactcagcggcgtggagggggagggacttcataaactgggttatatcttacgagacatttccaagatcagtggcgggaatatgtacgctgatgacactgccggatgggatacccggataacagaagacgatctgcagaacgaggctaaaatcacggacattatggaaccggagcacgccttgctcgcaaagtctatcttcaagctgacctatcaaaataaagtagttagagtgcagaggcctgcgaagaacggcactgtcatggatgtgattagccgcagagaccagcggggttccggacaggtgggaacatacggcctaaatacctttactaacatggaagcccaacttatcaggcagatggagtcagagggcatattcagtccatctgaactggagacacccaacctcgctgaacgtgccctggattggttggagaaacatggggtcgaacgattaaagcgcatggcaattagcggagacgactgtgttgtgaaacctatcgatgacagatttgctaccgccctgacagcactcaatgatatgggtaaggtacggaaggacatcccacagtgggagccctccaaaggctggaacgattggcagcaagtgccgttctgctcacaccactttcatcagcttattatgaaggacgggagggagatagtcgtgccttgtcgcaatcaggatgaactggttggcagagcacgggtgagccagggcgcgggttggtctctaaaagagactgcttgcctggggaagtcctatgcccaaatgtggcagctcatgtacttccacaggcgagacttgcgtctggcagccaacgctatctgtagtgccgtccccgtggattgggtaccaaccagcagaacgacctggtcgattcatgcacaccatcagtggatgacaactgaagacatgctttccgtttggaatcgcgtgtggatcgaggaaaacccttggatggaggataaaacccacatttcttcatgggaggacgtcccctatctgggaaagcgggaagaccaatggtgcggcagcctcatcggcttaacagctagggccacttgggcgaccaatatacaggtggctatcaaccaggttagacgcctgattgggaatgagaactacttggattacatgacgagtatgaagcggtttaaaaatgaatccgacccagagggagccctgtggtga

SEQ ID NO: 13298 - RNA, 9879 nt, synthetic construct
  misc_feature 1..9879: note = derived and/or modified CDS sequence (opt3) from DENV-1__FJ639688__SS-prME
  source 1..9879: mol_type = other RNA
tccgtgaccatgctgctcatgcttatgcccacagcactggctttccacttgactacgagaggaggggaacctcatatgatcgtctccaagcaggaaagaggaaaatctttactgtttaagacctcagccggtgttaacatgtgcacactaattgccatggacctcggcgagctgtgtgaagatactatgacctacaaatgcccacggataacagaggcggaaccggacgatgtggactgttggtgcaatgctaccgatacttgggtaacatatgggacctgtagtcaaacgggagagcaccgccgagacaagcgtagcgtggcccttgcaccccatgtcggcctgggtttggagactagaaccgaaacatggatgtcctctgagggggcctggaaacagatccagagggtggaaacttgggctctccggcaccctggattcaccgttattgcactgtttctggcccatgctatcggcacatcgattacccagaagggcatcatattcatcctcttaatgctggtgacgccatcaatggccatgcgctgcgtcgggattggaagcagagattttgtggagggtcttagtggcgcgacttgggtagacgttgtgttggagcacgggtcctgtgtcacaaccatggcaaaggataaacccactctggacatcgaactactcaagacagaggtgaccaaccctgccgtgctgaggaaactttgcattgaagctaagatctctaatacgaccacagatagccggtgtccaactcaaggagaggccaccctggtcgaagaacaagacgcaaacttcgtttgccgccgaacatttgtggatagaggctggggtaatgggtgtggattgttcggcaaaggctccctcataacttgcgctaagtttaagtgcgtaaccaaactggaggggaagattgtgcagtacgaaaacttaaaatattcagtcatcgtgacagttcacaccggagaccagcatcaagtgggtaatgagagtactgaacacggcacgacagccaccattactccccaggcgcctaccacagagatccagctgaccgactacggggccctcactcttgattgtagcccaaggacaggactggacttcaacgaaatggtcttgctaacgatgaaggagaaatcttggctggtgcataagcagtggtttctcgatctgccgcttccctggacctccggcgcatcaactagccaagagacatggaatcggcaggacctgttggtaaccttcaaaacagctcacgccaagaagcaggaagttgtggtcctcggtagtcaagagggggctatgcacactgccctgaccggcgcaacggaaatccagacctctggaacaactaccatttttgccggccatttaaaatgccgtctgaagatggataaactaacactcaaggggatgtcctatgtgatgtgtactggtagcttcaaactggagaaggaagtcgctgagacccagcacggaacggtgcttgttcagataaagtacgagggcacagacgcgccttgcaaaatcccattctcgacccaagatgaaaagggggtgactcagaacggacgcttgattacagcaaatcccatcgtaaccgacaaagagaagcctgtcaacatagaagccgagccaccctttggcgagtcttatattgtgatcggtgctggggaaaaagccctgaagctctcctggttcaagaaaggctcaagtatcggaaagatgtttgaggcaactgccagaggcgctaggcggatggccattctgggggataccgcatgggacttcggaagcatcggtggcgtttttacatccgtggggaaacttgtccatcagattttcggaacggcgtacggcgtgctgttttctggtgtaagctggaccatgaagatagggatcggcgtgttgctcacttggctgggattaaattcacgaagtacatccctgagcatgacctgtattgctgttggcctagtcacactctacctgggggtgatggtgcaggccgattctggatgcgtcatcaactggaaaggccgcgaacttaagtgtggttcagggatcttcgttactaatgaggtgcacacctggacggaacaatataagtttcaggcagacagtccgaaaagattgagcgccgctattggaaaggcctgggaggagggcgtgtgcggtataaggtccgcaacacggctggaaaacatcatgtggaaacagatttctaacgagctcaatcatatcctgttagaaaacgacatgaagttcaccgtagtcgtgggcgatgttgctgggattctggcccagggcaagaagatgatccgccctcaacccatggagtacaaatattcgtggaaaagctggggcaaggcgaagataatcggggccgacgtgcagaatactacctttattatcgatggaccaaacacacctgaatgtcccgacgatcagagagcttggaatgtctgggaggtggaggactacggcttcggtatttttactaccaacatctggcttaagttgagggattcctatacacaggtttgcgaccaccgtctcatgtcagcagccataaaagatagtaaggctgtgcacgccgacatggggtactggattgaatctgagaaaaatgaaacgtggaagctggcacgggcgagcttcatcgaggtaaagacctgtatttggccaaaatcccatactctatggtcaaacggagtcctggaaagcgagatgatcatacccaagatctatggcggtcctatttctcaacacaattaccgaccaggctacttcacacagaccgccgggccgtggcatctcggaaaactggagcttgattttgacttgtgcgaaggcactacagtggtggtcgatgagcactgcgggaacagaggaccctccctgaggaccacgactgttaccggcaagatcattcacgaatggtgttgccgcagttgtacattacctccactccggttcagaggtgaggacgggtgctggtatggaatggagatcaggcccgtgaaagaaaaggaggaaaatctggtaaagagcatggtgtctgctggctccggtgaggtcgactcatttagtcttggcctgttgtgtataagcattatgatcgaagaggtgatgcgctcgcgatggtcccggaaaatgctcatgaccgggactctggccgttttctttctactgatcatgggacagctcacatggaacgatctgattcgtctttgcatcatggtgggcgcaaatgcttctgacagaatggggatgggaaccacatacttggccctgatggcaactttcaagatgaggcctatgtttgccgtcggcttactcttccgccggctgaccagcagagaggtgcttctgctaacgattggtctctcactggttgctagtgtggaattgccaacatccctggaggaattaggggatggactcgcgatgggcataatgatcctgaaacttctgaccgactttcaatctcatcagttgtgggccactctcctgagcctaaccttcattaagacaactttttccctgcactatgcatggaaaaccatggctatggtcctttcaatcgtaagcctcctgcccttgtgtctgagtacgacatctcagaagaccacttggttaccggtgctcctgggctcccttgggtgcaagcctctgacaatgttcttgattgccgagaacaaaatctggggaaggcgaagctggccactcaatgaaggtataatggccgttggcatcgtgtcgattctgctatcatctctgcttaagaacgatgtccccctcgctgggcctctgatcgcaggaggcatgttgattgcctgttacgtgatcagtggttccagcgcggacttatctctggagaaagctgccgaggtaagctgggaagaggaagcagagcattccggggcctcacacaacatactcgtggaagtccaggatgacggaaccatgaagattaaagatgaggagcgcgacgatactctgacaatccttctgaaggctaccttgctagcagttagtggcgtgtatcccctgagcatcccagccacgctctttgtgtggtacttctggcagaagaagaagcagcggtctggcgtcctgtgggacactccttcacccccagaagtggagagagcggttcttgatgacgggatttataggataatgcagcgtggattactgggtcgcagccaggtaggcgtgggggtcttccaagaaaatgtgtttcataccatgtggcacgttacacggggagctgtgctcatgtaccagggcaaaagattggagccgagttgggccagcgtcaagaaagacctgatctcctacggtgggggatggaggctccagggctcttggaacaccggcgaggaagtgcaggtaattgcagtcgagcctgggaagaatcccaaaaacgtgcaaacagccccaggaactttcaagacccccgaaggtgaggttggcgctatcgccctggattttaagcctgggacgtcgggaagcccaattgtgaatcgagaaggcaaaatcgtcggtctttatgggaacggagtggttacaacttcaggcacctacgtgtccgcaatagctcaggccaaggcgagtcaggagggccccctgcctgagatcgaagacgaggtcttccggaaacgcaatttgacaattatggatctacacccggggtctggaaagaccagaaggtatctgccagccatcgtgcgggaagcaattaaacgaaagctcagaactttaatcctggctcccacccgcgtagtggccagcgagatggctgaagcacttaagggtatgcctataaggtaccaaacaacggccgttaaatccgagcatactggcaaggagattgtcgacctgatgtgccacgccacctttacaatgcgtctcttgtcaccagtgcgggtgcccaactataatatgatcatcatggatgaagctcatttcaccgacccttctagcattgcggcaagagggtacatcagtactagggtcggaatgggcgaggccgctgccatatttatgacagcaaccccgcccggttccgtagaagccttcccacagagcaacgctgtgattcaggatgaggaacgcgacatccctgagcgatcttggaactcagggtatgagtggattacggattttcccggaaaaactgtttggttcgtgccatccatcaagagtggcaacgacatagcgaattgtctgaggaaaaatggcaagcgggtcattcagctcagcaggaagacatttgataccgaataccagaaaaccaagaataacgactgggactacgtggttactacagatatctcggagatgggggccaacttccgcgcagaccgtgtgatcgatcctagacggtgcctgaaacccgtcattcttaaggacggaccagaaagggtgatcctagctggtccgatgcctgtaaccgtggcctctgcagcccagcgccgaggcagaattgggcggaatcacaacaaagagggagatcagtatatatacatgggccagcccctgaataacgacgaggatcatgctcactggacagaagccaagatgttgttagacaatatcaacactccagagggtattatccccgcgctgttcgaacctgagagggaaaagtccgcagccatcgatggggagtatcgcctcagaggcgaggctaggaaaacgtttgttgaactgatgcggcgtggagaccttccagtctggctgagctacaaggtggcctcagagggcttccaatatagtgatcgccgatggtgctttgacggggaaagaaataaccaggtgctcgaggaaaatatggatgtcgagatttggaccaaagagggagaaaggaagaaattgcggccccgctggctggacgctagaacatactctgaccctctagcactgagggagttcaaggaatttgccgctggtcggcgatccgttagcggcgatctcatacttgagatcgggaaactgccgcagcacttaactcagagagcccaaaacgcattggacaatctggtgatgctccataactcagaacagggaggccgcgcgtataggcacgccatggaggagctgccagataccattgaaacacttatgctgctcgctttgatcgccgtactgaccggtggggtgactttattctttctaagtggccggggactgggcaagacgagcattgggctcctttgtgtcatggcatcctctgtgctgttgtggatggctagcgttgagccccattggatcgccgcatccataatcctggagttctttctcatggtgctgcttattcctgagcccgaccgtcagagaaccccacaggataatcaactcgcctacgtcgtaatcggactgttgttcatgattctgacagtggctgcgaacgagatgggtttactagaaactaccaagaaagacctgggcatcgggcacgttgccgcagagaatcaccatcacgctgccatgctcgatgtggaccttcatcctgcctcagcatggacactgtacgctgtcgccaccactataattacacccatgatgaggcacacgatcgaaaacaccactgcgaacatttctttgacagctatcgccaatcaggcagccatactgatgggactcgataagggctggccaatcagtaaaatggacattggtgtgcctctgcttgctttagggtgctattcgcaggtcaacccgctgaccctcaccgcagccgtgttgatgctggttgcgcattacgctatcattggccccggactacaagccaaggcaacacgcgaggcccagaaacggactgctgccggcatcatgaagaatccaacggtggatgggatagtagcaattgacctggatcctgtggtctatgacgctaagtttgaaaaacagctcggacagatcatgcttctgatcttgtgtaccagccaaattctgctcatgcgaacaacttgggccctgtgcgagtccatcaccttagcgacaggcccccttaccactctgtgggagggttctccagggaagttctggaacacgacaatagccgtttcaatggcaaatatttttagaggaagctacctcgctggcgccggtctagcattctccctgatgaaaagtttgggcgggggaaggcgcggcaccggggctcagggagaaactctgggcgagaagtggaaacggcagctcaaccagctttctaagagcgagttcaatacctataagagatcaggtatcatggaggtggaccgttccgaagccaaagaggggctgaagaggggagagacaactaaacacgccgtcagtcggggcaccgcgaagttgcgctggtttgtggaacgaaacctggtaaaacctgagggtaaggtgattgatctcggctgtgggagaggaggctggagctactattgcgctgggttaaagaaagttacagaagtgaagggatacacgaaaggcggtcccgggcacgaggaaccgatcccaatggcaacctacggatggaatctggtcaaacttcattctggcaaagacgtgttctttatacctcccgagaagtgtgatactctgctatgcgacatcggcgagtcctcaccaaaccccacaattgaagaggggaggaccctccgggtcctgaaaatggtggaaccttggttgcgcggaaatcaattctgtatcaagattctgaacccgtatatgcccagcgttgtagagactctcgagcagatgcagagaaagcacggtggcatgcttgtgaggaatccactgtcgcgaaactctacacatgaaatgtactgggtcagttgcgggaccggaaatatcgtgtccgccgttaacatgacgagccggatgttactgaatcgttttaccatggctcacagaaaacctacatatgagcgcgatgtggacttgggcgccggtactaggcacgtcgcagtggaacccgaggtagccaacctcgatattatcgggcagcggatagaaaacattaagcatgagcacaaatcaacctggcattacgacgaggataatccttataagacatgggcttaccacggatcctatgaagtgaaaccatctggcagcgcgagttccatggttaacggcgtcgtgaagctgctaactaagccctgggacgtgatccctatggtcacccaaatggccatgacagataccactccattcgggcagcagagagtttttaaagagaaggtggacacgcgcacacccaaagcaaagaggggaaccgctcaaatcatggaagtaactgccaaatggctttggggtttcctgagccgaaataagaagccgcggatttgtaccagagaggaatttacaaggaaagtgcgctctaacgcagccataggcgctgtcttcgtggacgagaatcagtggaactcagccaaggaggcggttgaagatgagcgtttttgggacctcgtgcatcgggaaagagagctgcacaaacaggggaagtgcgcaacgtgcgtctacaatatgatgggaaaaagggaaaagaagttgggcgagttcggtaaagccaaggggagtcgcgctatctggtacatgtggctgggagcccgatttctcgagttcgaagcacttggcttcatgaacgaggatcactggttttcccgggaaaatagcctgtctggcgtggagggggagggattacataaactgggttatattttgagagacatctcgaagattcctggcgggaacatgtacgctgatgacaccgccggatgggatactaggatcacagaagacgatctccagaatgaggctcgcataaccgacatcatggaaccagagcacgccctgctagcaaaatcaattttcaaacttacttatcaaaacaaagtagttagagtgcagcggcccgcgaagaatggcacagtcatggatgtgatcagcaggcgtgaccagcgaggttccgggcaagtgggaacctacggcctgaacacatttactaatatggaagcccaactcattcgccagatggagagtgagggcatcttctctcctagcgaactggagaccccaaacttggctgaaagagtcttagattggctggagaagtatggggttgaacggctcaaaaggatggccatatccggagacgactgtgtggtaaagcccattgatgaccgctttgcaacggctcttaccgccctgaacgatatgggtaaagtgagaaaggacatcccgcagtgggagccttcaaaaggctggaatgattggcagcaagtccccttctgcagtcatcactttcaccagctaatcatgaaggacgggcgggagattgtggttccatgtaggaaccaggatgaactggtgggacgagcacgtgtctctcagggcgccggttggagcctcagagagacagcgtgcttggggaagtcctacgctcaaatgtggcagctgatgtatttccatcgccgggaccttaggctggccgcaaatgccatatgttcagctgtgcctgtagattggatccccactagcagaaccacatggtctattcacgcccatcaccagtggatgactaccgaagacatgctctccgtttggaaccgcgtgtggatcgaggaaaatccatggatggaggataaaacgcatattagtagctggggagacgtcccctacttaggcaagcgggaggaccaatggtgcggctcgctgatcgggttgacagcaagggctacctgggccactaacatacaggtggcgatctaccaggttcgaagactgattggaaatgaaaactatctcgattacatgacatccatgaaacggtttaagaatgagtctgaccctgaaggtgctctttggtga

SEQ ID NO: 13299 - RNA, 9879 nt, synthetic construct
  misc_feature 1..9879: note = derived and/or modified CDS sequence (opt3) from DENV-1__FJ639689__SS-prME
  source 1..9879: mol_type = other RNA
agcgtgaccatgctgctcatgcttatgcccactgcactggctttccacttgactatcaggggaggggagcctcatatgattgtctccaagcaggaaagggggaaatctttactgtttaagacgtcagccggtgttaacatgtgcaccctaatagcaatggacctcggagagctgtgtgaagataccatgacttacaaatgcccacggatcaccgaggcggaaccggacgatgtggactgttggtgcaatgctacagatacctgggtgacttatgggacatgtagtcagaccggagagcaccgccgagacaagcgtagcgtggcccttgcaccccatgtcggcctgggtttggagacgagaactgaaacctggatgtcctctgagggggcctggaaacagattcagagggtggaaacatgggctctccggcaccctggattcactgttatcgcactgtttctggcccatgctattggcacctcgatcacacagaagggcataatcttcattctcttaatgctggtgaccccatcaatggccatgcgctgcgtcgggatcggaagccgggattttgtggagggtcttagtggcgcgacgtgggtagacgttgtgttggagcacgggtcctgtgtcactacaatggcaaaggataaacccaccctggacattgaactactcaagactgaggtgacaaaccctgccatcctgaggaaactttgcatagaagctaagatttctaataccacgaccgatagccggtgtccaacacaaggagaggccactctggtggaagaacaggacgcaaacttcgtctgccgccgaacctttgttgatagaggctggggtaatgggtgtggattgttcggcaaaggctccctcatcacatgcgctaagtttaagtgcgtgactaaactggaggggaagattgtacagtacgaaaacttaaaatattcagtgatcgtcaccgtgcacacaggagaccagcatcaagttggtaatgagagtaccgaacacggcactacggccacaatcacaccccaggcgcctactaccgagattcagctgacagactacggggccctcacccttgattgtagcccaaggactggactggacttcaacgaaatggtgttgctaacaatgaaggagaaatcttggctggtccataagcagtggtttctcgatctgccgcttccctggacgtccggcgcatcaaccagccaagagacttggaatcggcaggacctgttggtgacattcaaaaccgctcacgccaagaagcaggaagtagttgtgctcggtagtcaagagggggctatgcacacagccctgactggcgcaaccgaaatacagacgtctggaaccacaactatctttgccggccatttaaaatgccgtctgaagatggataaactaaccctcaaggggatgtcctatgtcatgtgtacaggcagcttcaaactggagaaggaagtggctgagactcagcacggtaccgtccttgtgcagattaagtacgagggcacggacgcgccttgcaaaatcccattctcgacacaagatgaaaagggggttacccagaacggacgcttgataactgcaaatcccattgtgacagacaaagagaagcctgtaaacatcgaagccgagccaccctttggcgagtcttatatcgtcattggtgctggggaaaaagccctgaagctctcctggttcaagaaaggctcaagtatcggaaagatgtttgaggcaaccgccagaggcgctaggcggatggccattctgggggatactgcatgggacttcggaagcataggtggcgtgtttacctccgttgggaaacttgtgcatcagatcttcggaacagcgtacggcgtcctgttttctggtgtgagctggacgatgaagattgggatcggcgtattgctcacctggctgggattaaattcacgaagtacttccttcagcatgacatgtatcgctgtgggcctggttaccctatacctcggggtcatggtgcaggccgattctggatgcgtgattaactggaaaggccgcgaactgaagtgtggttcagggatatttgtcacaaatgaggttcacacttggaccgaacaatataagttccaggcagacagtccgaaaagacttagcgccgctatcggaaaggcctgggaggagggcgtgtgcggtattaggtccgcaacgcggttggaaaacatcatgtggaaacagatttctaacgagctgaatcatatcctcctggaaaacgacatgaagtttacagtggtagtcggcgatgtggctgggatattagcccagggcaagaagatgatccgccctcaacccatggagtacaaatattcgtggagaagctggggcaaggcgaagattatcggggccgacgttcagaataccactttcattatcgatggaccaaacacccctgaatgtcccgacgatcagagggcttggaatatatgggaggtggaggactacggctttggtattttcacaactaacatctggctgaaacttcgtgattcctatacccaggtctgcgaccaccggttgatgtcagcagccattaaggatagtaaagctgtgcacgccgacatggggtactggatcgaatctgagaagaatgaaacatggaaactcgcacgagcgagcttcatagaggttaagacgtgtgtgtggccaaagtcccataccctgtggtcaaacggagtactagaaagcgagatgatcattcccaaaatctatggcggtcctatttctcaacacaattacagaccaggctactttactcagacagccgggccgtggcatctgggaaagctcgagctggatttcgacctttgcgaaggcaccactgtcgtggtggatgagcactgcgggaacaggggaccctccttgcgcacaaccacggtcactggcaaaatcatacacgaatggtgttgccggagttgtaccctgcctccattaagatttaggggtgaggacgggtgctggtatggaatggagattcgccccgttaaggaaaaagaggaaaatctcgtaaagagcatggtatctgctggctccggtgaggtggactcattcagtctgggccttctgtgtatcagcatcatgacagaagaggtcatgcgatcgcggtggtcccgtaagatgttgatgaccgggactctcgccgtgtttctgctactgattatgggacagctcacatggaacgatctgatcagactttgcattatggttggcgcaaatgcttctgacaggatggggatgggaaccacatacttggccctgatggcaactttcaaaatgcgccctatgtttgccgtgggcttactcttccggagactgaccagcagggaggtccttctgctaacggtgggtctctcactggttgctagtgtggaattgccaaactccctggaggaattaggggatggactcgcgatgggcataatgatcctgaaacttctgacagactttcaaccccatcagttgtgggccaccctcctgtctctaactttcattaaaaccacatttagcctgcactatgcatggaagactatggctatggtcctttccatcgtatcactcttcccgctgtgtttgagcaccacgagtcagaaaacaacctggctgcctgtgttactcggctctctggggtgcaagccacttactatgtttctgattgccgagaataagatctggggacgacgctcctggcccttgaacgaaggtataatggccgttggcatcgtgagcattctcctgtcgtcactactgaaaaacgatgtccctcttgctgggcccctcatcgcaggagtgatgctgattgcctgttacgtaatctctggcagttccgcggacttgagcttagagaaggctgccgaggtgtcttgggaagaggaagcagagcatagcggtgcctcccacaatatactggtcgaagttcaggatgacgggacaatgaaaattaaggatgaggagcgggacgataccctcactatcctgcttaaagctacactgttggcagtgtcaggagtgtatccactaagtatccctgccaccctgttcgtctggtacttctggcaaaagaaaaagcagagaagcggcgtgctctgggacacgccctctccaccggaagttgagagggcggtactggatgacggcatttatcgtataatgcagcgcgggcttttaggacggtcccaggtgggtgtcggcgtgtttcaagaaaacgttttccatactatgtggcacgtgaccagaggggctgtcctgatgtaccagggaaagaggctcgagccttcatgggccagtgtgaaaaaggacttgatcagctacggcggtgggtggcgactgcagggatcctggaatacaggcgaggaagtacaggtcattgcagtggagcccggcaaaaacccaaagaatgttcaaaccgcccccgggacatttaaaactcctgaaggagaggtgggtgctatcgccctcgatttcaagccaggcacctctgggtcgcccattgtcaaccgggaaggaaagatcgtgggcctgtatggtaatggggttgtgacgacaagcggaacttacgtctcagcaatagctcaggccaaagcgtcccaggagggccctcttccggagatcgaagacgaggtgtttcgcaagagaaacctgaccattatggatttgcacccaggcagtgggaaaacaaggcggtatctacccgccatcgtacgagaagcaattaagagaaaactgcgcaccctcatcttagctcctactagggtggttgcctctgagatggctgaagcactgaagggaatgccaatacgttaccaaaccacagccgtcaagagcgagcatacgggtaaagagattgtggaccttatgtgccacgccactttcaccatgcggctgctctcccccgtgagagtccctaattataacatgatcatcatggatgaagctcattttacagacccgtcatctattgcggcaaggggctacatcagcacccgcgtagggatgggagaggccgctgccatattcatgactgcaacacccccaggcagtgtggaagcctttcctcagtccaatgctgttattcaggatgaggaacgagacatccccgagagaagctggaactctggttatgagtggattaccgatttcccagggaagacggtgtggtttgtcccttcaatcaaatccggaaatgacatagcgaactgtttgcggaagaatggcaaaagggtgattcagctgagtcgcaagactttcgatacagaataccaaaagaccaaaaacaacgactgggactacgttgtgaccactgatatcagcgagatgggcgccaatttccgtgcagacagagtcatcgatccccggaggtgcctcaagccagtgattctgaaagacgggccggaacgcgtaatccttgctggacctatgcccgtgacagttgcctcggcagcccagcgaagaggtcggattggcaggaaccacaataaggagggggatcagtatatatacatgggacagccactaaacaatgacgaggatcatgctcactggaccgaagccaaaatgctgttggacaacatcaatacacccgagggcattatccctgcgttatttgaaccagagcgcgaaaagtctgcagccatcgatggtgagtatagactgagaggggaagctcggaagactttcgtcgaactcatgcgtcgcggcgacctgcccgtgtggctttcctacaaagtggccagcgagggatttcaatattcagatcgaagatggtgcttcgacggcgaaaggaacaatcaggtcctggaggaaaacatggatgttgagatttggacgaaggagggggaacggaaaaagctccgccctagatggttggacgctaggacctacagtgacccgctggcactacgggagtttaaagagttcgccgctggacgaagatctgtgtccggtgatctgatactcgagatcggcaaacttccacagcacctgacacagcgcgcccaaaatgcattagacaacttggtaatgctgcataatagcgaacaaggcgggagggcgtatcggcacgccatggaggagctccccgatactattgaaaccctgatgcttctggctctcatcgccgtgttgacagggggtgtcaccctgtttttcttatcagggcgtggcctaggaaaaacaagtattggcctgctctgtgtgatggcaagctccgttcttctgtggatggcttctgtggagcctcattggatcgccgcaagcataatcttggaatttttcctgatggtcctcctgattcccgagccagacagacagaggacgcctcaggataaccaacttgcctacgtagtgatcgggctcctgtttatgattttgaccgttgctgcgaatgagatgggactgttagaaacaactaagaaggacctaggtatcggccacgtggccgtcgggaaccaccatcacgcagctatgctggatgtggacctccatcccgcctccgcctggaccctttacgcagtcgctacaaccataattactccaatgatgcgccacacaatcgagaacacgaccgccaatatttcactgactgcgatcgctaaccaggccgcaatattgatgggactggataaaggctggcctatctctaagatggacattggtgtgccgctcctggcccttgggtgctatagtcaggttaatcccttaacactgaccgctgcagtgctcatgttggtagcccattacgcgatcattggcccaggactgcaagctaaagccacccgggaagcacagaagcgaacagccgctggcatcatgaaaaaccctactgtggatgggatagtcgccattgacctagatcccgttgtgtatgacgcaaagttcgagaagcagctgggacagatcatgctccttatcctgtgtacgtcgcaaattttgctgatgagaaccacatgggctctctgcgaaagcatcactctggccaccggcccattaacaaccctttgggagggttcccctgggaaattttggaatactacgatagcggtctctatggccaacattttcaggggatcatacctggcaggcgctggtctcgccttcagcctaatgaagtccctgggcgggggacgccggggcacaggggcacagggagagaccttgggcgaaaaatggaagagacagctgaatcagctcagtaaatctgagtttaacacttataagcgtagcggtatcatggaagtggacaggtcagaggctaaggaagggcttaaacggggagagattaccaagcacgccgtatcccgcggcacagccaaactgcgatggttcgtggagagaaatttggttaagcccgaaggtaaagtgatcgatctgggctgtgggaggggaggctggagttactattgcgcggggctcaagaaggtcactgaggtgaaaggatacaccaagggcggtccggggcacgaggagccaatacctatggctacatacggatggaacttagtcaaactgcatagcggcaaggacgtgtttttcgttcccccagaaaaatgtgatacgcttctgtgcgacatcggcgagtcttcccccaatcctaccattgaggaagggcggactctacgcgtactcaagatggtggagccgtggctgagaggaaaccaattttgtatcaaaattttgaatccctatatgccatcagtcgtggaaacactggagcagatgcagaggaagcacggtggcatgctcgttcgaaaccctcttagcagaaattcgacccatgagatgtactgggtgtcttgcgggactggaaacatcgtcagtgcagtgaatatgacatcccgtatgctgttaaacagattcaccatggcccaccgcaagcccacgtatgaaagggatgtagacctgggcgctggtacccggcacgtggccgttgagcctgaagtcgcaaacttggatattatcgggcagagaatagagaatattaaacatgaacacaagagcacatggcattacgacgaggataacccatataaaacttgggcctaccacggatcatatgaggtgaagccctccggctctgctagcagtatggtgaatggcgtcgttaaactcctgaccaagccttgggacgtgatcccaatggtaacacaaatcgcgatgactgataccacaccctttgggcagcagcgcgtgttcaaggaaaaagtcgacaccaggactccgaaggccaaacgaggaacggcacaaattatggaggtgacagctaagtggctatggggttttctttcccggaacaaaaagcctagaatatgtaccagggaagagttcactcgcaaggttcgtagcaatgccgcaatcggcgccgtgtttgtcgacgaaaaccagtggaactctgctaaagaggccgtggaggatgaacggttctgggacctggtacatagagagagggaactccacaagcaggggaaatgcgcgacctgcgtttacaacatgatgggaaagcgcgagaaaaagctgggcgaatttggtaaggcaaaagggtcacgagccatttggtacatgtggttgggagctcggttcctggagttcgaggccctcggctttatgaatgaagatcactggttcagtagagagaactcccttagcggcgtggaaggggagggactgcataagttaggttatatcctgagggacatttctaaaatcccaggcgggaatatgtacgcagatgacacagctggatgggatacgcgcataaccgaggacgatttgcagaacgaagccagaatcactgacattatggagcccgaacacgctctcctggccaagtcgatctttaaactaacatatcaaaataaggtcgtgcgggtgcagaggcctgccaagaatggcaccgtcatggatgttatttcacgtcgagaccagcgcggtagcggacaggtgggaacttacggccttaatacattcaccaacatggaggcgcaactgatcagacagatggaatccgagggcatatttagtccatctgagctcgaaacacccaacctggccgagcgggtattggattggttagaaaagtatggggtggagaggctgaagcgcatggctattagcggagacgactgtgtcgtgaaaccgatcgatgacagattcgccactgcactcaccgctcttaatgatatgggtaaggttcggaaagacatccctcagtgggaaccctccaagggctggaacgattggcagcaagtgccattttgctcacatcacttccaccagctgattatgaaagacgggagggagatagtcgtgccttgtcgaaatcaggatgagctagtaggacgtgccagagttagtcagggcgcaggttggtctctgcgcgaaacggcctgcctcggaaagagctacgcgcaaatgtggcagttgatgtattttcatcggagggacctgagacttgctgccaacgcaatctgttccgccgtgcccgtcgattggattccaacctcacgcacaacttggagcatccacgctcatcaccagtggatgaccacagaggacatgctgtctgtgtggaatcgggtttggattgaagagaacccctggatggaagataagactcatatctccagttggggagacgtgccttacctcggcaaaagggaggaccaatggtgcggcagcttaatagggctgaccgcccgagcaacgtgggctacaaatatccaggtcgccattaaccaggtgagacggttgatcggaaatgagaactacctggattatatgacctcgatgaagaggttcaaaaatgaatccgacccagagggtgcgctctggtga

SEQ ID NO: 13300 - RNA, 9879 nt, synthetic construct
  misc_feature 1..9879: note = derived and/or modified CDS sequence (opt3) from DENV-1__FJ639690__SS-prME
  source 1..9879: mol_type = other RNA
agcgtgaccatgctgctcatgcttatgcccacagccctggctttccacttgactatcagaggcggggagcctcatatgattgtctccaagcaggaaaggggaaaatctttactgtttaagacgtcagcaggtgttaacatgtgcaccctaatagccatggacctcggcgagctgtgtgaagatacaatgacttacaaatgcccacggatcaccgaggcggaaccggacgatgtggactgttggtgcaatgctacagatacctgggtaacttatgggacatgtagtcaaattggagagcaccgccgagacaagcgtagcgtggcccttgcaccccatgtcggcctgggtttggagaccagaacggaaacttggatgtcctctgagggggcctggaaacagatccagagggtggaaacctgggctctccggcaccctggattcacagttattgcactgtttctggcccatgctatcggcacttcgataacccagaagggcatcattttcatcctcttaatgctggtgacaccatcaatggccatgcgctgcgtcgggattggaagcagagattttgtggagggtcttagtggcgcgacctgggtagacgttgtgttggagcacgggtcctgtgtcacgactatggcaaaggataaacccacactggacatcgaactactcaagaccgaggtgactaaccctgccatactgaggaaactttgcattgaagctaagatctctaatacaaccacggatagccggtgtccaacccaaggagaggccacactggtggaagagcaggacgcaaacttcgtctgccgccgaacttttgttgatagaggctggggtaatgggtgtggattgttcggcaaaggctccctcattacctgcgctaagtttaagtgcgtgacaaaactggaggggaagatcgtacagtacgaaaacttaaaatattcagtgatcgtcactgtgcacaccggagaccagcatcaagttggtaatgagagtacagaacacggcaccactgccacgattacaccccaggcgcctaccactgagatacagctgaccgactacggggccctcacacttgattgtagcccaaggaccggactggacttcaacgaaatggtgttgctaactatgaaggagaaatcttggctggtccataagcagtggtttctcgatctgccgcttccctggacatccggcgcatcaacgagccaagagacctggaatcggcaggacctgttggtgactttcaaaacagctcacgccaagaagcaggaagtagttgtgctcggtagtcaagagggggctatgcacaccgccctgacaggcgcaactgaaatccagacctctggaacgaccacaatttttgccggccatttaaaatgccgtctgaagatggataaactaactctcaaggggatgtcctatgtcatgtgtaccggaagcttcaaactggagaaggaagtggctgagacacagcacggtactgtccttgtgcagatcaagtacgagggcaccgacgcgccttgcaaaataccattctcgacgcaagatgaaaagggggttacacagaacggacgcttgattaccgcaaatcccatcgtgactgacaaagagaagcctgtaaacatcgaagccgagccaccctttggcgagtcttatattgtcatcggtgctggggaaaaagccctgaagctctcctggttcaagaaaggctcaagtattggaaagatgtttgaggcaacagccagaggcgctaggcggatggccatactgggggataccgcatgggacttcggaagcatcggtggcgtgtttacttccgttgggaaacttgtgcatcagattttcggaaccgcgtacggcgtcctgttttctggtgtgagctggacaatgaagatcgggatcggcgtattgctcacgtggctgggattaaattcacgaagtacctccttcagcatgacttgtattgctgtgggcctggttacactatacctcggggtcatggtgcaggccgattctggatgcgtgataaactggaaaggccgcgaactgaagtgtggttcagggatctttgtcaccaatgaggttcacacatggactgaacaatataagttccaggcagacagtccgaaaagacttagcgccgctattggaaaggcctgggaggagggcgtgtgcggtatcaggtccgcaacccggttggaaaacattatgtggaaacagatctctaacgagctgaatcatatactcctggaaaacgacatgaagtttacggtggtagtcggcgatgtggctgggatcttagcccagggaaaaaagatgattcgccctcaacccatggagtacaaatattcgtggagaagctggggcaaggcgaagatcattggggccgacgttcagaatacaaccttcatcatagatggaccaaacactcctgaatgtcccgacgatcagagggcttggaatatttgggaggtggaggactacggctttggtatcttcaccacaaacatttggctgaaacttcgtgattcctatactcaggtctgcgaccaccggttgatgtcagcagccatcaaggatagtaaagctgtgcacgccgacatggggtactggatagaatctgagaagaatgaaacctggaaactcgcacgagcgagcttcatcgaggttaagacatgtgtgtggccaaagtcccatacgctgtggtcaaacggagtactagaaagcgagatgattatccccaaaatttatggcggtcctatctctcaacacaattacagaccaggctactttacccagactgccgggccgtggcatctgggaaagctcgagctggatttcgacctttgcgaaggcacaaccgtcgtggtggatgagcactgcgggaacaggggaccctccttgcgcactacaaccgtcacgggcaaaataattcacgaatggtgttgccggagttgtactctgcctccattaagatttaggggtgaggacgggtgctggtatggaatggagatccgccccgttaaggaaaaagaggaaaatctcgtgaagagcatggtatctgctggctccggtgaggtggactcattcagtctgggccttctgtgtatcagcattatgaccgaagaggtcatgcgatcgcggtggtcccgtaagatgttgatgacagggaccctcgccgtgtttctgctactgatcatgggacagctcacttggaacgatctgattagactttgcataatggttggcgcaaatgcttctgacaggatggggatgggaacaacctacttggccctgatggcaacattcaaaatgcgccctatgtttgccgtgggcttactcttccggagactgactagcagggaggtccttctgctaaccgtgggtctctcactggttgctagtgtggaattgccaaactccctggaggaattaggggatggactcgcgatgggcatcatgattctgaagcttctgacggactttcaaccccatcagttgtgggccacactcctgtctctaaccttcatcaaaactacctttagcctgcactatgcatggaagacaatggctatggtcctttccattgtatcactcttcccgctgtgtttgagcactaccagtcagaaaacgacatggctgcctgtgttactcggctctctggggtgcaagccacttaccatgtttctgatcgccgagaataagatatggggacgacgctcctggcccttgaacgaaggtatcatggccgttggcattgtgagcatcctcctgtcgtcactactgaaaaacgatgtccctcttgctgggcccctcattgcaggaggcatgctgatcgcctgttacgtgatatctggtagttccgcggacttgagcttagagaaggctgccgaggtatcttgggaagaggaagcagagcatagcggggcctcccacaatattctggtggaagtccaggatgacggaactatgaaaatcaaggatgaggagcgggacgatacactcaccatcctgcttaaagctactctgttggcagtttcaggcgtgtatccactaagtattcctgccacactgttcgtgtggtacttctggcaaaagaaaaagcagagaagcggcgtcctctgggacaccccctctccaccggaagtggagagggcggttctggatgacgggatatatcgtatcatgcagcgcggacttttaggtcggtcccaggtaggcgtgggggtctttcaagaaaacgtgttccatacgatgtggcacgttactagaggagctgtgctgatgtaccagggcaagaggctcgagccttcatgggccagtgtcaaaaaggacttgattagctacggtgggggatggcgactgcagggctcctggaataccggcgaggaagtgcaggtaatcgcagtcgagcccgggaaaaacccaaagaatgtgcaaacagcccccggaacctttaaaacacctgaaggtgaggttggcgctattgccctcgatttcaagccagggacttctggatcgcccatcgtgaaccgggaaggcaagatagtcggtctgtatgggaatggagtggttaccacgagcggcacatacgtgtcagcaatcgctcaggccaaagcgtcccaggagggccctcttccggagattgaagacgaggtctttcgcaagagaaacctgactatcatggatttgcacccagggagtggaaaaaccaggcggtatctacccgccattgtgcgagaagcaatcaagagaaaactgcgcacactcatattagctcctaccagggtagtggcctctgagatggctgaagcactgaagggtatgccaattcgttaccaaactaccgccgttaagagcgagcatacaggcaaagagatcgtcgaccttatgtgccacgccacgttcactatgcggctgctctcccccgtgagagtgcctaattataacatgatcattatggatgaagctcattttaccgacccgtcatctatcgcggcaagggggtacataagcacacgcgtcggaatgggcgaggccgctgccattttcatgaccgcaactcccccaggtagtgtagaagcctttcctcagtccaatgctgtgatccaggatgaggaacgagacattcccgagagaagctggaactctgggtatgagtggatcacagatttcccaggaaagaccgtttggtttgtgccttcaataaaatccggcaatgacattgcgaactgtttgcggaagaatggcaaaagggtcatccagctgagtcgcaagacgttcgatactgaataccaaaagacaaaaaacaacgactgggactacgtggttaccaccgatatcagcgagatgggggccaatttccgtgcagacagagtgattgatccccggaggtgcctcaagccagtcatcctgaaagacggaccggaacgcgtgattcttgctggtcctatgcccgtaactgtggcctcggcagcccagcgaagaggccggatagggaggaaccacaataaggagggagatcagtatatctacatgggccagccactaaacaatgacgaggatcatgctcactggacagaagccaaaatgctgttggacaacattaatacccccgagggtatcatccctgcgttatttgaaccagagcgcgaaaagtctgcagccattgatggggagtatagactgaggggcgaggctcggaagacattcgttgaactcatgcgtcgcggagacctgcccgtctggctttcctacaaagtggccagcgagggctttcaatattcagatcgaagatggtgcttcgacggggaaaggaacaatcaggtgctggaggaaaacatggatgtcgagatatggactaaggagggagaacggaaaaagctccgccctagatggttggacgctaggacgtacagtgacccgctggcactacgggagtttaaagaattcgccgctggtcgaagatctgtttccggcgatctgatcctcgagattgggaagcttccacagcacctgacccagcgcgcccaaaatgcattagacaacttggtgatgctgcataatagcgaacagggaggcagggcgtatcggcacgccatggaggagctccccgatacaatcgaaactctgatgcttctggctctcattgccgtattgaccggtggggtgacactgtttttcttatcaggccgtggactaggcaaaaccagtatcgggctgctctgtgtcatggcaagctccgtgcttctgtggatggcttctgttgagcctcattggatagccgcaagcatcattttggaatttttcctgatggtgctcctgatccccgagccagacagacagaggactcctcaggataaccaacttgcctacgtcgtaattggactcctgtttatgatcttgacggtggctgcgaatgagatgggtctgttagaaaccacaaagaaggacctaggcatagggcacgttgccgtgggaaaccaccatcacgcagctatgctggatgtcgacctccatcccgcctccgcctggactctttacgcagtggctaccacaattatcaccccaatgatgcgccacactattgagaacacaacggccaatatctcactgaccgcgatagctaaccaggccgcaatcttgatgggcctggataaaggttggcctatttctaagatggacatcggggtcccgctcctggcccttggctgctatagtcaggtgaatcccttaactctgacagctgcagttctcatgttggtggcccattacgcgattatcggaccaggcctgcaagctaaagccacccgggaagcacagaagcgaaccgccgctgggataatgaaaaaccctacagtagatggaattgtggccatcgacctagatcccgtcgtttatgacgcaaagttcgagaagcagctgggccagatcatgctccttattctgtgtacttcgcaaatcttgctgatgagaacgacctgggctctctgcgaaagcataacactggccactggtccattaaccacactttgggaggggtcccctggaaaattttggaataccactattgcggtgtctatggccaacatcttcaggggctcatacctggcaggtgctggcctcgccttcagcctaatgaagtccctggggggaggccgccgggggacgggagcacagggcgagacattgggtgaaaaatggaagagacagctgaatcagctcagtaaatctgagtttaacacctataagcgtagcgggattatggaagtcgacaggtcagaggctaaggaaggacttaaacggggcgagatcactaagcacgccgtgtcccgcggtaccgccaaactgcgatggttcgtagagagaaatttggtgaagcccgaaggcaaagttatagatctggggtgtggaaggggcgggtggagttactattgcgcgggactcaagaaggtgacagaggtcaaaggctacactaagggtgggccgggacacgaagagccaatccctatggctacctacggctggaacttagtgaaactgcatagcggcaaggacgtctttttcgtgcccccagaaaaatgtgatacacttctgtgcgacattggggagtcttcccccaatcctacgatcgaggaaggacggaccctacgcgttctcaagatggtagagccgtggctgagaggtaaccaattttgtattaaaatcttgaatccctatatgccatcagtggtcgaaactctggagcagatgcagaggaagcacggcgggatgctcgtgcgaaaccctcttagccggaattcgacacatgagatgtactgggtttcttgcggaaccggcaacattgtgagtgcagtcaatatgacttcccgtatgctgttaaacagattcacaatggcccaccgcaagcccacctatgaaagggatgtggacctgggtgctgggacgcggcacgtagccgtggagcctgaagttgcaaacttggatatcataggacagagaattgagaatatcaaacatgaacacaagagcacctggcattacgacgaggataacccatataaaacatgggcctaccacggctcatatgaggtcaagccctccggctctgctagcagtatggtgaatggggtggtcaaactcctgactaagccttgggacgttatcccaatggtgacccaaattgcgatgacagatactaccccctttggacagcagcgcgtattcaaggaaaaagtggacacaaggaccccgaaggccaaacgaggtactgcacaaataatggaggtcacggctaagtggctatggggctttctttcccggaacaaaaagcctagaatctgtacaagggaagagttcacccgcaaggtgcgtagcaatgccgcaattggggccgtttttgtggacgaaaaccagtggaattctgctaaagaggccgtcgaggatgaacggttctgggacctggtgcatagagagagggaactccacaagcagggaaaatgcgcgacttgcgtatacaacatgatgggcaagcgcgagaaaaagctgggtgaatttgggaaggcaaaaggatcacgagccatctggtacatgtggttgggcgctcggttcctggagttcgaggccctcggctttatgaatgaagatcactggttcagtagagagaactcccttagcggggttgaaggagagggtctgcataagttaggctatattctgagggacatctctaaaataccagggggaaatatgtacgcagatgacaccgctggctgggatacacgcatcacggaggacgatttgcagaacgaagccagaattaccgacatcatggagcccgaacacgctctcctggccaagtcgatttttaaactaacttatcaaaataaggtggtccgggtgcagaggcctgcaaaaaacggtacagtgatggatgtcatctcacgtcgagaccagcgcgggagcggacaggttggcacctacggccttaatactttcacaaacatggaggcgcaactgataagacagatggaatccgaggggatttttagtccatctgagctcgaaacccccaacctggccgagcgggtgttggattggttagaaaagtatggagtagagaggctgaagcgcatggctatcagcggtgacgactgtgtggtcaaaccgatcgatgacagattcgccacagcactcactgctcttaatgatatgggcaaggtgcggaaagacattcctcagtgggaaccctccaaggggtggaacgattggcagcaagttccattttgctcacatcacttccaccagctgataatgaaagacggaagggagatcgtggtcccttgtcgaaatcaggatgagctagtgggccgtgccagagtaagtcagggtgcagggtggtctctgcgcgaaaccgcctgcctcggaaagagctacgcgcaaatgtggcagttgatgtattttcatcggagggacctgagacttgctgccaacgcaatttgttccgccgttcccgtggattggatcccaacgtcacgcaccacatggagcattcacgctcatcaccagtggatgactaccgaggacatgctgtctgtctggaatcgggtgtggatcgaagagaacccctggatggaagataagacacatatatccagttggggcgacgttccttacctcggcaaaagggaggaccaatggtgcgggagcttaatcggactgactgcccgagcaacctgggctacgaatattcaggtggccatcaaccaggtcagacggttgattggtaatgagaactacctggattatatgacatcgatgaagaggttcaaaaatgaatccgacccagagggcgcgctctggtga

SEQ ID NO: 13301 - RNA, 9879 nt, synthetic construct
  misc_feature 1..9879: note = derived and/or modified CDS sequence (opt3) from DENV-1__FJ639691__SS-prME
  source 1..9879: mol_type = other RNA
agcgtgaccatgctgctcatgcttatgcccaccgccctggctttccacttgactacgagaggaggggaacctcatatgatcgtctccaagcaggaaaggggaaaatctttactgtttaagacctcagccggtgttaacatgtgcacactgattgccatggacctcggagagttctgtgaagatactatgacctacaaatgcccacggataagtgaagcggaaccggacgatgtggactgttggtgcaatgctacagatacctgggtaacttatgggacatgtagccaaaccggagagcaccgccgagacaagcgttccgtggccctggcaccccatgtcggccttggtctggagacgagaactgaaacctggatgtcttcggagggggcctggaaacagatccagagggtggaaacatgggctttgcggcaccctggatttactgttattgcactcttcctggcccatgctatcggcacctcaattacacagaagggcatcatatttatcctgctcatgttagtgaccccaagcatggccatgcgctgcgtcgggattggaagtagagatttcgtggagggtctgtccggcgcgacgtgggtagacgttgtgcttgagcacgggtcttgtgtcactacaatggcaaaggataaacccaccttggacatcgaactgctaaagactgaggtgacaaaccctgccgtgctcaggaaactgtgcattgaagctaagatcagcaataccacgaccgattcccggtgtccaacacaaggagaggccactcttgtcgaagaacaagacgcaaactttgtttgccgccgaaccttcgtggatagaggctggggtaatgggtgtggactgtttggcaaaggctcattgataacatgcgctaagttcaagtgcgtaactaaactcgaggggaagattgtgcagtacgaaaacctgaaatatagtgtcatcgtgaccgttcacacaggagaccagcatcaagtgggtaatgagagcaccgaacacggcactacggccacaattacaccccaggcgccttctactgagatccagttaaccgactacggggccctgacactcgattgttccccaaggaccggacttgactttaacgaaatggtcctgttgactatgaaggagaaatcatggctagtgcataagcagtggttcctggatctcccgctgccctggacaagcggcgcaagtacgtctcaagagacctggaatcggcaggaccttctggtaacttttaaaacagctcacgccaagaagcaggaagttgtggtcttgggttcccaagagggggctatgcacaccgccctcacaggcgcaactgaaatccagaccagcggaacgaccacaattttcgccggccatctgaaatgccgtttaaagatggataaactgactctaaaggggatgtcgtatgtgatgtgtaccggatctttcaaactcgagaaggaagtcgctgagacacagcacggtactgtgctggttcagataaagtacgagggcaccgacgcgccttgcaaaatcccattttccacgcaagatgaaaagggggtgacacagaacggacgccttattaccgcaaatcccatcgtaactgacaaagagaagcctgtcaacatagaagccgagccacccttcggcgagtcatatattgtgatcggtgctggggaaaaagccttgaagctgagttggtttaagaaaggcagctccatcggaaagatgttcgaggcaacagccagaggcgctaggcggatggccattctcggggataccgcatgggactttggatctatcggtggcgttttcactagcgtggggaaactggtccatcagatttttggaaccgcgtacggcgtgcttttctcaggtgtaagttggacaatgaagatagggatcggcgtgctgttgacgtggctcggactaaattcccgaagcacctctttatcaatgacttgtattgctgttggcctggtcacactatacctcggggtgatggtgcaggccgatagtggatgcgtcatcaactggaaaggccgcgaactgaagtgtggtagcgggatctttgttaccaatgaggtgcacacatggactgaacaatataagttccaggcagactccccgaaaagactttctgccgctattggaaaggcctgggaggagggcgtgtgcggtataaggtcggcaacccggttggaaaacatcatgtggaaacagattagcaacgagctgaatcatatcctcctggaaaacgacatgaagtttacggtagtcgtgggcgatgttgctgggattttagcccagggcaagaagatgatccgccctcaacccatggagtacaaatattcctggaagtcatggggcaaggcgaaaataatcggggccgacgtgcagaatacaaccttcattatcgatggaccaaacactcctgaatgtcccgacgatcagagagcttggaatatttgggaggtcgaggactacggctttggtatcttcaccacaaacatatggctgaaacttagggatagttatactcaggtgtgcgaccaccgtttgatgtctgcagccattaaagatagcaaggctgttcacgccgacatggggtactggatcgaatccgagaaaaatgaaacctggaagctcgcacgggcgtcattcattgaggtgaagacatgtatctggccaaaaagccatacgctgtggtctaacggagtactagaatccgagatgataatccccaagatttatggcggtcctatcagtcaacacaattaccgaccaggctactttacccagactgccgggccgtggcatctgggaaaactcgagctggatttcgacctttgcgaaggcacaaccgtcgtggtggatgagcactgcgggaacagaggacccagcttgaggactacaaccgtcacgggcaagattatccacgaatggtgttgccgctcttgtactctgcctccattacggtttaaaggtgaggacgggtgctggtatggaatggagataagacccgttaaggaaaaggaggaaaatctcgtgaaatccatggtatcagctggcagtggtgaggtggacagcttctcgctgggccttctgtgtatttccatcatgatcgaagaggtcatgaggtctcgctggagccgaaagatgttgatgaccgggacactcgccgtgtttttcctgctaattatgggacagctgacctggaacgatctcatccggctgtgcattatggttggcgcaaatgcttcagaccgtatggggatgggaatgacttaccttgccttgatggcaacatttaaaatgagacctatgttcgccgtgggcctgttatttaggcgcctcaccagtcgggaggtcctgcttctgacaataggtctatccctcgtggcttctgttgaactgccaaacagcttggaggaactgggggatggattagcgatgggcatcatgattctcaagctgcttactgacttccaatcctatcagctgtgggccaccttgctctcactgacgtttatcaaaacaaccttcagcctacattacgcatggaagactatggctatggtgctgagtattgtctctctttttcccctctgtctgtccaccacaagccagaagactacctggttgccggtactgttaggctcgctcgggtgcaaacctctgacgatgttccttatcgccgagaataagatatggggaagaaaatcatggccactgaacgaaggtatcatggccgtgggcattgtttctatcttgctcagttccctgctaaagaacgatgtgcccctggctgggcctcttattgcaggaggcatgctcatcgcctgttatgtcataagcggttctagcgcggacctgtccttggagaaagctgccgaggtgtcatgggaagaggaagcagagcacagtggggccagccataatattttagtagaagtgcaggatgacggaacaatgaagatcaaagatgaggagagggacgataccctgactatcctcctgaaggctacacttctggcagtctctggcgtttaccccttgtccattccagccaccctattcgtgtggtatttttggcaaaagaaaaagcagcgatcaggcgtgctgtgggacactcctagtcccccagaagtcgagcgcgcggtgctcgatgacgggatataccggatcatgcagagaggactgcttggtaggagccaggttggcgtaggggtgttccaagaaaacgtctttcacacaatgtggcatgtgacccgtggagctgttttaatgtaccagggcaaacgcctggagccgtcctgggcctctgtgaagaaagacctcatttcgtatggtgggggatggcggttgcagggcagctggaatacgggcgaggaagtccaggtgatcgcagtagagcctgggaagaaccccaagaatgtccaaactgccccaggaaccttcaaaacatcagaaggtgaggtgggcgctattgccctggattttaagcccgggacctccggaagtcctatcgttaacagagaaggcaaaatagtgggtctctacgggaatggagtcgtgacaacttctggcacctatgttagcgcaatcgctcaggccaaggcgtcccaggagggcccactgcccgagattgaagacgaggtgttcaggaaacgaaaccttacgatcatggatctgcaccctgggtcaggaaagacacggcgctacttgccggccattgtcagagaagcaatcaagaggaaactacggactctgatactcgctccaacccgagtggtagcctctgagatggctgaagcattaaagggtatgcccattagatatcaaacaaccgccgtgaaaagcgagcacactggcaaggagatcgttgacctgatgtgccatgccacctttacaatgcgccttctgagtcctgtcagggtgccaaattacaacatgatcattatggatgaagctcacttcacggacccctccagcatcgcggcacgtgggtatatatctactcgggtgggaatgggcgaggccgctgccatttttatgaccgcaacacctccgggttcagtcgaagccttcccccagtccaatgctgtaatccaggatgaggaaagagacattccagagaggagttggaacagcgggtacgagtggatcaccgattttcctggaaaaactgtgtggttcgttccctcgataaagtctggcaatgacattgcgaactgtctccgcaagaatggcaaacgagtgatccagttgtccagaaagacattcgataccgaataccagaagacgaagaacaacgactgggactatgtcgtgactacagatatcagcgagatgggggccaattttcgggcagacagggttattgatccacgccgttgcctgaaacctgtgatcctcaaggacggacccgaaagagtcattctggctggtccaatgccggtgaccgtagcctcagcagcccagcggaggggccgcatagggcgaaaccataataaggagggagatcagtacatctatatgggccagcctcttaacaatgacgaggatcacgctcattggaccgaagccaaaatgctactggacaacattaatactcccgagggtatcatcccagcgttgttcgaacccgagagagaaaagagtgcagccattgatggggagtaccggttaaggggcgaggctcgcaaaacatttgtggaactgatgagaaggggagacctccctgtttggctgtcttataaggtcgcctccgagggcttccaatacagcgatcggcgttggtgctttgacggggaacgcaacaatcaggtgcttgaggaaaacatggatgtggagatatggaccaaagagggagaacgaaagaaactgagaccaaggtggctcgacgctcggacatattcagaccccttggcactgcgcgagttcaaggaatttgccgctggtagaaggagtgtcagcggcgatctaatcctggagattgggaagctccctcagcaccttactcagcgggcccaaaatgcactggacaacttagttatgttgcacaattccgaacagggaggccgagcgtacagacatgccatggaggagctgccggatacgatcgaaaccctcatgctgcttgctctgattgccgtgctcacaggtggggtaactttgttctttctgtctggccgcggattaggcaaaaccagcatcgggctactgtgtgtgatggcatcctcagtcctcctttggatggcttctgtggagccacactggatagccgcaagtatcattctggagttctttttgatggttctgctcatccccgagcctgacaggcagcggacaccccaggataaccaactggcctacgtggtcattggacttctcttcatgatcctgaccgtagctgcgaatgagatgggtttgctggaaactacgaagaaagacttaggcatagggcatgtggccgttgagaaccaccaccatgcagctatgctagatgtggacctgcacccagcctcggcctggaccctctatgcagtcgctacaactattatcacccctatgatgcgtcatacaattgaaaacaccactgccaatatcagccttacagcgatagctaaccaggccgcaatcctgatgggattggataagggctggcccatttccaaaatggacatcggtgtgccactgctcgccctggggtgctactctcaggtcaatcctcttacgttaaccgctgcagtgctgatgctcgttgcccactatgcgattatcggcccgggattgcaagctaaggccactagagaggcacagaagaggacagccgctggcataatgaaaaaccccaccgtggatgggattgtagccatcgacctggatccagtggtctacgacgcaaagtttgaaaaacagctaggacagatcatgctgctcattctttgtacctcacaaatcctgttgatgcgcacaacttgggctctgtgcgagagcataacgctcgccaccggccctctgacaactttatgggagggttcccccgggaagttctggaataccacaattgcggttagtatggccaacatcttccggggatcttatcttgcaggcgctggtctggcctttagcctcatgaaatcactaggcgggggacgaagaggcaccggggcacagggagaaactctgggcgagaagtggaagaggcagttgaatcagctgtccaaaagtgagttcaacacgtacaagcgcagcggtattatggaggtggaccggtctgaagctaaagaggggctcaagagaggagagacaaccaaacatgccgtctcccgtggcactgccaaacttaggtggtttgtggaacggaatctggtaaagccagagggtaaagtgatcgatttgggctgtgggcgcggaggctggtcatattactgcgcggggctgaagaaagttaccgaagtgaagggatacacaaaaggcggtcctgggcacgaggaacccataccgatggctacttatggatggaacctcgtcaagttacacagcggcaaagacgtgttctttgtcccacctgagaagtgtgataccctgctttgcgacatcggcgagtcgtctcccaatccaacaattgaagaggggcgaacgctgagagtgctaaagatggttgaaccctggctcaggggaaaccaattctgtatcaaaattctgaatccttacatgccgagtgtagtggagaccttggagcagatgcagcggaagcatggtggcatgctggtccgcaaccccctctccagaaatagcactcacgaaatgtattgggtgtcatgcgggacaggaaacatcgtttccgcagtgaatatgacctctaggatgcttctgaaccgatttactatggcccatcggaaaccaacatacgagcgtgatgtcgacttaggcgctggtaccagacacgtggccgtagaacctgaggtggcaaacctggatattatcgggcagcgcatagaaaatattaagcacgagcataaaagcacgtggcactatgacgaggataacccctacaagacctgggcctatcatggaagttacgaagttaagccttccggcagcgcttcttcaatggtcaatggcgtggtgaaattgctcacaaagccatgggacgtcatccccatggttactcaaatcgcgatgaccgatacaactcctttcgggcagcagagggtgtttaaagagaaggtagacacccggacaccaaaagccaagagaggaaccgcacaaattatggaagtgactgctaagtggctgtggggtttcctaagtcgcaacaaaaagcccaggatatgtacgcgagaggaatttacacggaaagtcagatccaatgccgcaatcggcgccgtgttcgttgacgagaaccagtggaatagcgctaaggaggccgtggaagatgagaggttttgggaccttgtccaccgcgaacgtgagctgcataaacaggggaagtgcgcgacctgcgtgtacaacatgatgggaaagcgggagaaaaagctcggcgagttcggtaaagcaaaggggtctagagccatttggtatatgtggctgggagctaggttcttggagtttgaagccctgggcttcatgaatgaggatcactggttttcgcgcgaaaactcactcagcggcgtagagggggagggacttcacaaactgggttacatcttacgagacatttccaagatcagtggcgggaatatgtatgcagatgacactgctggatgggatacccggataacagaagacgatctgcagaacgaggccaaaatcacggacattatggaaccggagcatgctttgctcgccaagtctatcttcaagctgacctaccaaaataaagttgtgagagtccagaggcctgcaaagaacggcactgtgatggatgtgattagccgcagagaccagcggggttccgggcaggtcggaacatatggcctaaatacctttactaacatggaagcgcaacttatcaggcagatggagtcagagggcatattcagtccatctgaactggagacacccaacctcgccgaacgtaccctggattggttggagaaacacggggttgaacgattaaagcgcatggctattagcggagacgactgtgtggtaaaacctatcgatgacagatttgccacagcactgactgctctcaatgatatgggtaaggtgcggaaggacatcccacagtgggagccctccaaaggctggaacgattggcagcaagtcccgttctgctcacatcactttcaccagcttattatgaaggacgggagggagatagtggttccttgtcgcaatcaggatgaactggtgggcagagcacgggtcagccagggcgcaggttggtctctaagggagaccgcctgcctggggaaatcctacgcgcaaatgtggcagctcatgtatttccatcgacgtgacttgagactggctgccaacgcaatctgtagtgccgtgcccgtagattgggttccaacgagccgcaccacatggtcgattcacgctcatcaccagtggatgactaccgaagacatgctttccgtgtggaatcgggtctggatcgaggaaaacccttggatggaggataagacacatatttcttcatgggaggacgtgccctacctgggaaaaagggaagaccaatggtgcggcagcctcatcggcttaactgccagagcaacctgggctacgaatatacaggttgccatcaaccaggtgcgccggctgattgggaatgagaactacttggattatatgacaagtatgaagaggtttaagaatgaatccgacctggagggagcgctctggtga

SEQ ID NO: 13302 - RNA, 9879 nt, synthetic construct
  misc_feature 1..9879: note = derived and/or modified CDS sequence (opt3) from DENV-1__FJ639692__SS-prME
  source 1..9879: mol_type = other RNA
agcgtgaccatgctgctcatgcttatgcccacagccctggctttccacttgactacgagaggcggggagcctcatatgatcgtctccaagcaggaaaggggaaaatctttactgtttaagacctcagcaggtgttaacatgtgcacactaattgccatggacctcggcgagctgtgtgaagatactatgacctacaaatgcccacggataacagaggcggaaccggacgatgtggactgttggtgcaatgctaccgatacttgggtaacatatgggacctgtagtcaaacgggagagcaccgccgagacaagcgtagcgtggcccttgcaccccatgtcggcctgggtttggagactagaaccgaaacatggatgtcctctgagtcggcctggaaacagatccagagggtggaaacttgggctctccggcaccctgggttcaccgttattgcactgtttctggcccatgctatcggaacatcaattacccagaagggcatcatattcatcctcttaatgctggtgacgccaagcatggccatgcgctgcgtcggcattgggagtagagattttgtggagggactttccggtgcgacttgggtagacgttgtgttggagcacggctcttgtgtcacaaccatggcaaaggataaacccactctggacatcgaactactcaagacagaggtgaccaaccctgccattctgaggaaactttgcatcgaagctaagataagcaatacgaccacagattcccggtgtccaactcaaggggaggccaccctggtggaagagcaggacgcaaacttcgtctgccgccgaacatttgttgatagaggatggggcaatggttgtgggttgttcggaaaaggctcactcattacttgcgctaagtttaagtgcgtgaccaaactggagggcaagatcgtacagtacgaaaacttaaaatatagtgtgattgtcacagtgcacaccggggaccagcatcaagttggaaatgagagcactgaacacggtacgacagccaccatcactccccaggcgcctaccacagagatccagctgaccgactacggcgccctcactcttgattgttctccaaggacagggctggacttcaacgaaatggtgttgctaacgatgaaggagaaatcctggctggtccataagcagtggtttctcgatctgccgcttccctggacctcaggagcaagcactagtcaagagacatggaatcggcaggacctgttggtgaccttcaaaacagctcacgccaagaagcaggaagtagttgtgctcggctctcaagagggtgctatgcacactgccctgaccggggcaacggaaattcagacctccggcacaactaccatatttgccggacatttaaaatgccgtctgaagatggataaactaacactcaagggcatgagctatgtcatgtgtactgggtcgttcaaactggagaaggaagtggctgagacccagcacggaacggtccttgtgcagatcaagtacgagggtacagacgcgccttgcaaaattccattctctacccaagatgaaaagggcgttactcagaacgggcgcttgatcacagcaaatcccatagtgaccgacaaagagaagcctgtaaacattgaagccgagccaccctttggagagtcctatatcgtcatcggcgctggtgaaaaagccctgaagctctcatggttcaagaaagggagtagcattggcaagatgtttgaggcaactgccagaggagctaggcggatggccatcctgggcgataccgcatgggacttcgggtccattggaggtgtgtttacatctgttggcaaacttgtgcatcagatattcgggacggcgtacggagtcctgtttagcggcgtgtcatggaccatgaagatcggtattggggtattgctcacttggctgggcttaaatagtcgatccacaagcctgtctatgacctgtatcgctgtgggactagttacactctacctgggcgtcatggtgcaggccgattcagggtgcgtgatcaactggaaaggacgcgaacttaagtgtggcagtggtattttcgtcactaatgaggttcacacctggacggaacaatataagtttcaggcagacagcccgaaaagattgtccgccgctatagggaaggcctgggaggagggagtgtgcggcatcaggtctgcaacacggctggaaaacattatgtggaaacagatctcgaacgagctcaatcatattctgttagaaaacgacatgaagttcaccgtggtagtcggtgatgtggctggcatcctggcccaggggaaaaagatgatacgccctcaacccatggagtacaaatatagctggaagtcctggggaaaggcgaaaatcattggcgccgacgttcagaatactacctttatcattgatgggccaaacacacctgaatgtcccgacgatcagagagcttggaatatctgggaggtggaggactacggattcggcatatttactaccaacatttggcttaagttgagggattcatatacacaggtctgcgaccaccgtctcatgagtgcagccatcaaagattctaaggctgtgcacgccgacatgggttactggattgaaagcgagaaaaatgaaacgtggaagctggcacgggcgtccttcatcgaggttaagacctgtatatggccaaaatcacatactctatggagcaacggggtgctggaatctgagatgatcattcccaagatctatggaggccctatttcccaacacaattaccgaccaggttacttcacacagaccgccggcccgtggcatctcgggaaactggagcttgattttgacttgtgcgaaggaactacagtagtcgtggatgagcactgcggcaacagagggcccagtctgaggaccacgactgtgaccggaaagatcatacacgaatggtgttgccgcagctgtacattacctccactccggttcagaggcgaggacggttgctggtatgggatggagattaggcccgtcaaagaaaaggaggaaaatctggttaagtctatggtgtccgctggatcaggcgaggtagacagttttagccttggtctgttgtgtatctcgatcatgattgaagaggtgatgcgctcccgatggtctcggaaaatgctcatgaccggcactctggccgtcttcctactgctcatcatggggcagctgacatggaacgatcttattcgtttgtgcataatggtgggagcaaatgctagcgacagaatgggcatggggaccacatacctggccttaatggcaacttttaagatgaggcctatgttcgccgttggactcctgtttcgccggcttacctcaagagaggtgctgctactcacgatcggcctgagtttggtcgcttccgtggaactgccaaactctttagaggaactcggtgatgggctggcgatgggaattatgatccttaaactgttgacagacttccaaagccatcagctctgggccaccctgctatccctgacttttattaagaccacattctcacttcactatgcatggaaaactatggctatggttctcagcatcgtgagtctgtttcccttgtgtctgtctaccacgtcccagaagacaacctggttaccggtcctcctgggcagccttggctgcaagcctctgactatgttcttgatagccgagaataaaatctgggggaggcgatcgtggccactcaacgaaggaattatggccgtaggtatcgtgtcaattctgctatctagtctgcttaagaacgatgttcccctcgctggccctctgatcgcagggggaatgttgatagcctgttacgtgatttccggcagctctgcggacttaagcctggagaaagctgccgaggtctcctgggaagaggaagcagagcattcaggtgccagtcacaatatcctcgtggaagtacaggatgacgggacaatgaagatcaaagatgaggagcgcgacgataccctgactattcttctgaaggctacattgctagcagtgagcggagtctatcccctgtctataccagccaccctctttgtttggtacttctggcaaaaaaagaagcagcggtccggcgtgctgtgggacacgccttcacccccagaagtggagagagcggtccttgatgacggcatctataggattatgcagcgtgggttactgggacgcagtcaggtgggtgttggcgtattccaagaaaacgtgtttcatactatgtggcacgtcacccggggggctgtgctcatgtaccagggaaaaagattggagccgagctgggcctccgttaagaaagacctgatctcttacggcggtgggtggaggctccagggatcgtggaatacaggcgaggaagtgcaggtcattgcagtggagcctggcaagaaccccaaaaatgtacaaaccgccccagggacattcaagactcccgaaggagaggtcggtgctatcgccctggattttaagcctggcaccagcgggtcaccaatagtgaaccgagaaggaaaaatcgttggcctttatggtaatggggtggtcacgacatccggaacttacgtgagtgcaattgctcaggccaaggcgtctcaggagggccccctgcctgagatcgaagacgaggttttccggaaacgcaacttgaccattatggatctacacccgggcagcgggaagacaagaaggtatctgccagccatcgtgcgggaagcaataaaacgaaagctcagaaccttaattctggctcccactcgcgtcgtggcctccgagatggctgaagcacttaagggaatgcctatcaggtaccaaaccacagccgtaaaatcagagcatacgggtaaggagatcgtggacctgatgtgccacgccacttttaccatgcgtctcttgtctccagttcgggtccccaattataacatgattatcatggatgaagctcatttcacagaccctagcagtatagcggcaagaggctacatttccaccagggtggggatgggagaggccgctgccatctttatgactgcaacaccgcccggcagcgtggaagccttcccacagtctaatgctctgattcaggatgaggaacgcgacatccctgagcgatcatggaactccggttatgagtggataaccgattttcccgggaaaacggtctggttcgtaccaagtattaagagcggaaatgacatcgcgaactgtctcagaaaaaatggcaagcgggtgatccagctgtcgaggaagacttttgatacagaataccaaaaaaccaagaacaacgactgggactacgttgtgaccactgatatttctgagatgggcgccaatttccgcgcagaccgtgtcatcgatcctagacggtgccttaaacccgtgattctaaaggacgggccagaaagggttatactggctggaccgatgcctgtgacagtcgcctccgcagcccagcgccgaggtagaatcggccggaaccacaataaagagggggatcagtatatttacatgggacagcccttgaacaatgacgaggatcatgctcactggaccgaagccaagatgttactggacaacatcaatacaccagagggcatcattcccgcgctcttcgaacctgagagggaaaagagcgcagccatagatggtgagtatcgcctgagaggggaggctaggaaaacttttgtggaacttatgcggcgtggcgacctgccagtatggctctcatacaaggtggccagtgagggattccaatattctgatcgccgatggtgctttgacggcgaaagaaacaatcaggttttggaggaaaacatggatgtcgagatctggacgaaagagggggaaaggaagaaactgcggccccgctggctagacgctagaacctactccgaccctctggcactcagggagttcaaggaatttgccgctggacggcgaagcgtgtcaggtgatcttattctggagatcggcaaattaccgcagcacttgacacagagagcccaaaatgcactggacaacctcgtgatgctgcataatagtgaacaggggggacgcgcgtataggcacgccatggaggagcttccagatactattgaaaccctgatgctcttggctctgatcgccgtcttaacaggcggtgttaccctattctttctgagcgggcggggcctcggaaagacttccataggccttctgtgtgtgatggcatctagcgtattgctgtggatggcttccgtggagccccattggatcgccgcatcaattatcctcgaattctttctgatggtccttctcattcctgagcccgaccgtcagagaacgccacaggataaccaactggcctacgtggttatcgggttgctgttcatgatattaaccgtggctgcgaatgagatgggactactggaaacaactaagaaagacctcggtattggccacgtcgccgtagggaaccaccatcacgcagctatgcttgatgtggacctgcatcctgcctctgcctggaccttgtacgcagttgctacaaccatcattactcccatgatgaggcacacaatcgagaacacgaccgccaatataagtctgactgcgatcgctaaccaggccgcaattctcatgggactggataagggctggccaatctcgaaaatggacattggtgtgcctcttttagccctggggtgctatagccaggtcaatccgctcacattgaccgctgcagtgctgatgctagtcgcccattacgcgatcataggccccggactgcaagctaaggccacccgcgaagcacagaaacggacagccgctggcattatgaagaacccaactgtggatgggatcgttgccatcgacctcgatcctgtggtatatgacgcaaagtttgagaaacagcttggacagattatgctgttgatcctgtgtacgtcccaaatactcctgatgcgaaccacatgggctttatgcgaatctattactcttgccaccggccccctgacaaccctctgggagggttcaccagggaagttctggaatactacgatcgcggtgagcatggccaacatttttagaggatcctacctagcaggcgctggtctggccttcagtttgatgaaatctctgggcgggggaaggcgcggcacaggggcacagggagagaccctcggcgaaaagtggaaacggcagcttaatcagctgagcaagtcagagttcaacacttataagagatccggtatcaccgaagtcgaccgtagtgaggctaaagaagggttgaagaggggagagacaactaaacacgccgttagccggggcaccgccaagctgcgctggtttgtggagcgaaatctcgtcaaacctgaaggtaaggtgatagatttaggctgtgggagaggaggctggtcttactattgcgcggggctgaagaaagtaacagaggtgaagggatacacgaaaggcggtcccgggcacgaagagccgatcccaatggctacctacggatggaaccttgttaagctgcattccggcaaagacgtgttctttattcctcccgaaaagtgtgatactctactctgcgacatcggcgagtcaagcccaaatcccacaattgaggaagggaggaccctgcgggtcttgaaaatggtggagccttggctgcgcggaaaccaattctgtatcaagattctcaatccgtatatgccctcggtcgtggaaactcttgagcagatgcagagaaagcacggtggcatgctggttaggaacccattatctcgaaatagtacacatgagatgtactgggtatcctgcgggaccggaaacatcgtgagcgcagtcaatatgacgtcacggatgctgttgaaccgttttaccatggcccacagaaaacctacatatgaacgcgatgtggacctcggcgctggtactaggcacgttgccgtggagcccgaagtcgcaaacctggatataattgggcagcggatcgagaatatcaagcatgaacacaaatccacctggcattacgacgaggataacccttataagacatgggcctaccacggatcttatgaggtgaaaccaagcggcagtgcttccagcatggtaaatggcgtggttaagctacttactaagccctgggacgtcattcctatggtgacccaaatagcgatgacagataccactccattcgggcagcagagagtgtttaaagaaaaggtcgacacgcgcacacccaaagccaagaggggaaccgcacaaatcatggaggttactgctaaatggctgtggggtttcctctctcgaaacaagaagccgcggatttgtaccagagaagagtttacaaggaaagtgcgctcaaatgccgcaatcggcgccgtattcgtggacgaaaaccagtggaatagtgctaaggaggccgtcgaggatgaacgtttttgggacctggtgcatcgggagagagaattgcacaaacaggggaagtgcgcgacgtgcgtttacaacatgatgggaaaaagggagaagaagctgggcgaattcggtaaagcaaaggggtcccgcgccatttggtacatgtggctcggagctcgatttcttgagttcgaggccctgggcttcatgaatgaagatcactggtttagccgggagaactctttatcgggcgtggaaggggagggactgcataaattgggttatatcctcagagacatatcaaagatccctggcgggaatatgtacgcagatgacaccgctggatgggatactaggattacagaggacgatctgcagaacgaagcccgcatcaccgacattatggagccagaacacgctctacttgccaaaagcatcttcaagctgacttatcaaaataaagtcgtgagagtacagcggcccgcaaagaacggcacagttatggatgtgatatccaggcgtgaccagcgaggtagtgggcaggtcggaacctacggcctcaatacatttactaacatggaggcgcaactgattcgccagatggaatctgagggcatcttcagcccttccgagttggaaaccccaaacttagccgagagagtgctggattggctcgaaaagtatggggtggagcggcttaaaaggatggctatctcaggagacgactgtgtcgttaagcccattgatgaccgctttgccacggcactgaccgctctaaatgatatgggtaaagtgagaaaggacataccgcagtgggaacctagtaaaggctggaacgattggcagcaagtacccttctgctctcatcactttcaccagctgatcatgaaggacgggcgggagattgtggtcccatgtaggaatcaggatgagctcgtgggacgagcccgtgttagccagggcgcaggttggtccttgagagaaacagcctgcctggggaagtcatacgcgcaaatgtggcagcttatgtatttccatcgccgggacctgaggctcgctgccaacgcaatctgtagcgccgtgcctgtcgattggattcccacttctagaaccacatggtccatccacgctcatcaccagtggatgactaccgaggacatgttaagtgtgtggaatcgcgtatggatagaagagaacccatggatggaagataaaacgcatatcagctcgtggggagacgttccctacctgggcaagcgggaggaccaatggtgcggctccttgattgggctgacagccagggcaacctgggctactaatatccaggtggccattaaccaggtccgaagactcatcggaaatgagaactaccttgattatatgacatctatgaaacggtttaagaatgaatcagaccctgagggtgcgctgtggtga

SEQ ID NO: 13303 - RNA, 9879 nt, synthetic construct
  misc_feature 1..9879: note = derived and/or modified CDS sequence (opt3) from DENV-1__FJ639693__SS-prME
  source 1..9879: mol_type = other RNA
agcgtgaccatgctgctcatgcttatgcccaccgccctggctttccacttgactacgagaggaggggaacctcatatgatcgtctccaagcaggaaaggggaaaatctttactgtttaagacctcagccggtgttaacatgtgcacactgattgccatggacctcggagagttctgtgaagatactatgacctacaaatgcccacggataagtgaagcggaaccggacgatgtggactgttggtgcaatgctacagatacctgggtaacttatgggacatgtagccaaaccggagaacaccgccgagacaagcgttccgtggccctggcaccccatgtcggccttggtctggagacgagaactgaaacctggatgtcttcggagggggcctggaaacagatccagagggtggaaacatgggctttgcggcaccctggatttactgttattgcactcttcctggcccatgctatcggcacctcaattacacagaagggcatcatatttatcctgctcatgttagtgaccccaagcatggccatgcgctgcgtcgggattggaagtagagatttcgtggagggtctgtccggcgcgacgtgggtagacgttgtgcttgagcacgggtcttgtgtcactacaatggcaaaggataaacccaccttggacatcgaactgctaaagactgaggtgacaaaccctgccgtgctcaggaaactgtgcattgaagctaagatcagcaataccacgaccgattcccggtgtccaacacaaggagaggccactcttgtcgaagaacaagacgcaaactttgtttgccgccgaaccttcgtggatagaggctggggtaatgggtgtggactgtttggcaaaggctcattgataacatgcgctaagttcaagtgcgtaactaaactcgaggggaagattgtgcagtacgaaaacctgaaatatagtgtcatcgtgaccgttcacacaggagaccagcatcaagtgggtaatgagagcaccgaacacggcactacggccacaattacaccccaggcgccttctactgagatccagttaaccgactacggggccctgacactcgattgttccccaaggaccggacttgactttaacgaaatggtcctgttgactatgaaggagaaatcatggctagtgcataagcagtggttcctggatctcccgctgccctggacaagcggcgcaagtacgtctcaagagacctggaatcggcaggaccttctggtaacttttaaaacagctcacgccaagaagcaggaagttgtggtcttgggttcccaagagggggctatgcacaccgccctcacaggcgcaactgaaatccagaccagcggaacgaccacaattttcgccggccatctgaaatgccgtttaaagatggataaactgactctaaaggggatgtcgtatgtgatgtgtaccggatctttcaaactcgagaaggaagtcgctgagacacagcacggtactgtgctggttcagataaagtacgagggcaccgacgcgccttgcaaaatcccattttccacgcaagatgaaaagggggtgacacagaacggacgccttattaccgcaaatcccatcgtaactgacaaagagaagcctgtcaacatagaagccgagccacccttcggcgagtcatatattgtgatcggtgctggggaaaaagccttgaagctgagttggtttaagaaaggcagctccatcggaaagatgttcgaggcaacagccagaggcgctaggcggatggccattctcggggataccgcatgggactttggatctatcggtggcgttttcactagcgtggggaaactggtccatcagatttttggaaccgcgtacggcgtgcttttctcaggtgtaagttggacaatgaagatagggatcggcgtgctgttgacgtggctcggactaaattcccgaagcacctctttatcaatgacttgtattgctgttggcctggtcacactatacctcggggtgatggtgcaggccgatagtggatgcgtcatcaactggaaaggccgcgaactgaagtgtggtagcgggatctttgttaccaatgaggtgcacacatggactgaacaatataagttccaggcagactccccgaaaagactttctgccgctattggaaaggcctgggaggagggcgtgtgcggtataaggtcggcaacccggttggaaaacatcatgtggaaacagattagcaacgagctgaatcatatcctcctggaaaacgacatgaagtttacggtagtcgtgggcgatgttgctgggattttagcccagggcaagaagatgatccgccctcaacccatggagtacaaatattcctggaagtcatggggcaaggcgaaaataatcggggccgacgtgcagaatacaaccttcattatcgatggaccaaacactcctgaatgtcccgacgatcagagagcttggaatatttgggaggtcgaggactacggctttggtatcttcaccacaaacatatggctgaaacttagggatagttatactcaggtgtgcgaccaccgtttgatgtctgcagccattaaagatagcaaggctgttcacgccgacatggggtactggatcgaatccgagaaaaatgaaacctggaagctcgcacgggcgtcattcattgaggtgaagacatgtatctggccaaaaagccatacgctgtggtctaacggagtactagaatccgagatgataatccccaagatttatggcggtcctatcagtcaacacaattaccgaccaggctactttacccagactgccgggccgtggcatctgggaaaactcgagctggatttcgacctttgcgaaggcacaaccgtcgtggtggatgagcactgcgggaacagaggacccagcttgaggactacaaccgtcacgggcaagattatccacgaatggtgttgccgctcttgtactctgcctccattacggtttaaaggtgaggacgggtgctggtatggaatggagataagacccgttaaggaaaaggaggaaaatctcgtgaaatccatggtatcagctggcagtggtgaggtggacagcttctcgctgggccttctgtgtatttccatcatgatcgaagaggtcatgaggtctcgctggagccgaaagatgttgatgaccgggacactcgccgtgtttttcctgctaattatgggacagctgacctggaacgatctcatccggctgtgcattatggttggcgcaaatgcttcagaccgtatggggatgggaatgacttaccttgccttgatggcaacatttaaaatgagacctatgttcgccgtgggcctgttatttaggcgcctcaccagtcgggaggtcctgcttctgacaataggtctatccctcgtggcttctgttgaactgccaaacagcttggaggaactgggggatggattagcgatgggcatcatgattctcaagctgcttactgacttccaatcccatcagctgtgggccaccttgctctcactgacgtttatcaaaacaaccttcagcctacactatgcatggaagactatggctatggtgctgagtattgtctctctttttcccctctgtctgtccaccacaagccagaagactacctggttgccggtactgttaggctcgctcgggtgcaaacctctgacgatgttccttatcgccgagaataagatatggggaagaaaatcatggccactgaacgaaggtatcatggccgtgggcattgtttctatcttgctcagttccctgctaaagaacgatgtgcccctggctgggcctcttattgcaggaggcatgctcatcgcctgttacgtcataagcggttctagcgcggacctgtccttggagaaagctgccgaggtgtcatgggaagaggaagcagagcatagtggggccagccacaatattttagtagaagtgcaggatgacggaacaatgaagatcaaagatgaggagagggacgataccctgactatcctcctgaaggctacacttctggcagtctctggcgtttatcccttgtccattccagccaccctattcgtgtggtacttttggcaaaagaaaaagcagcgatcaggcgtgctgtgggacactcctagtcccccagaagtcgagcgcgcggtgctcgatgacgggatatatcggatcatgcagagaggactgcttggtaggagccaggttggcgtaggggtgttccaagaaaacgtctttcatacaatgtggcacgtgacccgtggagctgttttaatgtaccagggcaaacgcctggagccgtcctgggcctctgtgaagaaagacctcatttcgtacggtgggggatggcggttgcagggcagctggaatacgggcgaggaagtccaggtgatcgcagtagagcctgggaagaaccccaagaatgtccaaactgccccaggaaccttcaaaacatcagaaggtgaggtgggcgctattgccctggattttaagcccgggacctccggaagtcctatcgttaacagagaaggcaaaatagtgggtctctatgggaatggagtcgtgacaacttctggcacctacgttagcgcaatcgctcaggccaaggcgtcccaggagggcccactgcccgagattgaagacgaggtgttcaggaaacgaaaccttacgatcatggatctgcaccctgggtcaggaaagacacggcgctatttgccggccattgtcagagaagcaatcaagaggaaactacggactctgatactcgctccaacccgagtggtagcctctgagatggctgaagcattaaagggtatgcccattagataccaaacaaccgccgtgaaaagcgagcatactggcaaggagatcgttgacctgatgtgccacgccacctttacaatgcgccttctgagtcctgtcagggtgccaaattataacatgatcattatggatgaagctcatttcacggacccctccagcatcgcggcacgtgggtacatatctactcgggtgggaatgggcgaggccgctgccatttttatgaccgcaacacctccgggttcagccgaggctttcccccagtccaatgcggtcatccaggatgaggaaagagacattccagagaggagttggaacagcgggtatgagtggatcaccgattttcctggaaaaactgtatggttcgtgccctcgataaagtctggcaatgacattgccaactgtctccgcaagaatggcaaacgagttatccagttgtccagaaagacattcgataccgaataccagaaaacgaagaacaacgactgggactacgtggtcactacagatatcagcgagatgggggcaaattttcgggctgacagggtgattgatccacgccgttgcctgaaacctgttatcctcaaggacggacccgaaagagtgattctggccggtccaatgccggtcaccgtggcatcagccgctcagcggaggggccgcatagggcgaaaccacaataaggagggagatcagtatatctacatgggccagcctcttaacaatgacgaggatcatgcccactggaccgaagcgaaaatgctactggacaacattaatactcccgagggtatcatcccagcattgttcgaacccgagagagaaaagagtgccgctattgatggggagtatcggttaaggggcgaggcccgcaaaacatttgtagaactgatgagaaggggagacctccctgtgtggctgtcttacaaggttgcttccgagggcttccaatatagcgatcggcgttggtgctttgacggggaacgcaacaatcaggtccttgaggaaaacatggatgtggagatatggaccaaagagggagaacgaaagaaactgagaccaaggtggctcgacgcacggacatactcagaccccttggccctgcgcgagttcaaggaatttgctgccggtagaaggagtgtgagcggcgatctaatcctggagattgggaagctccctcagcaccttactcagcgggcacaaaatgcgctggacaacttagtcatgttgcataattccgaacagggaggccgagcctatagacacgctatggaggagctgccggatacgatcgaaaccctcatgctgcttgccctgattgcagttctcacaggtggggtgactttgttctttctgtctggccgcggattaggcaaaaccagcatcgggctactgtgtgtaatggcttcctcagtgctcctttggatggcctctgtcgagccacattggatagcagccagtatcattctggagttctttttgatggtgctgctcatccccgagcctgacaggcagcggacaccccaggataaccaactggcttacgttgtgattggacttctcttcatgatcctgaccgtcgcggccaatgagatgggtttgctggaaactacgaagaaagacttaggcatagggcacgtagcagtggagaaccaccatcacgctgccatgctagatgttgacctgcatccagcctcggcatggaccctctacgctgtggccacaactattatcacccctatgatgcgtcacacaattgaaaacaccactgcgaatatcagccttacagctatagccaaccaggcagccatcctgatgggattggataagggctggcccatttccaaaatggacatcggtgtcccactgctcgctctggggtgctattctcaggtgaatcctcttacgttaaccgcagccgtcctgatgctcgtggcgcattacgctattatcggcccgggattgcaagccaaggcaactagagaggcccagaagaggacagctgccggcataatgaaaaaccccaccgttgatgggattgtggcaatcgacctggatccagtagtgtatgacgctaagtttgaaaaacagctaggacagatcatgctgctcattctttgtacctcacaaatcctgttgatgcgcacaacttgggccctgtgcgagagcataacgctcgcggtcggcttccagaccacactgtgggagggttcccctgggaagttctggaatactaccattgccgttagtatggcaaacatctttcggggatcttacttagctggcgccggtcttgcattcagcctgatgaaatcactcggcgggggacgaagaggcacaggggctcagggagaaaccctaggcgagaagtggaagaggcagctgaatcaattgtccaaaagtgaatttaacacttataagcgcagcggtattatggaggtggaccggtctgaagccaaagaggggctgaagagaggagagacgacaaaacacgccgtctcccgtggcaccgcgaagctcaggtggttcgtggaacggaatcttgtaaagcccgagggtaaagtgatcgatctgggctgtgggcgcggaggctggtcatactattgcgctgggttgaagaaagttactgaagtgaagggatacaccaaaggcggtccagggcacgaggaacctatacccatggcaacatacggatggaacctggtcaagctccatagcggcaaagacgtgtttttcgtcccgccagagaagtgtgatactttactgtgcgacatcggcgagtcgtctcctaatcccaccattgaagaggggcgaacacttagagtgctgaagatggttgaaccatggctaaggggaaaccagttttgtatcaaaattctcaatccctatatgcctagtgtagtggagacgctggagcagatgcagcggaagcacggtggcatgttggtccgcaacccgctgtccagaaatagcacccatgaaatgtactgggtgtcatgcgggactggaaacatcgtttccgccgtgaatatgacatctaggatgctccttaaccgattcaccatggctcaccggaaacccacttatgagcgtgatgtcgacctgggcgccggtacaagacacgtggcagtagaaccagaggtggccaacttagatattatcgggcaacgcatagaaaatattaagcatgagcacaaaagcacctggcattacgacgaggataacccttataagacgtgggcttaccacggaagttatgaagttaagccctccggcagcgcgtcttcaatggtcaatggcgtggtgaaactgttgaccaagccttgggacgtcatcccaatggttacacagatcgccatgactgataccacaccctttgggcagcaaagggtgttcaaagagaaggtagacactcggacccctaaagcaaagagaggaacagctcagattatggaagtgaccgccaagtggctctggggttttctgagtcgcaacaaaaagccaaggatatgtactcgagaggagttcacgcggaaagtcagatccaatgcagccatcggcgctgtgtttgttgacgagaaccagtggaatagcgccaaggaggcggtggaagatgagaggttctgggacctagtccatcgcgaacgtgagcttcacaaacaggggaagtgcgcaacatgcgtgtacaacatgatgggaaagcgggagaaaaagctgggcgagttcggtaaagccaaggggtctagagctatttggtacatgtggctcggagccaggtttctggagttcgaagcattgggctttatgaatgaggatcactggttctcgcgcgaaaactcactgagcggcgtagagggggagggactccataaacttggttatatcctgcgagacatttccaagatcagtggcgggaatatgtacgctgatgacaccgccggatgggatactcggataaccgaagacgatttacaaaacgaggctaaaatcacagacattatggaacccgagcacgccctgttggcaaagtctatctttaagctcacgtatcagaataaagttgtgagagtccagaggccggcgaagaacggcaccgtgatggatgtgattagccgcagagaccagcggggttccgggcaagtcggaacttacggcctgaatacattcaccaacatggaagcccagctaatcaggcagatggagtcagagggcatatttagtccttctgaacttgagactccaaacctggctgaacgtgccctcgattggctggagaaacatggggttgaacgattgaagcgcatggcaattagcggagacgactgtgtggtaaaacccatcgatgacagattcgctacagccttaaccgcactgaatgatatgggtaaggtgcggaaggacatccctcagtgggagccatccaaaggctggaacgattggcaacaggtccccttttgctcacaccacttccatcagctcattatgaaggacgggagggagatagtggttccgtgtcgcaatcaggatgaacttgtgggcagagcacgggtcagccaaggcgcgggttggtctctgagggagacagcttgcctagggaaatcctatgcccagatgtggcagctgatgtactttcaccgacgtgacctcagattggcagccaacgctatctgtagtgccggacctgtggattgggtacccactagccgcaccacgtggtcgattcatgcacaccatcaatggatgaccacagaagacatgctgtccgtttggaatcgggtgtggatcgaggaaaacccatggatggaggataagactcacatttcttcatgggaggacgtcccttatcttggcaaaagggaagaccagtggtgcggcagcctgatcgggctcaccgctagagccacatgggcgactaatatacaggtggctatcaaccaggttcgccggttaattggaaatgagaactacctggattacatgaccagtatgaagaggttcaagaatgaatccgaccccgagggtgccttgtggtga

SEQ ID NO: 13304 - RNA, 9879 nt, synthetic construct
  misc_feature 1..9879: note = derived and/or modified CDS sequence (opt3) from DENV-1__FJ639694__SS-prME
  source 1..9879: mol_type = other RNA
tccgtgaccatgctgctcatgcttatgcccacagcactggctttccacttgactacgcggggaggggagcctcatatgatcgtctccaagcaggaaaggggaaaatctttactgtttaagacctcagccggtgttaacatgtgcacactgattgcaatggacctcggcgagctgtgtgaagatactatgacctacaaatgcccacggataacagaggcggaaccggacgatgtggactgttggtgcaatgctaccgatacttgggtaacatatgggacctgtagtcaaacgggagagcaccgccgagacaagcgtagcgtggcacttgcaccccatgtcggcctgggtttggagactagaaccgaaacatggatgtcctctgagggggcctggaaacagatccagagggtggaaacttgggctctccggcaccctggattcaccgttattgcactgtttctggcccatgctatcggcacatcgattacccagaagggcatcatattcatcctcttaatgctggtgacgccatcaatggccatgcgctgcgtcgggattggaagcagagattttgtggagggtcttagtggcgcgacttgggtagacgttgtgttggagcacgggtcctgtgtcacaaccatggcaaaggataaacccactctggacatcgaactactcaagacagaggtgaccaaccctgccattctgaggaaactttgcatcgaagctaagatatctaatacgaccacagatagccggtgtccaactcaaggagaggccaccctggtggaagaacaggacgcaaacttcgtctgccgccgaacatttgttgatagaggctggggtaatgggtgtggattgttcggcaaaggctccctcattacttgcgctaagtttaagtgcgtgaccaaactggaggggaagatcgtacagtacgaaaacttaaaatattcagtgattgtcacagtgcacaccggagaccagcatcaagttggtaatgagagtactgaacacggcacgacagccaccatcactccccaggcgcctaccacagagatccagctgaccgactacggggccctcactcttgattgtagcccaaggacaggactggacttcaacgaaatggtgttgctaacgatgaaggagaaatcttggctggtccataagcagtggtttctcgatctgccgcttccctggacctccggcgcatcaactagccaagagacatggaatcggcaggacctgttggtgaccttcaaaacagctcacgccaagaagcaggaagtagttgtgctcggtagtcaagagggggctatgcacactgccctgaccggcgcaacggaaattcagacctctggaacaactaccatatttgccggccatttaaaatgccgtctgaagatggataaactaacactcaaggggatgtcctatgtcatgtgtactggatcgttcaaactggagaaggaagtggctgagacccagcacggtacggtccttgtgcagatcaagtacgagggcacagacgcgccttgcaaaattccattctcgacccaagatgaaaagggggttactcagaacggacgcttgatcacagcaaatcccatagtgaccgacaaagagaagcctgtaaacattgaagccgagccaccctttggcgagtcttatatcgtcatcggtgctggggaaaaagccctgaagctctcctggttcaagaaaggctcaagtattggaaagatgtttgaggcaactgccagaggcgctaggcggatggccatcctgggggataccgcatgggacttcggaagcattggtggcgtgtttacatccgttgggaaacttgtgcatcagatattcggaacggcgtacggcgtcctgttttctggtgtgagctggaccatgaagatcgggattggcgtattgctcacttggctgggattaaattcacgaagtacatccttcagcatgacctgtatcgctgtgggcctggttacactatacctcggggtcatggtgcaggccgattctggatgcgtgatcaactggaaaggccgcgaactgaagtgtggttcagggatttttgtcactaatgaggttcacacctggacggaacaatataagttccaggcagacagtccgaaaagacttagcgccgctataggaaaggcctgggaggagggcgtgtgcggtatcaggtccgcaacacggttggaaaacattatgtggaaacagatctctaacgagctgaatcatattctcctggaaaacgacatgaagtttaccgtggtagtcggcgatgtggctgggatcttagcccagggcaagaagatgatacgccctcaacccatggagtacaaatattcgtggagaagctggggcaaggcgaagatcattggggccgacgttcagaatactaccttcatcattgatggaccaaacacacctgaatgtcccgacgatcagagggcttggaatatctgggaggtggaggactacggctttggtatattcactaccaacatttggctgaaacttcgtgattcctatacacaggtctgcgaccaccggttgatgtcagcagccatcaaggatagtaaagctgtgcacgccgacatggggtactggattgaatctgagaagaatgaaacgtggaaactcgcacgagcgagcttcatcgaggttaagacctgtatatggccaaagtcccatactctgtggtcaaacggagtgctagaaagcgagatgatcattcccaaaatctatggcggtcctatttctcaacacaattacagaccaggctactttacacagaccgccgggccgtggcatctgggaaagctcgagctggatttcgacctttgcgaaggcactacagtagtcgtggatgagcactgcgggaacaggggaccctccttgcgcaccacgactgtgaccggcaaaatcatacacgaatggtgttgccggagttgtacactgcctccattaagatttaggggtgaggacgggtgctggtatggaatggagattcgccccgtcaaggaaaaagaggaaaatctcgttaagagcatggtgtctgctggctccggtgaggtagactcattcagtctgggccttctgtgtatcagcatcatgattgaagaggtgatgcgatcgcggtggtcccgtaagatgttgatgaccgggactctcgccgtctttctgctactgatcatgggacagctcacatggaacgatctgattagactttgcataatggtgggcgcaaatgcttctgacaggatggggatgggaaccacatacttggccctgatggcaactttcaaaatgcgccctatgtttgccgttggcttactcttccggagactgaccagcagggaggtgcttctgctaacgatcggtctctcactggtcgctagtgtggaattgccaaactccctggaggaattaggggatggactcgcgatgggcattatgatcctgaaacttctgacagactttcaatctcatcagttgtgggccaccctcctgagcctaactttcattaaaaccacattttccctgcactatgcatggaagactatggctatggttctttcaatcgtgagcctcttccccctgtgtttgagtaccacgtctcagaaaacaacctggctgccggtcttactcggctccctggggtgcaagcctcttactatgtttctgatagccgagaataagatctggggacgacgcagctggccattgaacgaaggtattatggccgtaggcatcgtgtcgattctcctgtcatctctactgaaaaacgatgttccccttgctgggcctctcatcgcaggaggcatgctgatagcctgttacgtgattagtggttccagcgcggacttgtctttagagaaggctgccgaggtcagctgggaagaggaagcagagcattccggggcctcacacaatatcctggtggaagtacaggatgacggaacaatgaaaatcaaggatgaggagcgggacgataccctcactattctgcttaaagctacactgttggcagtgagtggcgtctatcccctaagcataccagccaccctgttcgtttggtacttctggcaaaagaaaaagcagagatctggcgtgctctgggacacgccttcacccccagaagtggagagggcggtcctggatgacgggatctatcgtattatgcagcgcggacttttaggtcggagccaggtgggcgttggggtatttcaagaaaacgtgttccatactatgtggcacgtcaccagaggagctgtgctgatgtaccagggcaagaggctcgagccgagttgggccagcgttaaaaaggacttgatctcctacggtgggggatggcgactgcagggctcttggaatacaggcgaggaagtgcaggtcattgcagtggagcctgggaaaaaccccaagaatgtacaaaccgccccaggaacatttaaaactcccgaaggtgaggtcggcgctatcgccctcgatttcaagcctgggacctcgggaagcccaatagtgaaccgggaaggcaagatcgttggtctgtatgggaatggagtggtcacgacatcaggcacttacgtgtccgcaattgctcaggccaaagcgagtcaggagggcccccttcctgagatcgaagacgaggtttttcgcaagagaaacctgaccattatggatttgcacccggggtctggaaaaacaaggcggtatctaccagccatcgtgcgagaagcaataaagagaaaactgcgcaccctcattttagctcccactagggtcgtggccagcgagatggctgaagcactgaagggtatgcctatccgttaccaaaccacagccgtaaagtccgagcatacgggcaaagagatcgtggaccttatgtgccacgccactttcaccatgcggctgctctcaccagttagagtccccaattataacatgattatcatggatgaagctcattttacagacccttctagcatagcggcaagggggtacattagtacccgcgtgggaatgggcgaggccgctgccatcttcatgactgcaacaccgcccggttccgtggaagcctttccacagagcaatgctgtcattcaggatgaggaacgagacatccctgagagatcttggaactcagggtatgagtggataaccgatttccccggaaagacggtatggtttgtgccatccattaaaagtggcaatgacatcgcgaactgtttgcggaagaatggcaaaagggttatccagctgagccgcaagactttcgatacagaataccaaaagaccaaaaacaacgactgggactacgtggtcaccactgatatttcggagatgggggccaatttccgtgcagacagagtgatcgatcctcggaggtgcctcaagcccgttattctgaaagacggaccagaacgcgtgatacttgctggtccgatgcctgtcacagtggcctctgcagcccagcgaagaggccggatcgggaggaaccacaataaggagggagatcagtatatttacatgggccagcccctaaacaatgacgaggatcatgctcactggaccgaagccaaaatgctgttggacaacatcaatacaccagagggtatcattcccgcgttatttgaacctgagcgcgaaaagtccgcagccatagatggggagtatagactgaggggcgaggctcggaagactttcgtagaactcatgcgtcgcggagacctgccagtgtggcttagctacaaagttgcctcagagggctttcaatatagtgatcgaagatggtgcttcgacggggaaaggaacaatcaggtcctggaggaaaacatggatgtggagatctggacgaaggagggagaacggaaaaagctccgccccagatggttggacgctaggacctactctgaccctctggcactacgggagtttaaagagttcgccgctggtcgaagatccgtgagcggcgatctgattctcgagatcgggaaacttccgcagcacctgacacagcgcgcccaaaatgcattagacaacttggtcatgctgcataattcagaacagggaggcagggcgtatcggcacgccatggaggagctcccagatactattgaaaccctgatgcttctggctctcatcgccgttttgacaggtggggtgaccctgtttttcttaagtggccgtggactaggcaaaactagcatagggctgctctgtgtaatggcatcctctgtgcttctgtggatggctagcgtcgagccccattggatcgccgcatccattatcttggaatttttcctgatggtgctcctgattcctgagcccgacagacagaggacgccacaggataaccaacttgcctacgttgtgatcggactcctgtttatgatattgaccgtcgctgcgaatgagatgggtctgttagaaacaactaagaaggacctaggcattgggcacgtagccgtgggaaaccaccatcacgcagctatgctggatgttgacctccatcctgcctcagcctggaccctttacgcagtggctacaaccatcattactcccatgatgcgccacacaatcgagaacacgaccgccaatatatctctgactgcgatcgctaaccaggccgcaattttgatgggcctggataaaggttggccaatcagtaagatggacattggggtccctctcctggcccttggctgctatagccaggtgaatccgttaacactgaccgctgcagtcctcatgttggtggcccattacgcgatcataggacccggcctgcaagctaaagccacccgggaagcacagaagcgaacagccgctgggattatgaaaaacccaactgttgatggaatcgtggccatcgacctagatcctgtagtgtatgacgcaaagttcgagaagcagctgggccagattatgctccttatcctgtgtacgagccaaatattgctgatgagaaccacatgggctctctgcgaatccattactctggccaccggtcccttaacaaccctttgggaggggtctccaggaaaattttggaatactacgatcgcggtctcaatggccaacattttcaggggcagctacctggccggtgctggcctcgccttctccctaatgaagagtctagggggaggccgccgggggacaggagcacagggcgagaccttgggtgaaaaatggaagagacagctgaatcagctctctaaaagcgagtttaacacttataagcgttcagggatcatggaagttgacaggtccgaggctaaggaaggacttaaacggggcgagataaccaagcacgccgtgagtcgcggtacagccaaactgcgatggttcgtcgagagaaatttggtgaagcctgaaggcaaagtaatcgatctggggtgtggaaggggcgggtggagctactattgcgcgggactcaagaaggtgactgaggttaaaggctacaccaagggtgggcccggacacgaggaaccgattccaatggctacatacggctggaacttagtgaaactgcattctggcaaggacgtctttttcgtgcctcccgaaaaatgtgatacgcttctgtgcgacatcggggagtcctcaccaaatcccaccattgaggaaggacggactctacgcgtcctcaagatggtggagccttggctgagaggtaaccaattttgtatcaaaattttgaatccgtatatgcccagcgttgtagaaacactggagcagatgcagaggaagcacggcgggatgctcgtgcgaaacccactttcgagaaattctacccatgagatgtactgggtcagttgcggaactggcaacatcgtgtccgcagttaatatgacaagccgtatgctgttaaacagattcaccatggcccaccgcaagcctacgtatgaaagggatgtggacctgggtgctgggacccggcacgtcgccgtggagcccgaagtagcaaacttggatataattggacagagaatcgagaatatcaaacatgaacacaagtcaacatggcattacgacgaggataacccttataaaacttgggcctaccacggctcctatgaggtgaagccatctggcagcgctagttccatggttaatggggtcgtgaaactcctgaccaagccctgggacgtgattcctatggtcacacaaatagcgatgactgataccacaccatttggacagcagcgcgttttcaaggaaaaagtggacaccaggactcccaaggccaaacgaggtacggcacaaatcatggaggtaacagctaagtggctatggggctttcttagccggaacaaaaagccgagaatttgtaccagggaagagttcactcgcaaggtgcgttctaatgccgcaatcggggccgtctttgtggacgaaaaccagtggaactcagctaaagaggccgttgaggatgaacggttctgggacctggtgcatagagagagggaactccacaagcagggaaaatgcgcgacctgcgtctacaacatgatgggcaagcgcgagaaaaagctgggtgaatttgggaaggcaaaaggaagtcgagccatttggtacatgtggttgggcgctcggttcctggagttcgaggccctcggctttatgaatgaagatcactggttctccagagagaacagcctttctggggtggaaggagagggtctgcataagttaggctatatcctgagggacatatcgaaaatccctgggggaaatatgtacgcagatgacacagctggctgggatacgcgcattaccgaggacgatttgcagaacgaagccagaatcactgacattatggagccagaacacgctctcctggccaagtcaatctttaaactaacatatcaaaataaggtagttcgggtgcagaggcccgccaagaatggtaccgtcatggatgtgataagccgtcgagaccagcgcgggtccggacaggtgggcacttacggccttaatacattcaccaacatggaggcgcaactgattagacagatggaaagtgaggggatcttttctcctagcgagctcgaaacaccaaacctggccgagcgggtcttggattggttagaaaagtatggagttgagaggctgaagcgcatggctatctccggtgacgactgtgtggtaaaacccattgatgacagattcgccactgcactcaccgctcttaatgatatgggcaaggtgcggaaagacataccgcagtgggaaccttcaaaggggtggaacgattggcagcaagtccccttttgcagtcatcacttccaccagctgatcatgaaagacggaagggagattgtggttccatgtcgaaatcaggatgagctagtgggccgtgccagagtctctcagggtgcagggtggagcctgcgcgaaacggcctgcctcggaaagtcctacgcgcaaatgtggcagttgatgtattttcatcggagggacctgagacttgctgccaacgcaatctgttcagccgtgcctgtagattggattcccaccagccgcacaacttggtctatccacgctcatcaccagtggatgaccacagaggacatgctgtccgtttggaatcgggtgtggatagaagagaacccatggatggaagataagactcatatcagtaattggggcgacgtcccctacctcggcaaaagggaggaccaatggtgcgggagcttaattggactgaccgcccgagcaacgtgggctacaaacatccaggtggccattaatcaggttagacggttgatcggtaacgagaattacctggattatatgacctcgatgaagaggttcaaaaacgaatccgaccctgagggcgcgctctggtga

SEQ ID NO: 13305 - RNA, 9879 nt, synthetic construct
  misc_feature 1..9879: note = derived and/or modified CDS sequence (opt3) from DENV-1__FJ639695__SS-prME
  source 1..9879: mol_type = other RNA
tccgtgaccatgctgctcatgcttatgcccacagccctggctttccacttgactacgagaggaggggagcctcatatgatcgtctccaagcaagaaagaggaaaatctttactgtttaagacctcagcgggtgttaacatgtgcacactgattgccatggacctcggcgagctgtgtgaagatactatgacctacaaatgcccacggataacagaggcggaaccggacgatgtggactgttggtgcaatgctaccgatacttgggtaacatatgggacctgtagtcaaacgggagagcaccgccgagacaagcgtagcgtggcccttgcaccccatgtcggcctgggtttggagactagaaccgaaacatggatgtcctctgagggggcctggaaacagatccagagggtggaaacttgggctctccggcaccctggattcaccgttattgcactgtttctggcccatgctatcggcacatcgattacccagaagggcatcatattcatcctcttaatgctggtgacgccatcaatggccatgcgctgcgtcgggattggaagcagagattttgtggagggtcttagtggcgcgacttgggtagacgttgtgttggagcacgggtcctgtgtcacaaccatggcaaaggataaacccactctggacatcgaactgctcaagacagaggtgaccaaccctgccattctgaggaaactttgcatcgaagctaagatatctaatacgaccacagatagccggtgtccaactcaaggagaggccaccctggtggaggaacaagacgcaaacttcgtctgccgccgaacatttgttgatagaggctggggtaatgggtgtggattgttcggcaaaggctccctcatgacttgcgctaagtttaagtgcgtgaccaaactggaggggaagattgtacagtacgaaaacttaaaatattcagtgatcgtcacagtgcacaccggagaccagcatcaagttggtaatgagagtactgaacacggcacgacagccaccattactccccaggcgcctaccacagagatccagctgaccgactacggggccctcactcttgattgtagcccaaggacaggactggacttcaacgaaatggtgttgctaacgatgaaggagaaatcttggctggtccataagcagtggtttctcgatctgccgcttccctggacctccggcgcatcaactagccaagagacatggaatcggcaggacctgttggtgaccttcaaaacagctcacgccaagaagcaggaagtagttgtgctcggtagtcaagagggggctatgcacactgccctgaccggcgcaacggaaatccagacctctggaacaactaccatttttgccggccatttaaaatgccgtctgaagatggataaactaacactcaaggggatgtcctatgtcatgtgtactggtagcttcaaactggagaaggaagtggctgagacccagcacggtacggtccttgtgcagataaagtacgagggcacagacgcgccttgcaaaatcccattctcgacccaagatgaaaagggggttactcagaacggacgcttgattacagcaaatcccatcgtgaccgacaaagagaagcctgtaaacatagaagccgagccaccctttggcgagtcttatattgtcatcggtgctggggaaaaagccctgaagctctcctggttcaagaaaggctcaagtatcggaaagatgtttgaggcaactgccagaggcgctaggcggatggccattctgggggataccgcatgggacttcggaagcatcggtggcgtgtttacatccgttgggaaacttgtgcatcagattttcggaacggcgtacggcgtcctgttttctggtgtgagctggaccatgaagatagggttgggcgtactcctgacttggttaggactaaattcacgaagtacatccctaagcatgacctgtatcgctgtgggcctcgttacactgtaccttggggtcatggtgcaggccgattctggatgcgtgattaactggaaaggccgcgaattgaagtgtggttcagggatcttcgtcactaatgaggttcacacctggacggaacaatataagtttcaggcagacagtccgaaaagactgagcgccgctatcggaaaggcctgggaggagggcgtgtgcggtattaggtccgcaacacggctcgaaaacataatgtggaaacagatctctaacgagctgaatcatattttactggaaaacgacatgaagttcaccgtggtagtcggcgatgtggctgggatccttgcccagggcaaaaagatgattcgccctcaacccatggagtacaaatattcgtggaaaagctggggcaaggcgaagatcataggggccgacgttcagaatactacctttatcattgatggaccaaacacacctgaatgtcccgacgatcagagagcttggaatatctgggaggtggaggactacggcttcggtatttttactaccaacatctggttgaagctcagggattcctatacacaggtctgcgaccaccgtctgatgtcagcagccataaaagatagtaaggctgtgcacgccgacatggggtactggattgaatctgagaaaaatgaaacgtggaagctagcacgggcgagcttcatcgaggttaagacctgtatttggccaaaatcccatactctgtggtcaaacggagtgctcgaaagcgagatgatcatacccaagatctatggcggtcctatttctcaacacaattaccgaccaggctacttcacacagaccgccgggccgtggcatctgggaaaacttgagttggattttgacctgtgcgaaggcactacagtagtcgtggatgagcactgcgggaacagaggaccctccttaaggaccacgactgtgaccggcaagatcattcacgaatggtgttgccgcagttgtacactccctccactgcggttcagaggtgaggacgggtgctggtatggaatggagatcaggcccgtcaaagaaaaggaggaaaatcttgttaagagcatggtgtctgctggctccggtgaggtagactcatttagtctgggcttgctctgtataagcattatgatcgaagaggtgatgcgctcgcgatggtcccggaaaatgctgatgaccgggactctagccgtcttcctgctcctgatcatgggacagcttacatggaacgatttgattcgtctgtgcatcatggtgggcgcaaatgcttctgacagaatggggatgggaaccacatacttagccctcatggcaacttttaagatgaggcctatgttcgccgttggcctgctttttcgccggctgaccagcagagaggtgctactcctgacgattggtttgtcactggtcgctagtgtggaattaccaaactccctcgaggaactgggggatggacttgcgatgggcataatgatcctgaaattgctcacagacttccaatctcatcagctgtgggccaccctactgagccttacttttattaagaccacattctccctccactatgcatggaaaactatggctatggttctgtcaatcgtgagcttgtttcccctgtgtttaagtaccacgtctcagaagacaacctggctcccggtcctgcttggctccctggggtgcaagcctttgactatgttcctcattgccgagaataaaatctggggaaggcgaagctggccactgaacgaaggtataatggccgtaggcatcgtgtcgattctactgtcatctcttctcaagaacgatgttcccctggctgggcctttgatcgcaggaggcatgttaattgcctgttacgtgatcagtggttccagcgcggacctgtctctcgagaaagctgccgaggtcagctgggaagaggaagcagagcattccggggcctcacacaatatactggtggaagtacaggatgacggaacaatgaagattaaagatgaggagcgcgacgatacccttactatcctgttgaaggctacactactggcagtgagtggcgtctatcccctcagcatcccagccaccctgtttgtttggtacttctggcagaaaaagaagcagcggtctggcgtgctttgggacacgccttcacccccagaagtggagagagcggtcttagatgacgggatttataggataatgcagcgtggactgctcggtcgcagccaggtgggcgttggggtattccaagaaaacgtgtttcatactatgtggcacgtcacccggggagctgtgttgatgtaccagggcaaaagactggagccgagttgggccagcgttaagaaagacctcatctcctacggtgggggatggaggctgcagggctcttggaatacaggcgaggaagtgcaggtcattgcagtggagcctgggaagaaccccaaaaatgtacaaaccgccccaggaacattcaagactcccgaaggtgaggtcggcgctatcgcccttgattttaagcctgggacctcgggaagcccaattgtgaaccgagaaggcaaaatcgttggtctgtatgggaatggagtggtcacgacatcaggcacttacgtgtccgcaatagctcaggccaaggcgagtcaggagggccccttgcctgagatcgaagacgaggttttccggaaacgcaacctaaccattatggatctgcacccggggtctggaaagacaagaaggtatctcccagccatcgtgcgggaagcaattaaacgaaagttaagaaccctgatccttgctcccactcgcgtcgtggccagcgagatggctgaagcactgaagggtatgcctataaggtaccaaaccacagccgtaaaatccgagcatacgggcaaggagattgtggacctcatgtgccacgccacttttaccatgcgtttgctgtcaccagttcgggtccccaattataacatgatcatcatggatgaagctcatttcacagacccttctagcattgcggcaagagggtacatcagtaccagggtgggaatgggcgaggccgctgccatatttatgactgcaacaccgcccggttccgtggaagccttcccacagagcaatgctgtcattcaggatgaggaacgcgacatccctgagcgatcttggaactcagggtatgagtggattaccgattttcccggaaaaacggtatggttcgtgccatccatcaagagtggcaatgacatagcgaactgtctcaggaaaaatggcaagcgggttattcagctgagcaggaagacttttgatacagaataccagaaaaccaagaacaacgactgggactacgtggtcaccactgatatctcggagatgggggccaatttccgcgcagaccgtgtgatcgatcctagacggtgccttaaacccgttattctaaaggacggaccagaaagggtgatcctggctggtccgatgcctgtcacagtggcctctgcagcccagcgccgaggcagaattgggcggtcccacaacaaagagggagatcagtatatatacatgggccagcccttgaataacgacgaggatcatgctcactggaccgaagccaagatgttactggacaatatcaacacaccagagggtattatccccgcactcttcgaacctgagagggaaaagagcgcagccatcgatggggagtatcgcctgagaggcgaggctaggaaaacttttgtagaacttatgcggcgtggagacctgccagtgtggctctcatacaaggttgccagtgagggcttccaatattctgatcgccgatggtgctttgacggggaaagaaataaccaggtcttggaggaaaatatggatgtggagatttggacgaaagagggagaaaggaagaaactgcggccccgctggctagacgctagaacctactccgaccctctggcactcagggagttcaaggaatttgccgctggtcggcgaagcgtgtcaggcgatcttatactggagatcgggaaattaccgcagcacttgacacagagagcccaaaacgcactggacaatctcgtcatgctgcataacagtgaacagggaggccgcgcgtataggcacgccatggaggagcttccagatactattgaaaccctgatgctcttggctctgatcgccgttttaacaggtggggtgaccctattctttctgagcggccggggactcggcaagacttccattgggcttctgtgtgtaatggcatctagcgtgttgctgtggatggcttccgtcgagccccattggatcgccgcatcaataatcctcgagttctttctgatggtgcttctcattcctgagcccgaccgtcagagaacgccacaggataatcaactggcctacgttgtgatcggattgctgttcatgattttaaccgtcgctgcgaacgagatgggtctactggaaacaactaagaaagacctcggcatcgggcacgtagccgtgggaaatcaccatcacgcagctatgcttgatgttgacctgcatcctgcctctgcctggaccttgtacgcagtggctacaaccataattactcccatgatgaggcacacaatcgagaacacgaccgccaacattagtctgactgcgatcgctaatcaggccgcaatactcatgggcctggataagggttggccaatctcgaaaatggacattggggtccctcttttagccctgggctgctatagccaggtgaacccgctcacattgaccgctgcagtcctgatgctagtggcccattacgcgatcattggacccggcctgcaagctaaggccacccgcgaagcacagaaacggacagccgctgggatcatgaagaatccaactgttgatggaatagtggccattgacctcgatcctgtagtgtatgacgcaaagtttgagaaacagcttggccagatcatgctgttgatcctgtgtacgtcccaaattctcctgatgcgaaccacatgggctttatgcgaatctatcactcttgccaccggtcccctgacaaccctctgggaggggtcaccaggaaagttctggaacactacgatagcggtcagcatggccaatatttttagaggctcctacctagcaggagctggcctggccttcagtttgatgaaatctctagggggaggcaggcgcgggacaggagcacagggcgagaccctcggtgaaaagtggaaacggcagcttaaccagctgagcaagtcagagttcaatacttataagagatccgggatcatggaagttgaccgtagtgaggctaaagaaggattgaagaggggcgagaccacaaaacacgccgtgagccggggtactgccaagctgcgctggtttgtcgagcgaaacctcgtgaaacctgaaggcaaggtaattgatttagggtgtggaagaggcgggtggtcttactattgcgcgggactgaagaaagtgaccgaggttaagggctacacaaaaggtgggcccggacacgaagaaccgatcccaatggctacgtacggctggaatcttgtgaagctgcattccggcaaagacgtcttctttatacctcccgaaaagtgtgataccctactctgcgacatcggggagtcaagcccaaaccccactattgaggaaggaaggacactgcgggtgttgaaaatggtcgagccttggctgcgcggtaatcaattctgtatcaagattctcaacccgtatatgccctcggtggttgaaacccttgagcagatgcagagaaagcacggcgggatgctggtaaggaatccattatctcgaaacagtactcatgagatgtactgggtgtcctgcggaacaggcaatatcgtcagcgcagtgaacatgacctcacggatgctgttgaatcgttttacgatggcccacagaaaacctacctatgaacgcgatgttgacctcggtgctgggacaaggcacgtggccgtcgagcccgaagtggcaaacctggatattatcggacagcggatagagaacattaagcatgaacacaaatccacttggcattacgacgaggataatccttataagacctgggcctaccacggctcttatgaggtaaaaccaagcggcagtgcttccagcatggtgaacggggttgtcaagctacttacaaagccctgggacgtgatccctatggtgactcaaatcgcgatgaccgatacaaccccattcggacagcagagagtctttaaagaaaaggttgacactcgcacgcccaaagccaagaggggtacagcacaaattatggaggtgaccgctaaatggctgtggggcttcctctctcgaaataagaagccgcggatatgtactagagaagagtttaccaggaaagtacgctcaaacgccgcaatcggggccgtgttcgtcgacgaaaatcagtggaacagtgctaaggaggccgtggaggatgaacgtttttgggacctggttcatcgggagagagaattgcacaaacagggaaagtgcgcgacatgcgtgtacaatatgatgggcaaaagggagaagaagctgggtgagttcgggaaagcaaagggatcccgcgccatttggtacatgtggctcggcgctcgatttcttgagttcgaggccctgggcttcatgaacgaagatcactggtttagccgggaaaattctttatcgggggtcgaaggagagggtctgcataaattgggctatatcctcagagacatttcaaagatccctgggggaaacatgtacgcagatgacacggctggctgggataccaggataactgaggacgatctgcagaatgaagcccgcatcacagacattatggagccagaacacgctctacttgccaaaagcatcttcaagctgacctatcaaaacaaagtggtaagagttcagcggcccgcaaagaatggtactgtgatggatgtcatttccaggcgtgaccagcgagggagtggacaggtgggcacatacggcctcaacacctttacaaatatggaggcgcaactgatccgccagatggaatctgaggggatattcagcccttccgagttggaaactccaaacttagccgagagagtgctggtctggctcgaaaagtatggagttgagcggcttaaaaggatggctatttcaggtgatgactgtgtggtaaagcccatcgacgatcgctttgccaccgcactgacggctctaaacgacatgggcaaagtgagaaaggatatcccgcagtgggaacctagtaaagggtggaatgactggcagcaagtccccttctgctctcatcactttcaccagctgattatgaaggatggacgggagatagtggttccatgtaggaaccaggacgagctcgtgggccgagcccgtgtcagccagggtgcagggtggtccttgagagaaaccgcctgcctgggaaagtcatacgcgcaaatgtggcagcttatgtatttccatcgccgggatctgaggctcgctgccaatgcaatctgtagcgccgtgcctgtagactggattcccacatctagaactacctggtccatccacgctcatcaccagtggatgacaactgaggatatgttaagtgtttggaaccgcgtgtggattgaagagaatccatggatggaagacaaaacccatatcagctcgtggggcgatgtcccctacctgggcaagcgggaggaccaatggtgcgggtccttgataggactgacggccagggcaacatgggctaccaacatccaggtggccattaatcaggttcgaagactcatcggtaacgagaattaccttgactatatgacttctatgaaacggtttaagaacgaatcagatcctgagggcgcgctgtggtga

SEQ ID NO: 13306 - RNA, 9879 nt, synthetic construct
  misc_feature 1..9879: note = derived and/or modified CDS sequence (opt3) from DENV-1__FJ639696__SS-prME
  source 1..9879: mol_type = other RNA
agcgtgaccatgctgctcatgcttatgcccaccgcactggctttccacttgactacgagaggaggggaacctcatatgatcgtctccaagcaggaaaggggaaaatctttactgtttaagacctcagccggtgttaacatgtgcacactgattgccatggacctcggagagttctgtgaagatactatgacctacaaatgcccacggataagtgaagcggaaccggacgatgtggactgttggtgcaatgctacagatacctgggtaacttatgggacatgtagccaaaccggagagcaccgccgagacaagcgttccgtggccctggcaccccatgtcggccttggtctggagacgagaactgaaacctggatgtcttcggagggggcctggaaacagatccagagggtggaaacatgggctttgcggcaccctggatttactgttattgcactcttcctggcccatgctatcggcacctcaattacacagaagggcatcatatttatcctgctcatgttagtgaccccaagcatggccatgcgctgcgtcgggattggaagtagagatttcgtggagggtctgtccggcgcgacgtgggtagacgttgtgcttgagcacgggtcttgtgtcactacaatggcaaaggataaacccaccttggacatcgaactgctaaagactgaggtgacaaaccctgccgtgctcaggaaactgtgcattgaagctaagatcagcaataccacgaccgattcccggtgtccaacacaaggagaggccactcttgtcgaagaacaagacgcaaactttgtttgccgccgaaccttcgtggatagaggctggggtaatgggtgtggactgtttggcaaaggctcattgataacatgcgctaagttcaagtgcgtaactaaactcgaggggaagattgtgcagtacgaaaacctgaaatatagtgtcatcgtgaccgttcacacaggagaccagcatcaagtgggtaatgagagcaccgaacacggcactacggccacaattacaccccaggcgccttctactgagatccagttaaccgactacggggccctgacactcgattgttccccaaggaccggacttgactttaacgaaatggtcctgttgactatgaaggagaaatcatggctagtgcataagcagtggttcctggatctcccgctgccctggacaagcggcgcaagtacgtctcaagagacctggaatcggcaggaccttctggtaacttttaaaacagctcacgccaagaagcaggaagttgtggtcttgggttcccaagagggggctatgcacaccgccctcacaggcgcaactgaaatccagaccagcggaacgaccacaattttcgccggccatctgaaatgccgtttaaagatggataaactgactctaaaggggatgtcgtatgtgatgtgtaccggatctttcaaactcgagaaggaagtcgctgagacacagcacggtactgtgctggttcagataaagtacgagggcaccgacgcgccttgcaaaatcccattttccacgcaagatgaaaagggggtgacacagaacggacgccttattaccgcaaatcccatcgtaactgacaaagagaagcctgtcaacatagaagccgagccacccttcggcgagtcatatattgtgatcggtgctggggaaaaagccttgaagctgagttggtttaagaaaggcagctccatcggaaagatgttcgaggcaacagccagaggcgctaggcggatggccattctcggggataccgcatgggactttggatctatcggtggcgttttcactagcgtggggaaactggtccatcagatttttggaaccgcgtacggcgtgcttttctcaggtgtaagttggacaatgaagatagggatcggcgtgctgttgacgtggctcggactaaattcccgaagcacctctttatcaatgacttgtattgctgttggcctggtcacactatacctcggggtgatggtgcaggccgatagtggatgcgtcatcaactggaaaggccgcgaactgaagtgtggtagcgggatctttgttaccaatgaggtgcacacatggactgaacaatataagttccaggcagactccccgaaaagactttctgccgctattggaaaggcctgggaggagggcgtgtgcggtataaggtcggcaacccggttggaaaacatcatgtggaaacagattagcaacgagctgaatcatatcctcctggaaaacgacatgaagtttacggtagtcgtgggcgatgttgctgggattttagcccagggcaagaagatgatccgccctcaacccatggagtacaaatattcctggaagtcatggggcaaggcgaaaataatcggggccgacgtgcagaatacaaccttcattatcgatggaccaaacactcctgaatgtcccgacgatcagagagcttggaatatttgggaggtcgaggactacggctttggtatcttcaccacaaacatatggctgaaacttagggatagttatactcaggtgtgcgaccaccgtttgatgtctgcagccattaaagatagcaaggctgttcacgccgacatggggtactggatcgaatccgagaaaaatgaaacctggaagctcgcacgggcgtcattcattgaggtgaagacatgtatctggccaaaaagccatacgctgtggtctaacggagtactagaatccgagatgataatccccaagatttatggcggtcctatcagtcaacacaattaccgaccaggctactttacccagactgccgggccgtggcatctgggaaaactcgagctggatttcgacctttgcgaaggcacaaccgtcgtggtggatgagcactgcgggaacagaggacccagcttgaggactacaaccgtcacgggcaagattatccacgaatggtgttgccgctcttgtactctgcctccattacggtttaaaggtgaggacgggtgctggtatggaatggagataagacccgttaaggaaaaggaggaaaatctcgtgaaatccatggtatcagctggcagtggtgaggtggacagcttctcgctgggccttctgtgtatttccatcatgatcgaagaggtcatgaggtctcgctggagccgaaagatgttgatgaccgggacactcgccgtgtttttcctgctaattatgggacagctgacctggaacgatctcatccggctgtgcattatggttggcgcaaatgcttcagaccgtatggggatgggaatgacttaccttgccttgatggcaacatttaaaatgagacctatgttcgccgtgggcctgttatttaggcgcctcaccagtcgggaggtcctgcttctgacaataggtctatccctcgtggcttctgttgaactgccaaacagcttggaggaactgggggatggattagcgatgggcatcatgattctcaagctgcttactgacttccaatcccatcagctgtgggccaccttgctctcactgacgtttatcaaaacaaccttcagcctacactatgcatggaagactatggctatggtgctgagtattgtctctctttttcccctctgtctgtccaccacaagccagaagactacctggttgccggtactgttaggctcgctcgggtgcaaacctctgacgatgttccttatcgccgagaataagatatggggaagaaaatcatggccactgaacgaaggtatcatggccgtgggcattgtttctatcttgctcagttccctgctaaagaacgatgtgcccctggctgggcctcttattgcaggaggcatgctcatcgcctgttacgtcataagcggttctagcgcggacctgtccttggagaaagctgccgaggtgtcatgggaagaggaagcagagcatagtggggccagccacaatattttagtagaagtgcaggatgacggaacaatgaagatcaaagatgaggagagggacgataccctgactatcctcctgaaggctacacttctggcagtctctggcgtttatcccttgtccattccagccaccctattcgtgtggtacttttggcaaaagaaaaagcagcgatcaggcgtgctgtgggacactcctagtcccccagaagtcgagcgcgcggtgctcgatgacgggatatatcggatcatgcagagaggactgcttggtaggagccaggttggcgtaggggtgttccaagaaaacgtctttcatacaatgtggcacgtgacccgtggagctgttttaatgtaccagggcaaacgcctggagccgtcctgggcctctgtgaagaaagacctcatttcgtacggtgggggatggcggttgcagggcagctggaatacgggcgaggaagtccaggtgatcgcagtagagcctgggaagaaccccaagaatgtccaaactgccccaggaaccttcaaaacatcagaaggtgaggtgggcgctattgccctggattttaagcccgggacctccggaagtcctatcgttaacagagaaggcaaaatagtgggtctctatgggaatggagtcgtgacaacttctggcacctacgttagcgcaatcgctcaggccaaggcgtcccaggagggcccactgcccgagattgaagacgaggtgttcaggaaacgaaaccttacgatcatggatctgcaccctgggtcaggaaagacacggcgctatttgccggccattgtcagagaagcaatcaagaggaaactacggactctgatactcgctccaacccgagtggtagcctctgagatggctgaagcattaaagggtatgcccattagataccaaacaaccgccgtgaaaagcgagcatactggcaaggagatcgttgacctgatgtgccacgccacctttacaatgcgccttctgagtcctgtcagggtgccaaattataacatgatcattatggatgaagctcatttcacggacccctccagcatcgcggcacgtgggtacatatctactcgggtgggaatgggcgaggccgctgccatttttatgaccgcaacacctccgggttcagtcgaagccttcccccagtccaatgctgtaatccaggatgaggaaagagacattccagagaggagttggaacagcgggtatgagtggatcaccgattttcctggaaaaactgtgtggttcgttccctcgataaagtctggcaatgacattgcgaactgtctccgcaagaatggcaaacgagtgatccagttgtccagaaagacattcgataccgaataccagaagacgaagaacaacgactgggactacgtcgtgactacagatatcagcgagatgggggccaattttcgggcagacagggttattgatccacgccgttgcctgaaacctgtgatcctcaaggacggacccgaaagagtcattctggctggtccaatgccggtgaccgtagcctcagcagcccagcggaggggccgcatagggcgaaaccacaataaggagggagatcagtatatctacatgggccagcctcttaacaatgacgaggatcatgctcactggaccgaagccaaaatgctactggacaacattaatactcccgagggtatcatcccagcgttgttcgaacccgagagagaaaagagtgcagccattgatggggagtatcggttaaggggcgaggctcgcaaaacatttgtggaactgatgagaaggggagacctccctgtttggctgtcttacaaggtcgcctccgagggcttccaatatagcgatcggcgttggtgctttgacggggaacgcaacaatcaggtgcttgaggaaaacatggatgtggagatatggaccaaagagggagaacgaaagaaactgagaccaaggtggctcgacgctcggacatactcagaccccttggcactgcgcgagttcaaggaatttgccgctggtagaaggagtgtcagcggcgatctaatcctggagattgggaagctccctcagcaccttactcagcgggcccaaaatgcactggacaacttagttatgttgcataattccgaacagggaggccgagcgtatagacacgccatggaggagctgccggatacgatcgaaaccctcatgctgcttgctctgattgccgtgctcacaggtggggtaactttgttctttctgtctggccgcggattaggcaaaaccagcatcgggctactgtgtgtgatggcatcctcagtcctcctttggatggcttctgtggagccacattggatagccgcaagtatcattctggagttctttttgatggttctgctcatccccgagcctgacaggcagcggacaccccaggataaccaactggcctacgtggtcattggacttctcttcatgatcctgaccgtagctgcgaatgagatgggtttgctggaaactacgaagaaagacttaggcatagggcacgtggccgttgagaaccaccatcacgcagctatgctagatgtggacctgcatccagcctcggcctggaccctctacgcagtcgctacaactattatcacccctatgatgcgtcacacaattgaaaacaccactgccaatatcagccttacagcgatagctaaccaggccgcaatcctgatgggattggataagggctggcccatttccaaaatggacatcggtgtgccactgctcgccctggggtgctattctcaggtcaatcctcttacgttaaccgctgcagtgctgatgctcgttgcccattacgcgattatcggcccgggattgcaagctaaggccactagagaggcacagaagaggacagccgctggcataatgaaaaaccccaccgtggatgggattgtagccatcgacctggatccagtggtctatgacgcaaagtttgaaaaacagctaggacagatcatgctgctcattctttgtacctcacaaatcctgttgatgcgcacaacttgggctctgtgcgagagcataacgctcgccaccggccctctgacaactttatgggagggttcccccgggaagttctggaataccacaattgcggttagtatggccaacatcttccggggatcttaccttgcaggcgctggtctggcctttagcctcatgaaatcactaggcgggggacgaagaggcaccggggcacagggagaaactctgggcgagaagtggaagaggcagttgaatcagctgtccaaaagtgagttcaacacgtataagcgcagcggtattatggaggtggaccggtctgaagctaaagaggggctcaagagaggagagacaaccaaacacgccgtctcccgtggcactgccaaacttaggtggtttgtggaacggaatctggtaaagccagagggtaaagtgatcgatttgggctgtgggcgcggaggctggtcatactattgcgcggggctgaagaaagttaccgaagtgaagggatacacaaaaggcggtcctgggcacgaggaacccataccgatggctacttacggatggaacctcgtcaagttacatagcggcaaagacgtgttctttgtcccacctgagaagtgtgataccctgctttgcgacatcggcgagtcgtctcccaatccaacaattgaagaggggcgaacgctgagagtgctaaagatggttgaaccctggctcaggggaaaccaattctgtatcaaaattctgaatccttatatgccgagtgtagtggagaccttggagcagatgcagcggaagcacggtggcatgctggtccgcaaccccctctccagaaatagcactcatgaaatgtactgggtgtcatgcgggacaggaaacatcgtttccgcagtgaatatgacctctaggatgcttctgaaccgatttactatggcccaccggaaaccaacatatgagcgtgatgtcgacttaggcgctggtaccagacacgtggccgtagaacctgaggtggcaaacctggatattatcgggcagcgcatagaaaatattaagcatgagcacaaaagcacgtggcattacgacgaggataacccctataagacctgggcctaccacggaagttatgaagttaagccttccggcagcgcttcttcaatggtcaatggcgtggtgaaattgctcacaaagccatgggacgtcatccccatggttactcaaatcgcgatgaccgatacaactcctttcgggcagcagagggtgtttaaagagaaggtagacacccggacaccaaaagccaagagaggaaccgcacaaattatggaagtgactgctaagtggctgtggggtttcctaagtcgcaacaaaaagcccaggatatgtacgcgagaggaatttacacggaaagtcagatccaatgccgcaatcggcgccgtgttcgttgacgagaaccagtggaatagcgctaaggaggccgtggaagatgagaggttttgggaccttgtccatcgcgaacgtgagctgcacaaacaggggaagtgcgcgacctgcgtgtacaacatgatgggaaagcgggagaaaaagctcggcgagttcggtaaagcaaaggggtctagagccatttggtacatgtggctgggagctaggttcttggagtttgaagccctgggcttcatgaatgaggatcactggttttcgcgcgaaaactcactcagcggcgtagagggggagggacttcataaactgggttatatcttacgagacatttccaagatcagtggcgggaatatgtacgcagatgacactgctggatgggatacccggataacagaagacgatctgcagaacgaggccaaaatcacggacattatggaaccggagcacgctttgctcgccaagtctatcttcaagctgacctatcaaaataaagttgtgagagtccagaggcctgcaaagaacggcactgtgatggatgtgattagccgcagagaccagcggggttccgggcaggtcggaacatacggcctaaatacctttactaacatggaagcgcaacttatcaggcagatggagtcagagggcatattcagtccatctgaactggagacacccaacctcgccgaacgtgctctggattggttggagaaacatggggttgaacgattaaagcgcatggccattagcggagacgactgtgtggtaaaacctatcgatgacagatttgcaaccgctctgacagccctcaatgatatgggtaaggtgcggaaggacatcccacagtgggagccctccaaaggctggaacgattggcagcaagtcccgttctgctcacaccactttcatcagcttattatgaaggacgggagggagatagtggttccttgtcgcaatcaggatgaactggtgggcagagcacgggtcagccagggcgccggttggtctctaagggagactgcgtgcctggggaaatcctatgctcaaatgtggcagctcatgtacttccaccgacgtgacttgagactggccgcaaacgccatctgtagtgctgtgcccgtagattgggttccaaccagccgcacgacctggtcgattcatgcccaccatcagtggatgacaactgaagacatgctttccgtgtggaatcgggtctggatcgaggaaaacccttggatggaggataagacccacatttcttcatgggaggacgtgccctatctgggaaaaagggaagaccaatggtgcggcagcctcatcggcttaacagcaagagctacttgggccaccaatatacaggttgcgatcaaccaggtgcgccggctgattgggaatgagaactacttggattacatgacgagtatgaagaggtttaagaatgaatccgacctggagggagctctctggtga

SEQ ID NO: 13307 - RNA, 9879 nt, synthetic construct
  misc_feature 1..9879: note = derived and/or modified CDS sequence (opt3) from DENV-1__HM181937__SS-prME
  source 1..9879: mol_type = other RNA
tccgtgaccatgctgctcatgcttatgcccacagcactggctttccacttgactacgagaggaggggagcctcatatgatcgtctccaagcaggaaagaggaaaatctttactgtttaagacctcagccggtgttaatatgtgcacattgattgccatggacctcggcgagctgtgtgaagatactatgacctacaaatgcccacggataacagaggcggaaccggacgatgtggactgttggtgcaatgctaccgatacttgggtaacatatgggacctgtagtcaaacgggagagcaccgccgagacaagcgtagcgtggcccttgcaccccatgtcggcctgggtttggagactagaaccgaaacatggatgtcctctgagggggcctggaaacagatccagagggtggaaacttgggctctccggcaccctggattcaccgttattgcactgtttctggcccatgctatcggcacatcgattacccagaagggcatcatattcatcctcttaatgctggtgacgccatcaatggccatgcgctgcgtcgggattggaagcagagattttgtggagggtcttagtggcgcgacttgggtagacgttgtgttggagcacgggtcctgtgtcacaaccatggcaaaggataaacccactctggacatcgaactactcaagacagaggtgaccaaccctgccattctgaggaaactttgcatcgaagctaagatatctaatacgaccacagatagccggtgtccaactcaaggagaggccaccctggtggaagaacaagacgcaaacttcgtctgccgccgaacatttgttgatagaggctggggtaatgggtgtggattgttcggcaaaggctccctcattacttgcgctaagtttaagtgcgtgaccaaactggaggggaagatcgtacagtacgaaaacttaaaatattcagtgattgtcacagtgcacaccggagaccagcatcaagttggtaatgagagtactgaacacggcacgacagccaccatcactccccaggcgcctaccacagagatccagctgaccgactacggggccctcactcttgattgtagcccaaggacaggactggacttcaacgaaatggtgttgctaacgatgaaggagaaatcttggctggtccataagcagtggtttctcgatctgccgcttccctggacctccggcgcatcaactagccaagagacatggaatcggcaggacctgttggtgaccttcaaaacagctcacgccaagaagcaggaagtagttgtgctcggtagtcaagagggggctatgcacactgccctgaccggcgcaacggaaattcagacctctggaacaactaccatatttgccggccatttaaaatgccgtctgaagatggataaactaacactcaaggggatgtcctatgtcatgtgtactggtagcttcaaactggagaaggaagtggctgagacccagcacggtacggtccttgtgcagatcaagtacgagggcacagacgcgccttgcaaaattccattctcgacccaagatgaaaagggggttactcagaacggacgcttgatcacagcaaatcccatagtgaccgacaaagagaagcctgtaaacattgaagccgagccaccctttggcgagtcttatatcgtcatcggtgctggggaaaaagccctgaagctctcctggttcaagaaaggctcaagtattggaaagatgtttgaggcaactgccagaggcgctaggcggatggccatcctgggggataccgcatgggacttcggaagcattggtggcgtgtttacatccgttgggaaacttgtgcatcagatattcggaacggcgtacggcgtcctgttttctggtgtgagctggaccatgaagatcgggattggcgtattgctcacttggctgggattaaattcacgaagtacatccctgagcatgacctgtatcgctgtgggcctagttacactctacctgggggtcatggtgcaggccgattctggatgcgtgatcaactggaaaggccgcgaacttaagtgtggttcagggattttcgtcactaatgaggttcacacctggacggaacaatataagtttcaggcagacagtccgaaaagattgagcgccgctataggaaaggcctgggaggagggcgtgtgcggtatcaggtccgcaacacggctggaaaacattatgtggaaacagatctctaacgagctcaatcatattctgttagaaaacgacatgaagttcaccgtggtagtcggcgatgtggctgggatcctggcccagggcaagaagatgatacgccctcaacccatggagtacaaatattcgtggaaaagctggggcaaggcgaagatcattggggccgacgttcagaatactacctttatcattgatggaccaaacacacctgaatgtcccgacgatcagagagcttggaatatctgggaggtggaggactacggcttcggtatatttactaccaacatttggcttaagttgagggattcctatacacaggtctgcgaccaccgtctcatgtcagcagccatcaaagatagtaaggctgtgcacgccgacatggggtactggattgaatctgagaaaaatgaaacgtggaagctggcacgggcgagcttcatcgaggttaagacctgtatatggccaaaatcccatactctatggtcaaacggagtgctggaaagcgagatgatcattcccaagatctatggcggtcctatttctcaacacaattaccgaccaggctacttcacacagaccgccgggccgtggcatctcggaaaactggagcttgattttgacttgtgcgaaggcactacagtagtcgtggatgagcactgcgggaacagaggaccctccctgaggaccacgactgtgaccggcaagatcatacacgaatggtgttgccgcagttgtacattacctccactccggttcagaggtgaggacgggtgctggtatggaatggagattaggcccgtcaaagaaaaggaggaaaatctggttaagagcatggtgtctgctggctccggtgaggtagactcatttagtcttggcctgttgtgtatcagcatcatgattgaagaggtgatgcgctcgcgatggtcccggaaaatgctcatgaccgggactctggccgtcttcctactgctcatcatgggacagctgacatggaacgatcttattcgtttgtgcataatggtgggcgcaaatgcttctgacagaatggggatgggaaccacatacctggccttaatggcaacttttaagatgaggcctatgttcgccgttggcctcctgtttcgccggcttaccagcagagaggtgctgctactcacgatcggtctgtcattggtcgctagtgtggaactgccaaactccttagaggaactcggggatggactggcgatgggcattatgatccttaaactgttgacagacttccaatctcatcagctctgggccaccctgctaagcctgacttttattaagaccacattctcccttcactatgcatggaaaactatggctatggttctctcaatcgtgagcctgtttcccttgtgtctgagtaccacgtctcagaagacaacctggttaccggtcctcctgggctcccttgggtgcaagcctctgactatgttcttgatagccgagaataaaatctggggaaggcgaagctggccactcaacgaaggtattatggccgtaggcatcgtgtcgattctgctatcatctctgcttaagaacgatgttcccctcgctgggcctctgatcgcaggaggcatgttgatagcctgttacgtgattagtggttccagcgcggacttatctctggagaaagctgccgaggtcagctgggaagaggaagcagagcattccggggcctcacacaatatcctcgtggaagtacaggatgacggaacaatgaagatcaaagatgaggagcgcgacgataccctgactattcttctgaaggctacattgctagcagtgagtggcgtctatcccctgagcataccagccaccctctttgtttggtacttctggcagaaaaagaagcagcggtctggcgtgctgtgggacacgccttcacccccagaagtggagagagcggtccttgatgacgggatctataggattatgcagcgtggattactgggtcgcagccaggtgggcgttggggtattccaagaaaacgtgtttcatactatgtggcacgtcacccggggagctgtgctcatgtaccagggcaaaagattggagccgagttgggccagcgttaagaaagacctgatctcctacggtgggggatggaggctccagggctcttggaatacaggcgaggaagtgcaggtcattgcagtggagcctgggaagaaccccaaaaatgtacaaaccgccccaggaacattcaagactcccgaaggtgaggtcggcgctatcgccctggattttaagcctgggacctcgggaagcccaatagtgaaccgagaaggcaaaatcgttggtctttatgggaatggagtggtcacgacatcaggcacttacgtgtccgcaattgctcaggccaaggcgagtcaggagggccccctgcctgagatcgaagacgaggttttccggaaacgcaacttgaccattatggatctacacccggggtctggaaagacaagaaggtatctgccagccatcgtgcgggaagcaataaaacgaaagctcagaaccttaattctggctcccactcgcgtcgtggccagcgagatggctgaagcacttaagggtatgcctatcaggtaccaaaccacagccgtaaaatccgagcatacgggcaaggagatcgtggacctgatgtgccacgccacttttaccatgcgtctcttgtcaccagttcgggtccccaattataacatgattatcatggatgaagctcatttcacagacccttctagcatagcggcaagagggtacattagtaccagggtgggaatgggcgaggccgctgccatctttatgactgcaacaccgcccggttccgtggaagccttcccacagagcaatgctgtcattcaggatgaggaacgcgacatccctgagcgatcttggaactcagggtatgagtggataaccgattttcccggaaaaacggtatggttcgtgccatccattaagagtggcaatgacatcgcgaactgtctgaggaaaaatggcaagcgggttatccagctcagcaggaagacttttgatacagaataccagaaaaccaagaacaacgactgggactacgtggtcaccactgatatttcggagatgggggccaatttccgcgcagaccgtgtgatcgatcctagacggtgcctgaaacccgttattcttaaggacggaccagaaagggtgatactagctggtccgatgcctgtcacagtggcctctgcagcccagcgccgaggcagaatcgggcggaaccacaataaagagggagatcagtatatttacatgggccagcccctgaacaatgacgaggatcatgctcactggaccgaagccaagatgttgttagacaacatcaatacaccagagggtatcattcccgcgctgttcgaacctgagagggaaaagtccgcagccatagatggggagtatcgcctcagaggcgaggctaggaaaacttttgtagaactgatgcggcgtggagaccttccagtgtggctgagctacaaggttgcctcagagggcttccaatatagtgatcgccgatggtgctttgacggggaaagaaacaatcaggtcctcgaggaaaacatggatgtggagatctggacgaaagagggagaaaggaagaaattgcggccccgctggctggacgctagaacctactctgaccctctagcactgagggagttcaaggaatttgccgctggtcggcgatccgtgagcggcgatctcattcttgagatcgggaaactgccgcagcacttaacacagagagcccaaaatgcattggacaacctggtcatgctccataattcagaacagggaggccgcgcgtataggcacgccatggaggagctgccagatactattgaaacccttatgctgctcgctttgatcgccgttctgacaggtggggtgaccttattctttctaagtggccggggactgggcaagactagcatagggctcctttgtgtaatggcatcctctgtgctgttgtggatggctagcgtcgagccccattggatcgccgcatccattatcctggagttctttctcatggtgctgcttattcctgagcccgaccgtcagagaacgccacaggataaccaactcgcctacgttgtgatcggactgttgttcatgatactgaccgtcgctgcgaatgagatgggtttactagaaacaactaagaaagacctgggcattgggcacgtagccgtgggaaaccaccatcacgcagctatgctcgatgttgaccttcatcctgcctcagcctggaccctgtacgcagtggctacaaccatcattactcccatgatgaggcacacaatcgagaacacgaccgccaatatatctttgactgcgatcgctaaccaggccgcaattctgatgggcctcgataagggttggccaatcagtaaaatggacattggggtccctctgcttgccttaggctgctattcgcaagtgaatccgctgacactcaccgctgcagtcttgatgctggtggcccattacgcgatcataggacccggcctacaagctaaggccacccgcgaagcacagaaacggacagccgctgggattatgaagaacccaactgttgatggaatcgtggccatcgacctggatcctgtagtgtatgacgcaaagtttgagaaacagctcggccagattatgcttctgatcttgtgtacgagccaaatactgctcatgcgaaccacatgggctctgtgcgaatccattactttagccaccggtccccttacaaccctgtgggaggggtctccaggaaagttctggaatactacgatcgcggtctcaatggccaacatttttagaggcagctacctcgcaggagctggcctagccttctccctgatgaaaagtctagggggaggcaggcgcgggacaggagcacagggcgagaccctgggtgaaaagtggaaacggcagctcaatcagctttctaagagcgagttcaacacttataagagatcagggatcatggaagttgaccgttccgaggctaaagaaggactgaagaggggcgagaccacaaaacacgccgtgagtcggggtactgccaagttgcgctggtttgtcgagcgaaatctggtgaaacctgaaggcaaggtaatagatctcgggtgtggaagaggcgggtggagctactattgcgcgggattaaagaaagtgaccgaggttaagggctacacaaaaggtgggcccggacacgaagaaccgatcccaatggctacgtacggctggaacctggtgaaacttcattctggcaaagacgtcttctttattcctcccgaaaagtgtgataccctgctatgcgacatcggggagtcctcaccaaatcccactattgaggaaggaaggacactccgggtgctgaaaatggtcgagccttggttgcgcggtaaccaattctgtatcaagattctgaatccgtatatgcccagcgtggttgaaaccctcgagcagatgcagagaaagcacggcgggatgcttgtaaggaacccactgtcgcgaaattctactcatgagatgtactgggtgagttgcggaacaggcaacatcgtctccgcagtgaatatgaccagccggatgttactgaaccgttttacgatggcccacagaaaacctacctatgaacgcgatgttgacttgggtgctgggacaaggcacgtggccgtcgagcccgaagtggcaaacctcgatataattggacagcggatcgagaatatcaagcatgaacacaaatcaacttggcattacgacgaggataacccttataagacctgggcctaccacggctcctatgaggtaaaaccatctggcagcgctagttccatggtgaatggggttgtcaagctgctaacaaagccctgggacgtgattcctatggtgactcaaatagcgatgaccgatacaaccccattcggacagcagagagtctttaaagaaaaggttgacactcgcacgcccaaagccaagaggggtacagcacaaatcatggaggtgaccgctaaatggctttggggcttcctgagccgaaacaagaagccgcggatttgtactagagaagagtttaccaggaaagtacgctctaatgccgcaatcggggccgtgttcgtcgacgaaaaccagtggaactcagctaaggaggccgtggaggatgaacgtttttgggacctcgttcataaagagcgggaactgcacaagcagggaaaatgcgcgacatgcgtgtacaacatgatgggcaagagagagaagaaattgggtgagttcgggaaggcaaaaggaagtagggccatttggtacatgtggctgggcgctcgctttctcgagttcgaggcccttggcttcatgaatgaagatcactggttttcccgagagaacagcctgtctggggtcgaaggagagggtttacataagctgggctatatcttgcgggacatatcgaaaatccctgggggaaatatgtacgcagatgacacggctggctgggataccagaattactgaggacgatctccagaacgaagccaggatcacagacattatggagccagaacacgctctgctagccaagtcaatcttcaaacttacctatcaaaataaggtggtacgcgttcagagacccgcaaagaacggtactgtgatggatgtcataagccggagggaccagcgtgggtccggacaggtgggcacatacggcctgaatacctttacaaacattgaggcgcaactcatccgacagatggaaagtgaggggatcttctctcctagcgagctggaaactccaaacttggccgagcgcgtgttagattggctggaaaaatatggagtcgagagactcaagcggatggctatttccggtgacgactgtgttgtgaaacccatagatgacaggtttgccaccgcacttacggctctgaatgatatgggcaaggtacgcaaagacatcccgcagtgggaaccttcaaaggggtggaacgattggcagcaagtgcccttctgcagtcatcactttcaccagctaattatgaaggacggaagagagatcgtcgtgccatgtcggaatcaggatgagctggttggcagggcccgagtgtctcagggtgcagggtggagcctccgtgaaaccgcctgcttgggaaaatcctacgcgcaaatgtggcagctgatgtatttccatagacgcgaccttcggctggctgccaacgcaatttgttcagccgtccctgtggattggatccccacaagcaggactacctggtctatacacgctcatcaccagtggatgacaactgaggacatgctctccgtatggaatagagtttggatcgaagagaacccatggatggaagataagacccatattagtagctggggcgacgtgccctacttaggcaaacgcgaggaccaatggtgcgggtcgctgatcggattgacggcccgggcaacatgggctaccaatattcaggtcgccatcaaccaggtgaggcgactgattggtaatgagaactacctcgattatatgacttccatgaagagatttaaaaatgaatctgaccctgagggcgcgctttggtga

SEQ ID NO: 13308 - RNA, 9879 nt, synthetic construct
  misc_feature 1..9879: note = derived and/or modified CDS sequence (opt3) from DENV-1__HM181939__SS-prME
  source 1..9879: mol_type = other RNA
agcgtgaccatgctgctcatgcttatgcccaccgcactggctttccacttgactacgagaggaggggaacctcatatgatcgtctccaagcaggaaaggggaaaatctttactgtttaagacctcagccggtgttaacatgtgcacactgattgccatggacctcggcgagttctgtgaagatactatgacctacaaatgcccacggataagtgaagcggaaccggacgatgtggactgttggtgcaatgctacagatacctgggtaacttatgggacatgtagccaaaccggagagcaccgccgagacaagcgttccgtggccctggcaccccatgtcggccttggtctggagacgagaactgaaacctggatgtcttcggagggggcctggaaacagatccagagggtggaaacatgggctttgcggcaccctggatttactgttattgcactcttcctggcccatgctatcggcacctcaattacacagaagggcatcatatttatcctgctcatgttagtgaccccaagcatggccatgcgctgcgtcgggattggaagtagagatttcgtggagggtctgtccggcgcgacgtgggtagacgttgtgcttgagcacgggtcttgtgtcactacaatggcaaaggataaacccaccttggacatcgaactgctaaagactgaggtgacaaaccctgccgtgctcaggaaactgtgcattgaagctaagatcagcaataccacgaccgattcccggtgtccaacacaaggagaggccactcttgtcgaagaacaagacgcaaactttgtttgccgccgaaccttcgtggatagaggctggggtaatgggtgtggactgtttggcaaaggctcattgataacatgcgctaagttcaagtgcgtaactaaactcgaggggaagattgtgcagtacgaaaacctgaaatatagtgtcatcgtgaccgttcacacaggagaccagcatcaagtgggtaatgagagcaccgaacacggcactacggccacaattacaccccaggcgccttctactgagatccagttaaccgactacggggccctgacactcgattgttccccaaggaccggacttgactttaacgaaatggtcctgttgactatgaaggagaaatcatggctagtgcataagcagtggttcctggatctcccgctgccctggacaagcggcgcaagtacgtctcaagagacctggaatcggcaggaccttctggtaacttttaaaacagctcacgccaagaagcaggaagttgtggtcttgggttcccaagagggggctatgcacaccgccctcacaggcgcaactgaaatccagaccagcggaacgaccacaattttcgccggccatctgaaatgccgtttaaagatggataaactgactctaaaggggatgtcgtatgtgatgtgtaccggatctttcaaactcgagaaggaagtcgctgagacacagcacggtactgtgctggttcagataaagtacgagggcaccgacgcgccttgcaaaatcccattttccacgcaagatgaaaagggggtgacacagaacggacgccttattaccgcaaatcccatcgtaactgacaaagagaagcctgtcaacatagaagccgagccacccttcggcgagtcatatattgtgatcggtgctggggaaaaagccttgaagctgagttggtttaagaaaggcagctccatcggaaagatgttcgaggcaacagccagaggcgctaggcggatggccattctcggggataccgcatgggactttggatctatcggtggcgttttcactagcgtggggaaactggtccatcagatttttggaaccgcgtacggcgtgcttttctcaggtgtaagttggacaatgaagatagggatcggcgtgctgttgacgtggctcggactaaattcccgaagcacctctttatcaatgacttgtattgctgttggcctggtcacactatacctcggggtgatggtgcaggccgatagtggatgcgtcatcaactggaaaggccgcgaactgaagtgtggtagcgggatctttgttaccaatgaggtgcacacatggactgaacaatataagttccaggcagactccccgaaaagactttctgccgctattggaaaggcctgggaggagggcgtgtgcggtataaggtcggcaacccggttggaaaacatcatgtggaaacagattagcaacgagctgaatcatatcctcctggaaaacgacatgaagtttacggtagtcgtgggcgatgttgctgggattttagcccagggcaagaagatgatccgccctcaacccatggagtacaaatattcctggaagtcatggggcaaggcgaaaataatcggggccgacgtgcagaatacaaccttcattatcgatggaccaaacactcctgaatgtcccgacgatcagagagcttggaatatttgggaggtcgaggactacggctttggtatcttcaccacaaacatatggctgaaacttagggatagttatactcaggtgtgcgaccaccgtttgatgtctgcagccattaaagatagcaaggctgttcacgccgacatggggtactggatcgaatccgagaaaaatgaaacctggaagctcgcacgggcgtcattcattgaggtgaagacatgtatctggccaaaaagccatacgctgtggtctaacggagtactagaatccgagatgataatccccaagatttatggcggtcctatcagtcaacacaattaccgaccaggctactttacccagactgccgggccgtggcatctgggaaaactcgagctggatttcgacctttgcgaaggcacaaccgtcgtggtggatgagcactgcgggaacagaggacccagcttgaggactacaaccgtcacgggcaagattatccacgaatggtgttgccgctcttgtactctgcctccattacggtttaaaggtgaggacgggtgctggtatggaatggagataagacccgttaaggaaaaggaggaaaatctcgtgaaatccatggtatcagctggcagtggtgaggtggacagcttctcgctgggccttctgtgtatttccatcatgatcgaagaggtcatgaggtctcgctggagccgaaagatgttgatgaccgggacactcgccgtgtttttcctgctaattatgggacagctgacctggaacgatctcatccggctgtgcattatggttggcgcaaatgcttcagaccgtatggggatgggaatgacttaccttgccttgatggcaacatttaaaatgagacctatgttcgccgtgggcctgttatttaggcgcctcaccagtcgggaggtcctgcttctgacaataggtctatccctcgtggcttctgttgaactgccaaacagcttggaggaactgggggatggattagcgatgggcatcatgattctcaagctgcttactgacttccaatcccatcagctgtgggccaccttgctctcactgacgtttatcaaaacaaccttcagcctacactatgcatggaagactatggctatggtgctgagtattgtctctctttttcccctctgtctgtccaccacaagccagaagactacctggttgccggtactgttaggctcgctcgggtgcaaacctctgacgatgttccttatcgccgagaataagatatggggaagaaaatcatggccactgaacgaaggtatcatggccgtgggcattgtttctatcttgctcagttccctgctaaagaacgatgtgcccctggctgggcctcttattgcaggaggcatgctcatcgcctgttacgtcataagcggttctagcgcggacctgtccttggagaaagctgccgaggtgtcatgggaagaggaagcagagcatagtggggccagccacaatattttagtagaagtgcaggatgacggaacaatgaagatcaaagatgaggagagggacgataccctgactatcctcctgaaggctacacttctggcagtctctggcgtttatcccttgtccattccagccaccctattcgtgtggtacttttggcaaaagaaaaagcagcgatcaggcgtgctgtgggacactcctagtcccccagaagtcgagcgcgcggtgctcgatgacgggatatatcggatcatgcagagaggactgcttggtaggagccaggttggcgtaggggtgttccaagaaaacgtctttcatacaatgtggcacgtgacccgtggagctgttttaatgtaccagggcaaacgcctggagccgtcctgggcctctgtgaagaaagacctcatttcgtacggtgggggatggcggttgcagggcagctggaatacgggcgaggaagtccaggtgatcgcagtagagcctgggaagaaccccaagaatgtccaaactgccccaggaaccttcaaaacatcagaaggtgaggtgggcgctattgccctggattttaagcccgggacctccggaagtcctatcgttaacagagaaggcaaaatagtgggtctctatgggaatggagtcgtgacaacttctggcacctacgttagcgcaatcgctcaggccaaggcgtcccaggagggcccactgcccgagattgaagacgaggtgttcaggaaacgaaaccttacgatcatggatctgcaccctgggtcaggaaagacacggcgctatttgccggccattgtcagagaagcaatcaagaggaaactacggactctgatactcgctccaacccgagtggtagcctctgagatggctgaagcattaaagggtatgcccattagataccaaacaaccgccgtgaaaagcgagcatactggcaaggagatcgttgacctgatgtgccacgccacctttacaatgcgccttctgagtcctgtcagggtgccaaattataacatgatcattatggatgaagctcatttcacggacccctccagcatcgcggcacgtgggtacatatctactcgggtgggaatgggcgaggccgctgccatttttatgaccgcaacacctccgggttcagtcgaagccttcccccagtccaatgctgtaatccaggatgaggaaagagacattccagagaggagttggaacagcgggtatgagtggatcaccgattttcctggaaaaactgtgtggttcgttccctcgataaagtctggcaatgacattgcgaactgtctccgcaagaatggcaaacgagtgatccagttgtccagaaagacattcgataccgaataccagaagacgaagaacaacgactgggactacgtcgtgactacagatatcagcgagatgggggccaattttcgggcagacagggttattgatccacgccgttgcctgaaacctgtgatcctcaaggacggacccgaaagagtcattctggctggtccaatgccggtgaccgtagcctcagcagcccagcggaggggccgcatagggcgaaaccacaataaggagggagatcagtatatctacatgggccagcctcttaacaatgacgaggatcatgctcactggaccgaagccaaaatgctactggacaacattaatactcccgagggtatcatcccagcgttgttcgaacccgagagagaaaagagtgcagccattgatggggagtatcggttaaggggcgaggctcgcaaaacatttgtggaactgatgagaaggggagacctccctgtttggctgtcttacaaggtcgcctccgagggcttccaatatagcgatcggcgttggtgctttgacggggaacgcaacaatcaggtgcttgaggaaaacatggatgtggagatatggaccaaagagggagaacgaaagaaactgagaccaaggtggctcgacgctcggacatactcagaccccttggcactgcgcgagttcaaggaatttgccgctggtagaaggagtgtcagcggcgatctaatcctggagattgggaagctccctcagcaccttactcagcgggcccaaaatgcactggacaacttagttatgttgcataattccgaacagggaggccgagcgtatagacacgccatggaggagctgccggatacgatcgaaaccctcatgctgcttgctctgattgccgtgctcacaggtggggtaactttgttctttctgtctggccgcggattaggcaaaaccagcatcgggctactgtgtgtgatggcatcctcagtcctcctttggatggcttctgtggagccacattggatagccgcaagtatcattctggagttctttttgatggttctgctcatccccgagcctgacaggcagcggacaccccaggataaccaactggcctacgtggtcattggacttctcttcatgatcctgaccgtagctgcgaatgagatgggtttgctggaaactacgaagaaagacttaggcatagggcacgtggccgttgagaaccaccatcacgcagctatgctagatgtggacctgcatccagcctcggcctggaccctctacgcagtcgctacaactattatcacccctatgatgcgtcacacaattgaaaacaccactgccaatatcagccttacagcgatagctaaccaggccgcaatcctgatgggattggataagggctggcccatttccaaaatggacatcggtgtgccactgctcgccctggggtgctattctcaggtcaatcctcttacgttaaccgctgcagtgctgatgctcgttgcccattacgcgattatcggcccgggattgcaagctaaggccactagagaggcacagaagaggacagccgctggcataatgaaaaaccccaccgtggatgggattgtagccatcgacctggatccagtggtctatgacgcaaagtttgaaaaacagctaggacagatcatgctgctcattctttgtacctcacaaatcctgttgatgcgcacaacttgggctctgtgcgagagcataacgctcgccaccggccctctgacaactttatgggagggttcccccgggaagttctggaataccacaattgcggttagtatggccaacatcttccggggatcttaccttgcaggcgctggtctggcctttagcctcatgaaatcactaggcgggggacgaagaggcaccggggcacagggagaaactctgggcgagaagtggaagaggcagttgaatcagctgtccaaaagtgagttcaacacgtataagcgcagcggtattatggaggtggaccggtctgaagctaaagaggggctcaagagaggagagacaaccaaacacgccgtctcccgtggcactgccaaacttaggtggtttgtggaacggaatctggtaaagccagagggtaaagtgatcgatttgggctgtgggcgcggaggctggtcatactattgcgcggggctgaagaaagttaccgaagtgaagggatacacaaaaggcggtcctgggcacgaggaacccataccgatggctacttacggatggaacctcgtcaagttacatagcggcaaagacgtgttctttgtcccacctgagaagtgtgataccctgctttgcgacatcggcgagtcgtctcccaatccaacaattgaagaggggcgaacgctgagagtgctaaagatggttgaaccctggctcaggggaaaccaattctgtatcaaaattctgaatccttatatgccgagtgtagtggagaccttggagcagatgcagcggaagcacggtggcatgctggtccgcaaccccctctccagaaatagcactcatgaaatgtactgggtgtcatgcgggacaggaaacatcgtttccgcaattaatatgacctctaggatgcttctgaaccgatttactatggcccaccggaaaccaacatatgagcgtgatgtggacttaggcgctggtaccagacacgtcgccgtggaacctgaggtagcaaacctggatatcatagggcagcgcattgaaaatatcaagcatgagcacaaaagcacgtggcattacgacgaggataacccctataagacctgggcctaccacggaagttatgaagtgaagccttccggcagcgcttcttcaatggttaatggcgtcgtgaaattgctcacaaagccatgggacgtgatccccatggtcactcaaattgcgatgaccgatacaactcctttcgggcagcagagggtttttaaagagaaggtggacacccggacaccaaaagccaagagaggaaccgcacaaataatggaagtaactgctaagtggctgtggggtttcctaagtcgcaacaaaaagcccaggatctgtacgcgagaggaatttacacggaaagtgagatccaatgccgcaattggcgccgtcttcgtggacgagaaccagtggaatagcgctaaggaggccgttgaagatgagaggttttgggaccttgtgcatcgcgaacgtgagctgcacaaacaggggaagtgcgcgacctgcgtctacaacatgatgggaaagcgggagaaaaagctcggcgagttcggtaaagcaaaggggtctagagccatctggtacatgtggctgggagctaggttcttggagtttgaagccctgggcttcatgaatgaggatcactggttttcgcgcgaaaactcactcagcggcgtggagggggagggacttcataaactgggttatattttacgagacatctccaagataagtggcgggaatatgtacgcagatgacactgctggatgggatacccggatcacagaagacgatctgcagaacgaggccaaaattacggacatcatggaaccggagcacgctttgctcgccaattctattttcaagctgacctatcaaaacaaggtagttagagtgcagaggcctgccaaaaatggcactgtcatggatgtgatcagccgcagagaccagcggggttccggacaggtgggaacatacggcctaaacacctttactaacatggaagcgcaacttataaggcagatggagtcagagggcattttcagtccatctgaactggagacacccaatctcgccgaacgtgtcctggattggttggagaagcatggggttgaacgattaaaacgcatggctatcagcggagacgactgtgtggtaaagcctatcgatgacagatttgccaccgcactgacagctctcaacgatatgggtaaagtgcggaaggacattccacagtgggagccctccaagggctggaatgattggcagcaagtcccgttctgctcacaccactttcatcagcttataatgaaagacgggagggagatcgtggttccttgtcgcaaccaggatgaactggtggggagagcacgggtcagccagggcgcaggttggtctctaagggagactgcctgcctggggaagtcctatgcgcaaatgtggcagctcatgtacttccaccgacgtgacttgagactggctgccaatgcaatttgtagtgccgtgcccgtagattgggttccaaccagccgcacgacctggtcgatccatgctcaccatcagtggatgacaactgaagacatgctttccgtgtggaaccgggtctggattgaggaaaatccttggatggaggataaaacccacatctcttcatgggaggacgtgccctatctgggaaagagggaagaccaatggtgcggcagcctcataggcttaacagccagagcaacttgggctaccaacatccaggttgccattaatcaggtgcgccggctgatcgggaacgagaattacttggattacatgacgagtatgaaaaggtttaagaacgaatccgacccagagggagcgctgtggtga

SEQ ID NO: 13309 - RNA, 9879 nt, synthetic construct
  misc_feature 1..9879: note = derived and/or modified CDS sequence (opt3) from DENV-1__HM181942__SS-prME
  source 1..9879: mol_type = other RNA
agcgtgaccatgctgctcatgcttatgcccaccgcactggctttccacttgactacgagaggaggggaacctcatatgatcgtctccaagcaggaaaggggaaaatctttactgtttaagacctcagccggtgttaacatgtgcacactgattgccatggacctcggcgagttctgtgaagatactatgacctacaaatgcccacggataagtgaagcggaaccggacgatgtggactgttggtgcaatgctacagatacctgggtaacttatgggacatgtagccaaaccggagagcaccgccgagacaagcgttccgtggccctggcaccccatgtcggccttggtctggagacgagaactgaaacctggatgtcttcggagggggcctggaaacagatccagagggtggaaacatgggctttgcggcaccctggatttactgttattgcactcttcctggcccatgctatcggcacctcaattacacagaagggcatcatatttatcctgctcatgttagtgaccccaagcatggccatgcgctgcgtcgggattggaagtagagatttcgtggagggtctgtccggcgcgacgtgggtagacgttgtgcttgagcacgggtcttgtgtcactacaatggcaaaggataaacccaccttggacatcgaactgctaaagactgaggtgacaaaccctgccgtgctcaggaaactgtgcattgaagctaagatcagcaataccacgaccgattcccggtgtccaacacaaggagaggccactcttgtcgaagaacaagacgcaaactttgtttgccgccgaaccttcgtggatagaggctggggtaatgggtgtggactgtttggcaaaggctcattgataacatgcgctaagttcaagtgcgtaactaaactcgaggggaagattgtgcagtacgaaaacctgaaatatagtgtcatcgtgaccgttcacacaggagaccagcatcaagtgggtaatgagagcaccgaacacggcactacggccacaattacaccccaggcgccttctactgagatccagttaaccgactacggggccctgacactcgattgttccccaaggaccggacttgactttaacgaaatggtcctgttgactatgaaggagaaatcatggctagtgcataagcagtggttcctggatctcccgctgccctggacaagcggcgcaagtacgtctcaagagacctggaatcggcaggaccttctggtaacttttaaaacagctcacgccaagaagcaggaagttgtggtcttgggttcccaagagggggctatgcacaccgccctcacaggcgcaactgaaatccagaccagcggaacgaccacaattttcgccggccatctgaaatgccgtttaaagatggataaactgactctaaaggggatgtcgtatgtgatgtgtaccggatctttcaaactcgagaaggaagtcgctgagacacagcacggtactgtgctggttcagataaagtacgagggcaccgacgcgccttgcaaaatcccattttccacgcaagatgaaaagggggtgacacagaacggacgccttattaccgcaaatcccatcgtaactgacaaagagaagcctgtcaacatagaagccgagccacccttcggcgagtcatatattgtgatcggtgctggggaaaaagccttgaagctgagttggtttaagaaaggcagctccatcggaaagatgttcgaggcaacagccagaggcgctaggcggatggccattctcggggataccgcatgggactttggatctatcggtggcgttttcactagcgtggggaaactggtccatcagatttttggaaccgcgtacggcgtgcttttctcaggtgtaagttggacaatgaagatagggatcggcgtgctgttgacgtggctcggactaaattcccgaagcacctctttatcaatgacttgtattgctgttggcctggtcacactatacctcggggtgatggtgcaggccgatagtggatgcgtcatcaactggaaaggccgcgaactgaagtgtggtagcgggatctttgttaccaatgaggtgcacacatggactgaacaatataagttccaggcagactccccgaaaagactttctgccgctattggaaaggcctgggaggagggcgtgtgcggtataaggtcggcaacccggttggaaaacatcatgtggaaacagattagcaacgagctgaatcatatcctcctggaaaacgacatgaagtttacggtagtcgtgggcgatgttgctgggattttagcccagggcaagaagatgatccgccctcaacccatggagtacaaatattcctggaagtcatggggcaaggcgaaaataatcggggccgacgtgcagaatacaaccttcattatcgatggaccaaacactcctgaatgtcccgacgatcagagagcttggaatatttgggaggtcgaggactacggctttggtatcttcaccacaaacatatggctgaaacttagggatagttatactcaggtgtgcgaccaccgtttgatgtctgcagccattaaagatagcaaggctgttcacgccgacatggggtactggatcgaatccgagaaaaatgaaacctggaagctcgcacgggcgtcattcattgaggtgaagacatgtatctggccaaaaagccatacgctgtggtctaacggagtactagaatccgagatgataatccccaagatttatggcggtcctatcagtcaacacaattaccgaccaggctactttacccagactgccgggccgtggcatctgggaaaactcgagctggatttcgacctttgcgaaggcacaaccgtcgtggtggatgagcactgcgggaacagaggacccagcttgaggactacaaccgtcacgggcaagattatccacgaatggtgttgccgctcttgtactctgcctccattacggtttaaaggtgaggacgggtgctggtatggaatggagataagacccgttaaggaaaaggaggaaaatctcgtgaaatccatggtatcagctggcagtggtgaggtggacagcttctcgctgggccttctgtgtatttccatcatgatcgaagaggtcatgaggtctcgctggagccgaaagatgttgatgaccgggacactcgccgtgtttttcctgctaattatgggacagctgacctggaacgatctcatccggctgtgcattatggttggcgcaaatgcttcagaccgtatggggatgggaatgacttaccttgccttgatggcaacatttaaaatgagacctatgttcgccgtgggcctgttatttaggcgcctcaccagtcgggaggtcctgcttctgacaataggtctatccctcgtggcttctgttgaactgccaaacagcttggaggaactgggggatggattagcgatgggcatcatgattctcaagctgcttactgacttccaatcccatcagctgtgggccaccttgctctcactgacgtttatcaaaacaaccttcagcctacactatgcatggaagactatggctatggtgctgagtattgtctctctttttcccctctgtctgtccaccacaagccagaagactacctggttgccggtactgttaggctcgctcgggtgcaaacctctgacgatgttccttatcgccgagaataagatatggggaagaaaatcatggccactgaacgaaggtatcatggccgtgggcattgtttctatcttgctcagttccctgctaaagaacgatgtgcccctggctgggcctcttattgcaggaggcatgctcatcgcctgttacgtcataagcggttctagcgcggacctgtccttggagaaagctgccgaggtgtcatgggaagaggaagcagagcatagtggggccagccacaatattttagtagaagtgcaggatgacggaacaatgaagatcaaagatgaggagagggacgataccctgactatcctcctgaaggctacacttctggcagtctctggcgtttatcccttgtccattccagccaccctattcgtgtggtacttttggcaaaagaaaaagcagcgatcaggcgtgctgtgggacactcctagtcccccagaagtcgagcgcgcggtgctcgatgacgggatatatcggatcatgcagagaggactgcttggtaggagccaggttggcgtaggggtgttccaagaaaacgtctttcatacaatgtggcacgtgacccgtggagctgttttaatgtaccagggcaaacgcctggagccgtcctgggcctctgtgaagaaagacctcatttcgtacggtgggggatggcggttgcagggcagctggaatacgggcgaggaagtccaggtgatcgcagtagagcctgggaagaaccccaagaatgtccaaactgccccaggaaccttcaaaacatcagaaggtgaggtgggcgctattgccctggattttaagcccgggacctccggaagtcctatcgttaacagagaaggcaaaatagtgggtctctatgggaatggagtcgtgacaacttctggcacctacgttagcgcaatcgctcaggccaaggcgtcccaggagggcccactgcccgagattgaagacgaggtgttcaggaaacgaaaccttacgatcatggatctgcaccctgggtcaggaaagacacggcgctatttgccggccattgtcagagaagcaatcaagaggaaactacggactctgatactcgctccaacccgagtggtagcctctgagatggctgaagcattaaagggtatgcccattagataccaaacaaccgccgtgaaaagcgagcatactggcaaggagatcgttgacctgatgtgccacgccacctttacaatgcgccttctgagtcctgtcagggtgccaaattataacatgatcattatggatgaagctcatttcacggacccctccagcatcgcggcacgtgggtacatatctactcgggtgggaatgggcgaggccgctgccatttttatgaccgcaacacctccgggttcagtcgaagccttcccccagtccaatgctgtaatccaggatgaggaaagagacattccagagaggagttggaacagcgggtatgagtggatcaccgattttcctggaaaaactgtgtggttcgttccctcgataaagtctggcaatgacattgcgaactgtctccgcaagaatggcaaacgagtgatccagttgtccagaaagacattcgataccgaataccagaagacgaagaacaacgactgggactacgtcgtgactacagatatcagcgagatgggggccaattttcgggcagacagggttattgatccacgccgttgcctgaaacctgtgatcctcaaggacggacccgaaagagtcattctggctggtccaatgccggtgaccgtagcctcagcagcccagcggaggggccgcatagggcgaaaccacaataaggagggagatcagtatatctacatgggccagcctcttaacaatgacgaggatcatgctcactggaccgaagccaaaatgctactggacaacattaatactcccgagggtatcatcccagcgttgttcgaacccgagagagaaaagagtgcagccattgatggggagtatcggttaaggggcgaggctcgcaaaacatttgtggaactgatgagaaggggagacctccctgtttggctgtcttacaaggtcgcctccgagggcttccaatatagcgatcggcgttggtgctttgacggggaacgcaacaatcaggtgcttgaggaaaacatggatgtggagatatggaccaaagagggagaacgaaagaaactgagaccaaggtggctcgacgctcggacatactcagaccccttggcactgcgcgagttcaaggaatttgccgctggtagaaggagtgtcagcggcgatctaatcctggagattgggaagctccctcagcaccttactcagcgggcccaaaatgcactggacaacttagttatgttgcataattccgaacagggaggccgagcgtatagacacgccatggaggagctgccggatacgatcgaaaccctcatgctgcttgctctgattgccgtgctcacaggtggggtaactttgttctttctgtctggccgcggattaggcaaaaccagcatcgggctactgtgtgtgatggcatcctcagtcctcctttggatggcttctgtggagccacattggatagccgcaagtatcattctggagttctttttgatggttctgctcatccccgagcctgacaggcagcggacaccccaggataaccaactggcctacgtggtcattggacttctcttcatgatcctgaccgtagctgcgaatgagatgggtttgctggaaactacgaagaaagacttaggcatagggcacgtggccgttgagaaccaccatcacgcagctatgctagatgtggacctgcatccagcctcggcctggaccctctacgcagtcgctacaactattatcacccctatgatgcgtcacacaattgaaaacaccactgccaatatcagccttacagcgatagctaaccaggccgcaatcctgatgggattggataagggctggcccatttccaaaatggacatcggtgtgccactgctcgccctggggtgctattctcaggtcaatcctcttacgttaaccgctgcagtgctgatgctcgttgcccattacgcgattatcggcccgggattgcaagctaaggccactagagaggcacagaagaggacagccgctggcataatgaaaaaccccaccgtggatgggattgtagccatcgacctggatccagtggtctatgacgcaaagtttgaaaaacagctaggacagatcatgctgctcattctttgtacctcacaaatcctgttgatgcgcacaacttgggctctgtgcgagagcataacgctcgccaccggccctctgacaactttatgggagggttcccccgggaagttctggaataccacaattgcggttagtatggccaacatcttccggggatcttaccttgcaggcgctggtctggcctttagcctcatgaaatcactaggcgggggacgaagaggcaccggggcacagggagaaactctgggcgagaagtggaagaggcagttgaatcagctgtccaaaagtgagttcaacacgtataagcgcagcggtattatggaggtggaccggtctgaagctaaagaggggctcaagagaggagagacaaccaaacacgccgtctcccgtggcactgccaaacttaggtggtttgtggaacggaatctggtaaagccagagggtaaagtgatcgatttgggctgtgggcgcggaggctggtcatactattgcgcggggctgaagaaagttaccgaagtgaagggatacacaaaaggcggtcctgggcacgaggaacccataccgatggctacttacggatggaacctcgtcaagttacatagcggcaaagacgtgttctttgtcccacctgagaagtgtgataccctgctttgcgacatcggcgagtcgtctcccaatccaacaattgaagaggggcgaacgctgagagtgctaaagatggttgaaccctggctcaggggaaaccaattctgtatcaaaattctgaatccttatatgccgagtgtagtggagaccttggagcagatgcagcggaagcacggtggcatgctggtccgcaaccccctctccagaaatagcactcatgaaatgtactgggtgtcatgcgggacaggaaacatcgtttccgcagtgaatatgacctctaggatgcttctgaaccgatttactatggcccaccggaaaccaacatatgagcgtgatgtcgacttaggcgctggtaccagacacgtggccgtagaacctgaggtggcaaacctggatattatcgggcagcgcatagaaaatattaagcatgagcacaaaagcacgtggcattacgacgaggataacccctataagacctgggcctaccacggaagttatgaagttaagccttccggcagcgcttcttcaatggtcaatggcgtggtgaaattgctcacaaagccatgggacgtcatccccatggttactcaaatcgcgatgaccgatacaactcctttcgggcagcagagggtgtttaaagagaaggtagacacccggacaccaaaagccaagagaggaaccgcacaaattatggaagtgactgctaagtggctgtggggtttcctaagtcgcaacaaaaagcccaggatatgtacgcgagaggaatttacacggaaagtcagatccaatgccgcaatcggcgccgtgttcgttgacgagaaccagtggaatagcgctaaggaggccgtggaagatgagaggttttgggaccttgtccatcgcgaacgtgagctgcacaaacaggggaagtgcgcgacctgcgtgtacaacatgatgggaaagcgggagaaaaagctcggcgagttcggtaaagcaaaggggtctagagccatttggtacatgtggctgggagctaggttcttggagtttgaagccctgggcttcatgaatgaggatcactggttttcgcgcgaaaactcactcagcggcgtagagggggagggacttcataaactgggttatatcttacgagacatttccaagatcagtggcgggaatatgtacgcagatgacactgctggatgggatacccggataacagaagacgatctgcagaacgaggccaaaatcacggacattatggaaccggagcacgctttgctcgccaattctatcttcaagctgacctatcaaaacaaggttgtgagagtccagaggcctgccaaaaatggcactgtgatggatgtgattagccgcagagaccagcggggttccgggcaggtcggaacatacggcctaaacacctttactaacatggaagcgcaacttatcaggcagatggagtcagagggcatattcagtccatctgaactggagacacccaatctcgccgaacgtgttctggattggttggagaagcatggggtggaacgattaaaacgcatggctattagcggagacgactgtgtagtgaagcctatcgatgacagatttgccaccgcactgacagctctcaacgatatgggtaaagtccggaaggacatcccacagtgggagccctccaagggctggaatgattggcagcaagtgccgttctgctcacaccactttcatcagcttattatgaaagacgggagggagatagttgtgccttgtcgcaaccaggatgaactggtcggcagagcacgggtgagccagggagcaggttggtctctaagggagactgcctgcctggggaagtcctatgcgcaaatgtggcagctcatgtacttccaccgacgtgacttgagactggctgccaatgcaatctgtagtgccgtacccgttgattgggtgccaaccagccgcacgacctggtcgattcatgctcaccatcagtggatgacaactgaagacatgctttccgtctggaaccgggtgtggatcgaggaaaatccttggatggaggataaaacccacatttcttcatgggaggacgttccctatctgggaaagagggaagaccaatggtgcggcagcctcatcggcttaacagccagagcaacttgggctaccaacatacaggtggccatcaatcaggtccgccggctgattgggaacgagaattacttggattacatgacgagtatgaaaaggtttaagaacgaatccgacccagagggagcgctgtggtga

SEQ ID NO: 13310 - RNA, 9879 nt, synthetic construct
  misc_feature 1..9879: note = derived and/or modified CDS sequence (opt3) from DENV-1__HM488255__SS-prME
  source 1..9879: mol_type = other RNA
agcgtgaccatgctgctcatgcttatgcccactgcactggctttccacttgactacgcggggaggggagcctcatatgatcgtctccaagcaggaaaggggaaaatctttactgtttaagacctcagccggtgttaacatgtgcacactaattgccatggacctcggcgagctgtgtgaagatactatgacctacaaatgcccacggataacagaggcggaaccggacgatgtggactgttggtgcaatgctaccgatacttgggtaacatatgggacctgtagtcaaacgggagagcaccgccgagacaagcgtagcgtggcccttgcaccccatgtcggcctgggtttggagactagaaccgaaacatggatgtcctctgagtcggcctggaaacagatccagagggtggaaacttgggctctccggcaccctgggttcaccgttattgcactgtttctggcccatgctatcggaacatcaattacccagaagggcatcatattcatcctcttaatgctggtgacgccaagcatggccatgcgctgcgtcggcattgggagtcgggattttgtggagggactttccggtgcgacttgggtagacgttgtgttggagcacggctcttgtgtcacaaccatggcaaaggataaacccactctggacatcgaactactcaagacagaggtgaccaaccctgccattctgaggaaactttgcatcgaagctaagataagcaatacgaccacagattcccggtgtccaactcaaggggaggccaccctggtggaagaacaagacgcaaacttcgtctgccgccgaacatttgttgataggggatggggcaatggttgtgggttgttcggaaaaggctcactcattacttgcgctaagtttaagtgcgtgaccaaactggagggcaagatcgtacagtacgaaaacttaaaatatagtgtgattgtcacagtgcacaccggggaccagcatcaagttggaaatgagagcactgaacacggtacgacagccaccatcactccccaggcgcctaccacagagatccagctgaccgactacggcgccctcactcttgattgttctccaaggacagggctggacttcaacgaaatggtgttgctaacgatgaaggagaaatcctggctggtccataagcagtggtttctcgatctgccgcttccctggacctcaggagcaagcacaagtcaagagacatggaatcggcaggacctgttggtgaccttcaaaacagctcacgccaagaagcaggaagtagttgtgctcggctctcaagagggtgctatgcacactgccctgaccggggcaacggaaattcagacctccggcacaactaccatatttgccggacatttaaaatgccgtctgaagatggataaactaacactcaagggcatgagctatgtcatgtgtactgggtcgttcaaactggagaaggaagtggctgagacccagcacggaacggtccttgtgcagatcaagtacgagggtacagacgcgccttgcaaaattccattctctacccaagatgaaaagggcgttactcagaacgggcgcttgatcacagcaaatcccatagtgaccgacaaagagaagcctgtaaacattgaagccgagccaccctttggagagtcctatatcgtcatcggcgctggtgaaaaagccctgaagctctcatggttcaagaaagggagtagcattggcaagatgtttgaggcaactgccagaggagctaggcggatggccatcctgggcgataccgcatgggacttcgggtccattggaggtgtgtttacatctgttggcaaacttgtgcatcagatattcgggacggcgtacggagtcctgtttagcggcgtgtcatggaccatgaagatcggtattggggtattgctcacttggctgggcttaaatagtcgatccacaagcctgtctatgacctgtatcgctgtgggcctagttacactctacctgggcgtcatggtgcaggccgattcagggtgcgtgatcaactggaaaggacgcgaacttaagtgtggcagtggtattttcgtcactaatgaggttcacacctggacggaacaatataagtttcaggcagacagcccgaaaagattgtccgccgctatagggaaggcctgggaggagggagtgtgcggcatcaggtctgcaacacggctggaaaacattatgtggaaacagatctcgaacgagctcaatcatattctgttagaaaacgacatgaagttcaccgtggtagtcggtgatgtggctggcatcctggcccaggggaaaaagatgatacgccctcaacccatggagtacaaatatagctggaagtcctggggaaaggcgaaaatcattggcgccgacgttcagaatactacctttatcattgatgggccaaacacacctgaatgtcccgacgatcagagagcttggaatatctgggaggtggaggactacggattcggcatatttactaccaacatttggcttaagttgagggattcatatacacaggtctgcgaccaccgtctcatgagtgcagccatcaaagattctaaggctgtgcacgccgacatgggttactggattgaaagcgagaaaaatgaaacgtggaagctggcacgggcgtccttcatcgaggttaagacctgtatatggccaaaatcacatactctatggagcaacggggtgctggaatctgagatgatcattcccaagatctatggaggccctatttcccaacacaattaccgaccaggttacttcacacagaccgccggcccgtggcatctcgggaaactggagcttgattttgacttgtgcgaaggaactacagtagtcgtggatgagcactgcggcaacagagggcccagtctgaggaccacgactgtgaccggaaagatcatacacgaatggtgttgccgcagctgtacattacctccactccggttcagaggcgaggacggttgctggtatgggatggagattaggcccgtcaaagaaaaggaggaaaatctggttaagtctatggtgtccgctggatcaggcgaggtagacagttttagccttggtctgttgtgtatctcgatcatgattgaagaggtgatgcgctcccgatggtctcggaaaatgctcatgaccggcactctggccgtcttcctactgctcatcatggggcagctgacatggaacgatcttattcgtttgtgcataatggtgggagcaaatgctagcgacagaatgggcatggggaccacatacctggccttaatggcaacttttaagatgaggcctatgttcgccgttggactcctgtttcgccggcttacctcaagagaggtgctgctactcacgatcggcctgagtttggtcgcttccgtggaactgccaaactctttagaggaactcggtgatgggctggcgatgggaattatgatccttaaactgttgacagacttccaaagccatcagctctgggccaccctgctatccctgacttttattaagaccacattctcacttcactatgcatggaaaactatggctatggttctcagcatcgtgagtctgtttcccttgtgtctgtctaccacgtcccagaagacaacctggttaccggtcctcctgggcagccttggctgcaagcctctgactatgttcttgatagccgagaataaaatctgggggaggcgatcgtggccactcaacgaaggaattatggccgtaggtatcgtgtcaattctgctatctagtctgcttaagaacgatgttcccctcgctggccctctgatcgcagggggaatgttgatagcctgttacgtgatttccggcagctctgcggacttaagcctggagaaagctgccgaggtctcctgggaagaggaagcagagcattcaggtgccagtcacaatatcctcgtggaagtacaggatgacgggacaatgaagatcaaagatgaggagcgcgacgataccctgactattcttctgaaggctacattgctagcagtgagcggagtctatcccctgtctataccagccaccctctttgtttggtacttctggcagaagaagaagcagcggtccggcgtgctgtgggacacgccttcacccccagaagtggagagagcggtccttgatgacggcatctataggattatgcagcgtgggttactgggacgcagtcaggtgggtgttggcgtattccaagaaaacgtgtttcatactatgtggcacgtcaccagaggggctgtgctcatgtaccagggaaaaagattggagccgagctgggcctccgttaagaaagacctgatctcttacggcggtgggtggaggctccagggatcgtggaatacaggcgaggaagtgcaggtcattgcagtggagcctggcaagaaccccaaaaatgtacaaaccgccccagggacattcaagactcccgaaggagaggtcggtgctatcgccctggattttaagcctggcaccagcgggtcaccaatagtgaaccgagaaggaaaaatcgttggcctttatggtaatggggtggtcacgacatccggaacttacgtgagtgcaattgctcaggccaaggcgtctcaggagggccccctgcctgagatcgaagacgaggttttccggaaacgcaacttgaccattatggatctacacccgggcagcgggaagacaagaaggtatctgccagccatcgtgcgggaagcaataaaacgaaagctcagaaccttaattctggctcccactcgcgtcgtggcctccgagatggctgaagcacttaagggaatgcctatcaggtaccaaaccacagccgtaaaatcagagcatacgggtaaggagatcgtggacctgatgtgccacgccacttttaccatgcgtctcttgtctccagttcgggtccccaattataacatgattatcatggatgaagctcatttcacagaccctagcagtatagcggcaagaggctacatttccaccagggtggggatgggagaggccgctgccatctttatgactgcaacaccgcccggcagcgtggaagccttcccacagtctaatgctgtcattcaggatgaggaacgcgacatccctgagcgatcatggaactccggttatgagtggataaccgattttcccgggaaaacggtatggttcgtgccaagtattaagagcggaaatgacatcgcgaactgtctgaggaagaatggcaagcgggttatccagctctcgaggaagacttttgatacagaataccagaaaaccaagaacaacgactgggactacgtggtcaccactgatatttctgagatgggcgccaatttccgcgcagaccgtgtgatcgatcctagacggtgcctgaaacccgttattcttaaggacgggccagaaagggtgatactagctggaccgatgcctgtcacagtggcctccgcagcccagcgccgaggtagaatcggccggaaccacaataaagagggggatcagtatatttacatgggacagcccctgaacaatgacgaggatcatgctcactggaccgaagccaagatgttgttagacaacatcaatacaccagagggcatcattcccgcgctgttcgaacctgagagggaaaagagcgcagccatagatggtgagtatcgcctcagaggggaggctaggaaaacttttgtagaactgatgcggcgtggcgaccttccagtgtggctgtcatacaaggttgccagtgagggattccaatattctgatcgccgatggtgctttgacggcgaaagaaacaatcaggtcctcgaggaaaacatggatgtggagatctggacgaaagagggggaaaggaagaaattgcggccccgctggctggacgctagaacctactccgaccctctagcactgagggagttcaaggaatttgccgctggacggcgaagcgtgtcaggtgatctcattcttgagatcggcaaactgccgcagcacttaacacagagagcccaaaatgcattggacaacctggtcatgctccataatagtgaacaaggcgggcgcgcgtataggcacgccatggaggagctgccagatactattgaaacccttatgctgctcgctttgatcgccgttctgacagggggtgtgaccttattctttctaagcgggcggggcctgggaaagacttccataggcctcctttgtgtaatggcatctagcgtgctgttgtggatggcttccgtcgagccccattggatcgccgcatcaattatcctggagttctttctcatggtgctgcttattcctgagcccgaccgtcagagaacgccacaggataaccaactcgcctacgttgtgatcgggctgttgttcatgatactgaccgtcgctgcgaatgagatgggattactagaaacaactaagaaagacctgggtattggccacgtagccgtggggaaccaccatcacgcagctatgctcgatgttgaccttcatcctgcctctgcctggaccctgtacgcagtggctacaaccatcattactcccatgatgaggcacacaatcgagaacacgaccgccaatataagtttgactgcgatcgctaaccaggccgcaattctgatgggactcgataagggctggccaatctcgaaaatggacattggtgtccctctgcttgccttagggtgctatagccaggtgaatccgctgacactcaccgctgcagtcttgatgctggtggcccattacgcgatcataggccccggactacaagctaaggccacccgcgaagcacagaaacggacagccgctggcattatgaagaacccaactgttgatgggatcgtggccatcgacctggatcctgtagtgtatgacgcaaagtttgagaaacagctcggacagattatgcttctgatcttgtgtacgtcccaaatactgctcatgcgaaccacatgggctctgtgcgaatctattactttagccaccggcccccttacaaccctgtgggagggttcaccagggaagttctggaatactacgatcgcggtcagcatggccaacatttttagaggatcctacctcgcaggcgctggtctagccttcagtctgatgaaatctttgggcagggggcgccggggaacaggcgcacagggggagaccctgggagaaaagtggaaaagacagctcaatcagcttagcaagtcagagttcaacacttataagcgttccggcatcatggaagttgacaggagtgaggctaaagaaggtctgaagagaggggaaaccacaaaacacgccgtgagccgcggaactgccaagttgcgatggtttgtcgagagaaatctggtgaaacctgaaggcaaggtaatagatctcggttgtggcagagggggatggtcttactattgcgcgggcttaaagaaagtgaccgaggttaaggggtacacaaaaggaggccccggtcacgaggaaccgatcccaatggctacgtacgggtggaacctggtgaaacttcattccggaaaagacgtcttctttattcctcccgaaaagtgtgataccctgctatgcgacatcggcgagtcaagcccaaatcccactattgaggaaggccggacactccgcgtgctgaaaatggtcgagccttggttgagagggaaccaattctgtatcaagattctgaatccgtatatgccctcggtggttgaaaccctcgagcagatgcagaggaagcacggaggtatgcttgtacgaaacccactgtctcggaatagtactcatgagatgtactgggtgtcctgcggcacagggaacatcgtcagcgcagtgaatatgacctcacgtatgttactgaacagatttacgatggcccaccgcaaacctacctatgaaagggatgttgacttgggagctggcacacggcacgtggccgtcgagcccgaagtggcaaacctcgatataattggtcagagaatcgagaatatcaagcatgaacacaaatccacttggcattacgacgaggataacccttataagacctgggcctaccacgggtcttatgaggtaaaaccaagcggaagtgcttccagcatggtgaatggcgttgtcaagctgctaacaaagccctgggacgtgattcctatggtgactcaaatagcgatgaccgatacaaccccattcggccagcagcgcgtctttaaagaaaaggttgacactaggacgcccaaagccaagcgagggacagcacaaatcatggaggtgaccgctaaatggctttggggattcctgtctcggaacaagaagccgagaatttgtactagggaagagtttacccgcaaagtacgttcaaatgccgcaatcggtgccgtgttcgtcgacgaaaaccagtggaatagtgctaaggaggccgtggaggatgaacggttttgggacctcgttcatagagagagggaactgcacaaacagggcaagtgcgcgacatgcgtgtacaacatgatggggaaacgcgagaagaagttgggagagttcggcaaagcaaagggttcccgagccatttggtacatgtggctgggggctcggtttctcgagttcgaggcccttggattcatgaatgaagatcactggtttagcagagagaactctctgtcgggcgtcgaaggcgaggggttacataaactgggatatatcttgagggacatatcaaagatccctggtggcaatatgtacgcagatgacacggctgggtgggatacccgcattactgaggacgatctccagaacgaagccagaatcacagacattatggagccagaacacgctctgctagccaaaagcatcttcaaacttacctatcaaaataaagtggtacgggttcagaggcccgcaaagaacggaactgtgatggatgtcatatcccgtcgagaccagcgcggcagtggtcaggtggggacatacggactgaatacctttacaaacatggaggcgcaactcattagacagatggaatctgagggcatcttcagcccttccgagctggaaactccaaacttggccgagcgggtgttagattggctggaaaagtatggcgtcgagaggctcaaacgcatggctatctcaggggacgactgtgttgtgaagcccattgatgacagatttgccaccgcacttacggctctgaatgatatgggaaaagtacggaaggacataccgcagtgggaacctagtaaaggttggaacgattggcagcaagtgcccttctgctctcatcactttcaccagctaatcatgaaggacggcagggagattgtcgtgccatgtcgaaatcaggatgagctggttgggcgtgccagagtgagccagggagcaggctggtccctccgcgaaaccgcctgcttgggtaagtcatacgcgcaaatgtggcagctgatgtatttccatcggagggaccttagactggctgccaacgcaatctgtagcgccgtccctgtggattggattcccacatctcgcactacctggtccatccacgctcatcaccagtggatgacaactgaggacatgctcagtgtatggaatcgggtttggatagaagagaacccatggatggaagataaaacccatatcagctcgtggggagacgtgccctacttaggaaagagggaggaccaatggtgcggctccctgattggcttgacggcccgagcaacatgggctaccaatatccaggtcgccattaaccaggtgagacggctgatcgggaatgagaactacctcgattatatgacttctatgaaaaggtttaagaatgaatcagaccctgagggagcgctttggtga

SEQ ID NO: 13311 - RNA, 9879 nt, synthetic construct
  misc_feature 1..9879: note = derived and/or modified CDS sequence (opt3) from DENV-1__HM181944__SS-prME
  source 1..9879: mol_type = other RNA
agcgtgaccatgctgctcatgcttatgcccaccgcactggctttccacttgactacgagaggaggggaacctcatatgatcgtctccaagcaggaaaggggaaaatctttactgtttaagacctcagccggtgttaacatgtgcacactaattgccatggacctcggcgaactgtgtgaagatactatgacctacaaatgcccacggataagtgaagcggaaccggacgatgtggactgttggtgcaatgctacagatacctgggtaacttatgggacatgtagccaaaccggagagcaccgccgagacaagcgttccgtggcccttgcaccccatgtcggcctgggtttggagacgagaactgaaacctggatgtcttcggagggggcctggaaacagatccagagggtggaaacatgggctctccggcaccctggattcactgttattgcactgtttctggcccatgctatcggcacctcaattacacagaagggcatcatattcatcctcttaatgctggtgaccccaagcatggccatgcgctgcgtcgggattggaagtagagattttgtggagggtctttccggcgcgacgtgggtagacgttgtgttggagcacgggtcttgtgtcactacaatggcaaaggataaacccaccctggacatcgaactactcaagactgaggtgacaaaccctgccgtgctgaggaaactttgcattgaagctaagatcagcaataccacgaccgattcccggtgtccaacacaaggagaggccactctggtcgaagaacaagacgcaaacttcgtttgccgccgaacctttgtggatagaggctggggtaatgggtgtggattgttcggcaaaggctcactcataacatgcgctaagtttaagtgcgtaactaaactggaggggaagattgtgcagtacgaaaacttaaaatatagtgtcatcgtgaccgttcacacaggagaccagcatcaagtgggtaatgagagcaccgaacacggcactacggccacaattacaccccaggcgccttctactgagatccagctgaccgactacggggccctcacacttgattgttccccaaggaccggactggacttcaacgaaatggtcttgctaactatgaaggagaaatcatggctggtgcataagcagtggtttctcgatctgccgcttccctggacaagcggcgcaagtacgtctcaagagacctggaatcggcaggacctgttggtaactttcaaaacagctcacgccaagaagcaggaagttgtggtcctcggttcccaagagggggctatgcacaccgccctgacaggcgcaactgaaatccagaccagcggaacgaccacaatttttgccggccatttaaaatgccgtctgaagatggataaactaactctcaaggggatgtcgtatgtgatgtgtaccggatctttcaaactggagaaggaagtcgctgagacacagcacggtactgtgcttgttcagataaagtacgagggcaccgacgcgccttgcaaaatcccattctccacgcaagatgaaaagggggtgacacagaacggacgcttgattaccgcaaatcccatcgtaactgacaaagagaagcctgtcaacatagaagccgagccaccctttggcgagtcatatattgtgatcggtgctggggaaaaagccctgaagctcagttggttcaagaaaggcagctccatcggaaagatgtttgaggcaacagccagaggcgctaggcggatggccattctgggggataccgcatgggacttcggatctatcggtggcgtttttactagcgtggggaaacttgtccatcagattttcggaaccgcgtacggcgtgctgttttcaggtgtaagttggacaatgaagatagggatcggcgtgttgctcacgtggctgggattaaattcccgaagcacctctctgtcaatgacttgtattgctgttggcctagtcacactctacctgggggtgatggtgcaggccgatagtggatgcgtcatcaactggaaaggccgcgaacttaagtgtggtagcgggatcttcgttaccaatgaggtgcacacatggactgaacaatataagtttcaggcagactccccgaaaagattgtctgccgctattggaaaggcctgggaggagggcgtgtgcggtataaggtcggcaacccggctggaaaacatcatgtggaaacagattagcaacgagctcaatcatatcctgttagaaaacgacatgaagttcacggtagtcgtgggcgatgttgctgggattctggcccagggcaagaagatgatccgccctcaacccatggagtacaaatattcctggaagtcatggggcaaggcgaaaataatcggggccgacgtgcagaatacaacctttattatcgatggaccaaacactcctgaatgtcccgacgatcagagagcttggaatatttgggaggtcgaggactacggcttcggtatctttaccacaaacatatggcttaagttgagggatagttatactcaggtgtgcgaccaccgtctcatgtctgcagccattaaagatagcaaggctgttcacgccgacatggggtactggatcgaatccgagaaaaatgaaacctggaagctggcacgggcgtcattcattgaggtgaagacatgtatctggccaaaaagccatacgctatggtctaacggagtactggaatccgagatgataatccccaagatttatggcggtcctatcagtcaacacaattaccgaccaggctacttcacccagactgccgggccgtggcatctcggaaaactggagcttgattttgacttgtgcgaaggcacaaccgtcgtggtggatgagcactgcgggaacagaggacccagcctgaggactacaaccgtcacgggcaagattatccacgaatggtgttgccgctcttgtactttacctccactccggttcaaaggtgaggacgggtgctggtatggaatggagataagacccgttaaggaaaaggaggaaaatctggtgaaatccatggtatcagctggcagtggtgaggtggacagcttttcgcttggcctgttgtgtatttccatcatgatcgaagaggtcatgaggtctcgctggagccgaaagatgctcatgaccgggacactggccgtgttctttctactgattatgggacagctcacctggaacgatctgatccggctttgcattatggttggcgcaaatgcttcagaccgtatggggatgggaatgacttacttggccctgatggcaacattcaaaatgagacctatgtttgccgtgggcttactcttcaggcgcctgaccagtcgggaggtccttctgctaacaataggtctctccctggtggcttctgttgaattgccaaacagcctggaggaattaggggatggactcgcgatgggcatcatgattctgaaacttctgactgactttcaatcccatcagttgtgggccaccctcctgtcactaacgttcatcaaaacaacctttagcctgcactatgcatggaagactatggctatggtgcttagtattgtctctctcttccccctgtgtttgtccaccacaagccagaagactacctggctgccggtattactcggctcgctggggtgcaaacctcttacgatgtttctgatcgccgagaataagatatggggaagaaaatcatggccattgaacgaaggtatcatggccgtgggcattgtttctatcctcctgagttccctactgaagaacgatgtgccccttgctgggcctctcattgcaggaggcatgctgatcgcctgttacgtcataagcggttctagcgcggacttgtccttagagaaagctgccgaggtgtcatgggaagaggaagcagagcatagtggggccagccacaatattctggtagaagtgcaggatgacggaacaatgaagatcaaagatgaggagagggacgataccctcactatcctgcttaaggctacactgttggcagtctctggcgtttatcccctatccattccagccaccctgttcgtgtggtacttctggcaaaagaaaaagcagcgatcaggcgtgctctgggacactcctagtcccccagaagtcgagcgcgcggtgctggatgacgggatatatcggatcatgcagagaggacttttaggtaggagccaggttggcgtaggggtgtttcaagaaaacgtcttccatacaatgtggcacgtgacccgtggagctgttctgatgtaccagggcaaacgcctcgagccgtcctgggcctctgtgaagaaagacttgatttcgtacggtgggggatggcggctgcagggcagctggaatacgggcgaggaagtccaggtgatcgcagtagagcctgggaagaaccccaagaatgtccaaactgccccaggaacctttaaaacatcagaaggtgaggtgggcgctattgccctcgatttcaagcccgggacctccggaagtcctatcgttaacagagaaggcaaaatagtgggtctgtatgggaatggagtcgtgacaacttctggcacctacgttagcgcaatcgctcaggccaaggcgtcccaggagggcccacttcccgagattgaagacgaggtgtttaggaaacgaaacctgacgatcatggatttgcaccctgggtcaggaaagacacggcgctatctaccggccattgtcagagaagcaatcaagaggaaactgcggactctcatattagctccaacccgagtggtagcctctgagatggctgaagcactgaagggtatgcccattagataccaaacaaccgccgtgaaaagcgagcatactggcaaggagatcgttgaccttatgtgccacgccaccttcacaatgcgcctgctcagtcctgtcagggtgccaaattataacatgatcattatggatgaagctcattttacggacccctccagcatcgcggcacgtgggtacatatctactcgggtgggaatgggcgaggccgctgccattttcatgaccgcaacacctccgggttcagtcgaagcctttccccagtccaatgctgtaatccaggatgaggaaagagacattccagagaggagttggaacagcgggtatgagtggatcaccgatttccctggaaaaactgtgtggtttgttccctcgataaagtctggcaatgacattgcgaactgtttgcgcaagaatggcaaacgagtgatccagctgtccagaaagacattcgataccgaataccagaagacgaagaacaacgactgggactacgtcgtgactacagatatcagcgagatgggggccaatttccgggcagacagggttattgatccacgccgttgcctcaaacctgtgatcctgaaggacggacccgaaagagtcattcttgctggtccaatgccggtgaccgtagcctcagcagcccagcggaggggccgcatagggcgaaaccacaataaggagggagatcagtatatctacatgggccagcctctaaacaatgacgaggatcatgctcactggaccgaagccaaaatgctgttggacaacattaatactcccgagggtatcatcccagcgttatttgaacccgagagagaaaagagtgcagccattgatggggagtatcggctgaggggcgaggctcgcaaaacattcgtggaactcatgagaaggggagacctgcctgtttggctttcttacaaggtcgcctccgagggctttcaatatagcgatcggcgttggtgcttcgacggggaacgcaacaatcaggtgctggaggaaaacatggatgtggagatatggaccaaagagggagaacgaaagaaactcagaccaaggtggttggacgctcggacatactcagaccccctggcactacgcgagtttaaggagttcgccgctggtagaaggagtgtcagcggcgatctgatcctcgagattgggaaacttcctcagcacctgactcagcgggcccaaaatgcattagacaacttggttatgctgcataattccgaacagggaggccgagcgtatagacacgccatggaggagctcccggatacgatcgaaaccctgatgcttctggctctcattgccgtgttgacaggtggggtaactctgtttttcttatctggccgcggactaggcaaaaccagcatcgggctgctctgtgtgatggcatcctcagtccttctgtggatggcttctgtggagccacattggatagccgcaagtatcattttggaatttttcctgatggttctcctgatccccgagcctgacaggcagcggacaccccaggataaccaacttgcctacgtggtcattggactcctgtttatgatcttgaccgtagctgcgaatgagatgggtctgttagaaactacgaagaaagacctaggcatagggcacgtggccgttgagaaccaccatcacgcagctatgctggatgtggacctccatccagcctcggcctggaccctttacgcagtcgctacaactattatcacccctatgatgcgtcacacaattgaaaacaccactgccaatatcagcctgacagcgatagctaaccaggccgcaatcttgatgggactggataagggctggcccatttccaaaatggacatcggtgtgccactcctggcccttgggtgctattctcaggtcaatcctttaacgctgaccgctgcagtgctcatgttggttgcccattacgcgattatcggcccgggactgcaagctaaggccactagagaggcacagaagaggacagccgctggcataatgaaaaaccccaccgtggatgggattgtagccatcgacctagatccagtggtctatgacgcaaagttcgaaaaacagctgggacagatcatgctccttattctgtgtacctcacaaatcttgctgatgcgcacaacttgggctctctgcgagagcataacgctggccaccggccctttaacaactctttgggagggttcccccgggaagttttggaataccacaattgcggttagtatggccaacatcttccggggatcttacctggcaggcgctggtctcgccttcagcctaatgaaatcactgggcgggggacgaagaggcaccggggcacagggagaaactttgggcgagaagtggaagaggcagctgaatcagctctccaaaagtgaatttaacacgtataagcgcagcggtattatggaggtggaccggtctgaagctaaagaggggcttaagagaggagagacaaccaaacacgccgtctcccgtggcactgccaagctgaggtggttcgtggaacggaatttggtaaagccagagggtaaagtgatcgatctgggctgtgggcgcggaggctggtcatactattgcgcggggctcaagaaagttaccgaagtgaagggatacacaaaaggcggtcctgggcacgaggaacccataccgatggctacttacggatggaacttagtcaagctgcatagcggcaaagacgtgtttttcgtcccacctgagaagtgtgatacccttctgtgcgacatcggcgagtcgtctcccaatccaacaattgaagaggggcgaacgctaagagtgctcaagatggttgaaccctggctgaggggaaaccaattttgtatcaaaattttgaatccttatatgccgagtgtagtggagaccctggagcagatgcagcggaagcacggtggcatgctcgtccgcaaccccctttccagaaatagcactcatgaaatgtactgggtgtcatgcgggacaggaaacatcgtttccgcagtgaatatgacctctaggatgctgttaaaccgattcactatggcccaccggaaaccaacatatgagcgtgatgtcgacctgggcgctggtaccagacacgtggccgtagaacctgaggtggcaaacttggatattatcgggcagcgcatagaaaatattaagcatgagcacaaaagcacgtggcattacgacgaggataacccctataagacctgggcctaccacggaagttatgaagttaagccttccggcagcgcttcttcaatggtcaatggcgtggtgaaactcctgacaaagccatgggacgtcatccccatggttactcaaatcgcgatgaccgatacaactccttttgggcagcagagggtgttcaaagagaaggtagacacccggacaccaaaagccaagagaggaaccgcacaaattatggaagtgactgctaagtggctatggggttttcttagtcgcaacaaaaagcccaggatatgtacgcgagaggagttcacacggaaagtcagatccaatgccgcaatcggcgccgtgtttgttgacgagaaccagtggaatagcgctaaggaggccgtggaagatgagaggttctgggacctggtccatcgcgaacgtgagctccacaaacaggggaagtgcgcgacctgcgtgtacaacatgatgggaaagcgggagaaaaagctgggcgagtttggtaaagcaaaggggtctagagccatttggtacatgtggttgggagctaggttcctggagttcgaagccctcggctttatgaatgaggatcactggttctcgcgcgaaaactcacttagcggcgtagagggggagggactgcataaattaggttatatcctgcgagacatttccaagatcagtggcgggaatatgtacgcagatgacactgctggatgggatacccggataacagaagacgatttgcagaacgaggccaaaatcacggacattatggaaccggagcacgctctcctggccaattctatctttaagctaacctatcaaaacaaggttgtgagagtccagaggcctgccaaaaatggcactgtgatggatgtgattagccgcagagaccagcggggttccgggcaggtcggaacatacggccttaacaccttcactaacatggaagcgcaactgatcaggcagatggagtcagagggcatatttagtccatctgaactcgagacacccaatctggccgaacgtgttttggattggttagagaagcatggggtggaacgactgaaacgcatggctattagcggagacgactgtgtagtgaagcctatcgatgacagattcgccaccgcactcacagctcttaacgatatgggtaaagtccggaaggacatcccacagtgggagccctccaagggctggaatgattggcagcaagtgccgttttgctcacaccacttccatcagctgattatgaaagacgggagggagatagttgtgccttgtcgcaaccaggatgagctagtcggcagagcacgggtgagccagggagcaggttggtctctgagggagactgcctgcctcgggaagtcctatgcgcaaatgtggcagttgatgtactttcaccgacgtgacctgagacttgctgccaatgcaatctgtagtgccgtacccgttgattgggtgccaaccagccgcacgacctggtcgattcatgctcaccatcagtggatgacaactgaagacatgctgtccgtctggaaccgggtgtggatcgaggaaaatccttggatggaggataaaacccacatttcttcatgggaggacgttccctatctcggaaagagggaagaccaatggtgcggcagcttaatcggcctgacagccagagcaacttgggctaccaacatacaggtggccatcaatcaggtccgccggttgattgggaacgagaattacctggattacatgacgagtatgaaaaggttcaagaacgaatccgacccagagggagcgctctggtga

SEQ ID NO: 13312 - RNA, 9879 nt, synthetic construct
  misc_feature 1..9879: note = derived and/or modified CDS sequence (opt3) from DENV-1__HM181946__SS-prME
  source 1..9879: mol_type = other RNA
tccgtgaccatgctgctcatgcttatgcccacagcactggctttccacttgactacgagaggaggggagcctcatatgatcgtctccaagcaggaaagaggaaaatctttactgtttaagacctcagccggtgttaacatgtgcacactgattgcaatggacctcggcgagctgtgtgaagatactatgacctacaaatgcccacggattacagaggcggaaccggacgatgtggactgttggtgcaatgctaccgatacttgggtaacatatgggacctgtagtcaaacgggagagcaccgccgagacaagcgtagcgtggcacttgcaccccatgtcggcctgggtttggagactagaaccgaaacatggatgtcctctgagggggcctggaaacagatccagagggtggaaacttgggctctccggcaccctggattcaccgttattgcactgtttctggcccatgctatcggcacatcgattacccagaagggcatcatattcatcctcttaatgctggtgacgccatcaatggccatgcgctgcgtcgggattggaagcagagattttgtggagggtcttagtggcgcgacttgggtagacgttgtgttggagcacgggtcctgtgtcacaaccatggcaaaggataaacccactctggacatcgaactactcaagacagaggtgaccaaccctgccattctgaggaaactttgcatcgaagctaagatatctaatacgaccacagatagccggtgtccaactcaaggagaggccaccctggtggaagaacaagacgcaaacttcgtctgccgccgaacatttgttgatagaggctggggtaatgggtgtggattgttcggcaaaggctccctcattacttgcgctaagtttaagtgcgtgaccaaactggaggggaagatcgtacagtacgaaaacttaaaatattcagtgattgtcacagtgcacaccggagaccagcatcaagttggtaatgagagtactgaacacggcacgacagccaccatcactccccaggcgcctaccacagagatccagctgaccgactacggggccctcactcttgattgtagcccaaggacaggactggacttcaacgaaatggtgttgctaacgatgaaggagaaatcttggctggtccataagcagtggtttctcgatctgccgcttccctggacctccggcgcatcaactagccaagagacatggaatcggcaggacctgttggtgaccttcaaaacagctcacgccaagaagcaggaagtagttgtgctcggtagtcaagagggggctatgcacactgccctgaccggcgcaacggaaattcagacctctggaacaactaccatatttgccggccatttaaaatgccgtctgaagatggataaactaacactcaaggggatgtcctatgtcatgtgtactggatcgttcaaactggagaaggaagtggctgagacccagcacggtacggtccttgtgcagatccgctacgagggcacagacgcgccttgcaagattccattctcgacccaagatgaaagaggggttactcagaacggaaggttgatcacagcaaatcccatagtgaccgacaaagagaagcctgtaaacattgaagccgagccaccctttggcgagtcttatatcgtcatcggtgctggggaaaaagccctgaagctctcctggttcaaaaagggctcaagtattggaaagatgtttgaggcaactgcccggggcgctcgacgcatggccatcctgggggataccgcatgggacttcggaagcattggtggcgtgtttacatccgttgggaaacttgtgcatcagatattcggaacggcgtacggcgtcctgttttctggtgtgagctggaccatgaagatcgggattggcgtattgctcacttggctgggattaaattcaagaagtacatccttcagcatgacctgtatcgctgtgggcctggttacactatacctcggggtcatggtgcaggccgattctggatgcgtgatcaactggaaaggcagggaactgaagtgtggttcagggatttttgtcactaatgaggttcacacctggacggaacaatataaattccaggcagacagtccgaagcggcttagcgccgctataggaaaggcctgggaggagggcgtgtgcggtatccgctccgcaacaagattggaaaacattatgtggaaacagatctctaacgagctgaatcatattctcctggaaaacgacatgaagtttaccgtggtagtcggcgatgtggctgggatcttagcccagggcaagaagatgataaggcctcaacccatggagtacaaatattcgtggcgtagctggggcaaggcgaaaatcattggggccgacgttcagaatactaccttcatcattgatggaccaaacacacctgaatgtcccgacgatcagcgggcttggaatatctgggaggtggaggactacggctttggtatattcactaccaacatttggctgaaacttcgagattcctatacacaggtctgcgaccacagattgatgtcagcagccatcaaggatagtaaagctgtgcacgccgacatggggtactggattgaatctgagaagaatgaaacgtggaaactcgcaagggcgagcttcatcgaggttaagacctgtatatggccaaaatcccatactctgtggtcaaacggagtgctagaaagcgagatgatcattcccaagatctatggcggtcctatttctcaacacaattaccgcccaggctactttacacagaccgccgggccgtggcatctgggaaagctcgagctggatttcgacctttgcgaaggcactacagtagtcgtggatgagcactgcgggaaccggggaccctccttgagaaccacgactgtgaccggcaaaatcatacacgaatggtgttgcaggagttgtacactgcctccattacgctttcgaggtgaggacgggtgctggtatggaatggagattcggcccgtcaaggaaaaagaggaaaatctcgttaagagcatggtgtctgctggctccggtgaggtagactcattcagtctgggccttctgtgtatcagcatcatgattgaagaggtgatgcgttcgagatggtccaggaaaatgttgatgaccgggactctcgccgtctttctgctactgatcatgggacagctcacatggaacgatctgattcgcctttgcataatggtgggcgcaaatgcttctgaccggatggggatgggaaccacatacttggccctgatggcaactttcaagatgagacctatgtttgccgttggcttactcttcaggcgactgaccagccgcgaggtgcttctgctaacgatcggtctctcactggtcgctagtgtggaattgccaaactccctggaggaattaggggatggactcgcgatgggcattatgatcctgaaacttctgacagactttcaatctcatcagttgtgggccaccctcctgagcctaactttcattaaaaccacattttccctgcactatgcatggaagactatggctatggttctttcaatcgtgagcctcttccccctgtgtttgagtaccacgtctcagaaaacaacctggctgccggtcttactcggctccctggggtgcaagcctcttactatgtttctgatagccgagaataaaatctggggacggagaagctggccattgaacgaaggtattatggccgtaggcatcgtgtcgattctcctgtcatctctactgaagaacgatgttccccttgctgggcctctcatcgcaggaggcatgctgatagcctgttacgtgattagtggttccagcgcggacttgtctttagagaaggctgccgaggtcagctgggaagaggaagcagagcattccggggcctcacacaatatcctggtggaagtacaggatgacggaacaatgaaaatcaaggatgaggagagggacgataccctcactattctgcttaaagctacactgttggcagtgagtggcgtctatcccctaagcataccagccaccctgttcgtttggtacttctggcaaaagaaaaagcagcgttctggcgtgctctgggacacgccttcacccccagaagtggagcgcgcggtcctggatgacgggatctatcggattatgcagagaggacttttaggtaggagccaggtgggcgttggggtatttcaagaaaacgtgttccatactatgtggcacgtcacccgaggagctgtgctgatgtaccagggcaaacggctcgagccgagttgggccagcgttaagaaggacttgatctcctacggtgggggatggcgcctgcagggctcttggaatacaggcgaggaagtgcaggtcattgcagtggagcctgggaaaaaccccaagaatgtacaaaccgccccaggaacatttaaaactcccgaaggtgaggtcggcgctatcgccctcgatttcaagcctgggacctcgggaagcccaatagtgaacagagaaggcaaaatcgttggtctgtatgggaatggagtggtcacgacatcaggcacttacgtgtccgcaattgctcaggccaaggcgagtcaggagggcccccttcctgagatcgaagacgaggtttttaggaagcggaacctgaccattatggatttgcacccggggtctggaaaaacacgaagatatctaccagccatcgtgcgcgaagcaataaagaggaaactgcgtaccctcattttagctcccactcgggtcgtggccagcgagatggctgaagcactgaagggtatgcctatcagataccaaaccacagccgtaaaatccgagcatacgggcaaggagatcgtggaccttatgtgccacgccactttcaccatgaggctgctctcaccagttcgcgtccccaattataacatgattatcatggatgaagctcattttacagacccttctagcatagcggcacgagggtacattagtaccagagtgggaatgggcgaggccgctgccatcttcatgactgcaacaccgcccggttccgtggaagcctttccacagagcaatgctgtcattcaggatgaggaacgggacatccctgagaggtcttggaactcagggtatgagtggataaccgatttccccggaaagacggtatggtttgtgccatccattaaaagtggcaatgacatcgcgaactgtttgcgcaagaatggcaaacgtgttatccagctgagcagaaagactttcgatacagaataccagaagaccaagaacaacgactgggactacgtggtcaccactgatatttcggagatgggggccaatttccgggcagacagggtgatcgatcctcgccgatgcctcaagcccgttattctgaaagacggaccagaaagagtgatacttgctggtccgatgcctgtcacagtggcctctgcagcccagcggaggggccgcatcgggagaaaccacaataaggagggagatcagtatatttacatgggccagcccctaaacaatgacgaggatcatgctcactggaccgaagccaaaatgctgttggacaacatcaatacaccagagggtatcattcccgcgttatttgaacctgagagggaaaagtccgcagccatagatggggagtatcggctgcgtggcgaggctcgcaaaactttcgtagaactcatgcgaagaggagacctgccagtgtggcttagctacaaggttgcctcagagggctttcaatatagtgataggcggtggtgcttcgacggggaacgcaacaatcaggtcctggaggaaaacatggatgtggagatctggacgaaggagggagaaaggaagaagctcaggccccggtggttggacgctcgaacctactctgaccctctggcactaagagagtttaaagagttcgccgctggtcgcaggtccgtgagcggcgatctgattctcgagatcgggaaacttccgcagcacctgacacagcgggcccaaaatgcattagacaacttggtcatgctgcataattcagaacagggaggccgtgcgtatagacacgccatggaggagctcccagatactattgaaaccctgatgcttctggctctcatcgccgttttgacaggtggggtgaccctgtttttcttaagtggcaggggactaggcaaaactagcatagggctgctctgtgtaatggcatcctctgtgcttctgtggatggctagcgtcgagccccattggatcgccgcatccattatcttggaatttttcctgatggtgctcctgattcctgagcccgaccgccagcggacgccacaggataaccaacttgcctacgttgtgatcggactcctgtttatgatattgaccgtcgctgcgaatgagatgggtctgttagaaacaactaagaaagacctaggcattgggcacgtagccgtgggaaaccaccatcacgcagctatgctggatgttgacctccatcctgcctcagcctggaccctttacgcagtggctacaaccatcattactcccatgatgcgacacacaatcgagaacacgaccgccaatatatctctgactgcgatcgctaaccaggccgcaattttgatgggcctggataagggttggccaatcagtaagatggacattggggtccctctcctggcccttggctgctatagccaggtgaatccgttaacactgaccgctgcagtcctcatgttggtggcccattacgcgatcataggacccggcctgcaagctaaagccaccagagaagcacagaagaggacagccgctgggattatgaaaaacccaactgttgatggaatcgtggccatcgacctagatcctgtagtgtatgacgcaaagttcgagaaacagctgggccagattatgctccttatcctgtgtacgagccaaatattgctgatgcgcaccacatgggctctctgcgaatccattactctggccaccggtcccttaacaaccctttgggaggggtctccaggaaagttttggaatactacgatcgcggtctcaatggccaacattttccggggcagctacctggccggtgctggcctcgccttctccctaatgaagagtctagggggaggcagacgtgggacaggagcacagggcgagaccttgggtgaaaaatggaagaggcagctgaatcagctctctaaaagcgagtttaacacttataagcggtcagggatcatggaagttgaccgctccgaggctaaagaaggacttaagcgaggcgagaccacaaagcacgccgtgagtagaggtactgccaaactgaggtggttcgtcgagcggaatttggtgaagcctgaaggcaaagtaatagatctggggtgtggacgcggcgggtggagctactattgcgcgggactcaagaaagtgaccgaggttaagggctacacaaagggtgggcccggacacgaggaaccgatcccaatggctacgtacggctggaacttagtgaaactgcattctggcaaggacgtctttttcgtgcctcccgaaaaatgtgatacccttctgtgcgacattggggagtcctcaccaaatcccactatcgaggaaggaagaacactaagggtcctcaagatggtggagccttggctgcgaggtaaccaattttgtattaaaatcttgaatccgtatatgcccagcgttgtagaaaccctggagcagatgcagcggaagcacggcgggatgctcgtgcgtaacccactttcgagaaattctactcatgagatgtactgggtcagttgcggaacaggcaacattgtgtccgcagttaatatgaccagccgcatgctgttaaacaggttcacgatggcccaccggaaacctacctatgaaagagatgtggacctgggtgctgggacacgccacgtcgccgtggagcccgaagtagcaaacttggatatcataggacagaggattgagaatatcaagcatgaacacaagtcaacttggcattacgacgaggataacccttataaaacctgggcctaccacggctcctatgaggtgaagccatctggcagcgctagttccatggttaatggggtcgtgaaactcctgacaaagccctgggacgtgatccctatggtcactcaaattgcgatgaccgatacaaccccatttggacagcagcgagttttcaaagaaaaggtggacactcggacgcccaaggccaaaagaggtacagcacaaataatggaggtaaccgctaagtggctatggggctttcttagcaggaacaaaaagccgcgcatctgtactcgtgaagagttcacccggaaagtgagatctaatgccgcaattggggccgtctttgtggacgaaaaccagtggaactcagctaaggaggccgttgaggatgaaaggttctgggacctggtgcatcgcgagcgagaactccacaagcagggaaaatgcgcgacatgcgtctacaacatgatgggcaagcgggagaaaaagctgggtgaatttgggaaagcaaagggaagtagagccatctggtacatgtggttgggcgctaggttcctggagttcgaggccctcggctttatgaatgaagatcactggttctcccgcgagaacagcctttctggggtggaaggagagggtctgcataagttaggctatattctgagagacatctcgaaaatacctgggggaaatatgtacgcagatgacacggctggctgggatacccggatcactgaggacgatttgcagaacgaagccaggattacagacatcatggagccagaacacgctctcctggccaagtcaatttttaaactaacctatcaaaataaggtagttcgtgtgcagcgacccgccaaaaatggtactgtcatggatgtgatcagccgcagagaccagcgggggtccggacaggtgggcacatacggccttaataccttcacaaacatggaggcgcaactgataaggcagatggaaagtgaggggatattttctcctagcgagctcgaaactccaaacctggccgagcgcgtcttggattggttagaaaagtatggagttgagagactgaaacggatggctatctccggtgacgactgtgtggtaaagcccatcgatgacaggttcgccaccgcactcacggctcttaatgatatgggcaaggtgcgaaaagacattccgcagtgggaaccttcaaaggggtggaacgattggcagcaagtccccttttgcagtcatcacttccaccagctgataatgaaagacggacgtgagatcgtggttccatgtagaaatcaggatgagctagtgggccgcgcccgggtctctcagggtgcagggtggagcctgagggaaaccgcctgcctcggaaagtcctacgcgcaaatgtggcagttgatgtattttcatagacgcgacctgcggcttgctgccaacgcaatttgttcagccgtgcctgtagattggatccccacaagcaggactacctggtctattcacgctcatcaccagtggatgacaactgaggacatgctgtccgtttggaatcgagtgtggatcgaagagaacccatggatggaagataaaacccatataagtagctggggcgacgtcccctacctcggcaagagagaggaccaatggtgcgggtcgttaatcggactgacggcccgggcaacatgggctaccaatattcaggtggccatcaaccaggttaggcgcttgattggtaatgagaactacctggattatatgacttccatgaagcgtttcaaaaatgaatctgaccctgagggcgcgctctggtga

SEQ ID NO: 13313 - RNA, 9879 nt, synthetic construct
  misc_feature 1..9879: note = derived and/or modified CDS sequence (opt3) from DENV-1__HM181948__SS-prME
  source 1..9879: mol_type = other RNA
agcgtgaccatgctgctcatgcttatgcccacagccctggctttccacttgactacgagaggaggggagcctcatatgatcgtctccaagcaagaaagaggaaaatctttactgtttaagacctcagccggtgttaatatgtgcacattgattgccatggacctcggcgagctgtgtgaagatactatgacctacaaatgcccacggataacagaggtggaaccggacgatgtggactgttggtgcaatgcgaccgatacttgggtgacatatgggacctgtagtcaaacgggagagcaccgccgagacaagcgtagcgtcgctcttgcaccccatgtgggcctgggtttggagactagaaccgaaacatggatgtcctctgagggggcatggaaacagatccagagggttgaaacttgggccctccggcaccctggattcaccgtgattgctctgtttctggcacatgccatcggcacatcgattacccagaagggcatcatattcatcctcttaatgctggtcacgccatcaatggctatgcgctgcgtggggattggaagcagagattttgtagagggtcttagtggcgccacttgggttgacgtggtcttggagcacgggtcctgtgtgacaaccatggcgaaggataaacccactctggacatcgaactactcaagacagaggtgaccaaccctgcaattctgaggaaactttgcatcgaagccaagatatctaatacgaccacagatagccggtgtccaactcaaggagaggctaccctggtcgaagaacaagacgccaacttcgtttgccgccgaacatttgtggatagaggctggggtaatgggtgtggattgttcggcaaaggctccctcattacttgcgcaaagtttaagtgcgtaaccaaactggaggggaagatcgtgcagtacgaaaacttaaaatattcagtcattgtgacagttcacaccggagaccagcatcaagtgggtaatgagagtactgaacacggcacgacagctaccatcactccccaggcccctaccacagagatccagctgaccgactacggggcgctcactcttgattgtagcccaaggacaggactggacttcaacgaaatggtcttgctaacgatgaaggagaaatcttggctggtgcataagcagtggtttctcgatctgccgcttccctggacctccggcgcctcaactagccaagagacatggaatcggcaggacctgttggtaaccttcaaaacagcacacgctaagaagcaggaagttgtggtcctcggtagtcaagagggggccatgcacactgctctgaccggcgccacggaaattcagacctctggaacaactaccatatttgcaggccatttaaaatgccgtctgaagatggataaactaacactcaaggggatgtcctatgtgatgtgtactggtagcttcaaactggagaaggaagtcgccgagacccagcacggaacggtgcttgttcagatcaagtacgagggcacagacgctccttgcaaaattccattctcgacccaagatgaaaagggggtgactcagaacggacgcttgatcacagcgaatcccatagtaaccgacaaagagaagcctgtcaacattgaagcagagccaccctttggcgagtcttatatcgtgatcggtgccggggaaaaagctctgaagctctcctggttcaagaaaggctcaagtattggaaagatgtttgaggccactgcaagaggcgccaggcggatggctatcctgggggataccgcctgggacttcggaagcattggtggcgtttttacatccgtggggaaacttgtccatcagatattcggaacggcatacggcgtgctgttttctggtgtaagctggaccatgaagatcgggattggcgtgttgctcacttggctgggattaaattcacgaagtacatccctgagcatgacctgtatcgcggttggcctagtcacactctacctgggggtgatggtgcaggctgattctggatgcgtcatcaactggaaaggccgcgaacttaagtgtggttcagggattttcgttactaatgaggtgcacacctggacggaacaatataagtttcaggccgacagtccgaaaagattgagcgcagccataggaaaggcttgggaggagggcgtgtgcggtatcaggtccgccacacggctggaaaacattatgtggaaacagatctctaacgagctcaatcatattctgttagaaaacgacatgaagttcaccgtagtcgtgggcgatgttgcagggatcctggctcagggcaagaagatgatacgccctcaacccatggagtacaaatattcgtggaaaagctggggcaaggccaagatcattggggcggacgtgcagaatactacctttatcattgatggaccaaacacacctgaatgtcccgacgatcagagagcctggaatatctgggaggtcgaggactacggcttcggtatatttactaccaacatttggcttaagttgagggattcctatacacaggtgtgcgaccaccgtctcatgtcagctgcaatcaaagatagtaaggccgttcacgctgacatggggtactggattgaatctgagaaaaatgaaacgtggaagctggcccgggcatccttcatcgaggtgaagacctgtatatggccaaaatcccatactctatggtcaaacggagtactggaaagcgagatgatcattcccaagatctatggcggtcctatttctcaacacaattaccgaccaggctacttcacacagaccgcggggccgtggcatctcggaaaactggagcttgattttgacttgtgcgaaggcactacagtcgtggtggatgagcactgcgggaacagaggaccctccctgaggaccacgactgtcaccggcaagatcatacacgaatggtgttgccgcagttgtacattacctccactccggttcagaggtgaggacgggtgctggtatggaatggagattaggcccgttaaagaaaaggaggaaaatctggtaaagagcatggtatctgccggctccggtgaggtggactcatttagtcttggcctgttgtgtatcagcatcatgattgaagaggtcatgcgctcgcgatggtcccggaaaatgctcatgaccgggactctggctgtgttcctactgctcatcatgggacagctgacatggaacgatcttattcgtttgtgcataatggttggcgccaatgcatctgacagaatggggatgggaaccacatacctggctttaatggccacttttaagatgaggcctatgttcgcagtgggcctcctgtttcgccggcttaccagcagagaggtcctgctactcacgatcggtctgtcattggtggccagtgttgaactgccaaactccttagaggaactcggggatggactggctatgggcattatgatccttaaactgttgacagacttccaatctcatcagctctgggcgaccctgctaagcctgacttttattaagaccacattctcccttcactatgcctggaaaactatggcaatggtgctctcaatcgtcagcctgtttcccttgtgtctgagtaccacgtctcagaagacaacctggttaccggtactcctgggctcccttgggtgcaagcctctgactatgttcttgatagctgagaataaaatctggggaaggcgaagctggccactcaacgaaggtattatggccgtgggcatcgtttcgattctgctatcatctctgcttaagaacgatgtgcccctcgccgggcctctgatcgctggaggcatgttgatagcatgttacgtcattagtggttccagcgccgacttatctctggagaaagcggctgaggtgagctgggaagaggaagccgagcattccggggcatcacacaatatcctcgtagaagtgcaggatgacggaacaatgaagatcaaagatgaggagcgcgacgataccctgactattcttctgaaggccacattgctagctgtcagtggcgtttatcccctgagcataccagcaaccctctttgtgtggtacttctggcagaagaagaagcagcggtctggcgtgctgtgggacacgccttcacccccagaagtcgagagagccgtgcttgatgacgggatctataggattatgcagcgtggattactgggtcgcagccaggttggcgtaggggtgttccaagaaaacgtctttcatactatgtggcacgtgacccggggagcggttctcatgtaccagggcaaaagattggagccgagttgggctagcgtgaagaaagacctgatctcctacggtgggggatggaggctccagggctcttggaatacaggcgaggaagtccaggtgattgccgtagagcctgggaagaaccccaaaaatgtccaaaccgcaccaggaacattcaagactcccgaaggtgaggtgggcgccatcgctctggattttaagcctgggacctcgggaagcccaatagttaaccgagaaggcaaaatcgtgggtctttatgggaatggagtcgtgacgacatcaggcacttacgtttccgccattgcacaggctaaggccagtcaggagggccccctgcctgagatcgaagacgaggtgttccggaaacgcaacttgaccattatggatctacacccggggtctggaaagacaagaaggtatctgccagcgatcgtccgggaagccataaaacgaaagctcagaaccttaattctggcacccactcgcgtggtagctagcgagatggccgaagctcttaagggtatgcctatcaggtaccaaaccacagcagtgaaatccgagcatacgggcaaggagatcgttgacctgatgtgccacgccacttttaccatgcgtctcttgtcaccagtccgggtgcccaattataacatgattatcatggatgaagcccatttcacagacccttctagcatagctgcgagagggtacattagtaccagggtgggaatgggcgaggcagccgctatctttatgactgccacaccgcccggttccgtcgaagcattcccacagagcaatgccgtaattcaggatgaggaacgcgacatccctgagcgatcttggaactcagggtatgagtggataaccgattttcccggaaaaacggtgtggttcgttccatccattaagagtggcaatgacatcgctaactgtctgaggaaaaatggcaagcgggtgatccagctcagcaggaagacttttgatacagaataccagaaaaccaagaacaacgactgggactacgtcgtgaccactgatatttcggagatgggggcgaatttccgcgccgaccgtgttatcgatcctagacggtgcctgaaacccgtgattcttaaggacggaccagaaagggtcatactagcaggtccgatgcctgtgacagtagcttctgccgcacagcgccgaggcagaatcgggcggaaccacaataaagagggagatcagtatatttacatgggccagcccctgaacaatgacgaggatcatgcccactggaccgaagctaagatgttgttagacaacatcaatacaccagagggtatcattcccgccctgttcgaacctgagagggaaaagtccgcggcaatagatggggagtatcgcctcagaggcgaggccaggaaaacttttgtggaactgatgcggcgtggagaccttccagtttggctgagctacaaggtcgcttcagagggcttccaatatagtgatcgccgatggtgctttgacggggaaagaaacaatcaggtgctcgaggaaaacatggatgtggagatctggacgaaagagggagaaaggaagaaattgcggccccgctggctggacgccagaacctactctgaccctctagctctgagggagttcaaggaatttgcagccggtcggcgatccgtcagcggcgatctcattcttgagatcgggaaactgccgcagcacttaacacagagagctcaaaatgccttggacaacctggttatgctccataattcagaacagggaggccgcgcatataggcacgcgatggaggagctgccagatactattgaaacccttatgctgctcgccttgatcgctgtgctgacaggtggggtaaccttattctttctaagtggccggggactgggcaagactagcatagggctcctttgtgtgatggcctcctctgtcctgttgtggatggcaagcgtggagccccattggatcgctgcctccattatcctggagttctttctcatggttctgcttattcctgagcccgaccgtcagagaacgccacaggataaccaactcgcatacgtggtcatcggactgttgttcatgatactgaccgtagccgctaatgagatgggtttactagaaacaactaagaaagacctgggcattgggcacgtggcggttggaaaccaccatcacgccgcaatgctcgatgtggaccttcatcctgcttcagcctggaccctgtacgccgtcgcaacaaccatcattactcccatgatgaggcacacaatcgagaacacgaccgctaatatatctttgactgccatcgcgaaccaggctgccattctgatgggcctcgataagggttggccaatcagtaaaatggacattggggtgcctctgcttgcattaggctgctattcgcaggtcaatccgctgacactcaccgccgctgtgttgatgctggttgcacattacgccatcataggacccggcctacaagcgaaggctacccgcgaagcccagaaacggacagcagccgggattatgaagaacccaactgtggatggaatcgtagctatcgacctggatcctgtggtctatgacgccaagtttgagaaacagctcggccagattatgcttctgatcttgtgtacgagccaaatactgctcatgcgaaccacatgggcactgtgcgaatccattactttagctaccggtccccttacaaccctgtgggaggggtctccaggaaagttctggaatactacgatcgccgtttcaatggcgaacatttttagaggcagctacctcgccggtgcaggcctagctttctccctgatgaaaagtctagggggaggcaggcgcgggacaggagcccagggcgagaccctgggtgaaaagtggaaacggcagctcaatcagctttctaagagcgagttcaacacttataagagatcagggatcatggaagtggaccgttccgaggcaaaagaaggactgaagaggggcgagaccacaaaacacgctgtcagtcggggtactgccaagttgcgctggtttgtggagcgaaatctggtaaaacctgaaggcaaggtgatagatctcgggtgtggaagaggcgggtggagctactattgcgccggattaaagaaagttaccgaggtgaagggctacacaaaaggtgggcccggacacgaagaaccgatcccaatggcgacgtacggctggaacctggtcaaacttcattctggcaaagacgtgttctttattcctcccgaaaagtgtgataccctgctatgcgacatcggggagtcctcaccaaatcccactattgaggaaggaaggacactccgggtcctgaaaatggtggagccttggttgcgcggtaaccaattctgtatcaagattctgaatccgtatatgcccagcgttgtagaaaccctcgagcagatgcagagaaagcacggcgggatgcttgtgaggaacccactgtcgcgaaattctactcatgagatgtactgggtcagttgcggaacaggcaacatcgtgtccgctgttaatatgaccagccggatgttactgaaccgttttacgatggcacacagaaaacctacctatgaacgcgatgtggacttgggtgccgggacaaggcacgtcgctgtggagcccgaagtagccaacctcgatataattggacagcggatcgagaatatcaagcatgaacacaaatcaacttggcattacgacgaggataacccttataagacctgggcataccacggctcctatgaggtgaaaccatctggcagcgccagttccatggttaatggggtcgtgaagctgctaacaaagccctgggacgtgattcctatggtcactcaaatagctatgaccgatacaaccccattcggacagcagagagtttttaaagaaaaggtggacactcgcacgcccaaagcgaagaggggtacagcccaaatcatggaggtaaccgcaaaatggctttggggcttcctgagccgaaacaagaagccgcggatttgtactagagaagagtttaccaggaaagtgcgctctaatgctgccatcggggcagtcttcgtggacgaaaaccagtggaactcagccaaggaggctgttgaggatgaacgtttttgggacctcgtgcatcgggagagagaactgcacaaacagggaaagtgcgccacatgcgtctacaacatgatgggcaaaagggagaagaagttgggtgagttcgggaaagcgaagggaagtcgcgcaatttggtacatgtggctgggcgcccgatttctcgagttcgaggctcttggcttcatgaatgaagatcactggttttcccgggagaacagcctgtctggggtggaaggagagggtttacataaactgggctatatcttgagagacatatcgaagatccctgggggaaatatgtacgccgatgacacggcaggctgggataccaggattactgaggacgatctccagaacgaagctcgcatcacagacattatggagccagaacacgccctgctagctaaatcaatcttcaaacttacctatcaaaataaagtagttagagtgcagcggcccgccaagaacggtactgtcatggatgtgataagcaggcgtgaccagcgagggtccggacaggtgggcacatacggcctgaatacctttacaaacatggaggcacaactcattcgccagatggaaagtgaggggatcttctctcctagcgagctggaaactccaaacttggcggagagagtcttagattggctggaaaagtatggagttgagcggctcaaaaggatggccatctccggtgacgactgtgtggtaaagcccattgatgaccgctttgctaccgcccttacggcactgaatgatatgggcaaagtgagaaaggacataccgcagtgggaaccttcaaaagggtggaacgattggcagcaagtccccttctgcagtcatcactttcaccagctaatcatgaaggacggacgggagattgtggttccatgtaggaatcaggatgagctggtgggccgagctcgtgtctctcagggtgccgggtggagcctcagagaaaccgcatgcttgggaaagtcctacgcccaaatgtggcagctgatgtatttccatcgccgggaccttaggctggcggctaacgccatctgttcagcagtgcctgtagattggattcccacaagcagaactacctggtctatccacgcccatcaccagtggatgacaactgaggacatgctctccgtttggaatcgcgtgtggatagaagagaacccatggatggaagataaaacccatatcagtagctggggcgacgtcccctacttaggcaagcgggaggaccaatggtgcgggtcgctgattggattgacggctagggccacatgggcaaccaatatccaggtggctattaaccaggttcgaagactgatcggtaatgagaactacctcgattatatgacttccatgaaacggtttaagaatgaatctgaccctgagggcgccctttggtga

SEQ ID NO: 13314 - RNA, 9879 nt, synthetic construct
  misc_feature 1..9879: note = derived and/or modified CDS sequence (opt3) from DENV-1__HM181949__SS-prME
  source 1..9879: mol_type = other RNA
agcgtgaccatgctgctcatgcttatgcccacagcactggctttccacttgactacgcggggcggggagcctcatatgatcgtctccaagcaggaaagaggaaaatctttactgtttaagacctcagccggtgttaatatgtgcacactaattgccatggacctcggcgagctgtgtgaagatactatgacctacaaatgcccacggataacagaggcggaaccggacgatgtggactgttggtgcaatgctaccgatacttgggtaacatatgggacctgtagtcaaacgggagagcaccgccgagacaagcgttccgtggcccttgcaccccatgtcggcctgggtttggagactagaaccgaaacatggatgtcctctgagggggcctggaaacagatccagagggtggaaacttgggctctccggcaccctggattcaccgttattgcactgtttctggcccatgctatcggcacatcgattacccagaagggcatcatattcatcctcttaatgctggtgacgccatcaatggccatgcgctgcgtcgggattggaagcagagattttgtggagggtcttagtggcgcgacttgggtagacgttgtgttggagcacgggtcctgtgtcacaaccatggcaaaggataaacccactctggacatcgaactactcaagacagaggtgaccaaccctgccattctgaggaaactttgcatcgaagctaagatatctaatacgaccacagatagccggtgtccaactcaaggagaggccaccctggtggaagaacaagacgcaaacttcgtctgccgccgaacatttgttgatagaggctggggtaatgggtgtggattgttcggcaaaggctccctcattacttgcgctaagtttaagtgcgtgaccaaactggaggggaagatcgtacagtacgaaaacttaaaatattcagtgattgtcacagtgcacaccggagaccagcatcaagttggtaatgagagtactggccacgggacgacagccaccatcactccccaggcgcctaccacagaaatccagctgaccgactacggagccctcactcttgattgtagcccaaggacaggcctggacttcaacgagatggtgttgctaacgatgaaggaaaaatcttggctggtccataagcagtggtttctcgatctgccgcttccctggacctccggtgcatcaactagccaagagacatggaatcggcaggacctgttggtgaccttcaaaacagctcacgccaagaagcaggaggtagttgtgctcgggagtcaagaaggcgctatgcacactgccctgaccggagcaacggagattcagacctctggcacaactaccatatttgccgggcatttaaaatgccgtctgaagatggataaactaacactcaagggaatgtcctatgtcatgtgtactggtagcttcaaactggaaaaggaggtggctgaaacccagcacggcacggtccttgtgcagatcaagtacgaggggacagacgcgccttgcaaaattccattctcgacccaagatgagaagggagttactcagaacggccgcttgatcacagcaaatcccatagtgaccgacaaagaaaagcctgtaaacattgaggccgaaccaccctttggtgagtcttatatcgtcatcggggctggcgagaaagccctgaagctctcctggttcaagaaaggatcaagtattggcaagatgtttgaagcaactgccagaggggctaggcggatggccatcctgggagataccgcatgggacttcggtagcattggcggggtgtttacatccgttggaaaacttgtgcatcagatattcggcacggcgtacggtgtcctgttttctggggtgagctggaccatgaagatcggcattggagtattgctcacttggctgggcttaaattcacgaagtacatccctgagcatgacctgtatcgctgtggggctagttacactctacctgggagtcatggtgcaggccgattctggctgcgtgatcaactggaaaggtcgcgagcttaagtgtgggtcaggaattttcgtcactaatgaagttcacacctggacggagcaatataagtttcaggcagacagtccgaaaagattgagcgccgctataggcaaggcctgggaagagggtgtgtgcggcatcaggtccgcaacacggctggagaacattatgtggaaacagatctctaacgaactcaatcatattctgttagagaacgacatgaagttcaccgtggtagtcggggatgtggctggaatcctggcccagggcaaaaagatgatacgccctcaacccatggaatacaaatattcgtggaaaagctgggggaaggcgaagatcattggagccgacgttcagaatactacctttatcattgatggcccaaacacacctgagtgtcccgacgatcagagagcttggaatatctgggaagtggaggactacggtttcgggatatttactaccaacatttggcttaagttgagggattcctatacacaggtctgcgaccaccgtctcatgtcagcagccatcaaagatagtaaggctgtgcacgccgacatgggatactggattgagtctgagaagaatgagacgtggaagctggcacgggcgagcttcatcgaagttaagacctgtatatggccaaaatcccatactctatggtcaaacggcgtgctggagagcgaaatgatcattcccaagatctatggtggccctatttctcaacacaattaccgaccagggtacttcacacagaccgccggaccgtggcatctcggcaaactggagcttgattttgacttgtgcgaggggactacagtagtcgtggatgaacactgcggaaacagaggcccctccctgaggaccacgactgtgaccggtaagatcatacacgagtggtgttgccgcagttgtacattacctccactccggttcagaggggaagacggatgctggtatggcatggagattaggcccgtcaaagagaaggaagagaatctggttaagagcatggtgtctgctggttccggcgaagtagactcatttagtcttgggctgttgtgtatcagcatcatgattgaggaagtgatgcgctcgcgatggtcccggaaaatgctcatgaccggaactctggccgtcttcctactgctcatcatgggccagctgacatggaacgatcttattcgtttgtgcataatggtgggggcaaatgcttctgacagaatgggaatgggcaccacatacctggccttaatggcaacttttaagatgaggcctatgttcgccgttggtctcctgtttcgccggcttaccagcagagaggtgctgctactcacgatcgggctgtcattggtcgctagtgtggagctgccaaactccttagaagaactcggagatggcctggcgatgggcattatgatccttaaactgttgacagacttccaatctcatcagctctgggccaccctgctaagcctgacttttattaagaccacattctcccttcactatgcatggaaaactatggctatggttctctcaatcgtgagcctgtttcccttgtgtctgagtaccacgtctcagaagacaacctggttaccggtcctcctggggtcccttggatgcaagcctctgactatgttcttgatagccgaaaataaaatctggggtaggcgaagctggccactcaacgagggcattatggccgtagggatcgtgtcgattctgctatcatctctgcttaagaacgatgttcccctcgctggacctctgatcgcaggcggtatgttgatagcctgttacgtgattagtgggtccagcgcggacttatctctggaaaaagctgccgaggtcagctgggaggaagaggcagaacattccggagcctcacacaatatcctcgtggaggtacaggatgacggcacaatgaagatcaaagatgaagaacgcgacgataccctgactattcttctgaaggctacattgctagcagtgagtggcgtctatcccctgagcataccagccaccctctttgtttggtacttctggcagaagaagaagcagcggtctggggtgctgtgggacacgccttcacccccagaggtggaaagagcggtccttgatgacggaatctataggattatgcagcgtggtttactgggccgcagccaggtgggggttggagtattccaagagaacgtgtttcatactatgtggcacgtcacccggggcgctgtgctcatgtaccagggtaaaagattggaaccgagttgggccagcgttaagaaagacctgatctcctacgggggaggctggaggctccagggctcttggaatacaggggaggaggtgcaggtcattgcagtggaacctggaaagaaccccaaaaatgtacaaaccgccccaggtacattcaagactcccgagggcgaagtcggggctatcgccctggattttaagcctggaacctcgggcagcccaatagtgaaccgagagggtaaaatcgttgggctttatggaaatggcgtggtcacgacatcaggcacttacgtgtccgcaattgctcaggccaaggcgagtcaggaagggcccctgcctgagatcgaggacgaagttttccggaaacgcaacttgaccattatggatctacacccgggatctggtaagacaagaaggtatctgccagccatcgtgcgggaggcaataaaacgaaagctcagaaccttaattctggctcccactcgcgtcgtggccagcgaaatggctgaggcacttaagggcatgcctatcaggtaccaaaccacagccgtaaaatccgaacatacggggaaggagatcgtggacctgatgtgccacgccacttttaccatgcgtctcttgtcaccagttcgggtccccaattataacatgattatcatggatgaggctcatttcacagacccttctagcatagcggcaagaggatacattagtaccagggtgggcatgggtgaagccgctgccatctttatgactgcaacaccgcccgggtccgtggaggccttcccacagagcaatgctgtcattcaggatgaagaacgcgacatccctgaacgatcttggaactcaggatatgagtggataaccgattttcccggcaaaacggtatggttcgtgccatccattaagagtggcaatgacatcgcgaactgtctgaggaaaaatgggaagcgggttatccagctcagcaggaagacttttgatacagagtaccagaaaaccaagaacaacgactgggactacgtggtcaccactgatatttcggaaatgggagccaatttccgcgcagaccgtgtgatcgatcctagacggtgcctgaaacccgttattcttaaggacggtccagagagggtgatactagctggcccgatgcctgtcacagtggcctctgcagcccagcgccgagggagaatcggacggaaccacaataaagaaggcgatcagtatatttacatgggtcagcccctgaacaatgacgaggatcatgctcactggaccgaggccaagatgttgttagacaacatcaatacaccagaagggatcattcccgcgctgttcgagcctgaaagggagaagtccgcagccatagatggcgaatatcgcctcagaggagaggctaggaaaacttttgtagagctgatgcggcgtggcgaccttccagtgtggctgagctacaaggttgcctcagaagggttccaatatagtgatcgccgatggtgctttgacggagagagaaacaatcaggtcctcgaagagaacatggatgtggaaatctggacgaaagagggtgagaggaagaaattgcggccccgctggctggacgctagaacctactctgaccctctagcactgagggagttcaaggagtttgccgctggccggcgatccgtgagcggggatctcattcttgaaatcggaaaactgccgcagcacttaacacagagagcccaaaatgcattggacaacctggtcatgctccataattcagagcagggcggtcgcgcgtataggcacgccatggaggaactgccagatactattgagacccttatgctgctcgctttgatcgccgttctgacagggggcgtgaccttattctttctaagtggacggggcctggggaagactagcataggactcctttgtgtaatggcatcctctgtgctgttgtggatggctagcgtcgaaccccattggatcgccgcatccattatcctggagttctttctcatggtgctgcttattcctgaacccgaccgtcagagaacgccacaggataaccaactcgcctacgttgtgatcggtctgttgttcatgatactgaccgtcgctgcgaatgagatgggcttactagagacaactaagaaagacctggggattggacacgtagccgtgggcaaccaccatcacgcagctatgctcgatgttgaccttcatcctgcctcagcctggaccctgtacgcagtggctacaaccatcattactcccatgatgaggcacacaatcgaaaacacgaccgccaatatatctttgactgcgatcgctaaccaggccgcaattctgatgggtctcgataaggggtggccaatcagtaaaatggacattggcgtccctctgcttgccttaggatgctattcgcaagtgaatccgctgacactcaccgctgcagtcttgatgctggtggcccattacgcgatcataggccccgggctacaagctaaggccacccgcgaggcacagaaacggacagccgctggaattatgaagaacccaactgttgatggcatcgtggccatcgacctggatcctgtagtgtatgacgcaaagtttgaaaaacagctcggtcagattatgcttctgatcttgtgtacgagccaaatactgctcatgcgaaccacatgggctctgtgcgagtccattactttagccaccgggccccttacaaccctgtgggaaggatctccaggcaagttctggaatactacgatcgcggtctcaatggccaacatttttagaggtagctacctcgcaggcgctgggctagccttctccctgatgaaaagtttgggaaggggccgccgggggacaggagcacagggcgagaccctgggtgagaagtggaaaagacagctcaatcagctttctaagagcgagttcaacacttataagcgttcagggatcatggaggttgacaggtccgaagctaaagagggactgaagcggggcgaaaccacaaaacacgccgtgagtcgcggtactgccaagttgcgatggtttgtcgagagaaatctggtgaaacctgagggcaaggtaatagatctcgggtgtggaaggggcgggtggagctactattgcgcgggattaaagaaagtgaccgaagttaagggctacacaaaaggtgggcccggacacgaggaaccgatcccaatggctacgtacggctggaacctggtgaaacttcattctggcaaagacgtcttctttattcctcccgagaagtgtgataccctgctatgcgacatcggggaatcctcaccaaatcccactattgaggagggacggacactccgcgtgctgaaaatggtcgaaccttggttgagaggtaaccaattctgtatcaagattctgaatccgtatatgcccagcgtggttgagaccctcgaacagatgcagaggaagcacggcgggatgcttgtacgaaacccactgtcgagaaattctactcatgagatgtactgggtgagttgcggaacaggcaacatcgtctccgcagtgaatatgaccagccgtatgttactgaacagatttacgatggcccaccgcaaacctacctatgagagggatgttgacttgggtgctgggacacggcacgtggccgtcgaacccgaggtggcaaacctcgatataattggacagagaatcgaaaatatcaagcatgagcacaaatcaacttggcattacgacgaagataacccttataagacctgggcctaccacggctcctatgaggtaaaaccatctggcagcgctagttccatggtgaatggggttgtcaagctgctaacaaagccctgggacgtgattcctatggtgactcaaatagcgatgaccgatacaaccccattcggacagcagcgcgtctttaaagagaaggttgacactaggacgcccaaagccaagcgaggtacagcacaaatcatggaagtgaccgctaaatggctttggggcttcctgagccggaacaagaagccgagaatttgtactagggaggaatttacccgcaaagtacgttctaatgccgcaatcggggccgtgttcgtcgacgagaaccagtggaactcagctaaggaagccgtggaggatgagcggttttgggacctcgttcatagagaaagggagctgcacaaacagggaaagtgcgcgacatgcgtgtacaacatgatgggcaaacgcgaaaagaagttgggtgagttcgggaaagcaaagggaagtcgagccatttggtacatgtggctgggcgctcggtttctcgagttcgaggcccttggcttcatgaatgaggatcactggttttccagagaaaacagcctgtctggggtcgagggagaaggtttacataaactgggctatatcttgagggacatatcgaagatccctgggggaaatatgtacgcagatgacacggctggctgggatacccgcattactgaggacgatctccagaacgaggccagaatcacagacattatggaaccagagcacgctctgctagccaaatcaatcttcaaacttacctatcaaaataaagtggtacgggttcagaggcccgcaaagaacggtactgtgatggatgtcataagccgtcgagaccagcgcgggtccggacaggtgggcacatacggcctgaatacctttacaaacatggaagcgcaactcattagacagatggagagtgaagggatcttctctcctagcgagctggagactccaaacttggccgaacgggtgttagattggctggagaagtatggagtcgaaaggctcaaacgcatggctatctccggtgacgactgtgttgtgaagcccattgatgacagatttgccaccgcacttacggctctgaatgatatgggcaaagtacggaaggacataccgcagtgggagccttcaaaagggtggaacgattggcagcaagtgcccttctgcagtcatcactttcaccagctaatcatgaaggacggaagggaaattgtcgtgccatgtcgaaatcaggatgagctggttggccgtgccagagtgtctcagggtgcagggtggagcctccgcgagaccgcctgcttgggaaagtcctacgcgcaaatgtggcagctgatgtatttccatcggagggaccttagactggctgccaacgcaatctgttcagccgtccctgtggattggattcccacaagccgcactacctggtctatccacgctcatcaccagtggatgacaactgaagacatgctctccgtatggaatcgggtttggatagaggaaaacccatggatggaggataaaacccatatcagtagctggggcgacgtgccctacttaggcaagagggaagaccaatggtgcgggtcgctgattggattgacggcccgagcaacatgggctaccaatatccaggtcgccattaaccaggtgagacggctgatcggtaatgagaactacctcgattatatgacttccatgaaaaggtttaagaatgagtctgaccctgaaggcgcgctttggtga

SEQ ID NO: 13315 - RNA, 9879 nt, synthetic construct
  misc_feature 1..9879: note = derived and/or modified CDS sequence (opt3) from DENV-1__HM181950__SS-prME
  source 1..9879: mol_type = other RNA
tccgtgaccatgctgctcatgcttatgcccacagcactggctttccacttgactacgagaggaggggaacctcatatgatcgtctccaagcaggaaagaggaaaatctttactgtttaagacctcagccggtgttaatatgtgcacattgattgccatggacctcggcgagctgtgtgaagatactatgacctacaaatgcccacggataacagaggcggaaccggacgatgtggactgttggtgcaatgctaccgatacttgggtaacatatgggacctgtagtcaaacgggagagcaccgccgagacaagcgtagcgtggcccttgcaccccatgtcggcctgggtttggagactagaaccgaaacatggatgtcctctgagggggcctggaaacagatccagagggtggaaacttgggctctccggcaccctggattcaccgttattgcactgtttctggcccatgctatcggcacatcgattacccagaagggcatcatattcatcctcttaatgctggtgacgccatcaatggccatgcgctgcgtcgggattggaagcagagattttgtggagggtcttagtggcgcgacttgggtagacgttgtgttggagcacgggtcctgtgtcacaaccatggcaaaggataaacccactctggacatcgaactactcaagacagaggtgaccaaccctgccattctgaggaaactttgcatcgaagctaagatatctaatacgaccacagatagccggtgtccaactcaaggagaggccaccctggtggaagaacaagacgcaaacttcgtctgccgccgaacatttgttgatagaggctggggtaatgggtgtggattgttcggcaaaggctccctcattacttgcgctaagtttaagtgcgtgaccaaactggaggggaagatcgtacagtacgaaaacttaaaatattcagtgattgtcacagtgcacaccggagaccagcatcaagttggtaatgagagtactgaacacggcacgacagccaccatcactccccaggcgcctaccacagagatccagctgaccgactacggggccctcactcttgattgtagcccaaggacaggactggacttcaacgaaatggtgttgctaacgatgaaggagaaatcttggctggtccataagcagtggtttctcgatctgccgcttccctggacctccggcgcatcaactagccaagagacatggaatcggcaggacctgttggtgaccttcaaaacagctcacgccaagaagcaggaagtagttgtgctcggtagtcaagagggggctatgcacactgccctgaccggcgcaacggaaattcagacctctggaacaactaccatatttgccggccatttaaaatgccgtctgaagatggataaactaacactcaaggggatgtcctatgtcatgtgtactggtagcttcaaactggagaaggaagtggctgagacccagcacggaacggtccttgtgcagatcaagtacgagggcacagacgcgccttgcaaaattccattctcgacccaagatgaaaagggggttactcagaacggacgcttgatcacagcaaatcccatagtgaccgacaaagagaagcctgtaaacattgaagccgagccaccctttggcgagtcttatatcgtcatcggtgctggggaaaaagccctgaagctctcctggttcaagaaaggctcaagtattggaaagatgtttgaggcaactgccagaggcgctaggcggatggccatcctgggggataccgcatgggacttcggaagcattggtggcgtgtttacatccgttgggaaacttgtgcatcagatattcggagcggcttacggcgtcctgttttctggtgtgagctggacgatgaagatcgggattggcgtattgctcacctggctgggattaaattcacgaagtacttccctgagcatgacatgtatcgccgtgggcctagttaccctctacctgggggtcatggtgcaggcagattctggatgcgtgatcaactggaaaggccgcgaacttaagtgtggttcagggattttcgtcacaaatgaggttcacacttggaccgaacaatataagtttcaggccgacagtccgaaaagattgagcgctgccataggaaaggcatgggaggagggcgtgtgcggtatcaggtccgctacgcggctggaaaacattatgtggaaacagatctctaacgagctcaatcatattctgttagaaaacgacatgaagttcacagtggtagtcggcgatgtggccgggatcctggcgcagggcaagaagatgatacgccctcaacccatggagtacaaatattcgtggaaaagctggggcaaggccaagatcattggggctgacgttcagaataccacttttatcattgatggaccaaacacccctgaatgtcccgacgatcagagagcatggaatatctgggaggtggaggactacggcttcggtatatttacaactaacatttggcttaagttgagggattcctatacccaggtctgcgaccaccgtctcatgtcagccgctatcaaagatagtaaggccgtgcacgcagacatggggtactggattgaatctgagaaaaatgaaacatggaagctggcgcgggccagcttcatcgaggttaagacgtgtatatggccaaaatcccataccctatggtcaaacggagtgctggaaagcgagatgatcattcccaagatctatggcggtcctatttctcaacacaattaccgaccaggctacttcactcagacagctgggccgtggcatctcggaaaactggagcttgattttgacttgtgcgaaggcaccactgtagtcgtggatgagcactgcgggaacagaggaccctccctgaggacaaccacggtgactggcaagatcatacacgaatggtgttgccgcagttgtaccttacctccactccggttcagaggtgaggacgggtgctggtatggaatggagattaggcccgtcaaagaaaaggaggaaaatctggttaagagcatggtgtctgccggctccggtgaggtagactcatttagtcttggcctgttgtgtatcagcatcatgattgaagaggtgatgcgctcgcgatggtcccggaaaatgctcatgacagggaccctggcagtcttcctactgctcatcatgggacagctgacttggaacgatcttattcgtttgtgcataatggtgggcgctaatgcctctgacagaatggggatgggaacaacctacctggcattaatggccacatttaagatgaggcctatgttcgctgttggcctcctgtttcgccggcttactagcagagaggtgctgctactcaccatcggtctgtcattggtcgcgagtgtggaactgccaaactccttagaggaactcggggatggactggccatgggcattatgatccttaaactgttgacggacttccaatctcatcagctctgggcaacactgctaagcctgacctttattaagactaccttctcccttcactatgcttggaaaacaatggccatggttctctcaatcgtgagcctgtttcccttgtgtctgagtactacctctcagaagacgacatggttaccggtcctcctgggctcccttgggtgcaagcctctgaccatgttcttgatagccgagaataaaatctggggaaggcgaagctggccactcaacgaaggtattatggctgtaggcatcgtgtcgattctgctatcatctctgcttaagaacgatgttcccctcgcagggcctctgatcgccggaggcatgttgatagcgtgttacgtgattagtggttccagcgctgacttatctctggagaaagccgcagaggtcagctgggaagaggaagccgagcattccggggcttcacacaatatcctcgtggaagtacaggatgacggaactatgaagatcaaagatgaggagcgcgacgatacactgaccattcttctgaaggcaactttgctagccgtgagtggcgtctatcccctgagcataccagcgacactctttgtttggtacttctggcagaagaagaagcagcggtctggcgtgctgtgggacaccccttcacccccagaagtggagagagctgtccttgatgacgggatctataggattatgcagcgtggattactgggtcgcagccaggtgggcgttggggtattccaagaaaacgtgtttcatacgatgtggcacgtcactcggggagccgtgctcatgtaccagggcaaaagattggagccgagttgggcaagcgttaagaaagacctgatctcctacggtgggggatggaggctccagggctcttggaataccggcgaggaagtgcaggtcattgccgtggagcctgggaagaaccccaaaaatgtacaaacagctccaggaaccttcaagacacccgaaggtgaggtcggcgccatcgcactggattttaagcctgggacttcgggaagcccaatagtgaaccgagaaggcaaaatcgttggtctttatgggaatggagtggtcaccacgtcaggcacatacgtgtccgctattgcccaggcgaaggccagtcaggagggccccctgcctgagatcgaagacgaggttttccggaaacgcaacttgactattatggatctacacccggggtctggaaagaccagaaggtatctgccagcaatcgtgcgggaagctataaaacgaaagctcagaacattaattctggcccccacccgcgtcgtggctagcgagatggcagaagcccttaagggtatgcctatcaggtaccaaactaccgccgtaaaatccgagcatacaggcaaggagatcgtggacctgatgtgccacgctacgtttactatgcgtctcttgtcaccagttcgggtccccaattataacatgattatcatggatgaagcgcatttcaccgacccttctagcatagcagccagagggtacattagtacaagggtgggaatgggcgaggctgccgcaatctttatgaccgccactccgcccggttccgtggaggctttcccacagagcaatgcggtcattcaggatgaggaacgcgacatccctgagcgatcttggaactcagggtatgagtggataacagattttcccggaaaaaccgtatggttcgtgccatccattaagagtggcaatgacatcgccaactgtctgaggaaaaatggcaagcgggttatccagctcagcaggaagacgtttgatactgaataccagaaaacaaagaacaacgactgggactacgtggtcaccaccgatatttcggagatgggggcaaatttccgcgctgaccgtgtgatcgatcctagacggtgcctgaaacccgttattcttaaggacggaccagaaagggtgatactagccggtccgatgcctgtcactgtggcatctgccgctcagcgccgaggcagaatcgggcggaaccacaataaagagggagatcagtatatttacatgggccagcccctgaacaatgacgaggatcatgcccactggacagaagcgaagatgttgttagacaacatcaataccccagagggtatcattcccgcactgttcgaacctgagagggaaaagtccgccgctatagatggggagtatcgcctcagaggcgaggccaggaaaacatttgtagaactgatgcggcgtggagaccttccagtgtggctgagctacaaggttgcttcagagggcttccaatatagtgatcgccgatggtgctttgacggggaaagaaacaatcaggtcctcgaggaaaacatggatgtggagatctggactaaagagggagaaaggaagaaattgcggccccgctggctggacgcaagaacgtactctgaccctctagccctgagggagttcaaggaatttgctgccggtcggcgatccgtgagcggcgatctcattcttgagatcgggaaactgccgcagcacttaacccagagagcacaaaatgcgttggacaacctggtcatgctccataattcagaacagggaggccgcgcctataggcacgctatggaggagctgccagatacaattgaaactcttatgctgctcgccttgatcgcagttctgaccggtggggtgacattattctttctaagtggccggggactgggcaagaccagcatagggctcctttgtgtaatggcttcctctgtgctgttgtggatggccagcgtcgagccccattggatcgcagcctccattatcctggagttctttctcatggtgctgcttattcctgagcccgaccgtcagagaactccacaggataaccaactcgcttacgttgtgatcggactgttgttcatgatactgacggtcgcggccaatgagatgggtttactagaaaccacaaagaaagacctgggcattgggcacgtagcagtgggaaaccaccatcacgctgccatgctcgatgttgaccttcatcctgcctcagcatggactctgtacgctgtggccaccacaatcattacccccatgatgaggcacactatcgagaacacaacggcgaatatatctttgaccgctatcgccaaccaggcagccattctgatgggcctcgataagggttggccaatcagtaaaatggacattggggtccctctgcttgctttaggctgctattcgcaagtgaatccgctgactctcacagcagccgtcttgatgctggtggcgcattacgctatcataggacccggcctacaagccaaggcaacccgcgaagcccagaaacggaccgctgccgggattatgaagaacccaacagttgatggaatcgtggcaatcgacctggatcctgtagtgtatgacgctaagtttgagaaacagctcggccagattatgcttctgatcttgtgtactagccaaatactgctcatgcgaacgacctgggccctgtgcgaatccattacattagcgactggtccccttaccacactgtgggaggggtctccaggaaagttctggaataccactatcgccgtctcaatggcaaacatttttagaggcagctacctcgctggtgccggcctagcattctccctgatgaaaagtctagggggaggcaggcgcgggacgggagctcagggcgagacactgggtgaaaagtggaaacggcagctcaatcagctttctaagagcgagttcaacacctataagagatcagggatcatggaagttgaccgttccgaggccaaagaaggactgaagaggggcgagactaccaaacacgccgtgagtcggggtacagcgaagttgcgctggtttgtcgagcgaaatctggtgaaacctgaaggcaaggtaatagatctcgggtgtggaagaggcgggtggagctactattgcgctggattaaagaaagtgactgaggttaagggctacaccaaaggtgggcccggacacgaagaaccgatcccaatggcaacatacggctggaacctggtgaaacttcattctggcaaagacgtcttctttattcctcccgaaaagtgtgatacgctgctatgcgacatcggggagtcctcaccaaatcccaccattgaggaaggaaggactctccgggtgctgaaaatggtcgagccttggttgcgcggtaaccaattctgtatcaagattctgaatccgtatatgcccagcgtggttgaaacactcgagcagatgcagagaaagcacggcgggatgcttgtaaggaacccactgtcgcgaaattctacccatgagatgtactgggtgagttgcggaactggcaacatcgtctccgccgtgaatatgacaagccggatgttactgaaccgttttaccatggctcacagaaaacctacgtatgaacgcgatgttgacttgggtgccgggaccaggcacgtggcagtcgagcccgaagtggccaacctcgatataattggacagcggatcgagaatatcaagcatgaacacaaatcaacatggcattacgacgaggataacccttataagacttgggcttaccacggctcctatgaggtaaaaccatctggcagcgcgagttccatggtgaatggggttgtcaagctgctaaccaagccctgggacgtgattcctatggtgacacaaatagccatgactgataccacaccattcggacagcagagagtctttaaagaaaaggttgacacccgcactcccaaagcaaagaggggtacggctcaaatcatggaggtgacagccaaatggctttggggcttcctgagccgaaacaagaagccgcggatttgtaccagagaagagtttactaggaaagtacgctctaatgcagccatcggggctgtgttcgtcgacgaaaaccagtggaactcagccaaggaggcggtggaggatgaacgtttttgggacctcgttcatcgggagagagaactgcacaaacagggaaagtgcgcaacctgcgtgtacaacatgatgggcaaaagggagaagaagttgggtgagttcgggaaagccaagggaagtcgcgctatttggtacatgtggctgggcgcccgatttctcgagttcgaggcacttggcttcatgaatgaagatcactggttttcccgggagaacagcctgtctggggtcgaaggagagggtttacataaactgggctatatcttgagagacatatcgaagatccctgggggaaatatgtacgctgatgacacagccggctgggatacgaggattaccgaggacgatctccagaacgaagctcgcatcactgacattatggagccagaacacgccctgctagcaaaatcaatcttcaaacttacatatcaaaataaagtggtaagagttcagcggcccgcgaagaacggtaccgtgatggatgtcataagcaggcgtgaccagcgagggtccggacaggtgggcacttacagtctgaatacatttaccaacatggaggcccaactcattcgccagatggaatctgagggcatcttcagcccttccgagctggaaacaccaaacttggctgagagagtgttagattggctggaaaagtatggggtcgagcggctcaaaaggatggccatctcaggagacgactgtgttgtgaagcccattgatgaccgctttgcaactgctcttaccgccctgaatgatatgggtaaagtaagaaaggacataccgcagtgggaacctagtaaaggctggaacgattggcagcaagtgcccttctgctctcatcactttcaccagctaatcatgaaggacgggcgggagattgtcgtgccatgtaggaatcaggatgagctggttggacgagcacgtgtgagccagggcgccggttggtccctcagagaaacggcgtgcttggggaagtcatacgctcaaatgtggcagctgatgtatttccatcgccgggaccttaggctggccgcaaacgccatctgtagcgctgtccctgtggattggattcccacctctagaacaacttggtccatccacgcccatcaccagtggatgaccacagaggacatgctcagtgtatggaatcgcgtttggatagaagagaacccatggatggaagataaaactcatatcagctcgtggggagacgtgccctacttaggcaagcgggaggaccaatggtgcggctccctgattgggttgaccgcaagggctacgtgggccacaaatatccaggtcgcgattaaccaggtgcgaagactgatcggaaatgagaactacctcgattatatgacctctatgaaacggtttaagaatgaatcagaccctgagggtgctctttggtga

SEQ ID NO: 13316 - RNA, 9879 nt, synthetic construct
  misc_feature 1..9879: note = derived and/or modified CDS sequence (opt3) from DENV-1__HM181952__SS-prME
  source 1..9879: mol_type = other RNA
agcgtgacaatgctgctcatgcttatgcccacagccctggctttccacttgactacgagaggaggggaacctcatatgatcgtctccaagcaggaaagggggaaatctttactgtttaagacctcagccggtgttaatatgtgcacattaattgccatggacctcggagagctgtgtgaagatactatgacctacaaatgcccacggataacagaggcggaaccggacgatgtggactgttggtgcaatgctaccgatacttgggtaacatatgggacctgtagtcaaacgggagagcaccgccgagagaagcgtagcgtggcccttgcaccccatgtcggactgggtttggaaactagaaccgagacatggatgtcctctgaaggggcctggaaacagatccagagggtggagacttgggctctccggcaccctggattcaccgttattgcactgtttctggcccatgctatcggcacatcgattacccagaagggcatcatattcatcctcttaatgctggtgacgccatcaatggccatgcgctgcgtcgggattggaagcagagactttgtggagggtcttagtggcgcgacttgggtagatgttgtgttggaacacgggtcctgtgtcacaaccatggcaaaggacaaacccactctggatatcgagctgctcaagacagaagtgaccaaccctgccgtgctgaggaaactttgcattgaggctaagatctctaatacgaccacagacagccggtgtccaactcaaggagaagccaccctggtcgaggagcaggatgcaaacttcgtttgccgccgaacatttgtggacagaggctggggtaatgggtgtggattgttcggcaaaggctccctcctgacttgcgctaagtttaagtgcgtaaccaaattagaagggaagatagtgcagtacgagaacctgaaatattcagtcattgtgacagttcacaccggagatcagcatcaagtgggtaatgaaagtactgagcacggcacgacagccaccatcactccccaggcgcctaccacagaaattcagctcaccgactacggggcccttactctggactgtagcccaaggacaggattggatttcaacgagatggtcctactgacgatgaaggagaaatcttggctcgtgcataagcagtggtttctggaccttccgctgccctggacctccggcgcatcaactagccaagaaacatggaatcggcaggatttgctcgtaaccttcaaaacagctcacgccaagaagcaggaggttgtggtcctgggtagtcaagaaggggctatgcacactgccttaaccggcgcaacggagatccagacctctggaacaactaccatctttgccggccatctgaaatgccgtctaaagatggacaaactcacactgaaggggatgtcctatgtgatgtgtactggcagcttcaaacttgaaaaggaggtcgctgagacccagcacggtacggtgttggttcagattaagtacgaaggcacagatgcgccttgcaaaataccattctcgacccaagacgagaagggggtgactcagaacggacgcctgatcacagcaaatcccattgtaaccgataaagaaaagcctgtcaacatcgaggccgagccaccctttggcgaatcttatatagtgattggtgctggggagaaagccctcaagctgtcctggttcaagaaaggctcaagtatcggaaagatgtttgaagcaactgccagaggcgctaggcggatggccatccttggggacaccgcatgggatttcggaagcattggtggcgtttttacatccgtggggaaactggtccatcagatcttcggaacggcgtacggcgtgttgttttctggtgtaagctggaccatgaagattgggataggcgtgctcctgacttggttaggactaaattcacgaagtacatccctaagcatgacctgtatcgctgttggcctcgtcacactgtaccttggggtgatggtgcaggccgactctggatgcgtcattaactggaaaggccgcgagttgaagtgtggttcagggatcttcgttactaatgaagtgcacacctggacggagcaatataagtttcaggcagatagtccgaaaagactgagcgccgctatcggaaaggcctgggaggaaggcgtgtgcggtattaggtccgcaacacggctcgagaacataatgtggaaacagatctctaacgaactgaatcatattttactggagaacgacatgaagttcaccgtagtcgtgggcgacgttgctgggatccttgtgcagggcaagaagatgattcgccctcaacccatggaatacaaatattcgtggaaaagctggggcaaggccaaaatcataggggcggatgtccaaaattccacttttatcattgacggaccaaacacccctgagtgtcccgatgaccagagagcctggaatatctgggaggtggaagattacggcttcggtatttttacaactaacatctggttgaagctcagggactcatatacccaggtttgcgatcaccgtctgatgagtgctgcaataaaagactctaaggccgtgcacgctgatatggggtactggattgagagcgagaagaatgagacatggaagctagccaaggcatccttcatcgaagtaaaaacgtgtatttggccaaagtcacataccctgtggagcaacggagtcctcgagtctgagatgatcatacccaaaatccacggcggtcctatttcccaacataattatcggccaggctacttcactcagacagcggggccgtggcacctgggaaaacttgaattggactttgatctgtgcgagggcaccactgtggtggtcgacgaacactgcgggaaccgaggacccagtttaagaacaaccacggttactggcaaaatcattcatgagtggtgttgcaggagctgtaccctccctccactgcgcttccggggtgaggatgggtgctggtacggaatggaaatcagacccgtgaaggagaaggaagagaatcttgtaaaatctatggtgtccgccggctcaggtgaagtcgacagttttagcctgggcttgctctgtatatcgattatgatcgaggaggtgatgaggtcccgctggtctcgaaagatgctgatgacagggaccctagctgttttctttctgctcatcatgggacagctgacttggaacgaccttattcggttgtgcatcatggtgggcgccaatgcaagcgatcgtatggggatgggaacaacctatctggctttaatggccacattcaaaatgagacctatgtttgcagtcggcctcctgttcaggcgccttacttcacgggaagtgctgctactcaccattggtctgagtttggttgcctccgtggagctgccaaactctttagaggaactcggggacggactggctatgggcataatgatccttaagctgttgacggattttcaaagctaccagctctgggcgacactgctatccctgaccttcattaaaactaccttttcacttcactatgcctggaagacaatggcaatggtcctcagcatcgtaagtctgttccccttgtgtctgtctactacctcccagaagacgacatggttaccggtgctcctgggcagccttgggtgcaaacctctgaccatgtttttgattgctgaaaataagatctggggaagaaaatcgtggccactcaacgagggtataatggccgttggcatcgtgtcaattctgctatctagtctgcttaagaacgacgtccccctcgccgggcctctgatcgctggaggcatgttgattgcatgttacgtgatctccggtagctctgccgatttaagcctggagaaagcggctgaagtatcctgggaggaagaggccgaacattcaggggcaagtcacaatatactcgtggaggtccaggacgatggaactatgaagattaaagacgaggaaagggatgacacactgaccatccttctgaaggccactttgctagctgttagcggcgtgtatcccctgtctatcccagcaacactcttcgtgtggcatttctggcaaaagaaaaagcagcgatccggcgtcctgtgggataccccttcacccccagaggtggaacgcgccgttcttgacgatgggatttaccggataatgcagagaggattactgggtaggagtcaggtaggcgtgggggtctttcaagagaacgtgttccacacgatgtggcacgttactcgtggagcggtgctcatgtatcagggcaaacgcttggagccgagctgggcttccgtcaagaaagacctgatctcttacggtgggggatggcggctccagggctcgtggaataccggcgaagaggtgcaggtaattgccgtcgaacctgggaagaaccccaagaatgtgcaaacagcaccaggaacctttaaaacacccgagggtgaagttggcgccatcgctctggacttcaagcctgggactagcggatcaccaattgtgaacagagagggcaaaatcgtcggtctttacgggaatggagtggttaccacgtccggcacatatgtgagtgccatagcacaggctaaggcctctcaggagggccccctgcctgaaatcgaggatgaagtctttaggaaacgaaacttgactattatggacctacatccggggagcggaaagacccggcgctacctgccagcgatcgtgagagaggccattaagaggaaactccggacattaatcctggcacccacccgagtagtggcttccgaaatggccgaggctcttaagggtatgcctataagatatcaaactaccgcagttaaatcagagcacacaggcaaggaaattgtcgatctgatgtgccatgccacgttcactatgcgcctcttgtctccagtgagggtgcccaattacaacatgatcatcatggacgaggcccactttaccgatcctagcagtattgctgcgcgtgggtatatctccacacgggtcggaatgggcgaagcagccgctatattcatgaccgccactccgcccggtagcatggaggcatttccacagtctaatgccgtaattcaggacgaagagagagatatccctgagaggtcatggaactccgggtacgaatggattacagacttccccggaaaaaccgtgtggtttgttccaagtatcaaggctggcaatgatatagcgaactgtctgcgcaagaatggcaaacgagtgattcagctcagcagaaagacgttcgacactgagtatcagaagacaaagaacaacgattgggactacgtcgtgaccaccgacatctcggaaatgggggccaatttccgggcagatagggttatcgaccctcgccgttgcctgaaacccgtgattcttaaggatggaccagagagagtcatcctagctggtccgatgcctgtgactgtagcctctgcagcccagcggaggggccgcattgggcgaaaccataataaggagggagaccagtacatatatatgggccagcccctgaacaatgatgaagaccacgctcactggacagaggccaaaatgttgttagataacatcaataccccagaaggtattatccccgcgctgtttgagcctgaaagagagaagtccgcagccatcgacggggagtaccggctcaggggcgaagctcgcaaaacattcgtggagctgatgagaaggggagatcttccagtttggctgagctataaggtcgcctcagaaggctttcaatacagtgaccggcgttggtgcttcgatggggagcgcaacaatcaggtgctcgaagagaacatggacgtggagatttggactaaagaaggagagcgaaagaaattgagacccaggtggctggatgctcggacgtattctgaccctctagcactgcgcgaatttaaggagttcgccgctggtagaaggtccgtcagcggcgacctcatacttgaaatcgggaagctgccgcagcatttaacccagcgggcccaaaatgcattggataacctggttatgctccacaattcagagcagggaggccgagcgtacagacatgccatggaggaactgccagacacaattgagactcttatgctgctcgctttgatcgccgtgctgaccggtggggtaacattatttttcctaagtggcaaaggactgggcaagaccagcattgggctcctttgtgtgatggcatcctctgtcctgttgtggatggctagcgtggaaccccactggatcgccgcatccataatcctggagtttttcctcatggttctgcttattcctgagcccgatcgccagaggactccacaggacaaccaactcgcctatgtggtcatcggactgttgtttatgattctgacggtagctgcgaatgaaatgggtttactagagaccaccaaaaaggatctgggcatcgggcacgtggccgttgaaaaccatcaccatgcagctatgctcgacgtggatcttcaccctgcctcagcctggactctgtacgcagtcgctaccacaataattacccccatgatgcggcatactatcgagaacacaacggccaatatttctttgaccgcgatcgctaaccaggccgcaatactgatgggactcgacaaaggctggccaatcagtaagatggatattggtgtgcctctgcttgccttagggtgctactcgcaggtcaatccgctgactctcacagctgcagtgttgatgctggttgcccactatgcgatcgtgggccccggactacaagctaaggccacccgtgaagcacagaaaagaaccgccgctggcattatgaagaacccaacaatcgacgggatagtagccattgatctggaccctgtggtctacgatgcaaaattcgagaagcagctcggacagatcatgcttctgatcttgtgtactagccaaattctgctcatgaggacgacctgggctctgtgcgagtccatcacattagccactggcccccttaccacactgtgggaaggttctccagggaaattttggaataccactatagcggtttcaatggccaacattttccgcggaagctatctcgcaggcgctggtctagccttctccctgatgaagagtttgggcgggggacggcgaggcacgggggcacagggagagacactgggcgaaaagtggaaaagacagctcaatcagctttctaagagcgagtttaacacctacaaaaggtcaggtatcatggaagtggaccgctccgaggctaaggaggggctgaaacggggagaaactaccaagcacgccgtcagtagaggcacagccaagttgcgttggttcgtggagaggaatctggtaaaacctgaaggtaaggtgattgacctcggctgtgggcggggaggctggagctattactgcgcggggctgaaaaaggttactgaggtgaaaggatataccaagggcggtcccgggcatgaagaaccgatcccaatggctacatacggatggaacctagtcaaacttcactctggcaaggatgtgtttttcatacctcccgagaagtgtgacacgctgctatgcgatatcggcgaatcctcaccaaatcccaccattgaggaagggcgcactctccgagtcctgaaaatggtggagccttggttgagaggaaaccaattttgtatcaagattctgaatccgtacatgcccagcgttgtagagacactcgaacagatgcagaggaaacatggtggcatgcttgtgcggaacccactgtcgcgcaattctacccacgagatgtattgggtcagttgcgggactggaaacatcgtgtccgcagttaatatgacaagcagaatgttactgaacaggttcaccatggcccaccgaaagcctacgtacgaacgggacgtggatttgggcgctggtacccgtcatgtcgccgtggagcccgaagtagcaaacctcgacattatcgggcagagaatagagaatattaaacacgagcataagtcaacatggcactatgatgaagacaacccttacaagacttgggcctatcatggatcctacgaggtgaaaccatctggcagcgctagttccatggttaatggcgtcgtgaagctgctaaccaaaccctgggatgtgatccctatggtcacacaaatcgcgatgactgacaccacaccatttgggcagcagcgcgttttcaaggaaaaagtggataccaggactcccaaggccaagcggggaacggcacaaattatggaggtaacagctagatggctttggggttttctgagccgcaacaaaaagccgaggatatgtacccgagaagagttcactcggaaagtgagatctaatgccgcaatcggcgccgtctttgtggacgagaaccagtggaactcagctaaggaagccgttgaggacgataggttctgggacctcgtgcaccgcgaacgtgagctgcacaaacaggggaagtgcgcgacctgcgtctataacatgatgggaaagcgggagaaaaagttgggcgagtttggtaaagcaaaggggagtagagccatttggtacatgtggctgggagctaggttcctcgagttcgaagcccttggctttatgaatgaggatcattggttctcccgcgaaaacagcctgtctggcgtggagggggagggattacacaaactgggttacatcttgcgagacatttcgaagatccctggcgggaatatgtatgcagatgacacagctggatgggatacgcggataaccgaagacgatctccagaacgaggccaaaatcactgacattatggaaccagagcatgctctgctagccaagtcaatctttaaacttacataccaaaataaagtagttagagtgcagaggcccgcaaagaacggcaccgtcatggatgtgattagccgcagagaccagcggggttccggacaggtgggaacttatggcctgaatacattcaccaacatggaagcgcaactcatcaggcagatggagagtgagggcatatttctgcctaacgaattggagacaccaaatttagccgaacgtgtcctggattggctcgagaaatacggggttgaacgacttaagcgcatggctatttctggagacgactgtgtggtaaaacccatcgatgacagattcgccactgcactgaccgctctaaacgatatgggtaaggtgcggaaggacatcccgcagtgggagcctagcaaaggctggaatgattggcagcaagtccccttttgctcccaccacttccatcagctgattatgaaggacgggagggagatagtggttccatgtcgcaaccaggatgaactcgtgggcagagcacgggtctcacagggcgcaggttggagtttgagggagacggcctgcctggggaaatcttatgcgcaaatgtggcagcttatgtactttcaccgacgtgacctgagactcgctgccaatgcaatctgtagcgccgtgcctgtagattgggttcccacctcccgcacaacttggtcaattcatgctcaccatcagtggatgaccacagaagacatgttaagcgtgtggaaccgggtctggatcgaggaaaatccatggatggaggataagactaggatttcttcctgggaggacgtgccctatctgggaaaaagagaagaccaatggtgcggcagtttgatcggcctgaccgcccgcgcaacgtgggctacaaacatacaggttgccatcaatcaggtgcggaggctcattgggaacgagaattacagcgattacatgacctcgatgaagcgattcaagaacgaatccgagcctgagggagcgctttggtga

SEQ ID NO: 13317 - RNA, 9879 nt, synthetic construct
  misc_feature 1..9879: note = derived and/or modified CDS sequence (opt3) from DENV-1__HM181953__SS-prME
  source 1..9879: mol_type = other RNA
agcgtgaccatgctgctcatgcttatgcccacagcactggctttccacttgactacgagaggaggggagcctcatatgatcgtctccaagcaagaaagaggaaaatctttactgtttaagacctcagccggtgttaatatgtgcacattgattgccatggacctcggcgagctgtgtgaagatactatgacctacaaatgcccacggataacagaggcggaaccggacgatgtggactgttggtgcaatgctaccgatacttgggtgacatatgggacctgtagtcaaacgggagagcaccgccgagacaagcgtagcgtggcccttgcaccccatgtcggcctgggtttggagactagaaccgaaacatggatgtcctctgagggggcctggaaacagatccagagggtggaaacttgggctctccggcaccctggattcaccgttattgcactgtttctggcccatgctatcggcacatcgattacccagaagggcatcatattcatcctcttaatgctggtgacgccatcaatggccatgcgctgcgtcgggattggaagcagagattttgtggagggtcttagtggcgcgacttgggtagacgttgtgttggagcacgggtcctgtgtcacaaccatggcaaaggataaacccactctggacatcgaactactcaagacagaggtgaccaaccctgccattctgaggaaactttgcatcgaagctaagatatctaatacgaccacagatagccggtgtccaactcaaggagaggccaccctggtggaagaacaagacgcaaacttcgtctgccgccgaacatttgttgatagaggctggggtaatgggtgtggattgttcggcaaaggctccctcattacttgcgctaagtttaagtgcgtgaccaaactggaggggaagatcgtacagtacgaaaacttaaaatattcagtgattgtcacagtgcacaccggagaccagcatcaagttggtaatgagagtactgaacacggcacgacagccaccatcactccccaggcgcctaccacagagatccagctgaccgactacggggccctcactcttgattgtagcccaaggacaggactggacttcaacgaaatggtgttgctaacgatgaaggagaaatcttggctggtccataagcagtggtttctcgatctgccgcttccctggacctccggcgcatcaactagccaagagacatggaatcggcaggacctgttggtgaccttcaaaacagctcacgccaagaagcaggaagtagttgtgctcggtagtcaagagggggctatgcacactgccctgaccggcgcaacggaaattcagacctctggaacaactaccatatttgccggccatttaaaatgccgtctgaagatggataaactaacactcaaggggatgtcctatgtcatgtgtactggtagcttcaaactggagaaggaagtggctgagacccagcacggaacggtccttgtgcagatcaagtacgagggcacagacgcgccttgcaaaattccattctcgacccaagatgaaaagggggttactcagaacggacgcttgatcacagcaaatcccatagtgaccgacaaagagaagcctgtaaacattgaagccgagccaccctttggcgagtcttatatcgtcatcggtgctggggaaaaagccctgaagctctcctggttcaagaaaggctcaagtattggaaagatgtttgaggcaactgccagaggcgctaggcggatggccatcctgggggataccgcatgggacttcggaagcattggtggcgtgtttacatccgttgggaaacttgtgcatcagatattcggaacggcgtacggcgtcctgttttctggtgtgagctggaccatgaagatcgggattggcgtattgctcacttggctgggattaaattcacgaagtacatccctgagcatgacctgtatcgctgtgggcctagttacactctacctgggggtcatggtgcaggccgattctggatgcgtgatcaactggaaaggccgcgaacttaagtgtggttcagggattttcgtcactaatgaggttcacacctggacggaacaatataagtttcaggcagacagtccgaaaagattgagcgccgctataggaaaggcctgggaggagggcgtgtgcggtatcaggtccgcaacacggctggaaaacattatgtggaaacagatctctaacgagctcaatcatattctgttagaaaacgacatgaagttcaccgtggtagtcggcgatgtggctgggatcctggttcagggcaaaaagatgatacgccctcaacccatggagtacaaatattcgtggaaaagctggggcaaggccaagatcattggggcggacgtgcagaatactacctttatcattgatggaccaaacacacctgaatgtcccgacgatcagagagcctggaatatctgggaggtcgaggactacggcttcggtatatttactaccaacatttggcttaagttgagggattcctatacacaggtgtgcgaccaccgtctcatgtcagctgcaatcaaagatagtaaggccgttcacgctgacatggggtactggattgaatctgagaaaaatgaaacgtggaagctggcccgggcatccttcatcgaggtgaagacctgtatatggccaaaatcccatactctatggtcaaacggagtactggaaagcgagatgatcattcccaagatctatggcggtcctatttctcaacacaattaccgaccaggctacttcacacagaccgcggggccgtggcatctcggaaaactggagcttgattttgacttgtgcgaaggcactacagtcgtggtggatgagcactgcgggaacagaggaccctccctgaggaccacgactgtcaccggcaagatcatacacgaatggtgttgccgcagttgtacattacctccactccggttcagaggtgaggacgggtgctggtatggaatggagattaggcccgttaaagaaaaggaggaaaatctggtaaagagcatggtatctgccggctccggtgaggtggactcatttagtcttggcctgttgtgtatcagcatcatgattgaagaggtcatgcgctcgcgatggtcccggaaaatgctcatgaccgggactctggctgtgttcctactgctcatcatgggacagctgacatggaacgatcttattcgtttgtgcataatggttggcgccaatgcatctgacagaatggggatgggaaccacatacctggctttaatggccacttttaagatgaggcctatgttcgcagtgggcctcctgtttcgccggcttaccagcagagaggtcctgctactcacgatcggtctgtcattggtggccagtgttgaactgccaaactccttagaggaactcggggatggactggctatgggcattatgatccttaaactgttgacagacttccaatctcatcagctctgggcgaccctgctaagcctgacttttattaagaccacattctcccttcactatgcctggaaaactatggcaatggtgctctcaatcgtcagcctgtttcccttgtgtctgagtaccacgtctcagaagacaacctggttaccggtactcctgggctcccttgggtgcaagcctctgactatgttcttgatagctgagaataaaatctggggaaggcgaagctggccactcaacgaaggtattatggccgtgggcatcgtttcgattctgctatcatctctgcttaagaacgatgtgcccctcgccgggcctctgatcgctggaggcatgttgatagcatgttacgtcattagtggttccagcgccgacttatctctggagaaagcggctgaggtgagctgggaagaggaagccgagcattccggggcatcacacaatatcctcgtagaagtgcaggatgacggaacaatgaagatcaaagatgaggagcgcgacgataccctgactattcttctgaaggccacattgctagctgtcagtggcgtttatcccctgagcataccagcaaccctctttgtgtggtacttctggcagaaaaagaagcagcggtctggcgtgctgtgggacacgccttcacccccagaagtcgagagagccgtgcttgatgacgggatctataggattatgcagcgtggattactgggtcgcagccaggttggcgtaggggtgttccaagaaaacgtctttcatactatgtggcacgtgacccggggagcggttctcatgtaccagggcaaaagattggagccgagttgggctagcgtgaagaaagacctgatctcctacggtgggggatggaggctccagggctcttggaatacaggcgaggaagtccaggtgattgccgtagagcctgggaagaaccccaaaaatgtccaaaccgcaccaggaacattcaagactcccgaaggtgaggtgggcgccatcgctctggattttaagcctgggacctcgggaagcccaatagttaaccgagaaggcaaaatcgtgggtctttatgggaatggagtcgtgacgacatcaggcacttacgtttccgccattgcacaggctaaggccagtcaggagggccccctgcctgagatcgaagacgaggtgttccggaaacgcaacttgaccattatggatctacacccggggtctggaaagacaagaaggtatctgccagcgatcgtccgggaagccataaaacgaaagctcagaaccttaattctggcacccactcgcgtggtagctagcgagatggccgaagctcttaagggtatgcctatcaggtaccaaaccacagcagtgaaatccgagcatacgggcaaggagatcgttgacctgatgtgccacgccacttttaccatgcgtctcttgtcaccagtccgggtgcccaattataacatgattatcatggatgaagcccatttcacagacccttctagcatagctgcgagagggtacattagtaccagggtgggaatgggcgaggcagccgctatctttatgactgccacaccgcccggttccgtcgaagcattcccacagagcaatgccgtaattcaggatgaggaacgcgacatccctgagcgatcttggaactcagggtatgagtggataaccgattttcccggaaaaacggtgtggttcgttccatccattaagagtggcaatgacatcgctaactgtctgaggaaaaatggcaagcgggtgatccagctcagcaggaagacttttgatacagaataccagaaaaccaagaacaacgactgggactacgtcgtgaccactgatatttcggagatgggggcgaatttccgcgccgaccgtgttatcgatcctagacggtgcctgaaacccgtgattcttaaggacggaccagaaagggtcatactagcaggtccgatgcctgtgacagtagcttctgccgcacagcgccgaggcagaatcgggcggaaccacaataaagagggagatcagtatatttacatgggccagcccctgaacaatgacgaggatcatgcccactggaccgaagctaagatgttgttagacaacatcaatacaccagagggtatcattcccgccctgttcgaacctgagagggaaaagtccgcggcaatagatggggagtatcgcctcagaggcgaggccaggaaaacttttgtggaactgatgcggcgtggagaccttccagtttggctgagctacaaggtcgcttcagagggcttccaatatagtgatcgccgatggtgctttgacggggaaagaaacaatcaggtgctcgaggaaaacatggatgtggagatctggacgaaagagggagaaaggaagaaattgcggccccgctggctggacgccagaacctactctgaccctctagctctgagggagttcaaggaatttgcagccggtcggcgatccgtcagcggcgatctcattcttgagatcgggaaactgccgcagcacttaacacagagagctcaaaatgccttggacaacctggttatgctccataattcagaacagggaggccgcgcatataggcacgcgatggaggagctgccagatactattgaaacccttatgctgctcgccttgatcgctgtgctgacaggtggggtaaccttattctttctaagtggccggggactgggcaagactagcatagggctcctttgtgtgatggcctcctctgtcctgttgtggatggcaagcgtggagccccattggatcgctgcctccattatcctggagttctttctcatggttctgcttattcctgagcccgaccgtcagagaacgccacaggataaccaactcgcatacgtggtcatcggactgttgttcatgatactgaccgtagccgctaatgagatgggtttactagaaacaactaagaaagacctgggcattgggcacgtggcggttggaaaccaccatcacgccgcaatgctcgatgtggaccttcatcctgcttcagcctggaccctgtacgccgtcgcaacaaccatcattactcccatgatgaggcacacaatcgagaacacgaccgctaatatatctttgactgccatcgcgaaccaggctgccattctgatgggcctcgataagggttggccaatcagtaaaatggacattggggtgcctctgcttgcattaggctgctattcgcaggtcaatccgctgacactcaccgccgctgtgttgatgctggttgcacattacgccatcataggacccggcctacaagcgaaggctacccgcgaagcccagaaacggacagcagccgggattatgaagaacccaactgtggatggaatcgtagctatcgacctggatcctgtggtctatgacgccaagtttgagaaacagctcggccagattatgcttctgatcttgtgtacgagccaaatactgctcatgcgaaccacatgggcactgtgcgaatccattactttagctaccggtccccttacaaccctgtgggaggggtctccaggaaagttctggaatactacgatcgccgtttcaatggcgaacatttttagaggcagctacctcgccggtgcaggcctagctttctccctgatgaaaagtctagggggaggcaggcgcgggacaggagcccagggcgagaccctgggtgaaaagtggaaacggcagctcaatcagctttctaagctggagttcaacacttataagagaagcgggatcatggaagtggaccgttcagaggcaaaagaaggattgaagaggggcgagaccacaaaacacgctgtctcccggggtactgccaagctgcgctggtttgtggagcgaaatctcgtaaaacctgaaggcaaggtgatagatttagggtgtggaagaggcgggtggagttactattgcgccggactgaagaaagttaccgaggtgaagggctacacaaaaggtgggcccggacacgaagaaccgatcccaatggcgacgtacggctggaaccttgtcaagctgcatagcggcaaagacgtgttctttattcctcccgaaaagtgtgataccctactctgcgacatcggggagtcttccccaaatcccactattgaggaaggaaggacactgcgggtcttgaaaatggtggagccttggctgcgcggtaaccaattctgtatcaagattctcaatccgtatatgccctcagttgtagaaacccttgagcagatgcagagaaagcacggcgggatgctggtgaggaacccattaagccgaaattcgactcatgagatgtactgggtctcttgcggaacaggcaacatcgtgagtgctgttaatatgacctcccggatgctgttgaaccgttttacgatggcacacagaaaacctacctatgaacgcgatgtggacctcggtgccgggacaaggcacgtcgctgtggagcccgaagtagccaacctggatataattggacagcggatcgagaatatcaagcatgaacacaaaagcacttggcattacgacgaggataacccttataagacctgggcataccacggctcatatgaggtgaaaccatccggctctgccagcagtatggttaatggggtcgtgaagctacttacaaagccctgggacgtgattcctatggtcactcaaatagctatgaccgatacaaccccattcggacagcagagagtttttaaagaaaaggtggacactcgcacgcccaaagcgaagaggggtacagcccaaatcatggaggtaaccgcaaaatggctgtggggcttcctctcccgaaacaagaagccgcggatttgtactagagaagagtttaccaggaaagtgcgcagcaatgctgccatcggggcagtcttcgtggacgaaaaccagtggaactctgccaaggaggctgttgaggatgaacgtttttgggacctggtgcatcgggagagagaattgcacaaacagggaaagtgcgccacatgcgtctacaacatgatgggcaaaagggagaagaagctgggtgagttcgggaaagcgaagggatcacgcgcaatttggtacatgtggctcggcgcccgatttcttgagttcgaggctctgggcttcatgaatgaagatcactggtttagtcgggagaactccttaagcggggtggaaggagagggtctgcataaattgggctatatcctcagagacatatctaagatccctgggggaaatatgtacgccgatgacacggcaggctgggataccaggattactgaggacgatctgcagaacgaagctcgcatcacagacattatggagccagaacacgccctacttgctaaatcgatcttcaagctgacctatcaaaataaagtagttagagtgcagcggcccgccaagaacggtactgtcatggatgtgatatcaaggcgtgaccagcgagggagcggacaggtgggcacatacggcctcaatacctttacaaacatggaggcacaactgattcgccagatggaatccgaggggatcttcagtccttctgagttggaaactccaaacttagcggagagagtcctggattggctcgaaaagtatggagttgagcggcttaaaaggatggccatcagcggtgacgactgtgtggtaaagcccattgatgaccgctttgctaccgccctgacggcactaaatgatatgggcaaagtgagaaaggacataccgcagtgggaaccttccaaagggtggaacgattggcagcaagtccccttctgctcacatcactttcaccagctgatcatgaaggacggacgggagattgtggttccatgtaggaatcaggatgagctcgtgggccgagctcgtgtcagtcagggtgccgggtggtctttgagagaaaccgcatgcctgggaaagagctacgcccaaatgtggcagcttatgtatttccatcgccgggacctgaggctcgcggctaacgccatctgttccgcagtgcctgtagattggattcccacatcaagaactacctggagcatccacgcccatcaccagtggatgacaactgaggacatgttatctgtttggaatcgcgtgtggatagaagagaacccatggatggaagataaaacccatatctccagttggggcgacgtcccctacctgggcaagcgggaggaccaatggtgcgggagcttgattggactgacggctagggccacatgggcaaccaatatccaggtggctattaaccaggttcgaagactcatcggtaatgagaactaccttgattatatgacttcgatgaaacggtttaagaatgaatccgaccctgagggcgccctgtggtga

SEQ ID NO: 13318 - RNA, 9879 nt, synthetic construct
  misc_feature 1..9879: note = derived and/or modified CDS sequence (opt3) from DENV-1__KF921933__SS-prME
  source 1..9879: mol_type = other RNA
agcgtgaccatgctgctcatgcttatgcccacagccctggctttccacttgactacgagaggaggggagcctcatatgatcgtctccaagcaggaaaggggaaagtctttactgtttaagacctcagcgggtgttaatatgtgcacactcattgccatggacctcggcgagctgtgtgaagatactatgacctacaaatgcccacggataacagaggcggaaccggacgatgtggactgttggtgcaatgctaccgatacttgggtaacatatgggacctgtagtcaaacgggagagcaccgccgagacaagcgtagcgtggcccttgcaccccatgtcggcctgggtttggagactagaaccgaaacatggatgtcctctgagggggcctggaaacagatccagagggtggaaacttgggctctccggcaccctggattcaccgttattgcactgtttctggcccatgctatcggcacatcgattacccagaagggcatcatattcatcctcttaatgctggtgacgccatcaatggccatgcgctgcgtcgggattggaagcagagattttgtggagggtcttagtggcgcgacttgggtagacgttgtgttggagcacgggtcctgtgtcacaaccatggcaaaggataaacccactctggacatcgaactgctcaagacagaggtgaccaaccctgccattctgaggaaactttgcatcgaagctaagatatctaatacgaccacagatagcaaatgtccaactcaaggagaggccaccctggtggaagaacaggacgcaaacttcgtctgccggcgcacatttgttgatcgaggctggggtaatgggtgtggattgttcggcaagggctccctcattacttgcgctaagtttaaatgcgtgaccaagctggaggggaaaatcgtacagtacgaaaacttaaagtattcagtgattgtcacagtgcacaccggagaccagcatcaagttggtaatgagagtactgaacacggcacgacagccaccatcactccccaggcgcctaccacagagatccagctgaccgactacggggccctcactcttgattgtagcccaagaacaggactggacttcaacgaaatggtgttgctaacgatgaaagagaagtcttggctggtccataaacagtggtttctcgatctgccgcttccctggacctccggcgcatcaactagccaagagacatggaataggcaggacctgttggtgaccttcaagacagctcacgccaagaaacaggaagtagttgtgctcggtagtcaagagggggctatgcacactgccctgaccggcgcaacggaaattcagacctctggaacaactaccatatttgccggccatttaaagtgccggctgaaaatggataagctaacactcaaagggatgtcctatgtcatgtgtactggctcgttcaagctggagaaggaagtggctgagacccagcacggtacggtccttgtgcagatcaaatacgagggcacagacgcgccttgcaagattccattctcgacccaagatgaaaaaggggttactcagaacggacgtttgatcacagcaaatcccatagtgaccgacaaggagaaacctgtaaacattgaagccgagccaccctttggcgagtcttatatcgtcatcggtgctggggaaaaggccctgaagctctcctggttcaaaaagggctcaagtattggaaaaatgtttgaggcaactgcccgcggcgctagaaggatggccatcctgggggataccgcatgggacttcggaagcattggtggcgtgtttacatccgttgggaaacttgtgcatcagatattcggaacggcgtacggcgtcctgttttctggtgtgagctggaccatgaaaatcgggattggcgtattgctcacttggctgggattaaattcacggagtacatccctgagcatgacctgtatcgctgtgggcctagttacactctacctgggggtcatggtgcaggccgattctggatgcgtgatcaactggaagggccgagaacttaagtgtggttcagggattttcgtcactaatgaggttcacacctggacggaacaatataaatttcaggcagacagtccgaagcgcttgagcgccgctataggaaaagcctgggaggagggcgtgtgcggtatcagatccgcaacaaggctggaaaacattatgtggaagcagatctctaacgagctcaatcatattctgttagaaaacgacatgaaattcaccgtggtagtcggcgatgtggctgggatcctggcccagggaaagaaaatgatacggcctcaacccatggagtacaagtattcgtggaaaagctggggcaaggcgaagatcattggggccgacgttcagaatactacctttatcattgatggaccaaacacacctgaatgtcccgacgatcagcgcgcttggaatatctgggaggtggaggactacggcttcggtatatttactaccaacatttggcttaaattgagagattcctatacacaggtctgcgaccacaggctcatgtcagcagccatcaaggatagtaaagctgtgcacgccgacatggggtactggattgaatctgagaagaatgaaacgtggaagctggcacgtgcgagcttcatcgaggttaaaacctgtatatggccaaagtcccatactctatggtcaaacggagtgctggaaagcgagatgatcattcccaaaatctatggcggtcctatttctcaacacaattaccggctcggctacttcacacagaccgccgggccatggcatctgggaaaacttgagttggattttgacctgtgcgaaggcactacagtagtcgtggatgagcactgcgggaaccgaggaccgtccttaagaaccacgactgtgaccggcaaaatcatacacgaatggtgttgcaggagttgtacactaccccctctgcgcttccggggtgaggacgggtgctggtatggaatggagattagaccagtcaaggaaaaggaggaaaatcttgttaaaagcatggtgtctgctggctccggtgaggtagactcatttagtctgggcttgctctgtatcagcatcatgattgaagaggtgatgaggtcgcgctggtcccgaaagatgctgatgaccgggactctagccgtcttcctgctcctgatcatgggacagcttacatggaacgatttgattcggctgtgcataatggtgggcgcaaatgcttctgaccgtatggggatgggaaccacatacttagccctcatggcaacttttaaaatgagacccatgttcgccgttggcctgctttttaggcgcctgaccagccgggaggtgctactcctgacgatcggtttgtcactggtcgctagtgtggaattacctaactccctcgaggaactgggggatggacttgcgatgggcattatgatcctgaagttgctcacagacttccaatctcatcagctgtgggccaccctactgagccttacttttattaaaaccacattctccctccactatgcatggaagactatggctatggttctgtcaatcgtgagcttgtttccactgtgtttaagtaccacgtctcagaagacaacctggctccccgtcctgcttggctccctggggtgcaaaccgttgactatgttcctcatagccgagaataagatctggggaagaaggagctggcctctgaacgaaggtattatggccgtaggcatcgtgtcgattctactgtcatctcttctcaaaaacgatgttccactggctgggcccttgatcgcaggaggcatgttaatagcctgttacgtgattagtggttccagcgcggacctgtctctcgagaaggctgccgaggtcagctgggaagaggaagcagagcattccggggcctcacacaatatcctggtggaagtacaggatgacggaacaatgaaaatcaaggatgaggagcgagacgatacccttactattctgttgaaagctacactactggcagtgagtggcgtctatcctctcagcatacccgccaccctgtttgtttggtacttctggcaaaagaagaaacagcgctctggcgtgctttgggacacgccatcccctcccgaagtggagcgggcggtcttagatgacgggatctatagaattatgcagaggggactgctcggtcgttcacaggtgggcgttggggtattccaagaaaacgtgtttcatactatgtggcacgtcacccgcggagctgtgttgatgtaccagggcaagcggctggagccaagttgggccagcgttaaaaaggacctcatctcctacggtgggggatggagactgcagggctcttggaatacaggcgaggaagtgcaggtcattgcagtggagccggggaaaaaccctaagaatgtacaaaccgcccccggaacattcaagactccagaaggtgaggtcggcgctatcgcccttgattttaaacccgggacctcgggaagccctatagtgaacagggaaggcaagatcgttggtctgtatgggaatggagtggtcacgacatcaggcacttacgtgtccgcaattgctcaggccaaagcgagtcaggagggcccattgcccgagatcgaagacgaggttttccgaaagcggaacctaaccattatggatctgcaccctgggtctggaaaaacacgcagatatctcccggccatcgtgagggaagcaataaagcggaagttacgaaccctgattcttgctccaactagagtcgtggccagcgagatggctgaagcactgaaaggtatgcccatccgctaccaaaccacagccgtaaagtccgagcatacgggcaaagagatcgtggacctcatgtgccacgccacttttaccatgaggttgctgtcacctgttcgtgtcccaaattataacatgattatcatggatgaagctcatttcacagacccctctagcatagcggcacgggggtacattagtaccagagtgggaatgggcgaggccgctgccatctttatgactgcaacacctccgggttccgtggaagccttcccccagagcaatgctgtcattcaggatgaggaaagggacatcccagagcgctcttggaactcagggtatgagtggataaccgattttcctggaaagacggtatggttcgtgccctccattaaaagtggcaatgacatcgcgaactgtctccgaaagaatggcaagagagttatccagctgagccggaaaacttttgatacagaataccaaaagaccaaaaacaacgactgggactacgtggtcaccactgatatttcggagatgggggccaatttcagggcagaccgcgtgatcgatccacgtagatgccttaagcctgttattctaaaagacggacccgaacgggtgatactggctggtccaatgccggtcacagtggcctctgcagcccagaggcgcggccgaatcgggagaaaccacaataaggagggagatcagtatatttacatgggccagcctttgaacaatgacgaggatcatgctcactggaccgaagccaagatgttactggacaacatcaatacacccgagggtatcattccagcactcttcgaacccgagcgggaaaaatccgcagccatagatggggagtataggctgcgcggcgaggctagaaagacttttgtagaacttatgaggcggggagacctgcctgtgtggctcagctacaaagttgcctcagagggcttccaatatagtgatcgtcgctggtgctttgacggggaacgaaacaatcaggtcttggaggaaaacatggatgtggagatctggacgaaggagggagaaaggaagaagctgaggccacggtggctagacgctcgcacctactctgaccccctggcactcagagagttcaaagaatttgccgctggtaggcggtccgtgagcggcgatcttattctggagatcgggaagttacctcagcacttgacacagcgagcccaaaatgcactggacaacctcgtcatgctgcataattcagaacagggaggcagagcgtatcgccacgccatggaggagcttccggatactattgaaaccctgatgctcttggctctgatcgccgttttaacaggtggggtgaccctattctttctgagtggcaggggactcggcaagactagcatagggcttctgtgtgtaatggcatcctctgtgttgctgtggatggctagcgtcgagccacattggatcgccgcatccattatcctcgagttctttctgatggtgcttctcattcccgagcctgaccggcagcgtacgccccaggataaccaactggcctacgttgtgatcggattgctgttcatgatattaaccgtcgctgcgaatgagatgggtctactggaaacaactaaaaaggacctcggcattgggcacgtagccgtgggaaaccaccatcacgcagctatgcttgatgttgacctgcatccagcctcagcctggaccttgtacgcagtggctacaaccatcattactcctatgatgagacacacaatcgagaacacgaccgccaatatatctctgactgcgatcgctaaccaggccgcaattctcatgggcctggataaaggttggcccatcagtaagatggacattggggtcccacttttagccctgggctgctatagccaggtgaatcctctcacattgaccgctgcagtcctgatgctagtggcccattacgcgatcataggaccgggcctgcaagctaaagccaccagggaagcacagaagcgcacagccgctgggattatgaagaaccccactgttgatggaatcgtggccatcgacctcgatccagtagtgtatgacgcaaaatttgagaagcagcttggccagattatgctgttgatcctgtgtacgagccaaatactcctgatgcggaccacatgggctttatgcgaatccattactcttgccaccggtcctctgacaaccctctgggaggggtctcccggaaaattctggaatactacgatcgcggtctcaatggccaacatttttcgaggcagctacctagcaggagctggcctggccttctccttgatgaagagtctagggggtggcagaagggggacaggagcacagggcgagaccctcggtgaaaaatggaagcgccagcttaatcagctgtctaagagcgagttcaacacttataaacggtcagggatcatggaagttgacagatccgaggctaaggaaggattgaaacgtggcgagaccacaaagcacgccgtgagtaggggtactgccaaactgcggtggtttgtcgagcgcaatctcgtgaagccagaaggcaaggtaatagatttagggtgtggacgaggcgggtggagctactattgcgcgggactgaaaaaggtgaccgaggttaaaggctacacaaagggtgggcctggacacgaagaacccatcccgatggctacgtacggctggaaccttgtgaaactgcattctggcaaggacgtcttctttattccacctgaaaaatgtgataccctactctgcgacatcggggagtcctcacccaatccaactattgaggaaggaagaacactgagggtgttgaagatggtcgagccctggctgcggggtaaccaattctgtatcaagattctcaatccttatatgccgagcgtggttgaaacccttgagcagatgcagcgcaaacacggcgggatgctggtaagaaaccccttatcgagaaattctactcatgagatgtactgggtgagttgcggaacaggcaacatcgtctccgcagtgaatatgaccagccgaatgctgttgaaccggtttacgatggcccaccgtaagccaacctatgaaagagatgttgacctcggtgctgggacacgccacgtggccgtcgagcctgaagtggcaaacctggatataattggacagaggatcgagaatatcaaacatgaacacaagtcaacttggcattacgacgaggataacccctataaaacctgggcctaccacggctcctatgaggtaaagccttctggcagcgctagttccatggtgaatggggttgtcaagctacttacaaaaccatgggacgtgattcccatggtgactcaaatagcgatgaccgatacaacccctttcggacagcagcgggtctttaaggaaaaagttgacactagaacgccaaaggccaaacgcggtacagcacaaatcatggaggtgaccgctaagtggctgtggggcttcctcagcaggaacaagaaaccccgaatttgtactcgggaagagtttaccagaaaggtaaggtctaatgccgcaatcggggccgtgttcgtcgacgaaaaccagtggaactcagctaaagaggccgtggaggatggacgcttttgggacctggttcatcgtgaacgggagttgcacaagcagggcaaatgcgcgacatgcgtgtacaacatgatgggtaagagagaaaagaaactgggggagttcggaaaggcaaaaggcagtagggccatttggtacatgtggctcggcgctcgctttcttgagttcgaggccctggggttcatgaatgaggatcactggttttcccgagaaaacagcttatctggagtcgagggtgaaggcctgcataagttggggtatatcctccgggacatatcgaaaatcccgggaggcaatatgtacgcagatgacacggctggttgggataccagaattactgaggacgatctgcagaacgaggccaggatcacagacattatggaacctgagcacgctctacttgccaagtcaatcttcaaactgacctatcaaaataaggtggtacgcgttcagagaccagcaaagaacgggactgtgatggatgtcataagccggagggaccagcgtggatccggccaggtgggcacatacgggctcaatacctttacaaacatggaagcgcaactgattcgacagatggagagtgaaggaatcttctctcccagcgagttggagactcctaacttagccgaacgcgtgctggattggctcgagaaatatggtgtcgaaagacttaagcggatggctatctccggcgacgactgtgttgtgaaaccaattgatgacaggtttgccaccgcactgacggctctaaatgatatggggaaggtacgcaaagacataccccagtgggagccgtcaaagggatggaacgattggcagcaagtgcctttctgcagtcatcactttcaccagctgatcatgaaggacggcagagaaattgtcgtgccctgtcggaatcaggatgagctcgttggtagggcccgagtgtctcagggggcaggatggagcttgcgtgagaccgcctgcctgggcaaatcctacgcgcaaatgtggcagcttatgtatttccatagacgcgacctgcggctcgctgccaacgcaatctgttcagccgtcccagtggattggattcctacaagcaggactacctggtctatccacgctcatcaccagtggatgacaactgaagacatgttatccgtatggaatagagtttggatagaggaaaacccctggatggaggataagacccatatcagtagctggggcgacgtgccatacctggggaaacgcgaagaccaatggtgcggatcgttgattggtctgacggcccgggcaacatgggctaccaatatccaggtcgccattaaccaggtgaggcgactcatcggcaatgagaactaccttgattatatgacttccatgaagagatttaaaaatgagtctgaccccgaaggggcgctgtggtga

SEQ ID NO: 13319 - RNA, 9879 nt, synthetic construct
  misc_feature 1..9879: note = derived and/or modified CDS sequence (opt3) from DENV-1__HM181954__SS-prME
  source 1..9879: mol_type = other RNA
agcgtgaccatgctgctcatgcttatgccaacagccctggctttccacttgactacgagaggaggggagcctcatatgatcgtctccaagcaagaaagaggaaaatctttactgtttaagacctcagccggtgttaatatgtgcacattgattgccatggacctcggcgagctgtgtgaagatactatgacctacaaatgcccacggataacagaggcggaaccggacgatgtggactgttggtgcaatgctaccgatacttgggtaacatatgggacctgtagtcaaacgggagagcaccgccgagacaagcgtagcgtggcccttgcaccccatgtcggcctgggtttggagactagaaccgaaacatggatgtcctctgagggggcctggaaacagatccagagggtggaaacttgggctctccggcaccctggattcaccgttattgcactgtttctggcccatgctatcggcacatcgattacccagaagggcatcatattcatcctcttaatgctggtgacgccatcaatggccatgcgctgcgtcgggattggaagcagagattttgtggagggtcttagtggcgcgacttgggtagacgttgtgttggagcacgggtcctgtgtcacaaccatggcaaaggataaacccactctggacatcgaactactcaagacagaggtgaccaaccctgccattctgaggaaactttgcatcgaagctaagatatctaatacgaccacagatagccggtgtccaactcaaggagaggccaccctggtggaagaacaggacgcaaacttcgtctgccgccgaacatttgttgatagaggctggggtaatgggtgtggattgttcggcaaaggctccctcattacttgcgctaagtttaagtgcgtgaccaaactggaggggaagatcgtacagtacgaaaacttaaaatattcagtgattgtcacagtgcacaccggagaccagcatcaagttggtaatgagagtactgaacacggcacgacagccaccatcactccccaggcgcctaccacagagatccagctgaccgactacggggccctcactcttgattgtagcccaaggacaggactggacttcaacgaaatggtgttgctaacgatgaaggagaaatcttggctggtccataagcagtggtttctcgatctgccgcttccctggacccctggcgcatccacttcacaagagacatggaatcggcaggacctgttggtgaccttcaaaacagctcacgccaagaagcaggaagtagttgtgctcggtagccaagagggggctatgcacactgccctgaccggcgcaacggaaattcagaccagtggaacaactaccatatttgccggccatttaaaatgccgtctgaagatggataaactaacactcaaggggatgtcttatgtcatgtgtactggatccttcaaactggagaaggaagtggctgagacccagcacggtacggtccttgtgcagatcaagtacgagggcacagacgcgccatgcaaaattcccttcagcacccaagatgaaaagggggttactcagaacggacgcttgatcacagcaaatcctatagtgaccgacaaagagaagccagtaaacattgaagccgagcccccgtttggcgagtcgtatatcgtcatcggtgctggggaaaaagccctgaagctctcttggttcaagaaaggctcctcaattggaaagatgtttgaggcaactgccagaggcgctaggcggatggccatcctgggggataccgcatgggacttcggaagtattggtggcgtgtttacaagcgttgggaaacttgtgcatcagatattcggagcggcttacggcgtcctgttttccggtgtgtcttggacgatgaagatcgggattggcgtattgctcacctggctgggattaaatagccgatcaacaagtctgtccatgacatgtatcgccgtgggcctagttaccctctacctgggggtcatggtgcaggcagatagcggatgcgtgatcaactggaaaggccgcgaacttaagtgtggttctgggattttcgtcacaaatgaggttcacacttggaccgaacaatataagtttcaggccgactcacctaaaagattgagtgctgccataggaaaggcatgggaggagggcgtgtgcggtatcaggagcgctacgcggctggaaaacattatgtggaaacagatctccaacgagctcaatcatattctgttagaaaacgacatgaagttcacagtggtagtcggcgatgtggccgggatcctggcgcagggcaagaagatgatacgcccccaaccaatggagtacaaatattcttggaagtcgtggggcaaggccaaaatcattggggctgacgttcagaataccacttttatcattgatggacctaacacccccgaatgtccagacgatcagagagcatggaatatctgggaggtggaggactacggcttcggtatatttacaactaacatttggcttaagttgagggatagctatacccaggcctgcgaccaccgtctcatgtccgctgccatcaaagattcaaaggcagtccacgcggacatggggtactggattgaaagtgagaaaaatgaaacatggaagctggcccgggcttctttcatcgaggtgaagacgtgtatatggcccaaaagccataccctatggtccaacggagttctggaatcagagatgatcattcctaagatctatggcggtccaattagccaacacaattaccgaccgggctacttcactcagacagccgggccctggcatctcggaaaactggagcttgattttgacttgtgcgaaggcaccactgtggtagtcgatgagcactgcgggaacagaggaccttctctgaggacaaccacggtgactggcaagatcatacacgaatggtgttgccgctcctgtaccttaccacccctccggttcagaggtgaggacgggtgctggtatggaatggagattaggcctgtgaaagaaaaggaggaaaatctggtcaagagtatggttagcgcaggctctggtgaggtggactccttttcacttggcctgttgtgtatcagtatcatgattgaagaggtaatgcgcagccgatggtcgcggaaaatgctcatgacagggaccctggctgtgttcctactgctcatcatgggacagctgacttggaacgatcttattcgtttgtgcataatggtcggcgccaatgcatccgacagaatggggatgggaacaacctacctggccttaatggctacatttaagatgaggccaatgttcgcggtgggcctcctgtttcgccggcttacttctagagaggttctgctactcaccatcggtctgagcttggtggcctcagtcgaactgcccaacagtttagaggaactcggggatggactggcaatgggcattatgatccttaaactgttgacggacttccaatcccatcagctctgggctacactgctatctctgacctttattaagactaccttcagccttcactatgcctggaaaacaatggccatggtgctctccatcgtttcactgtttccgttgtgtctgagcactaccagtcagaagacgacatggttacctgtgctcctgggctctcttgggtgcaagccactgaccatgttcttgatagctgagaataaaatctggggaaggcgatcctggcccctcaacgaaggtattatggcagtcggcatcgtaagcattctgctatcgtcactgcttaagaacgatgtgcctctcgccgggcccctgatcgcgggaggcatgttgatagcttgttacgttatttctggtagttccgccgacttaagcctggagaaagcagccgaggtgtcttgggaagaggaagctgagcatagcggggcatcccacaatatcctcgtcgaagtgcaggatgacggaactatgaagatcaaagatgaggagcgcgacgatacactgaccattcttctgaaggccactttgctagcggtatcaggcgtgtatccactgagtatacctgctacactctttgtctggtacttctggcagaagaagaagcagcggagcggcgttctgtgggacaccccctctccaccggaagtggagagagccgtgcttgatgacgggatctataggattatgcagcgtggattactgggtcgctcccaggtcggcgtgggggttttccaagaaaacgtatttcatacgatgtggcacgtgactcggggagcagtcctcatgtaccagggcaaaagattggagccttcatgggccagtgtgaagaaagacctgatcagctacggtgggggatggaggctccagggctcctggaataccggcgaggaagttcaggtgattgctgtcgagcccgggaagaaccccaaaaatgtgcaaacagcccccggaaccttcaagacacctgaaggtgaggtaggcgcaatcgctctggattttaagccagggacttctggatcgcccatagtcaaccgagaaggcaaaatcgtgggtctttatgggaatggagttgtgaccacgagcggcacatacgtctcagccattgcgcaggccaaggcatcccaggagggccctctgccggagatcgaagacgaggtgttccggaaacgcaacttgactattatggatctacacccagggagtggaaagaccagaaggtatctgcccgctatcgttcgggaagccataaaacgaaagctcagaacattaattctggctcctacccgcgtggtcgcatctgagatggccgaagcccttaagggtatgccaatcaggtaccaaactaccgctgtgaaaagcgagcatacaggcaaggagatcgtagacctgatgtgccacgcgacgtttactatgcgtctcttgtcccccgtgcgggttcctaattataacatgattatcatggatgaagcacatttcaccgacccgtcatctatagccgctagagggtacattagcacaagggtcggaatgggcgaggccgcagccatctttatgaccgctactcccccaggtagtgtggaagcgttccctcagtccaatgccgtgattcaggatgaggaacgcgacatccccgagcgaagctggaactctgggtatgagtggataacagattttccaggaaaaaccgtctggttcgtaccttcaattaagtccggcaatgacatcgcaaactgtctgaggaaaaatggcaagcgggtgatccagctcagtaggaagacgtttgatactgaataccagaaaactaagaacaacgactgggactacgttgtgaccaccgatattagcgagatgggggctaatttccgcgccgaccgtgtcatcgatcccagacggtgcctgaaaccagtgattcttaaggacggaccggaaagggttatactagcaggtcctatgcccgtgactgtcgcctcggctgcccaacgccgaggcagaatcgggcggaaccacaataaagagggagatcagtatatttacatgggccagccactgaacaatgacgaggatcatgcgcactggacagaagcaaagatgttgttagacaacatcaatacccccgagggtatcattcctgccctgttcgaaccagagagggaaaagtctgctgccatagatggggagtatcgcctcagaggcgaggctaggaaaacatttgtggaactgatgcggcgtggagaccttcccgtatggctgtcctacaaggtggcaagcgagggcttccaatattcagatcgccgatggtgctttgacggggaaagaaacaatcaggttctcgaggaaaacatggatgtcgagatctggactaaagagggagaaaggaagaaattgcggcctcgctggctggacgccagaacgtacagtgacccgctagctctgagggagttcaaggaatttgccgcaggtcggcgatctgtgtccggcgatctcattcttgagatcgggaaactgccacagcacttaacccagagagcgcaaaatgccttggacaacctggtgatgctccataatagcgaacagggaggccgcgcttataggcacgccatggaggagctgcccgatacaattgaaactcttatgctgctcgcattgatcgctgtcctgaccggtggggttacattattctttctatcaggccggggactgggcaagaccagtatagggctcctttgtgtgatggccagctccgtactgttgtggatggcatctgtggagcctcattggatcgccgctagcattatcctggagttctttctcatggtcctgcttattcccgagccagaccgtcagagaactcctcaggataaccaactcgcgtacgtggttatcggactgttgttcatgatactgacggtggccgcaaatgagatgggtttactagaaaccacaaagaaagacctgggcattgggcacgtcgctgtaggaaaccaccatcacgccgccatgctcgatgtggaccttcatcccgcatccgcttggactctgtacgccgttgcgaccacaatcattaccccaatgatgaggcacactatcgagaacacaacggctaatatatcattgaccgccatcgcaaaccaggccgctattctgatgggcctcgataagggttggcctatctctaaaatggacattggggtgccgctgcttgcattaggctgctatagtcaggtcaatcccctgactctcacagccgcggtgttgatgctggtcgctcattacgccatcataggaccaggcctacaagcaaaggccacccgcgaagctcagaaacggaccgccgcagggattatgaagaaccctacagtggatggaatcgttgctatcgacctggatcccgtggtatatgacgccaagtttgagaaacagctcggccagattatgcttctgatcttgtgtacttcgcaaatactgctcatgcgaacgacctgggcgctgtgcgaaagcattacattagccactggtccacttaccacactgtgggaggggtcccctggaaagttctggaataccactatcgcagtgtctatggctaacatttttagaggctcatacctcgccggtgcaggcctagctttcagcctgatgaaatccctagggggaggcaggcgcgggacgggagcccagggcgagacactgggtgaaaagtggaaacggcagctcaatcagcttagtaagtctgagttcaacacctataagagaagcgggatcatggaagtcgaccgttcagaggccaaagaaggactgaagaggggcgagactaccaaacacgcggtttcccggggtacagctaagttgcgctggtttgtggagcgaaatctggtcaaacccgaaggcaaggtgatagatctcgggtgtggaagaggcgggtggagttactattgcgcaggattaaagaaagtaactgaggtgaagggctacaccaaaggtgggccgggacacgaagaaccaatccctatggccacatacggctggaacctggttaaacttcatagcggcaaagacgtgttctttattcccccagaaaagtgtgatacgctgctatgcgacatcggggagtcttcccccaatcctaccattgaggaaggaaggactctccgggtcctgaaaatggtggagccgtggttgcgcggtaaccaattctgtatcaagattctgaatccctatatgccatcagtcgtggaaacactcgagcagatgcagagaaagcacggcgggatgcttgttaggaaccctctgagccgaaattcgacccatgagatgtactgggtatcttgcggaactggcaacatcgtgagtgctgtcaatatgacatcccggatgttactgaaccgttttaccatggcccacagaaaacccacgtatgaacgcgatgtggacttgggtgcagggaccaggcacgttgccgtggagcctgaagtcgctaacctcgatataattggacagcggatcgagaatatcaagcatgaacacaaaagcacatggcattacgacgaggataacccatataagacttgggcgtaccacggctcatatgaggtgaaaccctccggctctgccagcagtatggtaaatggggtggttaagctgctaaccaagccttgggacgtcattccaatggtgacacaaatagcaatgactgataccacacccttcggacagcagagagtgtttaaagaaaaggtcgacacccgcactccgaaagctaagaggggtacggcccaaatcatggaggttacagcaaaatggctttggggcttcctgtcccgaaacaagaagcctcggatttgtaccagagaagagtttactaggaaagtgcgcagcaatgccgctatcggggccgtattcgtggacgaaaaccagtggaactctgcgaaggaggcagtcgaggatgaacgtttttgggacctcgtgcatcgggagagagaactgcacaaacagggaaagtgcgcaacctgcgtttacaacatgatgggcaaaagggagaagaagttgggtgagttcgggaaagctaagggatcacgcgccatttggtacatgtggctgggcgcacgatttctcgagttcgaggctcttggcttcatgaatgaagatcactggtttagtcgggagaactccctgagcggggtggaaggagagggtttacataaactgggctatatcttgagagacatatctaagatcccagggggaaatatgtacgccgatgacacagctggctgggatacgaggattaccgaggacgatctccagaacgaagcccgcatcactgacattatggagcccgaacacgcactgctagcgaaatcgatcttcaaacttacatatcaaaataaagtcgtgagagtacagcggcctgccaagaacggtaccgttatggatgtgatatcaaggcgtgaccagcgagggagcggacaggtcggcacttacggcctgaatacatttaccaacatggaggctcaactcattcgccagatggaatccgaggggatcttcagtccatctgagctggaaacacccaacttggccgagagagtgttagattggctggaaaagtatggagtggagcggctcaaaaggatggcaatcagcggtgacgactgtgtcgttaagccgattgatgaccgctttgctactgcccttaccgcactgaatgatatgggcaaagtgagaaaggacatacctcagtgggaaccctccaaagggtggaacgattggcagcaagtaccattctgctcacatcactttcaccagctaatcatgaaggacggacgggagattgtggtcccttgtaggaatcaggatgagctggtgggccgagcccgtgttagtcagggtgcggggtggtctctcagagaaacggcttgcttgggaaagagctacgcccaaatgtggcagctgatgtatttccatcgccgggaccttaggctggcagccaacgctatctgttccgccgtgcccgtcgattggattccaacctcaagaacaacttggagcatccacgcacatcaccagtggatgaccacagaggacatgctctctgtgtggaatcgcgtatggatagaagagaacccctggatggaagataaaactcatatctccagttggggcgacgttccttacttaggcaagcgggaggaccaatggtgcgggagcctgattggattgaccgctagggccacgtgggcgacaaatatccaggtggctattaaccaggtccgaagactgatcggtaatgagaactacctcgattatatgacctcgatgaaacggtttaagaatgaatccgacccagagggcgccctttggtga

SEQ ID NO: 13320 - RNA, 9879 nt, synthetic construct
  misc_feature 1..9879: note = derived and/or modified CDS sequence (opt3) from DENV-1__HM181955__SS-prME
  source 1..9879: mol_type = other RNA
agcgtgaccatgctgctcatgcttatgcccactgcactggctttccacttgactacgcggggaggggagcctcatatgatcgtctccaagcaggaaagaggaaaatctttactgtttaagacctcagccggtgttaacatgtgcacactaattgccatggacctcggcgagctgtgtgaagatactatgacctacaaatgcccacggataacagaggcggaaccggacgatgtggactgttggtgcaatgctaccgatacttgggtaacatatgggacctgtagtcaaacgggagagcaccgccgagacaagcgtagcgtggcccttgcaccccatgtcggcctgggtttggagactagaaccgaaacatggatgtcctctgagtcggcctggaaacagatccagagggtggaaacttgggctctccggcaccctgggttcaccgttattgcactgtttctggcccatgctatcggaacatcaattacccagaagggcatcatattcatcctcttaatgctggtgacgccaagcatggccatgcgctgcgtcggcattgggagtagagattttgtggagggactttccggtgcgacttgggtagacgttgtgttggagcacggctcttgtgtcacaaccatggcaaaggataaacccactctggacatcgaactactcaagacagaggtgaccaaccctgccattctgaggaaactttgcatcgaagctaagataagcaatacgaccacagattcccggtgtccaactcaaggggaggccaccctggtggaagaacaagacgcaaacttcgtctgccgccgaacatttgttgatagaggatggggcaatggttgtgggttgttcggaaaaggctcactcattacttgcgctaagtttaagtgcgtgaccaaactggagggcaagatcgtacagtacgaaaacttaaaatatagtgtgattgtcacagtgcacaccggggaccagcatcaagttggaaatgagagcactgaacacggtacgacagccaccatcactccccaggcgcctaccacagagatccagctgaccgactacggcgccctcactcttgattgttctccaaggacagggctggacttcaacgaaatggtgttgctaacgatgaaggagaaatcctggctggtccataagcagtggtttctcgatctgccgcttccctggacctcaggagcaagcacaagtcaagagacatggaatcggcaggacctgttggtgaccttcaaaacagctcacgccaagaagcaggaagtagttgtgctcggctctcaagagggtgctatgcacactgccctgaccggggcaacggaaattcagacctccggcacaactaccatatttgccggacatttaaaatgccgtctgaagatggataaactaacactcaagggcatgagctatgtcatgtgtactgggtcgttcaaactggagaaggaagtggctgagacccagcacggaacggtccttgtgcagatcaagtacgagggtacagacgcgccttgcaaaattccattctctacccaagatgaaaagggcgttactcagaacgggcgcttgatcacagcaaatcccatagtgaccgacaaagagaagcctgtaaacattgaagccgagccaccctttggagagtcctatatcgtcatcggcgctggtgaaaaagccctgaagctctcatggttcaagaaagggagtagcattggcaagatgtttgaggcaactgccagaggagctaggcggatggccatcctgggcgataccgcatgggacttcgggtccattggaggtgtgtttacatctgttggcaaacttgtgcatcagatattcgggacggcgtacggagtcctgtttagcggcgtgtcatggaccatgaagatcggtattggggtattgctcacttggctgggcttaaatagtcgatccacaagcctgtctatgacctgtatcgctgtgggcctagttacactctacctgggcgtcatggtgcaggccgattcagggtgcgtgatcaactggaaaggacgcgaacttaagtgtggcagtggtattttcgtcactaatgaggttcacacctggacggaacaatataagtttcaggcagacagcccgaaaagattgtccgccgctatagggaaggcctgggaggagggagtgtgcggcatcaggtctgcaacacggctggaaaacattatgtggaaacagatctcgaacgagctcaatcatattctgttagaaaacgacatgaagttcaccgtggtagtcggtgatgtggctggcatcctggcccaggggaaaaagatgatacgccctcaacccatggagtacaaatatagctggaagtcctggggaaaggcgaaaatcattggcgccgacgttcagaatactacctttatcattgatgggccaaacacacctgaatgtcccgacgatcagagagcttggaatatctgggaggtggaggactacggattcggcatatttactaccaacatttggcttaagttgagggattcatatacacaggtctgcgaccaccgtctcatgagtgcagccatcaaagattctaaggctgtgcacgccgacatgggttactggattgaaagcgagaaaaatgaaacgtggaagctggcacgggcgtccttcatcgaggttaagacctgtatatggccaaaatcacatactctatggagcaacggggtgctggaatctgagatgatcattcccaagatctatggaggccctatttcccaacacaattaccgaccaggttacttcacacagaccgccggcccgtggcatctcgggaaactggagcttgattttgacttgtgcgaaggaactacagtagtcgtggatgagcactgcggcaacagagggcccagtctgaggaccacgactgtgaccggaaagatcatacacgaatggtgttgccgcagctgtacattacctccactccggttcagaggcgaggacggttgctggtatgggatggagattaggcccgtcaaagaaaaggaggaaaatctggttaagtctatggtgtccgctggatcaggcgaggtagacagttttagccttggtctgttgtgtatctcgatcatgattgaagaggtgatgcgctcccgatggtctcggaaaatgctcatgaccggcactctggtcgtgttcctactgctcatcatggggcagctgacatggaacgatcttattcgtttgtgcataatggttggagccaatgcaagcgacagaatgggcatggggaccacatacctggctttaatggccacttttaagatgaggcctatgttcgcagtgggactcctgtttcgccggcttacctcaagagaggtcctgctactcacgatcggcctgagtttggtggcctccgttgaactgccaaactctttagaggaactcggtgatgggctggctatgggaattatgatccttaaactgttgacagacttccaaagccatcagctctgggcgaccctgctatccctgacttttattaagaccacattctcacttcactatgcctggaaaactatggcaatggtgctcagcatcgtcagtctgtttcccttgtgtctgtctaccacgtcccagaagacaacctggttaccggtactcctgggcagccttggctgcaagcctctgactatgttcttgatagctgagaataaaatctgggggaggcgatcgtggccactcaacgaaggaattatggccgtgggtatcgtttcaattctgctatctagtctgcttaagaacgatgtgcccctcgccggccctctgatcgctgggggaatgttgatagcatgttacgtcatttccggcagctctgccgacttaagcctggagaaagcggctgaggtgtcctgggaagaggaagccgagcattcaggtgcaagtcacaatatcctcgtagaagtgcaggatgacgggacaatgaagatcaaagatgaggagcgcgacgataccctgactattcttctgaaggccacattgctagctgtcagcggagtttatcccctgtctataccagcaaccctctttgtgtggtacttctggcagaagaagaagcagcggtccggcgtgctgtgggacacgccttcacccccagaagtcgagagagccgtgcttgatgacggcatctataggattatgcagcgtgggttactgggacgcagtcaggttggtgtaggcgtgttccaagaaaacgtctttcatactatgtggcacgtgaccagaggggcggttctcatgtaccagggaaaaagattggagccgagctgggcttccgtgaagaaagacctgatctcttacggcggtgggtggaggctccagggatcgtggaatacaggcgaggaagtccaggtgattgccgtagagcctggcaagaaccccaaaaatgtccaaaccgcaccagggacattcaagactcccgaaggagaggtgggtgccatcgctctggattttaagcctggcaccagcgggtcaccaatagttaaccgagaaggaaaaatcgtgggcctttatggtaatggggtcgtgacgacatccggaacttacgttagtgccattgcacaggctaaggcctctcaggagggccccctgcctgagatcgaagacgaggtgttccggaaacgcaacttgaccattatggatctacacccgggcagcgggaagacaagaaggtatctgccagcgatcgtccgggaagccataaaacgaaagctcagaaccttaattctggcacccactcgcgtggtagcttccgagatggccgaagctcttaagggaatgcctatcaggtaccaaaccacagcagtgaaatcagagcatacgggtaaggagatcgttgacctgatgtgccacgccacttttaccatgcgtctcttgtctccagtccgggtgcccaattataacatgattatcatggatgaagcccatttcacagaccctagcagtatagctgcgagaggctacatttccaccagggtggggatgggagaggcagccgctatctttatgactgccacaccgcccggcagcgtcgaagcattcccacagtctaatgccgtaattcaggatgaggaacgcgacatccctgagcgatcatggaactccggttatgagtggataaccgattttcccgggaaaacggtgtggttcgttccaagtattaagagcggaaatgacatcgctaactgtctgaggaagaatggcaagcgggtgatccagctctcgaggaagacttttgatacagaataccagaaaaccaagaacaacgactgggactacgtcgtgaccactgatatttctgagatgggcgcgaatttccgcgccgaccgtgttatcgatcctagacggtgcctgaaacccgtgattcttaaggacgggccagaaagggtcatactagcaggaccgatgcctgtgacagtagcttccgccgcacagcgccgaggtagaatcggccggaaccacaataaagagggggatcagtatatttacatgggacagcccctgaacaatgacgaggatcatgcccactggaccgaagctaagatgttgttagacaacatcaatacaccagagggcatcattcccgccctgttcgaacctgagagggaaaagagcgcggcaatagatggtgagtatcgcctcagaggggaggccaggaaaacttttgtggaactgatgcggcgtggcgaccttccagtttggctgtcatacaaggtcgctagtgagggattccaatattctgatcgccgatggtgctttgacggcgaaagaaacaatcaggtgctcgaggaaaacatggatgtggagatctggacgaaagagggggaaaggaagaaattgcggccccgctggctggacgccagaacctactccgaccctctagctctgagggagttcaaggaatttgcagccggacggcgaagcgtctcaggtgatctcattcttgagatcggcaaactgccgcagcacttaacacagagagctcaaaatgccttggacaacctggttatgctccataatagtgaacaaggcgggcgcgcatataggcacgcgatggaggagctgccagatactattgaaacccttatgctgctcgccttgatcgctgtgctgacagggggtgtaaccttattctttctaagcgggcggggcctgggaaagacttccataggcctcctttgtgtgatggcctctagcgtcctgttgtggatggcatccgtggagccccattggatcgctgcctcaattatcctggagttctttctcatggttctgcttattcctgagcccgaccgtcagagaacgccacaggataaccaactcgcatacgtggtcatcgggctgttgttcatgatactgaccgtagccgctaatgagatgggattactagaaacaactaagaaagacctgggtattggccacgtggcggttgggaaccaccatcacgccgcaatgctcgatgtggaccttcatcctgcttctgcctggaccctgtacgccgtcgcaacaaccatcattactcccatgatgaggcacacaatcgagaacacgaccgctaatataagtttgactgccatcgcgaaccaggctgccattctgatgggactcgataagggctggccaatctcgaaaatggacattggtgtgcctctgcttgcattagggtgctatagccaggtcaatccgctgacactcaccgccgctgtgttgatgctggttgcacattacgccatcataggccccggactacaagcgaaggctacccgcgaagcccagaaacggacagcagccggcattatgaagaacccaactgtggatgggatcgtagctatcgacctggatcctgtggtctatgacgccaagtttgagaaacagctcggacagattatgcttctgatcttgtgtacgtcccaaatactgctcatgcgaaccacatgggcactgtgcgaatctattactttagctaccggcccccttacaaccctgtgggagggttcaccagggaagttctggaatactacgatcgccgttagcatggcgaacatttttagaggatcctacctcgccggcgcaggtctagctttcagtctgatgaaatctttgggcgggggaaggcgcggcacaggggcccagggagagaccctgggcgaaaagtggaaacggcagctcaatcagcttagcaagtcagagttcaacacttataagagatccggtatcatggaagtggaccgtagtgaggcaaaagaagggctgaagaggggagagaccacaaaacacgctgtcagccggggcactgccaagttgcgctggtttgtggagcgaaatctggtaaaacctgaaggtaaggtgatagatctcggctgtgggagaggaggctggtcttactattgcgccgggttaaagaaagttaccgaggtgaagggatacacaaaaggcggtcccgggcacgaagaaccgatcccaatggcgacgtacggatggaacctggtcaaacttcattccggcaaagacgtgttctttattcctcccgaaaagtgtgataccctgctatgcgacatcggcgagtcaagcccaaatcccactattgaggaagggaggacactccgggtcctgaaaatggtggagccttggttgcgcggaaaccaattctgtatcaagattctgaatccgtatatgccctcggttgtagaaaccctcgagcagatgcagagaaagcacggtggcatgcttgtgaggaacccactgtctcgaaatagtactcatgagatgtactgggtctcctgcgggacaggaaacatcgtgagcgctgttaatatgacctcacggatgttactgaaccgttttacgatggcacacagaaaacctacctatgaacgcgatgtggacttgggcgccggtacaaggcacgtcgctgtggagcccgaagtagccaacctcgatataattgggcagcggatcgagaatatcaagcatgaacacaaatccacttggcattacgacgaggataacccttataagacctgggcataccacggatcttatgaggtgaaaccaagcggcagtgcctccagcatggttaatggcgtcgtgaagctgctaacaaagccctgggacgtgattcctatggtcactcaaatagctatgaccgatacaaccccattcgggcagcagagagtttttaaagaaaaggtggacactcgcacgcccaaagcgaagaggggaacagcccaaatcatggaggtaaccgcaaaatggctttggggtttcctgtctcgaaacaagaagccgcggatttgtactagagaagagtttaccaggaaagtgcgctcaaatgctgccatcggcgcagtcttcgtggacgaaaaccagtggaatagtgccaaggaggctgttgaggatgaacgtttttgggacctcgtgcatcgggagagagaactgcacaaacaggggaagtgcgccacatgcgtctacaacatgatgggaaaaagggagaagaagttgggcgagttcggtaaagcgaaggggtcccgcgcaatttggtacatgtggctgggagcccgatttctcgagttcgaggctcttggcttcatgaatgaagatcactggtttagccgggagaactctctgtcgggcgtggaaggggagggattacataaactgggttatatcttgagagacatatcaaagatccctggcgggaatatgtacgccgatgacacggcaggatgggataccaggattactgaggacgatctccagaacgaagctcgcatcacagacattatggagccagaacacgccctgctagctaaaagcatcttcaaacttacctatcaaaataaagtagttagagtgcagcggcccgccaagaacggcactgtcatggatgtgatatccaggcgtgaccagcgaggtagtggacaggtgggaacatacggcctgaatacctttacaaacatggaggcacaactcattcgccagatggaatctgagggcatcttcagcccttccgagctggaaactccaaacttggcggagagagtcttagattggctggaaaagtatggggttgagcggctcaaaaggatggccatctcaggagacgactgtgtggtaaagcccattgatgaccgctttgctaccgcccttacggcactgaatgatatgggtaaagtgagaaaggacataccgcagtgggaacctagtaaaggctggaacgattggcagcaagtccccttctgctctcatcactttcaccagctaatcatgaaggacgggcgggagattgtggttccatgtaggaatcaggatgagctggtgggacgagctcgtgtcagccagggcgccggttggtccctcagagaaaccgcatgcttggggaagtcatacgcccaaatgtggcagctgatgtatttccatcgccgggaccttaggctggcggctaacgccatctgtagcgcagtgcctgtagattggattcccacatctagaactacctggtccatccacgcccatcaccagtggatgacaactgaggacatgctcagtgtttggaatcgcgtgtggatagaagagaacccatggatggaagataaaacccatatcagctcgtggggagacgtcccctacttaggcaagcgggaggaccaatggtgcggctccctgattgggttgacggctagggccacatgggcaaccaatatccaggtggctattaaccaggttcgaagactgatcggaaatgagaactacctcgattatatgacttctatgaaacggtttaagaatgaatcagaccctgagggtgccctttggtga

SEQ ID NO: 13321 - RNA, 9879 nt, synthetic construct
  misc_feature 1..9879: note = derived and/or modified CDS sequence (opt3) from DENV-1__HM181959__SS-prME
  source 1..9879: mol_type = other RNA
agcgtgaccatgctgctcatgcttatgcccacagccctggctttccacttgactacgagaggcggggagcctcatatgatcgtctccaagcaggaaaggggaaaatctttactgtttaagacctcagcaggtgttaacatgtgcacactaattgccatggacctcggcgagctgtgtgaagatactatgacctacaaatgcccacggataacagaggcggaaccggacgatgtggactgttggtgcaatgctaccgatacttgggtaacatatgggacctgtagtcaaacgggagagcaccgccgagacaagcgtagcgtggcccttgcaccccatgtcggcctgggtttggagactagaaccgaaacatggatgtcctctgagtcggcctggaaacagatccagagggtggaaacttgggctctccggcaccctgggttcaccgttattgcactgtttctggcccatgctatcggaacatcaattacccagaagggcatcatattcatcctcttaatgctggtgacgccaagcatggccatgcgctgcgtcggcattgggagtagagattttgtggagggactttccggtgcgacttgggtagacgttgtgttggagcacggctcttgtgtcacaaccatggcaaaggataaacccactctggacatcgaactactcaagacagaggtgaccaaccctgccattctgaggaaactttgcatcgaagctaagataagcaatacgaccacagattcccggtgtccaactcaaggggaggccaccctggtggaagagcaggacgcaaacttcgtctgccgccgaacatttgttgatagaggatggggcaatggttgtgggttgttcggaaaaggctcactcattacttgcgctaagtttaagtgcgtgaccaaactggagggcaagatcgtacagtacgaaaacttaaaatatagtgtgattgtcacagtgcacaccggggaccagcatcaagttggaaatgagagcactgaacacggtacgacagccaccatcactccccaggcgcctaccacagagatccagctgaccgactacggcgccctcactcttgattgttctccaaggacagggctggacttcaacgaaatggtgttgctaacgatgaaggagaaatcctggctggtccataagcagtggtttctcgatctgccgcttccctggacctcaggagcaagcactagtcaagagacatggaatcggcaggacctgttggtgaccttcaaaacagctcacgccaagaagcaggaagtagttgtgctcggctctcaagagggtgctatgcacactgccctgaccggggcaacggaaattcagacctccggcacaactaccatatttgccggacatttaaaatgccgtctgaagatggataaactaacactcaagggcatgagctatgtcatgtgtactgggtcgttcaaactggagaaggaagtggctgagacccagcacggaacggtccttgtgcagatcaagtacgagggtacagacgcgccttgcaaaattccattctctacccaagatgaaaagggcgttactcagaacgggcgcttgatcacagcaaatcccatagtgaccgacaaagagaagcctgtaaacattgaagccgagccaccctttggagagtcctatatcgtcatcggcgctggtgaaaaagccctgaagctctcatggttcaagaaagggagtagcattggcaagatgtttgaggcaactgccagaggagctaggcggatggccatcctgggcgataccgcatgggacttcgggtccattggaggtgtgtttacatctgttggcaaacttgtgcatcagatattcgggacggcgtacggagtcctgtttagcggcgtgtcatggaccatgaagatcggtattggggtattgctcacttggctgggcttaaatagtcgatccacaagcctgtctatgacctgtatcgctgtgggactagttacactctacctgggcgtcatggtgcaggccgattcagggtgcgtgatcaactggaaaggacgcgaacttaagtgtggcagtggtattttcgtcactaatgaggttcacacctggacggaacaatataagtttcaggcagacagcccgaaaagattgtccgccgctatagggaaggcctgggaggagggagtgtgcggcatcaggtctgcaacacggctggaaaacattatgtggaaacagatctcgaacgagctcaatcatattctgttagaaaacgacatgaagttcaccgtggtagtcggtgatgtggctggcatcctggcccaggggaaaaagatgatacgccctcaacccatggagtacaaatatagctggaagtcctggggaaaggcgaaagttatcggcgccgacgtgcagaatactacctttattatcgatgggccaaacacacctgaatgtcccgacgatcagagagcttggaatatttgggaggtcgaggactacggattcggcatctttactaccaacatatggcttaagttgagggattcatatacacaggtgtgcgaccaccgtctcatgagtgcagccattaaagattctaaggctgttcacgccgacatgggttactggatcgaaagcgagaaaaatgaaacgtggaagctggcacgggcgtccttcattgaggtgaagacctgtatctggccaaaatcacatactctatggagcaacggggtactggaatctgagatgataatccccaagatttatggaggccctatctcccaacacaattaccgaccaggttacttcacacagaccgccggcccgtggcatctcgggaaactggagcttgattttgacttgtgcgaaggaactacagtcgtggtggatgagcactgcggcaacagagggcccagtctgaggaccacgactgtcaccggaaagattatccacgaatggtgttgccgcagctgtacattacctccactccggttcagaggcgaggacggttgctggtatgggatggagataaggcccgttaaagaaaaggaggaaaatctggtgaagtctatggtatccgctggatcaggcgaggtggacagttttagccttggtctgttgtgtatttcgatcatgatcgaagaggtcatgcgctcccgatggtctcggaaaatgctcatgaccggcactctggtggttttcctactgctcattatggggcagctgacatggaacgatcttatccgtttgtgcattatggtgggagccaatgcaagcgacagaatgggcatggggaccacatacctggctttaatggccacttttaagatgaggcctatgttcgcagtcggactcctgtttcgccggcttacctcaagagaggtgctgctactcacgataggcctgagtttggttgcctccgtggaactgccaaactctttagaggaactcggtgatgggctggctatgggaatcatgattcttaaactgttgacagacttccaaagccatcagctctgggcgaccctgctatccctgacttttatcaagaccacattctcacttcactatgcctggaaaactatggcaatggtcctcagcattgtaagtctgtttcccttgtgtctgtctaccacgtcccagaagacaacctggttaccggtgctcctgggcagccttggctgcaagcctctgactatgttcttgatcgctgagaataaaatatgggggaggcgatcgtggccactcaacgaaggaatcatggccgttggtattgtgtcaatcctgctatctagtctgcttaagaacgatgtccccctcgccggccctctgattgctgggggaatgttgatcgcatgttacgtgatatccggcagctctgccgacttaagcctggagaaagcggctgaggtatcctgggaagaggaagccgagcattcaggtgcaagtcacaatattctcgtggaagtccaggatgacgggacaatgaagatcaaagatgaggagcgcgacgataccctgactatccttctgaaggccacattgctagctgttagcggagtgtatcccctgtctattccagcaaccctctttgtgtggtacttctggcaaaaaaagaagcagcggtccggcgtcctgtgggacacgccttcacccccagaagtggagagagccgttcttgatgacggcatatataggatcatgcagcgtgggttactgggacgcagtcaggtaggtgtgggcgtcttccaagaaaacgtgtttcatactatgtggcacgttacccggggggcggtgctcatgtaccagggaaaaagattggagccgagctgggcttccgtcaagaaagacctgatttcttacggcggtgggtggaggctccagggatcgtggaatacaggcgaggaagtgcaggtaatcgccgtcgagcctggcaagaaccccaaaaatgtgcaaaccgcaccagggacattcaagactcccgaaggagaggttggtgccattgctctggattttaagcctggcaccagcgggtcaccaatcgtgaaccgagaaggaaaaatagtcggcctttatggtaatggggtggttacgacatccggaacttacgtgagtgccatcgcacaggctaaggcctctcaggagggccccctgcctgagattgaagacgaggtcttccggaaacgcaacttgaccatcatggatctacacccgggcagcgggaagacaagaaggtatctgccagcgattgtgcgggaagccatcaaacgaaagctcagaaccttaatactggcacccactcgcgtagtggcttccgagatggccgaagctcttaagggaatgcctattaggtaccaaaccacagcagttaaatcagagcatacgggtaaggagatcgtcgacctgatgtgccacgccacttttaccatgcgtctcttgtctccagtgcgggtgcccaattataacatgatcattatggatgaagcccatttcacagaccctagcagtatcgctgcgagaggctacatatccaccagggtcgggatgggagaggcagccgctatttttatgactgccacaccgcccggcagcgtagaagcattcccacagtctaatgccgtgatccaggatgaggaacgcgacattcctgagcgatcatggaactccggttatgagtggatcaccgattttcccgggaaaacggtttggttcgtgccaagtataaagagcggaaatgacattgctaactgtctgagaaaaaatggcaagcgggtcatccagctctcgaggaagacttttgatacagaataccaaaaaaccaagaacaacgactgggactacgtggttaccactgatatctctgagatgggcgcgaatttccgcgccgaccgtgtgattgatcctagacggtgcctgaaacccgtcatccttaaggacgggccagaaagggtgattctagcaggaccgatgcctgtaacagtggcttccgccgcacagcgccgaggtagaataggccggaaccacaataaagagggggatcagtatatctacatgggacagcccctgaacaatgacgaggatcatgcccactggaccgaagctaagatgttgttagacaacattaatacaccagagggcatcatccccgccctgttcgaacctgagagggaaaagagcgcggcaattgatggtgagtatcgcctcagaggggaggccaggaaaacttttgttgaactgatgcggcgtggcgaccttccagtctggctgtcatacaaggtggctagtgagggattccaatattctgatcgccgatggtgctttgacggcgaaagaaacaatcaggtgctcgaggaaaacatggatgtcgagatatggacgaaagagggggaaaggaagaaattgcggccccgctggctggacgccagaacctactccgaccctctagctctgagggagttcaaggaatttgcagccggacggcgaagcgtttcaggtgatctcatccttgagattggcaaactgccgcagcacttaacacagagagctcaaaatgccttggacaacctggtgatgctccataatagtgaacaggggggacgcgcatataggcacgcgatggaggagctgccagatactatcgaaacccttatgctgctcgccttgattgctgtactgacaggcggtgtgaccttattctttctaagcgggcggggcctgggaaagacttccatcggcctcctttgtgtcatggcctctagcgtgctgttgtggatggcatccgttgagccccattggatagctgcctcaatcattctggaattctttctcatggtgctgcttatccctgagcccgaccgtcagagaacgccacaggataaccaactcgcatacgtcgtaattgggctgttgttcatgatcctgaccgtggccgctaatgagatgggattactagaaacaactaagaaagacctgggtataggccacgttgcggtggggaaccaccatcacgccgcaatgctcgatgtcgaccttcatcctgcttctgcctggaccctgtacgccgtggcaacaaccattatcactcccatgatgaggcacacaattgagaacacgaccgctaatatcagtttgactgccatagcgaaccaggctgccatcctgatgggactcgataagggctggccaatttcgaaaatggacatcggtgtccctctgcttgcattagggtgctatagccaggtgaatccgctgacactcaccgccgctgttttgatgctggtggcacattacgccattatcggccccggactacaagcgaaggctacccgcgaagcccagaaacggacagcagccggcataatgaagaacccaactgtagatgggattgtggctatcgacctggatcctgtcgtttatgacgccaagtttgagaaacagctcggacagatcatgcttctgattttgtgtacgtcccaaatcctgctcatgcgaaccacatgggcactgtgcgaatctataactttagctaccggcccccttacaaccctgtgggagggttcaccagggaagttctggaatactacgattgccgtgagcatggcgaacatctttagaggatcctacctcgccggcgcaggtctagctttcagtctgatgaaatctttgggcgggggaaggcgcggcacaggggcccagggagagaccctgggcgaaaagtggaaacggcagctcaatcagcttagcaagtcagagttcaacacttataagagatccggtattatggaagtcgaccgtagtgaggcaaaagaagggctgaagaggggagagaccacaaaacacgctgtgagccggggcactgccaagttgcgctggtttgtagagcgaaatctggtgaaacctgaaggtaaggttatcgatctcggctgtgggagaggaggctggtcttactattgcgccgggttaaagaaagtgaccgaggtcaagggatacacaaaaggcggtcccgggcacgaagagccgataccaatggcgacgtacggatggaacctggtgaagcttcattccggcaaagacgtcttctttatccctcccgaaaagtgtgataccctgctatgcgacattggcgagtcaagcccaaatcccactatcgaggaagggaggacactccgggtgctgaaaatggttgagccttggttgcgcggaaaccaattctgtattaagatcctgaatccgtatatgccctcggtagtggaaaccctcgagcagatgcagagaaagcacggtggcatgcttgtcaggaacccactgtctcgaaatagtactcatgagatgtactgggtgtcctgcgggacaggaaacattgttagcgctgtgaatatgacctcacggatgttactgaaccgttttacgatggcacacagaaaacctacctatgaacgcgatgtcgacttgggcgccggtacaaggcacgtggctgtagagcccgaagtggccaacctcgatatcatagggcagcggattgagaatatcaagcatgaacacaaatccacttggcattacgacgaggataacccttataagacctgggcataccacggatcttatgaggttaaaccaagcggcagtgcctccagcatggtcaatggcgtggtgaagctgctaacaaagccctgggacgtcatccctatggttactcaaattgctatgaccgatacaaccccattcgggcagcagagagtgtttaaagaaaaggtagacactcgcacgcccaaagcgaagaggggaacagcccaaataatggaggtgaccgcaaaatggctttggggtttcctgtctcgaaacaagaagccgcggatctgtactagagaagagtttaccaggaaagtccgctcaaatgctgccattggcgcagtgttcgttgacgaaaaccagtggaatagtgccaaggaggctgtggaggatgaacgtttttgggacctcgtccatcgggagagagaactgcacaaacaggggaagtgcgccacatgcgtgtacaacatgatgggaaaaagggagaagaagttgggcgaattcggtaaagcgaaggggtcccgcgcaatctggtacatgtggctgggagcccgatttctcgagttcgaggctcttggcttcatgaatgaagatcactggtttagccgggagaactctctgtcgggcgtagaaggggagggattacataaactgggttatattttgagagacatctcaaagatacctggcgggaatatgtacgccgatgacacggcaggatgggataccaggatcactgaggacgatctccagaacgaagctcgcattacagacatcatggagccagaacacgccctgctagctaaaagcattttcaagcttacctatcaaaataaagttgtgagagtccagcggcccgccaagaacggcactgtgatggatgtgatctccaggcgtgaccagcgaggtagtgggcaggtcggaacatacggcctgaatacctttacaaacatggaggcacaactcatacgccagatggaatctgagggcattttcagcccttccgagctggaaactccaaacttggcggagagagttttagattggctggaaaagtatggggtggagcggctcaaaaggatggccatctcaggagacgactgtgtagtgaagcccatcgatgaccgctttgctaccgcccttacggcactgaatgatatgggtaaagtcagaaaggacattccgcagtgggaacctagtaaaggctggaacgattggcagcaagtgcccttctgctctcatcactttcaccagctaataatgaaggacgggcgggagatcgttgtgccatgtaggaatcaggatgagctggtcggacgagctcgtgtgagccagggcgccggttggtccctcagagaaaccgcatgcttggggaagtcatacgcccaaatgtggcagctgatgtatttccatcgccgggaccttaggctggcggctaacgccatttgtagcgcagtacctgttgattggatccccacatctagaactacctggtccattcacgcccatcaccagtggatgacaactgaggacatgctcagtgtgtggaatcgcgtctggatcgaagagaacccatggatggaagataaaacccatataagctcgtggggagacgtgccctacttaggcaagcgggaggaccaatggtgcggctccctgatcgggttgacggctagggccacatgggcaaccaatattcaggttgctatcaaccaggtgcgaagactgattggaaatgagaactacctcgattatatgacttctatgaaacggtttaagaatgaatcagaccctgagggtgccctttggtga

SEQ ID NO: 13322 - RNA, 9879 nt, synthetic construct
  misc_feature 1..9879: note = derived and/or modified CDS sequence (opt3) from DENV-1__JF937651__SS-prME
  source 1..9879: mol_type = other RNA
agcgtgaccatgctgctcatgcttatgcccactgccctggctttccacttgactacgagaggaggggagcctcatatgatcttatccaagcaagaaaggggaaaatctctgctgtttaagacctcagcgggtgtcaatatgtgcacactcattgccatggacctgggagagctttgtgaagatactatgacctacaaatgcccacggataacagaggcggaaccggacgatgttgactgttggtgcaatgctaccgatacttgggtgacatatgggacctgtagtcaaacgggagagcaccgccgagacaagcgtagcgtggccctggcaccccatgtgggattgggtctcgagactagaaccgaaacatggatgtcctctgagggggcctggaaacagatccagagggtcgaaacttgggctctgcggcaccctggattcaccgtgattgcactgtttctcgcccatgctatcggcacatcgattacccagaagggcatcatattcatcttactgatgcttgttacgccatcaatggccatgcgctgcgtggggattggaagcagagattttgtcgagggtttgagtggcgcgacttgggtggacgtagttctggagcacgggtcctgtgtgacaaccatggcaaaggataaacccactctggacatcgaactcctgaagacagaggtcaccaaccctgccattcttaggaaactgtgcatcgaagctaagatatctaatacgaccacagatagccggtgtccaactcaaggagaggccaccttggtggaagaacaagacgcaaacttcgtgtgccgccgaacatttgtcgatagaggctggggtaatgggtgtggactcttcggcaaaggctccctgattacttgcgctaagtttaagtgcgttaccaaattagaggggaagatcgtgcagtacgaaaacctgaaatattcagtaattgtgacagtccacaccggagaccagcatcaagtgggtaatgagagtactgaacacggcacgacagccaccatcactccccaggcgcctaccacagagatccagctcaccgactacggggcccttactctggattgtagcccaaggacaggattggacttcaacgaaatggttctactgacgatgaaggagaaatcttggctcgtgcataagcagtggtttctggatcttccgctgccctggacctccggcgcatcaactagccaagagacatggaatcggcaggacttgctcgtcaccttcaaaacagctcacgccaagaagcaggaagtggtagttctgggtagtcaagagggggctatgcacactgccttaaccggcgcaacggaaattcagacctctggaacaactaccatatttgccggccatctgaaatgccgtctaaagatggataaactcacactgaaggggatgtcctatgtgatgtgtactggcagcttcaaacttgagaaggaagtcgctgagacccagcacggtacggtgttggtccagatcaagtacgagggcacagacgcgccttgcaaaattccattctcgacccaagatgaaaagggggtgactcagaacggacgcctgatcacagcaaatcccatagttaccgacaaagagaagcctgtgaacattgaagccgagccaccctttggcgagtcttatatcgtaatcggtgctggggaaaaagccctcaagctgtcctggttcaagaaaggctcaagtattggaaagatgtttgaggcaactgccagaggcgctaggcggatggccatccttggggataccgcatgggacttcggaagcattggtggcgtctttacatccgtggggaaactgatacatcagatcttcggaacggcgtacggcgttttgttttctggtgtgagctggaccatgaagattgggatcggcgtcctcctgacttggttaggactaaattcacgaagtacatccctaagcatgacctgtatcgctgtgggcctcgtaacactgtaccttggggtgatggttcaggccgattctggatgcgtcattaactggaaaggccgcgaattgaagtgtggttcagggatattcgtgactaatgaggtgcacacctggacggaacaatataagtttcaggcagacagtccgaaaagactgagcgccgctatcggaaaggcctgggaggagggcgtctgcggtattaggtccgcaacacggctcgaaaacatcatgtggaaacagatttctaacgagctgaatcatatcttactggaaaacgacatgaagttcaccgttgtggtgggcgatgtagctgggatacttgcccagggcaaaaagatgatccgccctcaacccatggagtacaaatattcgtggaaaagctggggcaaggcgaagattatcggggccgacgtccagaatactacctttattatcgatggaccaaacacacctgaatgtcccgacgatcagagagcttggaatatatgggaggtggaggactacggcttcggtatttttactaccaacatctggttgaagctcagggattcctatacacaggtttgcgaccaccgtctgatgtcagcagccattaaagatagtaaggctgtgcacgccgacatggggtactggatcgaatctgagaaaaatgaaacgtggaagctagcacgggcgagcttcatagaggtcaagacctgtatctggccaaaatcccatactctgtggtcaaacggagtgctcgaaagcgagatgattatccccaagatttatggcggtcctatctctcaacacaattaccgaccaggctacttcacacagaccgccgggccgtggcatctgggaaaacttgagttggattttgacctgtgcgaaggcactacagttgtggtagatgagcactgcgggaacagaggaccctccttaaggaccacgactgtcaccggcaagataattcacgaatggtgttgccgcagttgtacactccctccactgcggttcagaggtgaggacgggtgctggtatggaatggagatcaggcccgtgaaagaaaaggaggaaaatcttgtaaagagcatggtctctgctggctccggtgaggttgactcatttagtctgggcttgctctgtatcagcattatgatcgaagaggtgatgcgctcgcgatggtcccggaaaatgctgatgaccgggactctagccgtattcctgctcctgattatgggacagcttacatggaacgatttgatacgtctgtgcatcatggtgggcgcaaatgcttgtgacagaatggggatgggaaccacatacttagccctcatggcaacttttaagatgaggcctatgttcgccgtcggcctgctttttcgccggctgacctctagagaggtgctactcctgacgattggtttgagcctggttgcttcagtggaattaccaaacagtctcgaggaactgggggatggacttgcgatgggcatcatgattctgaaattgctcacagacttccaatcctatcagctgtgggccaccctactgtctcttacttttatcaagaccacattcagcctccattacgcatggaaaactatggctatggtcctgtccatagtgtcattgtttcccctgtgcttaagcaccacgagtcagaagacaacctggctcccggttctgcttggctctctggggtgtaagcctttgactatgttcctcatcgccgagaataaaatttggggaaggcgatcctggccactgaacgaaggtatcatggccgtgggcattgtcagcatcctactgtcgtcacttctcaagaacgatgtacccctggctgggcctttgatagcaggaggcatgttaattgcctgctatgtgatctctggtagttccgcggacctgagcctcgagaaagctgccgaggtttcttgggaagaggaagcagagcacagcggggcctcccataatatcctggtggaagtccaggatgacggaacaatgaagattaaagatgaggagcgcgacgatacccttactatactgttgaaggctacactactggcagtgtcaggcgtataccccctcagtatcccagccaccctgtttgtgtggtatttctggcagaaaaagaagcagcggagcggcgtcctttgggacacgccttctcccccagaagttgagagagcggtgttagatgacgggatttacaggatcatgcagcgtggactgctcggtcgctcccaggtgggcgtcggggtgttccaagaaaacgtttttcacactatgtggcatgtaacccggggagctgtgttgatgtaccagggcaaaagactggagccgtcatgggccagtgtcaagaaagacctcattagctatggtgggggatggaggctgcagggctcctggaatacaggcgaggaagtgcaggttatcgcagtggagcctgggaagaaccccaaaaatgtccaaaccgccccaggaacattcaagactcccgaaggtgaggtgggcgctatagcccttgattttaagcctgggacctctggatcgccaatcgtaaaccgagaaggcaaaattgtcggtctgtacgggaatggagtggttacgacaagcggcacttatgtgtcagcaatcgctcaggccaaggcgtcccaggagggccccttgcctgagattgaagacgaggtcttccggaaacgcaacctaaccatcatggatctgcacccggggagtggaaagacaagaaggtacctcccagccatagtgcgggaagcaattaaacgaaagttaagaaccctgatccttgctcccactcgcgttgtggcctctgagatggctgaagcactgaagggtatgcctatcaggtatcaaaccacagccgtcaaaagcgagcacacgggcaaggagattgtggacctcatgtgtcatgccacttttaccatgcgtttgctgtccccagtacgggtgcccaattacaacatgatcataatggatgaagctcacttcacagacccttcatctattgcggcaagagggtatatcagcaccagggttggaatgggcgaggccgctgccatttttatgactgcaacaccgcccggtagtgtcgaagccttcccacagtccaatgctgtgatccaggatgaggaacgcgacatacctgagcgaagctggaactctgggtacgagtggattaccgattttcccggaaaaacggtgtggttcgtcccatcaatcaagtccggcaatgacatcgcgaactgcctcaggaaaaatggcaagcgggtaattcagctgagtaggaagacttttgatacagaataccagaaaaccaagaacaacgactgggactatgtggttaccactgatatcagcgagatgggggccaatttccgcgcagaccgtgtgattgatcctagacggtgccttaaacccgtcatactaaaggacggaccagaaagggtgatcctggctggtccgatgcctgttacagtggcctcggcagcccagcgccgaggcagaattgggcggaaccataataaagagggagatcagtacatctatatgggccagcccttgaacaatgacgaggatcacgctcattggaccgaagccaagatgttactggacaacatcaatacaccagagggtattatacccgcactcttcgaacctgagagggaaaagtctgcagccatcgatggggagtaccgcctgagaggcgaggctaggaaaacttttgtcgaacttatgcggcgtggagacctgccagtgtggctctcctataaggtagccagcgagggcttccaatactcagatcgccgatggtgttttgacggggaaagaaacaatcaggtgttggaggaaaacatggatgttgagatttggacgaaagagggagaaaggaagaaactgcggccccgctggctagacgctagaacctatagtgaccctctggcactcagggagttcaaggaatttgccgctggtcggcgatctgtctccggcgatcttatcctggagattgggaaattaccgcagcacttgacacagagagcccaaaatgcactggacaacctcgtgatgctgcacaatagcgaacagggaggccgcgcgtacaggcatgccatggaggagcttccagatactatcgaaaccctgatgctcttggctctgatagccgtgttaacaggtggggtcaccctattctttctgtcaggccggggactcggcaagacaagtatcgggcttctgtgcgttatggcaagctccgtgttgctgtggatggcttctgtagagccccactggattgccgcaagcatcattctcgagttctttctgatggtgcttctcatccctgagcccgaccgtcagagaacgccacaggataaccaactggcctacgtcgtgataggattgctgttcatgattttaaccgttgctgcgaatgagatgggtctactggaaacaactaagaaagacctcggcatcgggcatgtggccgtcggaaaccaccaccatgcagctatgcttgatgtagacctgcaccctgcctccgcctggaccttgtatgcagtggctacaaccattatcactcccatgatgaagcatacaatagagaacacgaccgccaatatctcactgactgcgattgctaaccaggccgcaatcctcatgggcctggataaaggttggccaatttctaagatggacatcggggttcctcttttagccctgggctgttacagtcaggtgaatccgctcacattgaccgctgcagtcctgatgctagtggcccactatgcgataattggacccggcctgcaagctaaagccaccagggaagcacagaagcgcacagccgctgggatcatgaagaacccaactgtcgatggaatcgtggccattgacctcgatcctgttgtgtacgacgcaaaatttgagaagcagcttggccagatcatgctgttgatactgtgcacgtcgcaaattctcctgatgcggaccacatgggctttatgtgaaagcatcactcttgccaccggtcccctgacaaccctctgggaggggtccccaggaaaattctggaatactacgattgcggtatctatggccaacatctttcgaggctcatatctagcaggagctggcctggccttcagcttgatgaagtccctagggggtggcagaagggggacaggagcacagggcgagaccctcggtgaaaaatggaagcgccagcttaatcagctgagtaagtctgagttcaacacttacaaacggagcgggataatggaagtggacagatcagaggctaaggaaggattgaaacgtggcgagaccacaaagcatgccgtctccaggggtactgccaaactgcggtggtttgttgagcgcaatctcgtgaagcctgaaggcaaggtcatcgatttagggtgcggacgaggcgggtggagttattactgtgcgggactgaaaaaggtgaccgaggtaaaaggctacacaaagggtgggcccggacacgaagaaccgattccaatggctacgtatggctggaaccttgtgaaactgcacagcggcaaggacgttttctttatccctcccgaaaaatgcgataccctactctgtgacattggggagtcttccccaaatcccactatcgaggaaggaagaacactgagggtgttgaagatggtcgagccttggctgcggggtaaccaattctgcattaagatcctcaatccgtacatgccctcagtggtcgaaacccttgagcagatgcagcgcaaacatggcgggatgctggtgagaaacccattaagcagaaattcgactcacgagatgtattgggtttcttgtggaacaggcaacatagtaagtgcagtgaatatgacctcccgaatgctgttgaaccggtttacgatggcccatcgtaagcctacctacgaaagagatgtcgacctcggtgctgggacacgccacgtggccgttgagcccgaagtggcaaacctggatattatcggacagaggatcgagaatattaaacacgaacataagagcacttggcactatgacgaggataacccttacaaaacctgggcctatcatggctcatacgaggtcaagccatccggctctgctagcagtatggtgaatggggtagtgaagctacttacaaaaccctgggacgttatacctatggtcactcaaatcgcgatgaccgatacaaccccattcggacagcagcgggtgtttaaggaaaaagtggacactagaacgcccaaggccaaacgcggtacagcacaaattatggaggtcaccgctaagtggctgtggggcttcctctccaggaacaagaaaccgcgaatctgcactcgggaagagtttaccgggaaggttagaagcaatgccgcaattggagccgtgttcgtagacgaaaaccagtggaactctgctaaagaggccgtggaggatgaaaggttttgggacctggtccaccgcgagcgtgaattgcataagcagggcaaatgcgcgacatgtgtgtacaacatgatgggtaagcgggagaagaaactgggggagttcggaaaggcaaaaggctcaagagccatctggtatatgtggctcggcgctaggtttcttgagttcgaggccctggggttcatgaatgaagatcactggtttagtcgcgagaactccttaagcggagttgaaggtgagggcctgcacaagttggggtacatactccgagacatctctaaaattcctggaggcaatatgtatgcagatgacacggctggttgggatacccggatcactgaggacgatctgcagaacgaagccagaattacagacatcatggagccagaacatgctctacttgccaagtcgatattcaaactgacctaccaaaataaggtggtcagggtgcagcgccccgcaaagaacgggactgtaatggatgttatttcaagacgggaccagaggggaagcggccaggtgggcacatatgggctcaatacctttacaaacatggaggcgcaactgatccgtcagatggaatccgagggaatcttcagtccttctgagttggaaactccaaacttagccgagcgagtcctggattggctcgaaaaatacggtgtggagcgccttaagagaatggctattagcggcgacgactgcgtggtcaaacccatagatgaccggtttgccaccgcactgacggctctaaatgatatggggaaggttaggaaagacatcccgcagtgggaaccttccaagggatggaacgattggcagcaagtgcccttctgttcacaccattttcaccagctgattatgaaggacggccgcgagatcgtagtgccatgcagaaatcaggatgagctcgtcggtcgggccagggtgagtcagggggcaggatggtctttgcgagaaaccgcctgtctgggcaaaagctatgcgcaaatgtggcagcttatgtacttccaccgtagagacctgcgcctcgctgccaacgcaatttgctccgccgttcctgtggattggatccccacatcacggactacctggagcatacatgctcaccatcagtggatgacaactgaggacatgttatctgtctggaatagggtgtggatcgaagagaacccatggatggaagataagacccacatttccagttggggcgacgtaccctacctggggaaaagagaggaccaatggtgtggcagcttgatcggtctgacggcccgcgcaacatgggctaccaatattcaggttgccatcaaccaggtgcggaggctcattggcaatgagaactatcttgattacatgacttcgatgaagcgatttaaaaatgaatccgaccctaagggggcgctgtggtga

SEQ ID NO: 13323 - RNA, 9879 nt, synthetic construct
  misc_feature 1..9879: note = derived and/or modified CDS sequence (opt3) from DENV-1__GU131956__SS-prME
  source 1..9879: mol_type = other RNA
agcgtgaccatgctgctcatgcttctgcccacagccttggctttccacttaactacgagaggcggggagcctcatatgatcgtctccaagcaggaaaggggaaaatctctgctatttaagacctcagcaggtgttaacatgtgcacactcattgccatggacctgggcgagctttgtgaagatactatgacctacaaatgcccacaaataacagaggcggaaccggacgatgtggactgttggtgcaatgctaccgatacttgggtaacatatgggacctgtagtcagacgggagagcaccggcgcgacaagcgaagcgtggccctggcaccccatgtcggcttgggtctcgagactcgtaccgaaacatggatgtcctctgagggggcctggaaacagatccagagagtggaaacttgggctctgaggcaccctggattcaccgttattgcactgtttctcgcccatgctatcggcacatcgattacccaaaagggcacgatcttcatattactgatgcttgtgactccatcaatggccatgcggtgcgtcgggatcggaaaccgcgattttgtggagggtttgagcggcgcgacatgggtagacgttgtgctggagcacgggagttgtgtcaccactatggcaaagaataaacccacactagatattgaactcctgaagaccgaggtgacgaaccctgccatccttagaaaactgtgcattgaagctaagatctccaataccacaactgactctaggtgtccaacccagggagaggccacattggtggaagagcaggatgcaaacttcgtctgccggcgcacttttgttgaccgaggctggggtaatgggtgtggactcttcggcaaaggcagcctgttaacctgcgctaagtttaagtgcgtgacaaaactggaggggaagatagtacagtacgaaaacctcaaatattccgtgattgtcaccgtgcacactggagatcaacatcaggttggtaatgagacgacagaacacggcaccatcgccactattaccccccaggcgcctacatcagagatccagcttaccgactacggggccctgactttggactgtagtccaagaacaggactagatttcaacgaaatggtgctgctcacgatgaaggagaaaagctggctggtccataagcaatggtttcttgacctgccgttgccctggacctctggcgcatccacttcacaggagacatggaataggcaggatctcctggtgaccttcaaaacagctcacgccaagaagcaagaagtagttgtgttaggtagccaggagggggctatgcacactgccctgaccggcgcaacggaaatccagaccagtggaacaactaccatttttgccggccatctaaaatgccggctcaagatggacaaactgacacttaaggggacttcttatgtcatgtgtaccggatccttcaaattggagaaggaagtggctgagacgcagcacggtacagtcctggtgcaagttaagtacgagggcaccgatgcgccttgcaaaataccattcagcactcaggacgaaaagggggtgacacagaacggacgtctcatcaccgcaaatcccattgtaactgataaagagaagcctgtcaacatcgaaaccgagccaccctttggcgagtcgtatatagtggttggtgccggggaaaaagctctgaagctttcttggttcaagaaaggctcctcaattggaaagatgtttgaggccacagcacgcggcgccagaaggatggctatcctgggggacacggcctgggatttcggaagtatcggtggcgtgtttaccagcgtcgggaaattggtgcatcaggtattcggaactgcatacggcgtgctcttttccggtgtttcttggacaatgaagattgggatcggcattctgttaacctggctgggactaaatagccggtcaacaagtctctccatgacttgtatagcggtcggcatggtgaccctgtaccttggggtgatggtccaagctgacagcggatgcgttatcaactggaaaggccgagaattgaagtgtggttctgggattttcgtgacgaacgaggtgcacacatggaccgaacagtataagtttcaggccgattcaccgaaacgcctgagtgcagccatcggaaaggcttgggaggagggcgtatgcggtatcagaagcgccactaggctcgaaaatattatgtggaaacagatatccaacgagctgaatcatatcttactggaaaacgacatgaagttcaccgtcgtggttggcgacgcaaatgggattcttgctcaaggaaaaaagatgatccggcctcagcccatggagcacaaatactcttggaagtcgtggggcaaggccaaaattatcggggcggatatacagaacacaacttttatcattgacggaccagatacccctgaatgtcccgacaatcagcgcgcctggaacatctgggaggtggaggattatggcttcggtatttttacaacgaatatctggttgaagctcagagacagctacacccaaatgtgcgatcacaggctgatgtccgctgcaataaaagactcaaaggccgtccatgctgatatggggtattggattgaaagtgagaaaaacgaaacttggaagctagcccgtgcatctttcatcgaggtgaagacatgtacctggccaaaaagccacactctgtggtccaatggagttctcgaatcagagatgattatccccaagatatacggcggtcctatcagccagcataactatcggccaggctacttcacacagaccgcggggccgtggcacctgggaaaacttgagttggactttgatctgtgcgaaggcacgactgtggtagtcgacgagcactgcgggaatcgaggaccctctttaagaaccacaaccgtgactggcaagattatccatgaatggtgttgcaggtcctgtacactccctccactgcgcttccggggtgaggatgggtgctggtacggaatggagattagacccgtgaaagaaaaggaggaaaaccttgtcaggagtatggttagcgccggctctggtgaggtggactccttttcactgggcatcttgtgtgctagtataatgattgaagaggtaatgcgcagccgatggtcgcggaagatgctcatgaccgggacactggccgtgttcctactgctcgtcatgggacaactgacttggaatgaccttatccgtttgtgcatcatggtgggcgcaaacgcttccgatagaatggggatgggaaccacgtatctggccttaatggcaacatttaaaatgaggcctatgttcgccgttggcctcctgtttcgccggcttacctctagagaggtgctgctactcactattggtctgagcttggtcgcttcagtggaactgccaaacagtttagaggaactcggggacggactggcgatgggcatcatgatgcttaagctgttgaccgagttccagccccaccagctctggacaactctgctatccctgacctttattaaaacgacactttctctcgattacgcctggaagaccactgcaatggctctgagcatagtttccttgttcccgctgtgtttatcaacaaccagccagaaaactacatggctccctgtgctgcttggcagttttgggtgcaagccactgaccatgttcttgatcacggaaaataagatttggggaaggaaatcttggcccctcaacgagggtatcatggccattggcatcgtctccatactgctaagctcgctgcttaagaatgacgtacctctcgccgggcccctgatcgctggaggcatgttgattgcatgttatgtgatctcaggttctagtgccgatttatccctggagaaagcggctgaagttagctgggagcaagaagccgagcattctgggactagccacaacattctcgtggaagtccaggacgatggaaccatgaagatcaaagacgaggagcgagatgacacactgaccatacttctgaaggcaacattgctagccgtgtccggcgtatacccaatgtcaattcctgctactctgtttgtgtggtatttctggcagaaaaagaagcagcgcagtggcgtcctctgggatacccccagcccaccggaagttgagcgggcagtgctggacgatgggatctacagaatccttcaaaggggattactgggtcgttctcaggtgggcgtcggggtgttccaggacggagtttttcatacgatgtggcacgtaacacgcggcgccgtgctcatgtatcagggtaaacggttggaaccttcctgggcgtcagtcaagaaagacctgattagttacgggggaggctggagattccaaggcagctggaatactggggaggaggtgcaggttatagctgtggaacccggaaagaacccaaaaaatgtccagaccacacccggtacctttaagactcctgagggcgaagtgggggccatcgcactcgatttcaagccaggaacctccggctctcccattgtaaacagggagggtaaaatcgtcgggctgtacggaaatggcgtggttacaacgtcgggcacttatgtgagcgccattgctcaagccaaggcatcacaggaagggcctcttccggagatcgaggacgaagtctttaaaaagcgaaacctgaccataatggatttgcacccaggatccggtaaaacacggcgctacctacccgctatggtgagagaggccatcaagaggaagctgcggaccctcattttagcgcctactcgagttgtggccagtgaaatggcagaggctctgaaaggcatgccaatcagatatcagacaaccgccgtcaagtctgaacatacggggcgcgagattgtggaccttatgtgccacgctactttcacaatgaggctgctcagccccgtacgtgtgcctaattacaacatgatcataatggatgaggcacattttaccgacccggcctccattgccgctcggggatatatctcaaccagagttggcatgggtgaagcggcagccatcttcatgactgctacacccccagggtctgtcgaggcctttcctcagagcaatgcagtgattcaagatgaagagagggacatccccgaacgcagttggaactccggatacgattggataaccgacttcccaggcaaaacagtgtggtttgtccctagcattaagtctggcaatgatatcgccaactgtttgcgaaaaaacgggaagagagtaattcagctgtcacggaagactttcgacacggagtatcagaaaaccaagaataacgactgggattacgtggttacaactgacatctccgagatgggagctaatttcagggcggatcgcgtgatagacccccgtagatgcctcaaaccagtcattctgaaggatggtccggaacgggtgatccttgccggccctatgcccgttaccgtggcaagtgctgcccagaggcgcgggcgaatcggaagaaaccaaaataaagagggcgaccagtacgtctatatgggtcagccactaaacaatgatgaagaccacgcacattggacagaggccaagatgctgttggataacattaatacccccgaggggatcattcctgctttatttgaaccagagcgggaaaagagcgccgcgatagacggcgagtacaggctgcgcggagaagcaagaaaaactttcgtggagctcatgaggcggggcgatctgcccgtatggctttcgtataaggtggcctctgaggggtttcagtactccgaccgtcgctggtgcttcgatggagaacgaaacaatcaagttctggaggaaaacatggacgtcgagatctggacgaaagaaggtgagagaaagaaactcaggcctcggtggttggacgctcgcacctatagcgatccgctggccctaagagagtttaaggaattcgctgcaggcaggcggtcagtgagtggggacctgattctcgagatcggaaaacttccacagcacctgacattacgagcccagaatgctttggataacctggtgatgctccacaattctgaacagggcggtaaggcctacagacatgcaatggaggaactgcccgacactatcgagacccttatgctgctcgcgttgattgccgtcctgacagggggcgttaccttatttttcctatccggaaagggcctggggaaaactagcataggactcctttgtgtgacagcttcaagtgccctgttgtggatggcaagcgtagagcctcactggatcgctgcctccattatcctggaatttttcctcatggtgctgcttattcccgagccagatcgccaaaggacgcctcaggacaaccagctcgcatatgtcgtgatcggtctgttgtttatgatactgaccgttgccgctaacgaaatgggcttactagagactacaaagaaagatctggggatcggacatgtggcggccgagaatcaccaacacgcaaccatgctcgacgtcgatcttcggcccgcttctgcctggaccctgtacgccgtagcaacaactgtgattacgccaatgatgcgtcataccatcgaaaacacaactgctaatattagcttgaccgccatcgcgaaccaggctgccatactgatgggcctcgacaagggttggcctatttccaaaatggatatcggggttccgctgcttgcattaggctgctactcacaggtgaatcccctgacactcaccgccgctgtcttgatgctggtggcacactatgccattatcggaccaggcctacaggcgaaggctactagagaggcccaaaagaggacggcagccgggataatgaaaaaccctacagtcgacggaatcgtggctattgatctggaccccgttgtgtacgacgccaagttcgaaaaacagctcggccagatcatgcttctgattttgtgtacctctcagatcctgctcatgcgcactacctgggcactgtgcgagagtataacattagctactggtccacttaccacactgtgggaagggtcgcctggaaagttttggaatacgaccattgccgtaagcatggcgaacatcttccggggctcctatctcgccggtgcaggcctagctttctctctgatgaaatcattggggggaggccgaagagggactggagcccaaggcgagacactgggtgagaagtggaagaggcagctcaatcagcttagcaaatccgaatttaacacctacaagcgcagtgggatcatggaggtggatcggtctgaagcaaaagagggactgaagagaggcgaaactacaaaacatgctgtcagccgtggtaccgccaagttgaggtggttcgttgagcggaatctggtgaagcccgagggcaaagtcattgacctcgggtgtggacgcggcgggtggtcatattactgcgccggattaaagaaagtgacggaagtaaagggctataccaaaggtgggccgggacacgaggaaccaatccctatggcgacatacggctggaacctggtgaagcttcattccggcaaagatgtttttttcatgcccccagagaagtgtgacactctgctatgcgatataggggaaagtagccccaatcctaccattgaggagggacgaacactcagagtgctgaagatggtcgaaccgtggttgaggggtaaccagttttgtatcaaaattctgaatccctacatgccatctgtggtcgagactctcgaacaaatgcagcggaagcacggcgggatgcttgtgcgcaaccctctgtccagaaattcaacccacgagatgtattgggttagctgcggaacaggcaacatcgtatcggctgtgaacatgacctctaggatgttactgaatcgattcactatggcacatcggaaacccacgtacgagcgtgacgtcgatttgggtgccgggacaagacacgtggctgttgaacctgaggtggccaacctcgacataatcggacagcgcattgaaaatatcaagaacgagcataaaagtacctggcactatgatgaagacaatccatacaagacttgggcatatcacggctcctacgaggtcaagcccagcggctcagcctcctctatggtgaacggggtagtgaggctgctaaccaaaccttgggatgttattccaatggtcacacaaatcgctatgacggacaccactccctttggacagcagcgggtgttcaaggagaaagtggacacaagaaccccgcgcgcgaagaggggtactacacagattatggaagtcaccgccaaatggctttggggctttctgagccgaaataagaagcctcggatctgtacaagagaggaattcactaggaaagttcgcagtaacgcagctataggggccgtgtttgtagatgagaatcaatggaactccgcaaaggaagccgtggaggacgagcgtttctgggatctcgtccatcgggaaagagagctgcacaaacagggaaagtgcgctacctgcgtgtataatatgatgggcaaaagggaaaagaagttgggtgagtttgggaaagccaagggaagccgcgcgatttggtacatgtggctgggcgcacgattcctcgaattcgaggcccttggctttatgaacgaggaccattggttctctcgggaaaattcactgagtggggttgagggagaaggtttacacaaactgggctacatcttgagagatatctccaagattccagggggaaacatgtatgctgacgatacggccggctgggacaccaggataacagaggatgacctccagaatgaggcaaaaatcactgaaattatggagcccgaacatgctctgctagccaccagcatctttaagcttacataccagaacaaagtggtccgcgtgcaaagacctgctaagaacggtactgtaatggatgttatttctcggagggaccagcgtgggtcgggacaggtgggcacctatggcctgaatacgttcacaaacatggaggtccagctcatccgacaaatggaatcagaggggatatttctgccaagcgagttggaaacccccaatttagccgagcgcgtgctggattggctcgaaaagcacggagcagagagacttaaacggatggcgatctccggtgacgactgtgtggtcaagccgattgatgacaggttcgccactgctctgacagccctaaacgatatgggcaaagttcgcaaggacatccctcagtgggaacccagtaaagggtggaatgattggcagcaggtgccattttgctctcaccatttccaccaactgattatgaaggacggaagagagatcgtagtgccttgtcggaaccaggatgagctcgtcggcagggcacgagtgagccagggtgctgggtggtccttgcgtgaaaccgcctgcctgggaaagtcatacgcacaaatgtggcagcttatgtattttcatagacgcgacctgcggctcgccgcgaatgctatatgtagtgccgttcccgtggattgggtcccaacttctaggaccacatggagcattcacgcacaccatcagtggatgacgaccgaggacatgttatccgtgtggaacagagtatggatcgaagagaatccctggatggaagataaaactcacgtttcaagctgggaggaggtgccttacctgggcaagcgcgaagaccagtggtgcggctctttgatcgggctgacagcccgggctacctgggccactaacattcaagtcgcaataaatcaggtgaggcgactcatcggaaacgagaattatcttgactacatgacatccatgaaaagattcaagaacgaaagtgatccagagggtgctctgtggtga

SEQ ID NO: 13324 - RNA, 9879 nt, synthetic construct
  misc_feature 1..9879: note = derived and/or modified CDS sequence (opt3) from DENV-1__GU131958__SS-prME
  source 1..9879: mol_type = other RNA
agcgtgaccatgctgctcatgcttctgcccacagccttggctttccacttaactacgagaggcggggagcctcatatgatcgtctccaagcaggaaaggggaaaatctctgctatttaagacctcagcaggtgttaacatgtgcacactcattgccatggacctgggcgagctttgtgaagatactatgacctacaaatgcccacaaataacagaggcggaaccggacgatgtggactgttggtgcaatgctaccgatacttgggtaacatatgggacctgtagtcagacgggagagcaccggcgcgacaagcgaagcgtggccctggcaccccatgtcggcttgggtctcgagactcgtaccgaaacatggatgtcctctgagggggcctggaaacagatccagagagtggaaacttgggctctgaggcaccctggattcaccgttattgcactgtttctcgcccatgctatcggcacatcgattacccaaaagggcatcatattcatcttactgatgcttgtgacgccatcaatggccatgcggtgcgtcgggattggaaaccgcgattttgtggagggtttgagcggcgcgacttgggtagacgttgtgctggagcacgggagttgtgtcacaaccatggcaaagaataaacccactctagatatcgaactcctgaagacagaggtgaccaaccctgccattcttagaaaactgtgcatcgaagctaagatatccaatacgaccacagactctaggtgtccaactcagggagaggccaccttggtggaagagcaggatgcaaacttcgtctgccggcgcacatttgttgaccgaggctggggtaatgggtgtggactcttcggcaaaggcagcctgttaacttgcgctaagtttaagtgcgtgaccaaactggaggggaagattgtacagtacgaaaacctcaaatattccgtgatcgtcacagtgcacaccggagatcaacatcaggttggtaatgagactacggaacacggcacaattgccaccatcactccccaggcgcctacctcagagatccagcttacagactacggggccctgaccttggactgtagtccaagaactggactagatttcaacgaaatggtgctgctcacaatgaaggagaaaagctggctggtccataagcaatggtttcttgacctgccgttgccctggacgtctggcgcatccacctcacaggagacttggaataggcaggatctcctggtgacattcaaaaccgctcacgccaagaagcaagaagtagttgtgttaggtagccaggagggggctatgcacacagccctgactggcgcaaccgaaattcagacgagtggaaccacaactatatttgccggccatctaaaatgccggctcaagatggacaaactgacccttaaggggacatcttatgtcatgtgtactggatccttcaaattggagaaggaagtggctgagacccagcacggtacggtcctggtgcaagttaagtacgagggcacagatgcgccttgcaaaatcccattcagcacccaggacgaaaagggggtgactcagaacggacgtctcattacagcaaatcccatcgtaaccgataaagagaagcctgtcaacatagaaactgagccaccctttggcgagtcgtatattgtggttggtgccggggaaaaagctctgaagctttcttggttcaagaaaggctcctcaatcggaaagatgtttgaggccaccgcacgcggcgccagaaggatggctatcctgggggacacagcctgggatttcggaagtattggtggcgtgtttacgagcgtcgggaaattggtgcatcaggtattcggaaccgcatacggcgtgctcttttccggtgtttcttggactatgaagatcgggattggcatactgttaacatggctgggactaaatagccggtcaaccagtctctccatgacatgtatcgcggtcggcatggtgactctgtaccttggggtgatggtccaagctgacagcggatgcgttattaactggaaaggccgagaattgaagtgtggttctgggatcttcgtgaccaacgaggtgcacacgtggacagaacagtataagtttcaggccgattcaccgaaacgcctgagtgcagccatcggaaaggcttgggaggagggcgtatgcggtattagaagcgccaccaggctcgaaaatataatgtggaaacagatctccaacgagctgaatcatattttactggaaaacgacatgaagttcactgtcgtggttggcgacgcaaatgggatccttgctcaaggaaaaaagatgattcggcctcagcccatggagcacaaatactcttggaagtcgtggggcaaggccaaaatcataggggcggatatccagaacaccacatttattatcgacggaccagatactcctgaatgtcccgacaatcagcgcgcctggaacatttgggaggtggaggattatggcttcggtatctttaccacaaatatatggttgaagctcagagacagctacacgcaaatgtgcgatcacaggctgatgtccgctgcaattaaagactcaaaggccgtccatgctgatatggggtattggatcgaaagtgagaaaaacgaaacctggaagctagcccgtgcatctttcattgaggtgaagacttgtacatggccaaaaagccacaccctgtggtccaatggagttctcgaatcagagatgatcatacccaagatctacggcggtcctattagccagcataactatcggccaggctacttcactcagacagcggggccgtggcacctgggaaaacttgagttggactttgatctgtgcgaaggcaccacggtggtagtcgacgagcactgcgggaatcgaggaccctctttaagaactaccacagtgaccggcaagatcattcatgaatggtgttgcaggtcctgtactctccctccactgcgcttccggggtgaggatgggtgctggtacggaatggagatcagacccgtgaaagaaaaggaggaaaaccttgtcaggagtatggttagcgccggctctggtgaggtggactccttttcactgggcatattgtgtgctagtattatgatcgaagaggtaatgcgcagccgatggtcgcggaagatgctcatgacagggaccctggccgtgttcctactgctcatcatgggacaactgacatggaatgaccttattcgtttgtgcatcatggtcggcgcaaacgcttccgatagaatggggatgggaactacctatctggccttaatggcaacgtttaaaatgaggcctatgttcgccgtgggcctcctgtttcgccggcttacatctagagaggttctgctactcaccattggtctgagcttggtggcttcagtcgaactgccaaacagtttagaggaactcggggacggactggcgatgggcataatgatgcttaagctgttgactgagttccagccccaccagctctggaccacactgctatccctgacttttatcaaaaccacgctttctctcgattacgcctggaagacaaccgcaatggctctgagcattgtgtccttgttcccgctgtgtttatcaactacaagccagaaaaccacttggctccctgttctgcttggcagttttgggtgcaagccactgacaatgttcttgatcaccgaaaataagatttggggaaggaaatcttggcccctcaacgagggtatcatggccataggcatcgtgtccattctgctaagctcgctgcttaagaatgacgtccctctcgccgggcccctgatcgctggaggcatgttgattgcatgttatgtaatctcaggttctagtgccgatttatccctggagaaagcggctgaagtgagctgggagcaagaagccgagcattctgggacgagccacaacatactcgttgaagtgcaggacgatggaactatgaagattaaagacgaggagcgagatgacaccctgacaatccttctgaaggcaaccttgctagccgtctccggcgtgtacccaatgtcaatccctgctacactgtttgtatggtatttctggcagaaaaagaagcagcgcagtggcgtgctctgggatactcccagcccaccggaagtcgagcgggcagttctggacgatgggatttacagaatacttcaaaggggattactgggtcgttctcaggtgggcgtgggggtcttccaggacggagtgtttcataccatgtggcacgttacgcgcggcgccgtactcatgtatcagggtaaacggttggaaccttcctgggcgtcagtgaagaaagacctgatcagttacgggggaggctggagattccaaggcagctggaatacaggggaggaggtccaggtgattgctgttgaacccggaaagaacccaaaaaatgtgcagactacccccggtacatttaagacccctgagggcgaagtcggggccatcgcactcgatttcaagccaggaacttccggctctcccattgtgaacagggagggtaaaatcgtagggctgtacggaaatggcgtcgtgaccacatcgggcacgtatgttagcgccatagctcaagccaaggcatcacaggaagggcctcttccggagatcgaggacgaagtgtttaaaaagcgaaacctgactattatggatttgcacccaggatccggtaaaacccggcgctacctacccgctatcgtcagagaggccattaagaggaagctgcggacactcatcttagcgcctacccgagtggttgccagtgaaatggcagaggctctgaaaggcatgccaataagatatcagactacagccgtgaagtctgaacataccgggcgcgagattgtcgaccttatgtgccacgctacgttcactatgaggctgctcagccccgtgcgtgtacctaattacaacatgatcatcatggatgaggcacattttacagacccggcctccattgccgctcggggatatatctcaaccagagtgggcatgggtgaagcggcagccatattcatgaccgctactcccccagggtctgttgaggcctttcctcagagcaatgcagtcattcaagatgaagagagggacatccccgaacgcagttggaactccggatacgattggattacagacttcccaggcaaaaccgtgtggtttgtgcctagcatcaagtctggcaatgatatagccaactgtttgcgaaaaaacgggaagagagtcattcagctgtcacggaagacattcgacactgagtatcagaaaacgaagaataacgactgggattacgtagtgaccacagacatctccgagatgggagctaatttcagggcggatcgcgttatcgacccccgtagatgcctcaaaccagtgattctgaaggatggtccggaacgggtcatccttgccggccctatgcccgtgactgttgcaagtgctgcccagaggcgcgggcgaattggaagaaaccaaaataaagagggcgaccagtacgtgtatatgggtcagccactaaacaatgatgaagaccacgcacattggaccgaggccaagatgctgttggataacataaatacacccgaggggatcattcctgctttatttgaaccagagcgggaaaagagcgccgcgatcgacggcgagtacaggctgcgcggagaagcaagaaaaaccttcgtcgagctcatgaggcggggcgatctgcccgtgtggctttcgtataaggtagcctctgaggggtttcagtactccgaccgtcgctggtgcttcgatggagaacgaaacaatcaagtgctggaggaaaacatggacgttgagatctggactaaagaaggtgagagaaagaaactcaggcctcggtggttggacgctcgcacgtatagcgatccgctggccctaagagagtttaaggaattcgctgcaggcaggcggtcagtcagtggggacctgattctcgagataggaaaacttccacagcacctgaccttacgagcccagaatgctttggataacctggtgatgctccacaattctgaacagggcggtaaggcctacagacatgcaatggaggaactgcccgacacaatcgagactcttatgctgctcgcgttgattgccgtgctgaccgggggcgtcacattatttttcctatccggaaagggcctggggaaaaccagcatcggactcctttgtgttactgcttcaagtgccctgttgtggatggcaagcgtggagcctcactggattgctgcctccatcatactggaatttttcctcatggtactgcttatccccgagccagatcgccaaaggacacctcaggacaaccagctcgcatatgtggtcattggtctgttgtttatgatcctgacggtggccgctaacgaaatgggcttactagagaccactaagaaagatctggggattggacatgttgcggccgagaatcaccaacacgcaacaatgctcgacgtggatcttcggcccgcttctgcctggaccctgtacgccgtcgcaaccacagtaatcactccaatgatgcgtcatacgatagaaaacaccacagctaatattagcttgactgccatcgcgaaccaggctgccattctgatgggcctcgacaagggttggcctatctccaaaatggatataggggtgccgctgcttgcattaggctgctactcacaggttaatcccctgaccctcacagccgctgtgttgatgctggtcgcacactatgccatcattggaccaggcctacaggcgaaggctaccagagaggcccaaaagaggactgcagccgggatcatgaaaaaccctacggtggacggaattgtcgctatcgatctggaccccgtggtttacgacgccaagttcgaaaaacagctcggccagataatgcttctgattttgtgtacatctcagatcctgctcatgcgcaccacttgggcactgtgcgagagtatcaccttagctacaggtccacttactaccctgtgggaagggtcgcctggaaagttttggaatacaacgattgccgtgagcatggcgaacatcttccggggctcctatctcgccggtgcaggcctagctttctctctgatgaaatcattggggggaggccgaagagggaccggagcccaaggcgagactctgggtgagaagtggaagaggcagctcaatcagcttagcaaatccgaatttaacacatacaagcgcagtgggataatggaggtagatcggtctgaagcaaaagagggactgaagagaggcgaaaccactaaacatgctgtgagccgtggtacagccaagttgaggtggttcgtcgagcggaatctggttaagcccgagggcaaagtgattgacctcgggtgtggacgcggcgggtggtcatattactgcgccggattaaagaaagtcaccgaagtgaagggctatacgaaaggtgggccgggacacgaggaaccaatccctatggcgacctacggctggaacctggtaaagcttcattccggcaaagatgtgtttttcatgcccccagagaagtgtgacacactgctatgcgatattggggaaagtagccccaatcctactatcgaggagggacgaaccctcagagttctgaagatggtggaaccgtggttgaggggtaaccagttttgtataaaaatcctgaatccctacatgccatctgtcgtggagacactcgaacaaatgcagcggaagcacggcgggatgcttgtccgcaaccctctgtccagaaattcaactcacgagatgtattgggtgagctgcggaaccggcaacattgtttcggctgtaaacatgacatctaggatgttactgaatcgattcaccatggcacatcggaaacccacttttgagcgtgacgtggatttgggtgccgggacgagacacgtcgctgtggaacctgaggttgccaacctcgacatcattggacagcgcatcgaaaatattaagaacgagcataaaagtacatggcactacgatgaagacaatccatataagacctgggcataccacggctcctatgaggtgaagcccagcggctcagcctcctctatggtcaacggggtggtaaggctgctaactaaaccttgggatgtgatcccaatggttacccaaatagctatgacagacacgacccccttcggacagcagcgggtctttaaggagaaagtggacactagaacaccgcgcgcgaagaggggtaccactcagattatggaagtgacagccaaatggctttggggcttcctgagccgaaataagaagcctcggatctgtaccagagaggaatttacaaggaaagtccgcagtaacgcagctatcggggccgttttcgtggatgagaatcaatggaactccgcaaaggaagccgtagaggacgagcgtttttgggatctcgtgcatcgggaaagagagctgcacaaacagggaaagtgcgctacttgcgtctacaatatgatgggcaaaagggaaaagaagttgggtgagttcgggaaagccaagggaagccgcgcgatttggtatatgtggctgggcgcacgattcctcgaatttgaggcccttggcttcatgaacgaggaccattggttttctcgggaaaattcactgagtggggtggagggagaaggtttacacaaactgggctacatattgagagatatctccaagattccagggggaaacatgtacgctgacgataccgccggctgggacacgaggatcaccgaggatgacctccagaatgaggcaaaaattacagatatcatggaacccgagcatgctctgctagccactagcatattcaagcttacctatcagaacaaagttgtgcgcgtccaaagacctgctaagaacggtacagtgatggacgtaatctctcggagggatcagcgtgggtcgggacaggttggcacttacggcctgaatacctttacgaacatggaagtgcagctcattcgacaaatggagtcagaagggatcttcctgccaagcgagttggagacacccaatttagccgaacgcgtcctggactggctcgagaagcacggagcagaaagacttaaacggatggcgatttccggtgacgattgtgtggtgaagccgatcgacgataggtttgccaccgctctgactgccctaaacgacatgggcaaagtccgcaaggatatacctcagtgggagcccagtaaagggtggaatgactggcagcaggttccattctgctctcaccattttcaccaactgattatgaaggatggaagagaaatcgtggtaccttgtcggaaccaggacgagctcgtgggcagggcacgagtcagccagggtgctgggtggtccttgcgtgagacagcctgcctgggaaagtcatatgcacaaatgtggcagcttatgtacttccatagacgcgatctgcggctcgccgcgaatgctatctgtagtgccgtgcccgttgactgggtgccaacctctaggactacctggagcattcacgcacaccatcagtggatgacaacggaagatatgttatccgtctggaacagagtgtggatagaggaaaatccctggatggaggacaaaacccacgtatcaagctgggaagaggttccttatctgggcaagcgcgaggaccagtggtgcggctctttgatcgggctgactgcccgggctacatgggccaccaacattcaagtggcaatcaatcaggtcaggcgactcattggaaacgaaaattaccttgattatatgacttccatgaaaagatttaagaacgagagtgacccagaaggtgctctgtggtga

SEQ ID NO: 13325 - RNA, 9879 nt, synthetic construct
  misc_feature 1..9879: note = derived and/or modified CDS sequence (opt3) from DENV-1__GQ868499__SS-prME
  source 1..9879: mol_type = other RNA
agcgtgaccatgctgctcatgcttctgcccacagcattggctttccacttaactacgcggggaggggaacctcatatgatcgtctccaagcaggaaaggggaaaatctctgctatttaagacctcagccggtgttaatatgtgcacactcattgccatggacctgggagaactttgtgaagatactatgacctacaaatgcccacaaataacagaggcggaaccggacgatgtggactgttggtgcaatgctaccgatacttgggtaacatatgggacctgtagtcagacgggaggccaccggcgcgagaagcgaagcgtggccctggcaccccatgtcggtttggggctcgagactcgtaccgaaacatggatgtcctctgagggagcctggaaacagatccagagagtggaaacttgggctctgaggcaccctggcttcaccgttattgcactgtttctcgcccatgctatcggcacatcgattacccaaaaggggatcattttcatcttactgatgcttgtgacgccatcaatggccatgcggtgcgtcggaattggtaatcgcgactttgtggagggcttgagcggggcgacttgggttgatgttgtgctggagcacggaagttgtgtcacaaccatggcaaagaataaacccactctagacatcgaactcctgaagacagaggtgaccaaccctgccgtgcttagaaaactgtgcattgaagctaagatctccaatacgaccacagattctaggtgtccaactcagggcgaggccaccttggtcgaagaacaggacgcaaacttcgtttgccggcgcacatttgtggatcgaggttgggggaatggatgtggcctcttcggcaaagggagcctgttaacttgcgctaagtttaagtgcgtaaccaaactggagggaaagatagtgcagtacgaaaacctcaaatattccgtcattgtgacagttcacaccggtgaccaacatcaggtgggcaatgagactacggaacacgggacaatcgccaccattactccccaggcgcctacctcagagatccagcttacagattacggagccctgaccttggactgtagtccaagaactggcctagacttcaacgaaatggtcctgctcacaatgaaggagaaaagctggctggtgcataagcaatggtttcttgatctgccgttgccctggacgtctggtgcatccacctcacaggagacttggaataggcaggacctcctggtaacattcaaaaccgctcacgccaagaagcaagaagttgtggtcttagggagccaggagggcgctatgcacacagccctgactggagcaaccgaaatccagacgagtggcaccacaactatttttgccgggcatctaaaatgccggctcaagatggataaactgacccttaagggaacatcttatgtgatgtgtactggttccttcaaattggagaaggaagtcgctgagacccagcacggcacggtgctggttcaagtgaagtacgaggggacagacgcgccttgcaaaataccattcagcacccaggatgaaaagggagtaactcagaacggccgtctcatcacagcaaatcccattgtcaccgacaaagagaagcctgtgaacatcgaaactgagccaccctttggtgagtcgtatatagttgtgggggccggcgaaaaagctctgaaactttcttggttcaagaaaggatcctcaattggcaagatgtttgaggccaccgcacgcggggccagaaggatggctatcctgggagatacagcctgggacttcggtagtatcggcggggtctttacgagcgtgggaaaattggtacatcaggtgttcggcaccgcatacggtgttctcttttccggggtctcttggactatgaagattggcatcggcattctgttaacatggctgggcctaaatagccggtcaaccagtctctccatgacatgtatagcggtggggatggtgactctgtaccttggagtcatggttcaagctgatagcggctgcgtgatcaactggaaaggtcgagaattgaagtgtgggtctggaattttcgtgaccaacgaggtacacacgtggacagaacagtataagtttcaggccgactcaccgaaacgcctgagtgcagccatcggcaaggcttgggaggagggtgtctgcggcatcagaagcgccaccaggctcgaaaatattatgtggaaacagatatccaacgagctgaatcatatcttactggaaaacgatatgaagttcactgtggttgtgggggacgcaaatggcattcttgctcaaggcaaaaagatgatccggcctcagcccatggagcacaaatactcttggaagtcgtgggggaaggccaaaattatcggagcggacatacagaacaccacatttatcattgatggcccagacactcctgaatgtcccgataatcagcgcgcctggaacatctgggaggtcgaggactatggtttcgggatttttaccacaaatatctggttgaagctcagagatagctacacgcaaatgtgcgaccacaggctgatgtccgctgcaataaaagattcaaaggccgtgcatgctgacatgggatattggattgaaagtgagaaaaacgaaacctggaagctagcccgtgcatctttcatcgaggttaagacttgtacatggccaaaaagccacaccctgtggtccaatggcgtgctcgaatcagagatgattatccccaagatatacggtggccctatcagccagcataactatcggccagggtacttcactcagacagcgggaccgtggcacctgggcaaacttgagttggattttgacctgtgcgaagggaccacggtagtcgtggatgagcactgcggaaatcgaggcccctctttaagaactaccacagtgaccggtaagattatccatgaatggtgttgcaggtcctgtactctccctccactgcgcttcagaggggaagacggatgctggtacggcatggagattagacccgtcaaagaaaaggaggaaaaccttgttaggagtatggtgagcgccggttctggcgaggtagattccttttcactggggatcttgtgtgctagtataatgattgaagaggtgatgcgcagccgatggtcgcggaagatgctcatgacaggaaccctggccgtcttcctactgctcatcatgggccaactgacatggaaagaccttatccgtttgtgcattatggtgggggcaaatgcttccgacagaatgggaatgggcactacctatctggccttaatggcaacgtttaagatgaggcctatgttcgccgttggtctcctgtttcgccggcttacatctagagaggtgctgctactcaccatcgggctgagcttggtcgcttcactggaattaccaaacagtctcgaggaactgggagatggccttgcgatgggcattatgatgctgaaattgctcactgagttccagccccaccagctgtggaccacactactgtcccttacttttataaagaccacgctctctctggactacgcctggaaaacaaccgcaatggctttgagcatcgtgtccctgttcccgttatgtctctcaactacaagccagaagaccacttggctgcctgttcttctggggagttttggatgcaagccattgacaatgttcctcattaccgaaaacaaaatctggggtaggaagtcttggcccctgaatgagggcattatggccatcgggatagtgtccatcctactgagctcgcttctcaaaaacgatgtccctctggccggacccttgattgctggcggtatgttaatcgcatgttatgtaatttcagggtctagtgccgacctgtccctcgagaaggtggcggaagttagctgggagcaagaagctgagcattctggaacgagccacaatatcctggtggaagtccaggatgacggcactatgaaaataaaggatgaggagcgagacgatacccttacaattctgttgaaagccaccctactggcagtgtccggcgtatacccaatgtcaatccctgccacactctttgtgtggtatttctggcagaagaagaaacagcgcagtggggtcctgtgggacactcccagcccaccggaagttgagcgggctgtgcttgatgacggaatctacagaattttacaaaggggtctgctcggccgttctcaggtgggggtcggagtgttccaggatggcgtttttcataccatgtggcacgtaacgcgcggtgcagtgttgatgtatcaggggaagcggctggaaccttcctgggcctcagtcaaaaaggacctcataagttacggaggcggctggagattccaagggagctggaacacaggagaggaggtgcaggttatcgcggtggaacccggtaaaaatccaaagaacgtccagactacccccggcacatttaagacccctgagggggaagtgggagctattgccctggacttcaaaccaggcacttccggttctcccatcgtaaatagggaggggaagattgtcggactttacggcaacggcgtggttaccacatcggggacgtatgtgagcgcaatcgcccaagctaaagcctcacaggaaggacctctgccggagatagaggatgaagtctttaagaaacgaaatttgactatcatggacctacacccaggttccggcaagacccggcgctacctgcccgcaattgtgagagaggctatcaagaggaaactccggacattaattctggcccctacccgagttgtggcgagtgaaatggccgaggcacttaaggggatgccaatcagatatcagactacagctgtcaaatctgaacataccggacgcgagatagtggatctgatgtgccacgccacgttcactatgaggctcttgagccccgtacgtgtgcctaactacaatatgattatcatggacgaggctcattttacagatccggcatccatcgccgcccggggctatatttcaaccagagttggtatgggggaagctgcggcaatcttcatgaccgccactcccccaggatctgtcgaggcttttcctcagagcaacgccgtgatacaagacgaagagagggatattcccgaacgcagttggaactccggctacgactggatcacagatttcccaggcaagaccgtgtggtttgtccctagcattaaatctgggaacgacatcgcaaattgtctgcgaaagaacggaaagagagtaatacagctctcacggaaaacattcgatactgagtatcagaagacgaaaaacaatgactgggactacgtggttaccacagatatttccgagatgggtgccaacttcagggctgaccgcgtgatcgatccccgtagatgcctgaagccagtcatccttaaagacggcccggaacgggtgattctagcggggcctatgcccgttactgtggccagtgcagctcagaggcgcggacgaatcggcagaaatcaaaacaaggagggtgatcagtacgtctatatggggcagccactgaataacgacgaagatcacgcccattggaccgaggcaaagatgttgttagacaatattaacacacccgagggcataatccctgccctgtttgaaccagagcgggaaaagagcgctgccattgatggagagtacaggctccgcggcgaggcgagaaagaccttcgtggagctgatgaggcgtggggaccttcccgtatggctgtcgtataaagtggcatctgagggatttcagtactccgatcggcgctggtgcttcgacggtgaacgaaataaccaagttctcgaggaaaatatggatgtcgagatctggactaaggaaggcgagaggaagaagttgaggcctcggtggctggacgcccgcacgtatagcgacccgctagctctgagagagtttaaagagttcgccgctgggaggcggtcagtgagtggagatctcatccttgagattggcaagctgccacagcacttaaccttgcgagcacagaacgccctggacaatctcgtgatgctgcacaactctgaacagggtgggaaggcttacagacatgccatggaggaacttcccgatacaatagagactctgatgctcttggcactgatcgcggtcttaaccggcggagttacactatttttcctgtccggcaaagggctcggaaagaccagcattggtcttctgtgtgtgactgcctcaagtgctttgctgtggatggccagcgtagagcctcactggatcgcagcttccattatcctcgaatttttcctgatggtgcttctcatacccgagccagaccgccaaaggacacctcaggataatcagctggcctatgtcgtgatcggcttgctgtttatgattttaacggttgcagccaacgaaatggggctactggagaccactaaaaaggacctcggaatcggccatgtggctgcggagaaccaccaacacgccacaatgcttgatgtcgacctgcggcccgcatctgcttggaccttgtacgccgtagccaccacagtgattactccaatgatgcgtcatacgatcgaaaataccacagcaaacataagcctgactgctattgccaatcaggcggctatcctcatgggtctggataaagggtggcctatttccaagatggacatcggcgttccgcttttagccctgggatgctactcacaggtgaaccccctcaccttgacagcagccgtcctgatgctagtggctcactatgcaataatcggcccagggctgcaggccaaggcgaccagagaggctcagaaaagaactgccgcaggaattatgaagaatcctacggtcgatggcatcgtggccattgacctcgatcccgttgtgtacgacgctaaattcgaaaagcagcttggtcagatcatgctgttgatactgtgtacatctcagattctcctgatgcgcaccacttgggccttatgcgagagtatcacccttgcaacagggccactgactaccctctgggaaggatcgcctggcaaattttggaacacaacgatcgctgtaagcatggccaatattttccggggttcctatctagcgggcgccgggctggcattctctttgatgaagtcactgggaggcgggcgaagaggaaccggcgctcaaggtgagactctcggggagaagtggaaaaggcagcttaaccagctgagcaagtccgaatttaatacatacaaacgcagtggaatcatggaggtggaccggtctgaagccaaggagggcttgaaaagaggtgaaaccactaagcatgcagtcagccgtggcacagctaagctgaggtggttcgttgagcggaacctcgtgaaacccgaggggaaggtcatagatttaggatgtggccgcgggggatggtcatattactgcgccggcctgaaaaaggtgaccgaagtaaaaggttatacgaaagggggaccgggccacgaggaaccaattcctatggccacctacggctggaatcttgtgaaactgcattccgggaaggacgtatttttcatgcccccagagaagtgtgatacactactctgcgacatcggagaaagtagccccaaccctactattgaggagggtcgaaccctgagagtgttgaaaatggtcgaaccgtggctgaggggcaatcagttttgtatcaagatactcaacccctacatgccatctgtggtcgagacacttgaacaaatgcagcggaaacacgggggaatgctggtgcgcaatcctttatccagaaactcaactcacgagatgtattgggttagctgcggcaccggtaatatcgtatcggcggtgaacatgacatctaggatgctgttgaaccgattcaccatggctcatcggaagcccacttacgagcgtgatgtcgacctcggggcaggaacgagacacgtggccgttgaacctgaggtggctaatctggatattatcggccagcgcattgaaaacatcaaaaatgagcataagagtacatggcactatgacgaagataacccatacaagacctgggcctatcacggctcctacgaggtcaaacccagcgggtcagcatcctctatggtgaatggagtagtgaggctacttactaagccttgggacgttattccaatggtcacccaaatcgccatgacagatacgaccccctttggtcagcagcgggtgttcaaagagaaggtggacactagaacaccgcgcgctaaaaggggcaccactcagataatggaagtcacagcgaagtggctgtgggggtttctcagccgaaacaagaaacctcggatttgtaccagagaggagttcacaaggaaggttcgcagtaatgccgcaatcggagctgtgtttgtagacgagaaccaatggaactccgccaaagaagcagtggaggatgagcgtttctgggacctggtccatcgggaaagagagttgcacaagcagggcaaatgcgccacttgcgtgtataacatgatgggtaagagggaaaagaaactgggggagtttggaaaggctaaaggcagccgcgccatctggtacatgtggctcggcgcgcgattccttgagttcgaggcactggggtttatgaatgaggatcattggttctctcgggaaaactcattaagtggagttgagggtgaaggcctgcacaagttggggtacattctcagagacatatccaaaatcccaggaggcaatatgtatgccgatgacaccgctggttgggatacgaggattaccgaggacgatctgcagaacgaggccaagatcacagacattatggaacccgagcatgcactacttgctactagcatctttaaactgacctaccagaataaggtggtccgcgtgcaaagacctgccaagaacgggacagtaatggatgttatatctcggagggaccagcgtggatcgggccaggtgggcacttatgggctcaacaccttcacgaatatggaagtccagctgatccgacaaatggagtcagaaggaatatttttgccaagcgagttagagacacccaacctggctgaacgcgtgctcgattggcttgagaaacacggtgccgaaagactgaagcggatggcaatctccggcgacgactgtgtggtcaaaccgattgatgacaggttcgcgaccgccctaactgctctgaatgatatggggaaggttcgcaaagacatccctcagtgggagcccagtaagggatggaacgattggcaacaggtgccattttgctctcaccatttccaccaactcataatgaaggacggcagagaaattgtagtgccttgtcggaatcaggatgagttggtcggtagggcccgagtgagccagggggcaggatggtccctgcgtgagacagcttgccttggcaaatcatacgcccaaatgtggcagctgatgtattttcatagacgcgacctccggttagcagccaacgcgatctgtagtgctgttcccgtggattgggtcccaacctctaggactacctggagcatccacgcccaccatcagtggatgacaacggaagacatgctgtccgtgtggaatagagtatggattgaggaaaacccctggatggaggataagacccacgtttcaagctgggaagaggtgccttacttgggcaaacgcgaggaccagtggtgcgggtctctgataggactcactgcacgggccacatgggctaccaatatccaagtcgccattaaccaggtgaggcgacttatcggtaatgaaaactatctggactacatgacttccatgaagagattcaaaaatgagagtgatccagaaggcgcactatggtga

SEQ ID NO: 13326 - RNA, 9879 nt, synthetic construct
  misc_feature 1..9879: note = derived and/or modified CDS sequence (opt3) from DENV-1__GQ868500__SS-prME
  source 1..9879: mol_type = other RNA
agcgtgaccatgctgctcatgcttctgccaacagcattggctttccacttaactacgagaggaggggaacctcatatgatcgtctccaagcaggaaaggggaaaatctctgttgtttaagacctcagccggtgttaacatgtgcacactcattgccatggacctgggcgaactttgtgaagatactatgacctacaaatgcccacagataacagaggcggaaccggacgatgtggactgttggtgcaatgctaccgatacttgggtaacatatgggacctgtagtcagacgggagagcaccggcgcgacaagcgaagcgtggccctggcaccccatgtcggcttgggtctcgagactcgtaccgaaacatggatgtcctctgagggggcctggaaacagatccagagagtggaaacttgggctctgaggcaccctggattcaccgttattgcactgtttctcgcccatgctatcggcacatcgattacccaaaagggcatcatattcatcttactgatgcttgtgacgccatcaatggccatgcggtgcgtcgggattggaaaccgcgattttgtggagggtttgagcggcgcgacttgggtagacgttgtgctggagcacgggagttgtgtcacaaccatggcaaagaataaacccactctagatatcgaactcctgaagacagaggtgaccaaccctgccattcttagaaaactgtgcatcgaagctaagatatccaatacgaccacagactctaggtgtccaactcagggagaggccaccttggtggaagaacaggatgcaaacttcgtctgccggcgcacatttgttgaccgaggctggggtaatgggtgtggactcttcggcaaaggcagcctgttaacttgcgctaagtttaagtgcgtgaccaaactggaggggaagattgtacagtacgaaaacctcaaatattccgtgatcgtcacagtgcacaccggagatcaacatcaggttggtaatgagactacggaacacggcacaattgccaccatcactccccaggcgcctacctcagagatccagcttacagactacggggccctgaccttggactgtagtccaagaactggactagatttcaacgaaatggtgctgctcacaatgaaggagaaaagctggctggtccataagcaatggtttcttgacctgccgttgccctggacgtctggcgcatccacctcacaggagacttggaataggcaggatctcctggtgacattcaaaaccgctcacgccaagaagcaagaagtagttgtgttaggtagccaggagggggctatgcacacagccctgactggcgcaaccgaaattcagacgagtggaaccacaactatatttgccggccatctaaaatgccggctcaagatggacaaactgacccttaaggggacatcttatgtcatgtgtactggatccttcaaattggagaaggaagtggctgagacccagcacggtacggtcctggtgcaagttaagtacgagggcacagatgcgccttgcaaaatcccattcagcacccaggacgaaaagggggtgactcagaacggacgtctcattacagcaaatcccatcgtaaccgataaagagaagcctgtcaacatagaaactgagccaccctttggcgagtcgtatattgtggttggtgccggggaaaaagctctgaaactttcttggttcaagaaaggctcctcaatcggaaagatgtttgaggccaccgcacgcggcgccagaaggatggctatcctgggggacacagcctgggatttcggaagtattggtggcgtgtttacgagcgtcgggaaattggtgcatcaggtattcggaaccgcatacggcgtgctcttttccggtgtttcttggactatgaagatcgggattggcatactgttaacatggctgggactaaatagccggtcaaccagtctctccatgacatgtatcgcggtcggcatggtgactctgtaccttggggtgatggtccaagctgacagcggatgcgttattaactggaaaggccgagaattgaagtgtggttctgggatcttcgtgaccaacgaggtgcacacgtggacagaacagtataagtttcaggccgattcaccgaaacgcctgagtgcagccatcggaaaggcttgggaggagggcgtatgcggtattagaagcgccaccaggctcgaaaatataatgtggaaacagatctccaacgagctgaatcatattttactggaaaacgacatgaagttcactgtcgtggttggcgacgcaaatgggatccttgctcaaggcaagaagatgattcggcctcagcccatggagcacaaatactcttggaagtcgtggggcaaggccaaaatcataggggcggatatccagaacaccacatttattatcgacggaccagatactcctgaatgtcccgacaatcagcgcgcctggaacatttgggaggtggaggattatggcttcggtatctttaccacaaatatatggttgaagctcagagacagctacacgcaaatgtgcgatcacaggctgatgtccgctgcaattaaagactcaaaggccgtccatgctgatatggggtattggatcgaaagtgagaaaaacgaaacctggaagctagcccgtgcatctttcattgaggtgaagacttgtacatggccaaaaagccacaccctgtggtccaatggagttctcgaatcagagatgatcatacccaagatctacggcggtcctattagccagcataactatcggccaggctacttcactcagacagcggggccgtggcacctgggaaaacttgagttggactttgatctgtgcgaaggcaccacggtggtagtcgacgagcactgcgggaatcgaggaccctctttaagaactaccacagtgaccggcaagatcattcatgaatggtgttgcaggtcctgtactctccctccactgcgcttccggggtgaggatgggtgctggtacggaatggagatcagacccgtgaaagaaaaggaggaaaaccttgtcaggagtatggttagcgccggctctggtgaggtggactccttttcactgggcatattgtgtgctagtattatgatcgaagaggtaatgcgcagccgatggtcgcggaagatgctcatgacagggaccctggccgtgttcctactgctcgtcatgggacaactgacatggaatgaccttatccgtttgtgcattatggtgggcgcaaacgcttccgatagaatggggatgggaactacctatctggccttaatggcaacgtttaaaatgaggcctatgttcgccgttggcctcctgtttcgccggcttacatctagagaggtgctgctactcaccatcggtctgagcttggtcgcttcagtggaactgccaaacagtttagaggaactcggggacggactggcgatgggcattatgatgcttaagctgttgactgagttccagccccaccagctctggaccacactgctatccctgacttttataaaaaccacgctttctctcgattacgcctggaagacaaccgcaatggctctgagcatcgtttccttgttcccgctgtgtttatcaactacaagccagaaaaccacttggctccctgtgctgcttggcagttttgggtgcaagccactgacaatgttcttgattaccgaaaataagatctggggaaggaaatcttggcccctcaacgagggtattatggccatcggcatagtctccatcctgctaagctcgctgcttaagaatgacgtacctctcgccgggcccctgattgctggaggcatgttgatcgcatgttatgtgatttcaggttctagtgccgatttatccctggagaaagcggctgaagttagctgggagcaagaagccgagcattctgggacgagccacaacatcctcgtggaagtccaggacgatggaactatgaagataaaagacgaggagcgagatgacaccctgacaattcttctgaaggcaaccttgctagccgtgtccggcgtatacccaatgtcaatccctgctacactgtttgtgtggtatttctggcagaaaaagaagcagcgcagtggcgtcctctgggatactcccagcccaccggaagttgagcgggcagtgctggacgatgggatctacaggattcttcaacgaggattactgggtcgttctcaggtgggcgtcggggtgttccaggacggagtttttcataccatgtggcacgtaacgcgcggcgccgtgctcatgtatcagggtaaacggttggaaccttcctgggcgtcagtcaagaaagacctgataagttacgggggaggctggagattccaaggcagctggaatacaggggaggaggtgcaggttatcgctgtggaacccggaaagaaccccaagaatgtccagactacccccggtacatttaagacccctgagggcgaagtgggggccattgcactcgatttcaagccaggaacttccggctctcccatcgtaaacagggagggtaaaattgtcgggctgtacggaaatggcgtggttaccacatcgggcacgtatgtgagcgccatcgctcaagccaaggcatcacaggaagggcctcttccggagatagaggacgaagtctttaaaaagcgaaacctgactatcatggatttgcacccaggatccggtaaaacccggcgctacctacccgctatggtgagagaggccattaagaggaagctgcggacactcatcttagcgcctacccgagttgtggccagtgaaatggcagaggctctgaaaggcatgccaattagatatcagactacagccgtcaagtctgaacataccgggcgcgagatcgtggaccttatgtgccacgctacgttcactatgaggctgctcagccccgtacgtgtgcctaattacaacatgataattatggatgaggcacattttacagacccggcctccatcgccgctcggggatatatctcaaccagagttggcatgggtgaagcggcagccattttcatgaccgctactcccccagggtctgtcgaggcctttcctcagagcaatgcagtgatccaagatgaagagagggacatacccgaacgcagttggaactccggatacgattggattacagacttcccaggcaaaaccgtgtggtttgtccctagcatcaagtctggcaatgatattgccaactgtttgagaaagaacgggaaaagagtaatccagctgtcacggaagacattcgacactgagtatcagaaaacgaagaataacgactgggattacgtggttaccacagacatatccgagatgggagctaatttcagggcggatcgcgtgattgacccccgtagatgcctcaaaccagtcatcctgaaggatggtccggaacgggtgatccttgccggccctatgcccgttactgtggcaagtgctgcccagaggcgcgggcgaattggaagaaaccaaaataaagagggcgaccagtacgtctatatgggtcagccactaaacaatgatgaagaccacgcacattggaccgaggccaagatgctgttggataacatcaatacacccgaggggattatacctgctttatttgaaccagagcgggaaaagagcgccgcgatcgacggcgagtacaggctgcgcggagaagcaagaaaaaccttcgtggagctcatgaggcggggcgatctgcccgtatggctttcgtataaggtggcctctgaggggtttcagtactccgaccgtcgctggtgcttcgatggagaacgaaacaatcaagttctggaggaaaacatggacgtcgagatttggactaaagaaggtgagagaaagaaactcaggcctcggtggttggacgctcgcacgtatagcgatccgctggccctaagagagtttaaggagttcgctgcaggcaggcggtcagtgagtggggacctgatcctcgagatcggaaaacttccacagcacctgaccttacgagcccagaatgctttggataacctggtgatgctccacaattctgaacagggcggtaaggcctacagacatgcaatggaggaactgcccgacacaattgagactcttatgctgctcgcgttgatagccgtcctgaccgggggcgttacattatttttcctatccggaaagggcctggggaaaaccagcatcggactcctttgtgtgactgcttcaagtgccctgttgtggatggcaagcgtagagcctcactggattgctgcctccatcattctggaatttttcctcatggtgctgcttatccccgagccagatcgccaaaggacacctcaggacaaccagctcgcatatgtcgtgataggtctgttgtttgttatcctgacggtggccgctaacgaaatgggcttactagagaccactaagaaagatctggggattggacatgtcgcggccgagaatcaccaacacgcaacaatgctcgacgtagatcttcggcccgcttctgcctggaccctgtacgccgtggcaaccacagttatcactccaatgatgcgtcatacgattgaaaacaccacagctaatatcagcttgactgccatagcgaaccaggctgccattctgatgggcctcgacaagggttggcctatctccaaaatggatattggggtgccgctgcttgcattaggctgctactcacaggtcaatcccctgaccctcacagccgctgtgttgatgctggtcgcacactatgccatcataggaccaggcctacaggcgaaggctaccagagaggcccaaaagaggactgcagccgggatcatgaaaaaccctacggtggacggaattgttgctatcgatctggaccccgtggtatacgacgccaagttcgaaaaacagctcggccagattatgcttctgatcttgtgtacatctcagatactgctcatgcgcaccacttgggcactgtgcgagagtattaccttagctacaggtccacttactaccctgtgggaagggtcgcctggaaagttttggaatacaacgatcgccgtgagcatggcgaacatcttccggggctcctatctcgccggtgcaggcctagctttctctctgatgaaatcactagggggaggccgaagagggaccggagcccaaggcgagactctgggtgagaagtggaagaggcagctcaatcagcttagcaaatccgaatttaacacatacaagcgcagtgggattatggaggtcgatcggtctgaagcaaaagagggactgaagagaggcgaaaccactaaacatgctgttagccgtggtacagccaagttgaggtggttcgtggagcggaatctggtcaagcccgagggcaaagtgatcgacctcgggtgtggacgcggcgggtggtcatattactgcgccggattaaagaaagtaaccgaagtgaagggctatacgaaaggtgggccgggacacgaggaaccaatacctatggcgacctacggctggaacctggttaaacttcattccggcaaagatgtgtttttcatgcccccagagaagtgtgacacactgctatgcgatattggggaaagtagccccaatcctactatcgaggagggacgaaccctcagagtcctgaagatggtggaaccgtggttgaggggtaaccagttttgtattaaaatcctgaatccctacatgccatctgtcgtggagacactcgaacaaatgcagcggaagcacggcgggatgcttgttcgcaaccctctgtccagaaattcaactcacgagatgtattgggtaagctgcggaaccggcaacatagtgtcggctgtcaacatgacatctaggatgttactgaatcgattcaccatggcacatcggaaacccacttacgagcgtgacgtggatttgggtgccgggacgagacacgttgctgtggaacctgaggtcgccaacctcgacatcattggacagcgcatcgaaaatattaagaacgagcataaaagtacatggcactatgatgaagacaatccatacaagacctgggcatatcacggctcctacgaggtgaagcccagcggctcagcctcctctatggtaaacggggtggttaggctgctaactaaaccttgggatgtcatcccaatggtgaagcaaattgctatgaccgacacaacgccctttggacagcagcgggtgttcaaagagaaggtcgacaccagaactccgcgcgcgaaaaggggtacaacccagatcatggaagttactgccaagtggctttggggctttctgagccgaaataagaaacctcggatatgtacaagagaggagttcaccaggaaggtgcgcagtaacgcagctattggggccgtatttgtgggagagaatcaatggaactccgcaaaagaagccgtcgaggatgagcgtgtgtgggacctcgttcatcgggaaagagagctgcacaagcagggcaaatgcgctacatgcgtgtataatatgatgggtaagagggaaaagaaattgggggagttcggaaaggccaaaggcagccgcgcgatctggtacatgtggctgggcgcacgatttctcgagttcgaggcccttgggttcatgaacgaggatcattggttttctcgggaaaattcactgagtggagtcgagggtgaaggcttacacaagctggggtacatcttgagagacatttccaaaataccaggaggcaacatgtatgctgatgacactgccggttgggataccaggatcacggaggacgatctccagaatgaggcaaagattaccgaaatcatggagcccgaacatgctctgctagccacaagcattttcaaacttacttaccagaacaaggtggtacgcgttcaaagacctgctaagaacgggaccgtgatggacgtcatctctcggagggatcagcgtggatcgggccaggtgggcacatatgggctgaatacttttaccaacatggaggtgcagctcatacgacaaatggaatcagagggaatcttcctgccaagcgagttggaaacgcccaatttagccgagcgcgtcctggactggctcgaaaaacacggtgcagagagacttaagcggatggcgatttccggcgatgactgtgttgtgaaaccgatcgacgataggtttgccacagctctgaccgccctaaacgacatggggaaggtacgcaaagatattcctcagtgggaacccagtaagggatggaatgactggcaacaggtgccattctgctctcaccattttcaccaactgatcatgaaggatggcagagagatagtcgtgccttgtcggaaccaggacgagctcgttggtagggcacgagtgagccagggggctggatggtccttgcgtgaaactgcctgcctgggcaaatcatacgcacaaatgtggcagcttatgtatttccatagacgcgatctgcggctcgccgcgaatgctatttgtagtgccgtccccgtggactgggtaccaacatctaggaccacttggagcatccacgcacaccatcagtggatgaccacagaggatatgttatccgtttggaacagagtgtggatcgaagagaatccctggatggaagacaagacgcacgtctcaagctgggaggaggtgccttacctgggcaaacgcgaagatcagtggtgcgggtctttgattggactgaccgcccgggctacttgggccacaaacatacaagttgcaatcaatcaggtgaggcgactcattggtaacgagaattatcttgactacatgacctccatgaagagatttaaaaacgaaagtgacccagagggcgctctgtggtga

SEQ ID NO: 13327 - RNA, 9879 nt, synthetic construct
  misc_feature 1..9879: note = derived and/or modified CDS sequence (opt3) from DENV-1__GU131961__SS-prME
  source 1..9879: mol_type = other RNA
agcgtgaccatgctgctcatgcttctgcccacagcattggctttccacttaactacgaggggaggggagcctcatatgatcgtctccaagcaggaaaggggaaaatctctgttatttaagacctcagccggtgttaacatgtgcacactcattgccatggacctgggcgagctttgtgaagatactatgacctacaaatgcccacaaataacagaggcggaaccggacgatgtggactgttggtgcaatgctaccgatacttgggtaacatatgggacctgtagtcagacgggagagcaccggcgcgacaagcgaagcgtggccctggcaccccatgtcggcttgggtctcgagactcgtaccgaaacatggatgtcctctgagggggcctggaaacagatccagagagtggaaacttgggctctgaggcaccctggattcaccgttattgcactgtttctcgcccatgctatcggcacatcgattacccaaaagggcatcatattcatcttactgatgcttgtgacgccatcaatggccatgcggtgcgtcgggattggaaaccgcgattttgtggagggtttgagcggcgcgacttgggtagacgttgtgctggagcacgggagttgtgtcacaaccatggcaaagaataaacccactttggatatcgaactcctgaagacagaggtgaccaaccctgccattcttagaaaactgtgcatcgaagctaagatatccaatacgaccacagactctaggtgtccaactcagggagaggccaccttggtggaagaacaggatgcaaacttcgtctgccggcgcacatttgttgaccgaggctggggtaatgggtgtggactcttcggcaaaggcagcctgttaacttgcgctaagtttaagtgcgtgaccaaactggaggggaagattgtacagtacgaaaacctcaaatattccgtgatcgtcacagtgcacaccggagatcaacatcaggttggtaatgagactacggaacacggcacaattgccaccatcactccccaggcgcctacctcagagatccagcttacagactacggggccctgaccttggactgtagtccaagaactggactagatttcaacgaaatggtgctgctcacaatgaaggagaaaagctggctggtccataagcaatggtttcttgacctgccgttgccctggacgtctggcgcatccacctcacaggagacttggaataggcaggatctcctggtgacattcaaaaccgctcacgccaagaagcaagaagtagttgtgttaggtagccaggagggggctatgcacacagccctgactggcgcaaccgaaattcagacgagtggaaccacaactatatttgccggccatctaaaatgccggctcaagatggacaaactgacccttaaggggacatcttatgtcatgtgtactggatccttccgtttggagaaagaagtggctgagacccagcacggtacggtcctggtgcaagttaagtacgagggcacagatgcgccttgcaagatcccattcagcacccaggacgaaaaaggggtgactcagaacggacgcctcattacagcaaatcccatcgtaaccgataaggagaaacctgtcaacatagaaactgagccaccctttggcgagtcgtatattgtggttggtgccggggaaaaggctctgaaactttcttggttcaagaagggctcctcaatcggaaaaatgtttgaggccaccgcaagaggcgccaggcggatggctatcctgggggacacagcctgggatttcggaagtattggtggcgtgtttacgagcgtcgggaagttggtgcatcaggtattcggaaccgcatacggcgtgctcttttccggtgtttcttggactatgaaaatcgggattggcatactgttaacatggctgggactaaatagccgatcaaccagtctctccatgacatgtatcgcggtcggcatggtgactctgtaccttggggtgatggtccaagctgacagcggatgcgttattaactggaagggccgcgaattgaaatgtggttctgggatcttcgtgaccaacgaggtgcacacgtggacagaacagtataagtttcaggccgattcaccgaagagactgagtgcagccatcggaaaggcttgggaggagggcgtatgcggtattaggagcgccacccggctcgaaaatataatgtggaagcagatctccaacgagctgaatcatattttactggaaaacgacatgaaattcactgtcgtggttggcgacgcaaatgggatccttgctcaaggaaagaaaatgattcgccctcagcccatggagcacaagtactcttggaaatcgtggggcaaggccaagatcataggggcggatatccagaacaccacatttattatcgacggaccagatactcctgaatgtcccgacaatcagagagcctggaacatttgggaggtggaggattatggcttcggtatctttaccacaaatatatggttgaaactcagggacagctacacgcaaatgtgcgatcaccgtctgatgtccgctgcaattaaggactcaaaagccgtccatgctgatatggggtattggatcgaaagtgagaagaacgaaacctggaaactagcccgggcatctttcattgaggtgaagacttgtacatggccaaagagccacaccctgtggtccaatggagttctcgaatcagagatgatcatacccaaaatctacggcggtcctattagccagcataactatcgaccaggctacttcactcagacagcggggccgtggcacctgggaaaacttgagttggactttgatctgtgcgaaggcaccacggtggtagtcgacgagcactgcgggaatagaggaccctctttaaggactaccacagtgaccggcaaaatcattcatgaatggtgttgccgctcctgtactctccctccactgcggttcagaggtgaggatgggtgctggtacggaatggagatcaggcccgtgaaggaaaaagaggaaaaccttgtccgcagtatggttagcgccggctctggtgaggtggactccttttcactgggcatattgtgtgctagtattatgatcgaagaggtaatgcgaagccggtggtcgcgtaagatgctcatgacagggaccctggccgtgttcctactgctcatcatgggacaactgacatggaatgaccttattagattgtgcatcatggtcggcgcaaacgcttccgataggatggggatgggaactacctatctggccttaatggcaacgtttaagatgcgccctatgttcgccgtgggcctcctgtttcggagacttacatctagggaggttctgctactcaccattggtctgagcttggtggcttcagtcgaactgccaaacagtttagaggaactcggggacggactggcgatgggcataatgatgcttaaactgttgactgagttccagccccaccagctctggaccacactgctatccctgacttttatcaagaccacgctttctctcgattacgcctggaaaacaaccgcaatggctctgagcattgtgtccttgttcccgctgtgtttatcaactacaagccagaagaccacttggctccctgttctgcttggcagttttgggtgcaaaccactgacaatgttcttgatcaccgaaaataagatttggggacgaaagtcttggcccctcaacgagggtatcatggccataggcatcgtgtccattctgctaagctcgctgcttaaaaatgacgtccctctcgccgggcccctgatcgctggaggcatgttgattgcatgttatgtaatctcaggttctagtgccgatttatccctggagaaggcggctgaagtgagctgggagcaagaagccgagcattctgggacgagccacaacatactcgttgaagtgcaggacgatggaactatgaaaattaaggacgaggagcgcgatgacaccctgacaatccttctgaaagcaaccttgctagccgtctccggcgtgtacccaatgtcaatccctgctacactgtttgtatggtatttctggcagaagaaaaagcagcggagtggcgtgctctgggatactcccagcccaccggaagtcgagagagcagttctggacgatgggatttacaggatacttcaacgtggattactgggtcgctctcaggtgggcgtgggggtcttccaggacggagtgtttcataccatgtggcacgttacgcggggcgccgtactcatgtatcagggtaagagattggaaccttcctgggcgtcagtgaaaaaggacctgatcagttacgggggaggctggaggttccaaggcagctggaatacaggggaggaggtccaggtgattgctgttgaacccggcaagaacccaaagaatgtgcagactacccccggtacatttaaaacccctgagggcgaagtcggggccatcgcactcgatttcaagccaggaacttccggctctcccattgtgaaccgagagggtaagatcgtagggctgtacggaaatggcgtcgtgaccacatcgggcacgtatgttagcgccatagctcaagccaaagcatcacaggaagggcctcttccggagatcgaggacgaagtgtttaagaaacggaacctgactattatggatttgcacccaggatccggtaagacccgcagatacctacccgctatcgtcagggaggccattaaacggaagctgcgaacactcatcttagcgcctaccagagtggttgccagtgaaatggcagaggctctgaagggcatgccaatacgctatcagactacagccgtgaaatctgaacataccgggagggagattgtcgaccttatgtgccacgctacgttcactatgcgtctgctcagccccgtgcgggtacctaattacaacatgatcatcatggatgaggcacattttacagacccggcctccattgccgctagaggatatatctcaaccagggtgggcatgggtgaagcggcagccatattcatgaccgctactcccccagggtctgttgaggcctttcctcagagcaatgcagtcattcaagatgaagaacgcgacatccccgaacgaagttggaactccggatacgattggattacagacttcccaggcaagaccgtgtggtttgtgcctagcatcaaatctggcaatgatatagccaactgtttgagaaagaacgggaaacgggtcattcagctgtcaaggaagacattcgacactgagtatcagaagacgaaaaataacgactgggattacgtagtgaccacagacatctccgagatgggagctaatttccgcgcggatcgtgttatcgaccccagacggtgcctcaagccagtgattctgaaagatggtccggaaagggtcatccttgccggccctatgcccgtgactgttgcaagtgctgcccagcgccgagggagaattggacggaaccaaaataaggagggcgaccagtacgtgtatatgggtcagccactaaacaatgatgaagaccacgcacattggaccgaggccaaaatgctgttggataacataaatacacccgaggggatcattcctgctttatttgaaccagagagggaaaagagcgccgcgatcgacggcgagtaccgcctgagaggagaagcaaggaagaccttcgtcgagctcatgcggcgtggcgatctgcccgtgtggctttcgtataaagtagcctctgaggggtttcagtactccgaccgccgatggtgcttcgatggagaaagaaacaatcaagtgctggaggaaaacatggacgttgagatctggactaaggaaggtgagaggaaaaagctccggcctcgctggttggacgctagaacgtatagcgatccgctggccctaagggagtttaaagagttcgctgcaggccggcgatcagtcagtggggacctgattctcgagataggaaaacttccacagcacctgaccttaagagcccagaatgctttggataacctggtgatgctccacaattctgaacagggcggtaaagcctaccgccatgcaatggaggaactgcccgacacaatcgagactcttatgctgctcgcgttgattgccgtgctgaccgggggcgtcacattatttttcctatccggaaagggcctggggaagaccagcatcggactcctttgtgttactgcttcaagtgccctgttgtggatggcaagcgtggagcctcactggattgctgcctccatcatactggaatttttcctcatggtactgcttatccccgagccagataggcaacggacacctcaggacaaccagctcgcatatgtggtcattggtctgttgtttatgatcctgacggtggccgctaacgaaatgggcttactagagaccactaaaaaggatctggggattggacatgttgcggccgagaatcaccaacacgcaacaatgctcgacgtggatcttcgtcccgcttctgcctggaccctgtacgccgtcgcaaccacagtaatcactccaatgatgagacatacgatagaaaacaccacagctaatattagcttgactgccatcgcgaaccaggctgccattctgatgggcctcgacaaaggttggcctatctccaagatggatataggggtgccgctgcttgcattaggctgctactcacaggttaatcccctgaccctcacagccgctgtgttgatgctggtcgcacactatgccatcattggaccaggcctacaggcgaaagctaccagggaggcccaaaagcgcactgcagccgggatcatgaagaaccctacggtggacggaattgtcgctatcgatctggaccccgtggtttacgacgccaaattcgaaaagcagctcggccagataatgcttctgattttgtgtacatctcagatcctgctcatgcggaccacttgggcactgtgcgagagtatcaccttagctacaggtccacttactaccctgtgggaagggtcgcctggaaaattttggaatacaacgattgccgtgagcatggcgaacatcttccgaggctcctatctcgccggtgcaggcctagctttctctctgatgaagtcactagggggaggcagaagggggaccggagcccaaggcgagactctgggtgagaaatggaagcgccagctcaatcagcttagcaagtccgaatttaacacatacaaacggagtgggataatggaggtagatagatctgaagcaaaggagggactgaaacgtggcgaaaccactaagcatgctgtgagcaggggtacagccaaattgcggtggttcgtcgagcgcaatctggttaagcccgagggcaaggtgattgacctcgggtgtggacgaggcgggtggtcatattactgcgccggactgaaaaaggtcaccgaagtgaaaggctatacgaagggtgggccgggacacgaggaaccaatccctatggcgacctacggctggaacctagtaaaacttcattccggcaaggatgtgtttttcatgcccccagagaaatgtgacacactgctatgcgatattggggaaagtagccccaatcctactatcgaggagggaagaaccctcagggttctgaagatggtggaaccgtggttgcggggtaaccagttttgtataaagatcctgaatccctacatgccatctgtcgtggagacactcgaacaaatgcagcgcaaacacggcgggatgcttgtcagaaaccctctgtccagaaattcaactcacgagatgtattgggtgagctgcggaaccggcaacattgtttcggctgtaaacatgacatctcgaatgttactgaatcggttcaccatggcacatcgtaagcccacttttgagagagacgtggatttgggtgccgggacgcgccacgtcgctgtggaacctgaggttgccaacctcgacatcattggacagaggatcgaaaatattaaaaacgagcataagagtacatggcactacgatgaagacaatccatataaaacctgggcataccacggctcctatgaggtgaagcccagcggctcagcctcctctatggtcaacggggtggtacggctgctaactaagccttgggatgtgatcccaatggttacccaaatagctatgacagacacgacccccttcggacagcagagagtctttaaagagaaggtggacactcgcacaccgagggcgaaacgaggtaccactcagattatggaagtgacagccaagtggctttggggcttcctgagccggaataaaaagcctagaatctgtaccagggaggaatttacacgcaaggtccgtagtaacgcagctatcggggccgttttcgtggatgagaatcaatggaactccgcaaaagaagccgtagaggacgagcggttttgggatctcgtgcatagagaaagggagctgcacaagcagggaaaatgcgctacttgcgtctacaatatgatgggcaagcgcgagaaaaagttgggtgagttcgggaaggccaaaggaagccgagcgatttggtatatgtggctgggcgcacggttcctcgaatttgaggcccttggcttcatgaacgaggaccattggttttctagagaaaattcactgagtggggtggagggagaaggtttacacaagctgggctacatattgagggatatctccaaaattccagggggaaacatgtacgctgacgataccgccggctgggacacgcgcatcaccgaggatgacctccagaatgaggcaaagattacagatatcatggaacccgagcatgctctgctagccactagcatattcaaacttacctatcagaacaaggttgtgagagtccaacggcctgctaaaaacggtacagtgatggacgtaatctctaggcgtgatcagcgagggtcgggacaggttggcacttacggcctgaatacctttacgaacatggaagtgcagctcattcgccaaatggagtcagaagggatcttcctgccaagcgagttggagacacccaatttagccgaaagagtcctggactggctcgagaagcacggagcagaacggcttaagaggatggcgatttccggtgacgattgtgtggtgaaaccgatcgacgatcgctttgccaccgctctgactgccctaaacgacatgggcaaggtcagaaaagatatacctcagtgggagcccagtaaggggtggaatgactggcagcaggttccattctgctctcaccattttcaccaactgattatgaaagatggacgggaaatcgtggtaccttgtaggaaccaggacgagctcgtgggccgagcacgtgtcagccagggtgctgggtggtccttgagagagacagcctgcctgggaaagtcatatgcacaaatgtggcagcttatgtacttccatcgccgggatctgaggctcgccgcgaatgctatctgtagtgccgtgcccgttgactgggtgccaacctctagaactacctggagcattcacgcacaccatcagtggatgacaacggaagatatgttatccgtctggaaccgcgtgtggatagaggaaaatccctggatggaggacaagacccacgtatcaagctgggaagaggttccttatctgggcaaacgggaggaccagtggtgcggctctttgatcgggctgactgccagggctacatgggccaccaacattcaagtggcaatcaatcaggtccgaagactcattggaaacgaaaattaccttgattatatgacttccatgaagcggtttaaaaacgagagtgacccagaaggtgtgctgtggtga

SEQ ID NO: 13328 - RNA, 9870 nt, synthetic construct
  misc_feature 1..9870: note = derived and/or modified CDS sequence (opt3) from DENV-1__GU131962__SS-prME
  source 1..9870: mol_type = other RNA
agcgtgaccatgctgctcatgcttctgcccactgccttggctttccacttaactacgagaggaggggaacctcatatgatcgtctccaagcaggaaaggggaaaatctctgttgtttaagacctcagctggtgttaacatgtgcacactcattgccatggacctgggcgaactttgtgaagatactatgacctacaaatgcccacagattacagaggcggaaccggacgatgtggactgttggtgcaatgctaccgatacttgggtaacatatgggacctgtagtcagacgggagagcaccggcgcgacaagcgaagcgtggccctggcaccccatgtcggcttgggtctcgagactcgtaccgaaacatggatgtcctctgagggggcctggaaacagatccagagagtggaaacttgggctctgaggcaccctggattcaccgttattgcactgtttctcgcccatgctatcggcacatcgattacccaaaagggcatcatattcatcttactgatgcttgtgacgccatcaatggccatgcggtgcgtcgggattggaaaccgcgattttgtggagggtttgagcggcgcgacttgggttgacgttgtgctggagcacgggagttgtgtcacaaccatggcaaagaataaacccactctagatatcgaactcctgaagacagaggtgaccaaccctgccattcttagaaaactgtgcatcgaagctaagatatccaatacgaccacagactctaggtgtccaactcagggagaggccaccttggtggaagaacaggatgcaaacttcgtctgccggcgcacatttgttgaccgaggctggggtaatgggtgtggactcttcggcaaaggcagcctgttaacttgcgctaagtttaagtgcgtgaccaaactggaggggaagattgtacagtacgaaaacctcaaatattccgtgatcgtcacagtgcacaccggagatcaacatcaggttggtaatgagactacggaacacggcacaattgccaccatcactccccaggcgcctacctcagagatccagcttacagactacggggccctgaccttggactgtagtccaagaactggactagatttcaacgaaatggtgctgctcacaatgaaggagaaaagctggctggtccataagcaatggtttcttgacctgccgttgccctggacgtctggcgcatccacctcacaggagacttggaataggcaggatctcctggtgacattcaaaaccgctcacgccaagaagcaagaagtagttgtgttaggtagccaggagggggctatgcacacagccctgactggcgcaaccgaaattcagacgagtggaaccacaactatatttgccggccatctaaaatgccggctcaagatggacaaactgacccttaaggggacatcttatgtcatgtgtactggatccttcaaattggagaaggaagtggctgagacccagcacggtacggtcctggtgcaagttaagtacgagggcacagatgcgccttgcaaaatcccattcagcacccaggacgaaaagggggtgactcagaacggacgtctcattacagcaaatcccatcgtaaccgataaagagaagcctgtcaacatagaaactgagccaccctttggcgagtcgtatattgtggttggtgccggggaaaaagctctgaaactttcttggttcaagaaaggctcctcaatcggaaagatgtttgaggccaccgcacgcggcgccagaaggatggctatcctgggggacacagcctgggatttcggaagtattggtggcgtgtttacgagcgtcgggaaattggtgcatcaggtattcggaaccgcatacggcgtgctcttttccggtgtttcttggactatgaagatcgggattggcatactgttaacatggctgggactaaatagccggtcaaccagtctctccatgacatgtatcgcggtcggcatggtgactctgtaccttggggtgatggtccaagctgacagcggatgcgttattaactggaaaggccgagaattgaagtgtggttctgggatcttcgtgaccaacgaggtgcacacgtggacagaacagtataagtttcaggccgattcaccgaaacgcctgagtgcagccatcggaaaggcttgggaggagggcgtatgcggtattagaagcgccaccaggctcgaaaatataatgtggaaacagatctccaacgagctgaatcatattttactggaaaacgacatgaagttcactgtcgtggttggcgacgcaaatgggatccttgctcaaggcaagaagatgattcggcctcagcccatggagcacaaatactcttggaagtcgtggggcaaggccaaaatcataggggcggatatccagaacaccacatttattatcgacggaccagatactcctgaatgtcccgacaatcagcgcgcctggaacatttgggaggtggaggattatggcttcggtatctttaccacaaatatatggttgaagctcagagacagctacacgcaaatgtgcgatcacaggctgatgtccgctgcaattaaagactcaaaggccgtccatgctgatatggggtattggatcgaaagtgagaaaaacgaaacctggaagctagcccgtgcatctttcattgaggtgaagacttgtacatggccaaaaagccacaccctgtggtccaatggagttctcgaatcagagatgatcatacccaagatctacggcggtcctattagccagcataactatcggccaggctacttcactcagacagcggggccgtggcacctgggaaaacttgagttggactttgatctgtgcgaaggcaccacggtggtagtcgacgagcactgcgggaatcgaggaccctctttaagaactaccacagtgaccggcaagatcattcatgaatggtgttgcaggtcctgtactctccctccactgcgcttccggggtgaggatgggtgctggtacggaatggagatcagacccgtgaaagaaaaggaggaaaaccttgtcaggagtatggttagcgccggctctggtgaggtggactccttttcactgggcatattgtgtgtaagtattatgatcgaagaggtgatgcgcagccgatggtcgcggaagatgctcatgacagggaccctggctgtcttcctactgctcgtgatgggacaactgacatggaatgaccttatccgtttgtgcattatggttggcgccaacgcatccgatagaatggggatgggaactacctatctggctttaatggccacgtttaaaatgaggcctatgttcgcagtgggcctcctgtttcgccggcttacatctagagaggtcctgctactcaccatcggtctgagcttggtggcctcagttgaactgccaaacagtttagaggaactcggggacggactggctatgggcattatgatgcttaagctgttgactgagttccagccccaccagctctggaccacactgctatccctgacttttataaaaaccacgctttctctcgattacgcgtggaagacaaccgccatggcactgagcatcgtgtccttgttcccgctgtgtttatcaactacaagccagaaaaccacttggctccctgtcctgcttggcagttttgggtgcaagccactgacaatgttcttgattaccgaaaataagatctggggaaggaaatcttggcccctcaacgagggtattatggctatcggcatagtatccatcctgctaagctcgctgcttaagaatgacgtgcctctcgccgggcccctgattgccggaggcatgttgatcgcttgttatgttatttcaggttctagtgcagatttatccctggagaaagccgcggaagtgagctgggagcaagaagctgagcattctgggacgagccacaacatcctcgtcgaagtgcaggacgatggaactatgaagataaaagacgaggagcgagatgacaccctgacaattcttctgaaggccaccttgctagcagtatccggcgtgtacccaatgtcaatccctgccacactgtttgtctggtatttctggcagaaaaagaagcagcgcagtggcgttctctgggatactcccagcccaccggaagtggagcgggctgtgctggacgatgggatctaccgaatacttcaaaggggattactgggtcgttctcaggtcggcgtgggggttttccaggacggagtatttcataccatgtggcacgtgacgcgcggcgcagtcctcatgtatcagggtaaacggttggaaccttcctgggcctcagtgaagaaagacctgataagttacgggggaggctggagattccaaggcagctggaatacaggggaggaggttcaggtgatcgcggtcgaacccggaaagaaccccaaaaatgtgcagactacccccggtacatttaagacccctgagggcgaagtaggggctattgccctcgatttcaagccaggaacttccggctctcccatcgtcaacagggagggtaaaattgtggggctgtacggaaatggcgttgtgaccacatcgggcacgtatgtcagcgcaatcgcccaagctaaggcctcacaggaagggcctcttccggagatagaggacgaagtgtttaaaaagcgaaacctgactatcatggatttgcacccaggatccggtaaaacccggcgctacctacccgcaattgttagagaggctatcaagaggaagctgcggacactcattttagcccctacccgagtggtcgcgagtgaaatggccgaggcactgaaaggcatgccaatcagatatcagactacagctgtgaagtctgaacataccgggcgcgagatagtagaccttatgtgccacgccacgttcactatgaggctgctcagccccgtgcgtgttcctaattacaacatgattatcatggatgaggctcattttacagacccggcatccatcgccgcccggggatatatttcaaccagagtcggcatgggtgaagctgcggcaatcttcatgaccgccactcccccagggtctgtggaggcttttcctcagagcaatgccgtgatacaagatgaagagagggacattcccgaacgcagttggaactccggatacgattggatcacagacttcccaggcaaaaccgtctggtttgtacctagcattaagtctggcaatgatatcgcaaactgtttgcggaaaaacgggaagagagtgatacagctgtcaagaaagacattcgacactgagtatcagaaaacgaagaataacgactgggattacgttgtgaccacagacatttccgagatgggagccaatttcagggctgatcgcgtcatcgacccccgtagatgcctcaaaccagtgatcctgaaggatggtccggaacgggttattcttgcgggccctatgcccgtgactgtcgccagtgcagctcagaggcgcgggcgaatcggaagaaaccaaaataaagagggcgaccagtacgtgtatatgggtcagccactaaacaatgatgaagaccacgcccattggaccgaggcaaagatgctgttggataacattaatacacccgaggggataatccctgccttatttgaaccagagcgggaaaagagcgctgccattgacggcgagtacaggctgcgcggagaagcgagaaaaaccttcgtagagctcatgaggcggggcgatctgcccgtgtggctttcgtataaggttgcatctgaggggtttcagtactccgaccgtcgctggtgcttcgatggagaacgaaacaatcaagtcctggaggaaaacatggacgtggagatctggactaaagaaggtgagagaaagaaactcaggcctcggtggttggacgcccgcacgtatagcgatccgctggctctaagagagtttaaggagttcgccgctggcaggcggtcagtgagtggggacctgatcctcgagattggaaaacttccacagcacctgaccttacgagcacagaatgccttggataacctggtcatgctccacaattctgaacagggcggtaaggcttacagacatgccatggaggaactgcccgacacaatagagactcttatgctgctcgcattgatcgcggttctgaccgggggcgtgacattatttttcctatccggaaagggcctggggaaaaccagcattggactcctttgtgtaactgcctcaagtgctctgttgtggatggccagcgtggagcctcactggatcgcagcttccattatcctggaatttttcctcatggtcctgcttatacccgagccagatcgccaaaggacacctcaggacaaccagctcgcctatgtggttatcggtctgttgtttatgattctgacggtggcagccaacgaaatgggcttactagagaccactaagaaagatctggggatcggacatgtcgctgcggagaatcaccaacacgccacaatgctcgacgtagatcttcggcccgcatctgcttggaccctgtacgccgtggccaccacagttattactccaatgatgcgtcatacgatcgaaaacaccacagcaaatattagcttgactgctattgccaaccaggcggctatcctgatgggcctcgacaagggttggcctatttccaaaatggatatcggggtgccgctgcttgccttaggctgctactcacaggtcaatcccctgaccctcacagcagccgtgttgatgctggtcgctcactatgcaataatcggaccaggcctacaggccaaggcgaccagagaggctcaaaagaggactgccgcagggattatgaaaaaccctacggtggacggaatcgttgccattgatctggaccccgtggtatacgacgctaagttcgaaaaacagctcggccagatcatgcttctgatattgtgtacatctcagattctgctcatgcgcaccacttgggccctgtgcgagagtatcaccttagcaacaggtccacttactaccctgtgggaagggtcgcctggaaagttttggaatacaacgatcgctgtgagcatggccaacattttccggggctcctatctcgcgggtgccggcctagcattctctctgatgaaatcactagggggaggccgaagagggaccggagctcaaggcgagactctgggtgagaagtggaagaggcagctcaatcagcttagcaaatccgaatttaacacatacaagcgcagtgggatcatggaggtcgatcggtctgaagccaaagagggactgaagagaggcgaaaccactaaacatgcagttagccgtggtacagctaagttgaggtggttcgtggagcggaatctggtcaagcccgagggcaaagtgatagacctcgggtgtggacgcggcgggtggtcatattactgcgccggattaaagaaagtaaccgaatatgcctccgcgggcctggctattatcgtgccgcttccactggatacgtacggtcgaaacagactaaagattcacagtgggaaagacgtatttttcatgcctcccgagaagggagataccctcctgtgtgacatcggcgaaagctctccaaatcccacaatagaggaaggcaggactttgcgggtgctgaaaatggtcgagccttggctccgcgggaaccagttttgcatcaagattcttaatccgtacatgccctccgtggtcgaggcactggaacaaatgcagagaaagcatggaggtatgttagtgaggaacccactgtcacgaaatagcacccacgagatgtattgggtttcgtgtggcacagggaacatcgtatctgccgtgaacatgacaagtcggatgttgctcaatcgtttcaccatggctcacagaaaacctacatacgaacgcgatgtcgacctgggagccggcaccaggcatgtggcagttgagcccgaggtggccaacctagatattatcggtcagcggattgaaaatatcaagaacgagcacaaatccacttggcattatgacgaagataatccttacaagacgtgggcttatcacgggagctacgaggtcaaaccatcaggatccgcgtctagcatggtgaacggcgtagtgagacttctgacaaagccctgggacgttatacctatggtcacccaaattgccatgactgacaccacaccatttggccagcagcgcgtgttcaaggaaaaagtggatacgaggaccccacgagcaaagcgggggactacacagatcatggaggtcaccgctaaatggctctggggatttctgagtagaaataagaaaccgaggatctgcactcgcgaggagttcacacgtaaggttcggtccaacgccgcaattggtgccgtgtttgtagacgagaatcaatggaacagcgctaaggaagccgtggaggatgaaagattctgggacttggtccacagggagcgcgagctgcataaacagggcaagtgtgcgacctgcgtgtataatatgatggggaaacgagaaaagaaactcggagagtttggcaaggcaaagggttctcgggccatatggtacatgtggcttggggctagattcctggagttcgaggccttaggatttatgaacgaagatcactggttctcaagggagaatagtctgtccggcgttgagggcgaagggttgcataaactcggatacatcctgcgcgacattagcaagatccctggtggcaacatgtatgcagatgacacagctgggtgggatactagaattaccgaggacgatctacagaatgaagccaaaatcacggagataatggagccagaacacgcacttctggccacctctatctttaagctcacataccagaacaaagtggtccgggtgcaaaggcccgcaaagaacggaactgtaatggacgttatttcgcgtcgagatcagcgcggctcaggtcaggtggggacctatggactgaatacattcactaacatggaggtccagttgatcagacaaatggaaagcgagggcatatttttaccttccgaactggagaccccaaatctcgcggagcgggtgcttgactggctggaaaaacatggcgccgagaggctaaagcgcatggctatcagtggggacgattgcgtggtcaagcccatagacgatagattcgccacggcactgacagctctcaacgacatgggaaaagttcggaaggatattccgcagtgggaaccttctaaaggttggaatgactggcaacaggtgcccttttgtagccaccacttccatcaattgatcatgaaggatggcagggagatcgtagtgccatgccgaaaccaggacgaactggtcgggcgtgccagagtgtcccagggagcaggctggtcacttcgcgagaccgcctgtctgggtaaaagttacgcgcaaatgtggcagctcatgtattttcaccggagggatttaagactggctgccaatgcaatttgctctgccgttcctgtggactgggtccccactagccgcacaacctggtccatacatgctcaccaccagtggatgactaccgaggatatgttgtcagtgtggaaccgggtatggatcgaagagaatccatggatggaagacaagacacatgttagctcttgggaggaagtgccctacctggggaagagggaggaccagtggtgtggatccctcattggccttacggcccgagcaacctgggctactaacatccaagtcgccattaatcaggtgagacggctgatcggcaacgagaattatctagattacatgacaagtatgaaaaggttcaagaacgaaagcgaccctgagggggcgctgtggtga

SEQ ID NO: 13329 - RNA, 9879 nt, synthetic construct
  misc_feature 1..9879: note = derived and/or modified CDS sequence (opt3) from DENV-1__GU131963__SS-prME
  source 1..9879: mol_type = other RNA
agcgtgaccatgctgctcatgcttctgccaacggccttggctttccacttaactacgagaggaggggaacctcatatgatcgtctccaagcaggaaaggggaaaatctctgctgtttaagacctcagctggtgttaacatgtgcacactcattgccatggacctgggcgagctttgtgaagatactatgacctacaaatgcccacaaataacagaggcggaaccggacgatgtggactgttggtgcaatgctaccgatacttgggtaacatatgggacctgtagtcagacgggagagcaccggcgcgacaagcgaagcgtggccctggcaccccatgtcggcttgggtctcgagactcgtaccgaaacatggatgtcctctgagggggcctggaaacagatccagagagtggaaacttgggctctgaggcaccctggattcaccgttattgcatttttcctggcccatgctatcggcacatcgattacccaaaagggcatcatatttatcctcttaatgctggtgacgccatcaatggccatgcggtgcgtcgggattggaaaccgcgatttcgtggagggtcttagcggcgcgacttgggtagacgttgtgttggagcacgggagttgtgtcacaaccatggcaaagaataaacccactctggatatcgaactactcaagacagaggtgaccaaccctgccattctgagaaaactttgcatcgaagctaagatatccaatacgaccacagactctaggtgtccaactcagggagaggccaccctggtggaagaacaggatgcaaactttgtctgccggcgcacattcgttgaccgaggctggggtaatgggtgtggattgtttggcaaaggcagcctcctgacttgcgctaagttcaagtgcgtgaccaaattagaggggaagattgtacagtacgaaaacctgaaatattccgtgatcgtcacagtgcacaccggagatcaacatcaggttggtaatgagactacggaacacggcacaattgccaccatcactccccaggcgcctacctcagagatccagctcacagactacggggcccttaccctggactgtagtccaagaactggattggattttaacgaaatggtgctactgacaatgaaggagaaaagctggctcgtccataagcaatggttcctggaccttccgctgccctggacgtctggcgcatccacctcacaggagacttggaataggcaggatttgctcgtgacatttaaaaccgctcacgccaagaagcaagaagtagttgtgctgggtagccaggagggggctatgcacacagccttaactggcgcaaccgaaattcagacgagtggaaccacaactatattcgccggccatctgaaatgccggctaaagatggacaaactcaccctgaaggggacatcttatgtcatgtgtactggatccttcaaacttgagaaggaagtggctgagacccagcacggtacggtcttggtgcaagttaagtacgagggcacagatgcgccttgcaaaatcccatttagcacccaggacgaaaagggggtgactcagaacggacgtctgattacagcaaatcccatcgtaaccgataaagagaagcctgtcaacatagaaactgagccacccttcggcgagtcgtatattgtggttggtgccggggaaaaagctctcaagctgtcttggtttaagaaaggctcctcaatcggaaagatgttcgaggccaccgcacgcggcgccagaaggatggctatccttggggacacagcctgggattttggaagtattggtggcgtgttcacgagcgtcgggaaactggtgcatcaggtatttggaaccgcatacggcgtgttgttctccggtgtttcttggactatgaagatcgggattggcatactcctgacatggttaggactgaatagccggtcaaccagtctatccatgacatgtatcgcggtcggcatggtgactctctacctgggggtgatggtccaagctgacagcggatgcgttattaactggaaaggccgagaacttaagtgtggttctgggatctttgtgaccaacgaggtgcacacgtggacagaacagtataagttccaggccgattcaccgaaacgcttgagtgcagccatcggaaaggcttgggaggagggcgtatgcggtattagaagcgccaccaggctggaaaatataatgtggaaacagatctccaacgagctcaatcatattctgttagaaaacgacatgaagtttactgtcgtggttggcgacgcaaatgggatcctggctcaaggcaagaagatgattcggcctcagcccatggagcacaaatactcttggaagtcgtggggcaaggccaaaatcataggggcggatatccagaacaccacattcattatcgacggaccagatactcctgaatgtcccgacaatcagcgcgcctggaacatttgggaggtggaggattatggctttggtatcttcaccacaaatatatggcttaagttgagagacagctacacgcaaatgtgcgatcacaggctcatgtccgctgcaattaaagactcaaaggccgtccatgctgatatggggtattggatcgaaagtgagaaaaacgaaacctggaagctggcccgtgcatctttcattgaggtgaagacttgtacatggccaaaaagccacaccctatggtccaatggagttctggaatcagagatgatcatacccaagatctacggcggtcctattagccagcataactatcggccaggctactttactcagacagcggggccgtggcacctcggaaaactggagcttgacttcgatttgtgcgaaggcaccacggtggtagtcgacgagcactgcgggaatcgaggaccctctctgagaactaccacagtgaccggcaagatcattcatgaatggtgttgcaggtcctgtactttacctccactccgctttcggggtgaggatgggtgctggtacggaatggagatcagacccgtgaaagaaaaggaggaaaacctggtcaggagtatggttagcgccggctctggtgaggtggactccttctcacttggcatactgtgtgtaagtattatgatcgaagaggtgatgcgcagccgatggtcgcggaagatgttgatgacagggaccctcgctgtctttctgctactggtgatgggacaactcacatggaatgacctgatccgtctttgcattatggttggcgccaacgcatccgatagaatggggatgggaactacctatttggctctgatggccacgttcaaaatgaggcctatgtttgcagtgggcttactcttccgccggctgacatctagagaggtccttctgctaaccatcggtctcagcctggtggcctcagttgaattgccaaacagtctggaggaattaggggacggactcgctatgggcattatgatgctgaaacttctgactgagtttcagccccaccagttgtggaccacactcctgtccctaactttcataaaaaccacgctgtctcttgattacgcgtggaagacaaccgccatggcactcagcatcgtgtccctgtttccgttgtgtctgtcaactacaagccagaaaaccacttggttacctgtcctcctgggcagtttcgggtgcaagccacttacaatgtttctgattaccgaaaataagatctggggaaggaaatcttggcccttgaacgagggtattatggctatcggcatagtatccatcctcctgagctcgctactgaagaatgacgtgcctcttgccgggcccctcattgccggaggcatgctgatcgcttgttatgttatttcaggttctagtgcagatttgtccttagagaaagccgcggaagtgagctgggagcaagaagctgagcattctgggacgagccacaacatcctggtcgaagtgcaggacgatggaactatgaagataaaagacgaggagcgagatgacaccctcacaattctgcttaaggccaccctgttggcagtatccggcgtgtacccaatgtcaatccctgccacactattcgtctggtatttctggcagaaaaagaagcagcgcagtggcgttctgtgggatactcccagcccaccggaagtggagcgggctgtgctcgacgatgggatctacaggattctgcaacgaggacttttaggtcgttctcaggtcggcgtgggggtttttcaggacggagtattccataccatgtggcacgtgacgcgcggcgcagtcctgatgtatcagggtaaacggctcgaaccttcctgggcctcagtgaagaaagacttgataagttacgggggaggctggagatttcaaggcagctggaatacaggggaggaggttcaggtgatcgcggtcgaacccggaaagaaccccaaaaatgtgcagactacccccggtacattcaagacccctgagggcgaagtaggggctattgccctggattttaagccaggaacttccggctctcccatcgtcaacagggagggtaaaattgtggggctctacggaaatggcgttgtgaccacatcgggcacgtatgtcagcgcaatcgcccaagctaaggcctcacaggaagggcctctgccggagatagaggacgaagtgttcaaaaagcgaaaccttactatcatggatctgcacccaggatccggtaaaacccggcgctacttgcccgcaattgttagagaggctatcaagaggaagctacggacactgattctcgcccctacccgagtggtcgcgagtgaaatggccgaggcattaaaaggcatgccaatcagatatcagactacagctgtgaagtctgaacataccgggcgcgagatagtagacctgatgtgccacgccacgtttactatgaggcttctgagccccgtgcgtgttcctaattacaacatgattatcatggatgaggctcatttcacagacccggcatccatcgccgcccggggatatatttcaaccagagtcggcatgggtgaagctgcggcaatctttatgaccgccactcccccagggtctgtggaggctttccctcagagcaatgccgtgatacaagatgaagagagggacattcccgaacgcagttggaactccggatacgattggatcacagactttccaggcaaaaccgtctggttcgtacctagcattaagtctggcaatgatatcgcaaactgtctcagaaagaacgggaaaagagtgatacagttgtcacggaagacattcgacactgagtatcagaaaacgaagaataacgactgggattacgttgtgaccacagacatttccgagatgggagccaattttagggctgatcgcgtcatcgacccccgtagatgcctgaaaccagtgatcctcaaggatggtccggaacgggttattctggcgggccctatgcccgtgactgtcgccagtgcagctcagaggcgcgggcgaatcggaagaaaccaaaataaagagggcgaccagtacgtgtatatgggtcagccacttaacaatgatgaagaccacgcccattggaccgaggcaaagatgctactggataacattaatacacccgaggggataatccctgccttgttcgaaccagagcgggaaaagagcgctgccattgacggcgagtacaggttacgcggagaagcgagaaaaacctttgtagagctgatgaggcggggcgatctccccgtgtggctgtcgtataaggttgcatctgaggggttccagtactccgaccgtcgctggtgctttgatggagaacgaaacaatcaagtccttgaggaaaacatggacgtggagatctggactaaagaaggtgagagaaagaaactgaggcctcggtggctcgacgcccgcacgtatagcgatccgttggctctgagagagttcaaggaatttgccgctggcaggcggtcagtgagtggggacctaatcctggagattggaaaactcccacagcaccttaccctgcgagcacagaatgccttagataacttggtcatgctgcacaattctgaacagggcggtaaggcttacagacatgccatggaggaactccccgacacaatagagactctgatgcttctggcactcatcgcggttttgaccgggggcgtgacactgttctttttatccggaaagggcctagggaaaaccagcattggactgctctgtgtaactgcctcaagtgcacttctgtggatggccagcgtggagcctcactggatcgcagcttccattatcttggagttctttctgatggtcctcctgatacccgagccagatcgccaaaggacacctcaggacaaccagcttgcctatgtggttatcggtctcctgttcatgattttgacggtggcagccaacgaaatgggcctgttagagaccactaagaaagatctagggatcggacatgtcgctgcggagaatcaccaacacgccacaatgctggacgtagatctccggcccgcatctgcttggaccctttacgccgtggccaccacagttattactccaatgatgcgtcatacgatcgaaaacaccacagcaaatataagcctgactgctattgccaaccaggcggctatcttgatgggcctggacaagggttggcctatttccaaaatggatatcggggtgccgctcctggcccttggctgctactcacaggtcaatcccttaaccctgacagcagccgtgctcatgttggtcgctcactatgcaataatcggaccaggcctgcaggccaaggcgaccagagaggctcaaaagaggactgccgcagggattatgaaaaaccctacggtggacggaatcgttgccattgatctagaccccgtggtatacgacgctaagtttgaaaaacagctgggccagatcatgctccttatactgtgtacatctcagattttgctgatgcgcaccacttgggccctctgcgagagtatcaccctggcaacaggtccattaactaccctttgggaagggtcgcctggaaagttctggaatacaacgatcgctgtgagcatggccaacattttccggggctcctatctggcgggtgccggcctcgcattttctctaatgaaatcactagggggaggccgaagagggaccggagctcaaggcgagactttgggtgagaagtggaagaggcagctgaatcagctcagcaaatccgagttcaacacatacaagcgcagtgggatcatggaggtcgatcggtctgaagccaaagagggacttaagagaggcgaaaccactaaacatgcagttagccgtggtacagctaagctgaggtggtttgtggagcggaatttggtcaagcccgagggcaaagtgatagacctggggtgtggacgcggcgggtggtcatattactgcgccggactcaagaaagtaaccgaagtgaagggctatacgaaaggtgggccgggacacgaggaaccaattcctatggccacctacggctggaacttagttaagctgcattccggcaaagatgtgttctttatgcccccagagaagtgtgacacacttctgtgcgatatcggggaaagtagccccaatcctactattgaggagggacgaaccctaagagtcctcaagatggtggaaccgtggctgaggggtaaccagttctgtatcaaaatattgaatccctacatgccatctgtcgtggaggcgctggaacaaatgcagcggaagcacggcgggatgctcgttcgcaaccctctttccagaaattcaacacacgagatgtattgggtaagctgcggaactggcaacatcgtgtcggctgtcaacatgacctctaggatgctgttaaatcgatttacaatggcacatcggaaacccacctacgagcgtgacgtggatctgggtgccgggactagacacgttgctgtggaacctgaggtcgccaacttggacattatcggacagcgcattgaaaatatcaagaacgagcataaaagtacgtggcactatgatgaagacaatccatacaagacatgggcatatcacggctcctacgaggtgaagcccagcggctcagcctcctctatggtaaacggggtggttaggctcctgaccaaaccttgggatgtcattccaatggtgactcaaatcgctatgaccgacacaacgcccttcggacagcagcgggtgtttaaggagaaagtcgacaccagaactccgcgcgcgaagaggggtacaacccagataatggaagttactgccaaatggctatggggcttccttagccgaaataagaagcctcggatttgtacaagagaggaatttaccaggaaagtgcgcagtaacgcagctatcggggccgtattcgtggatgagaatcaatggaactccgcaaaggaagccgtcgaggacgagcgtttttgggatctggtgcatcgggaaagagagctccacaaacagggaaagtgcgctacatgcgtttataatatgatgggcaaaagggaaaagaagctgggtgagttcgggaaagccaagggaagccgcgcgatctggtacatgtggttgggcgcacgattcctggaatttgaggccctcggcttcatgaacgaggaccattggttttctcgggaaaattcacttagtggggtggagggagaaggtctgcacaaattaggctacattctgagagatatatccaagatcccagggggaaacatgtatgctgacgatactgccggctgggacaccaggattacggaggatgacttgcagaatgaggcaaaaatcaccgaaattatggagcccgaacatgctctcctggccacaagcatcttcaagctaacttaccagaacaaagtcgtgcgcgtacaaagacctgctaagaacggtaccgttatggatgtgatatctcggagggaccagcgtgggtcgggacaggtcggcacatatggccttaatacttttaccaacatggaggtgcagctgatccgacaaatggaatcagaggggattttcctcccaagcgagctggaaacgcccaatttggccgagcgcgtgttagattggctggaaaagcacggagcagagagactcaaacggatggcgatctccggtgacgactgtgtcgttaagccgattgatgacaggtttgccacagctcttaccgccctgaacgatatgggcaaagtgcgcaaggacatccctcagtgggaacccagtaaagggtggaatgattggcagcaggtaccattctgctctcaccattttcaccaactaataatgaaggacggaagagagattgtggtcccttgtcggaaccaggatgagctggtgggcagggcacgagttagccagggtgctgggtggtccctccgtgaaactgcctgcttgggaaagtcatacgcacaaatgtggcagctgatgtatttccatagacgcgaccttcggctggccgcgaatgctatctgtagtgccgtgcccgtcgattgggtgccaacatctaggaccacttggagcatccacgcacaccatcagtggatgaccacagaggacatgctctccgtatggaacagagtttggattgaagagaatccctggatggaagataaaacacaggtgtcaagctgggaggaggtcccttacttaggcaagcgcgaagaccaatggtgcggctctctgatagggttgaccgcccgggctacttgggccacaaacatccaggtggcaattaatcaggttaggcgactgatcggaaacgagaattatctcgactacatgacctccatgaaaagatttaagaacgaaagtgatccagagggtgctctttggtga

SEQ ID NO: 13330 - RNA, 9879 nt, synthetic construct
  misc_feature 1..9879: note = derived and/or modified CDS sequence (opt3) from DENV-1__KF955442__SS-prME
  source 1..9879: mol_type = other RNA
agcgtgaccatgctgctcatgcttctgcccacagccttggctttccacttaactacgagaggcggggagcctcatatgatcgtctccaagcaggaaaggggaaaatctctgctatttaagacctcagcaggtgttaacatgtgcacactcattgccatggacctgggcgagctttgtgaagatactatgacctacaaatgcccacaaataacagaggcggaaccggacgatgtggactgttggtgcaatgctaccgatacttgggtaacatatgggacctgtagtcagacgggagagcaccggcgcgacaagcgaagcgtggccctggcaccccatgtcggcttgggtctcgagactcgtaccgaaacatggatgtcctctgagggggcctggaaacagatccagagagtggaaacttgggctctgaggcaccctggattcaccgttattgcactgtttctcgcccatgctatcggcacatcgattacccaaaagggcatcatattcatcttactgatgcttgtgacgccatcaatggccatgcggtgcgtcgggattggaaaccgcgattttgtggagggtttgagcggcgcgacttgggtagacgttgtgctggagcacgggagttgtgtcacaaccatggcaaagaataaacccactctagatatcgaactcctgaagacagaggtgaccaaccctgccattcttagaaaactgtgcatcgaagctaagatatccaatacgaccacagactctaggtgtccaactcagggagaggccaccttggtggaagagcaggatgcaaacttcgtctgccggcgcacatttgttgaccgaggctggggtaatgggtgtggactcttcggcaaaggcagcctgttaacttgcgctaagtttaagtgcgtgaccaaactggaggggaagattgtacagtacgaaaacctcaaatattccgtgatcgtcacagtgcacaccggagatcaacatcaggttggtaatgagactacggaacacggcacaattgccaccatcactccccaggcgcctacctcagagatccagcttacagactacggggccctgaccttggactgtagtccaagaactggactagatttcaacgaaatggtgctgctcacaatgaaggagaaaagctggctggtccataagcaatggtttcttgacctgccgttgccctggacgtctggcgcatccacctcacaggagacttggaataggcaggatctcctggtgacattcaaaaccgctcacgccaagaagcaagaagtagttgtgttaggtagccaggagggggctatgcacacagccctgactggcgcaaccgaaattcagacgagtggaaccacaactatatttgccggccatctaaaatgccggctcaagatggacaaactgacccttaaggggacatcttatgtcatgtgtactggatccttcaaattggagaaggaagtggctgagacccagcacggtacggtcctggtgcaagttaagtacgagggcacagatgcgccttgcaaaatcccattcagcacccaggacgaaaagggggtgactcagaacggacgtctcattacagcaaatcccatcgtaaccgataaagagaagcctgtcaacatagaaactgagccaccctttggcgagtcgtatattgtggttggtgccggggaaaaagctctgaagctttcttggttcaagaaaggctcctcaatcggaaagatgtttgaggccaccgcacgcggcgccagaaggatggctatcctgggggacacagcctgggatttcggaagtattggtggcgtgtttacgagcgtcgggaaattggtgcatcaggtattcggaaccgcatacggcgtgctcttttccggtgtttcttggactatgaagatcgggattggcatactgttaacatggctgggactaaatagccggtcaaccagtctctccatgacatgtatcgcggtcggcatggtgactctgtaccttggggtgatggtccaagctgacagcggatgcgttattaactggaaaggccgagaattgaagtgtggttctgggatcttcgtgaccaacgaggtgcacacgtggacagaacagtataagtttcaggccgattcaccgaaacgcctgagtgcagccatcggaaaggcttgggaggagggcgtatgcggtattagaagcgccaccaggctcgaaaatataatgtggaaacagatctccaacgagctgaatcatattttactggaaaacgacatgaagttcactgtcgtggttggcgacgcaaatgggatccttgctcaaggaaaaaagatgattcggcctcagcccatggagcacaaatactcttggaagtcgtggggcaaggccaaaatcataggggcggatatccagaacaccacatttattatcgacggaccagatactcctgaatgtcccgacaatcagcgcgcctggaacatttgggaggtggaggattatggcttcggtatctttaccacaaatatatggttgaagctcagagacagctacacgcaaatgtgcgatcacaggctgatgtccgctgcaattaaagactcaaaggccgtccatgctgatatggggtattggatcgaaagtgagaaaaacgaaacctggaagctagcccgtgcatctttcattgaggtgaagacttgtacatggccaaaaagccacaccctgtggtccaatggagttctcgaatcagagatgatcatacccaagatctacggcggtcctattagccagcataactatcggccaggctacttcactcagacagcggggccgtggcacctgggaaaacttgagttggactttgatctgtgcgacggcaccacggtggtagtcgatgaacactgcgggaatcgaggaccctctttaagaactaccacagtgaccggcaagatcattcatgagtggtgttgcaggtcctgtactctccctccactgcgcttccggggtgaagacgggtgctggtacggaatggagatcagacccgtgaaagagaaggaagagaaccttgtcaggagtatggttagcgccggctctggtgaagtggactccttttcactgggcatattgtgtgctagtattatgatcgaggaagtaatgcgcagccgatggtcgcggaagatgctcatgacagggaccctggccgtgttcctactgctcatcatgggacaactgacatggaatgatcttattcgtttgtgcatcatggtcggcgcaaacgcttccgacagaatggggatgggaactacctatctggccttaatggcaacgtttaaaatgaggcctatgttcgccgtgggcctcctgtttcgccggcttacatctagagaggttctgctactcaccattggtctgagcttggtggcttcagtcgagctgccaaacagtttagaagagctcggggatggactggcgatgggcataatgatgcttaagctgttgactgaattccagccccaccagctctggaccacactgctatccctgacttttatcaaaaccacgctttctctcgactacgcctggaagacaaccgcaatggctctgagcattgtgtccttgttcccgctgtgtttatcaactacaagccagaaaaccacttggctccctgttctgcttggcagttttgggtgcaagccactgacaatgttcttgatcaccgagaataagatttggggaaggaaatcttggcccctcaacgaaggtatcatggccataggcatcgtgtccattctgctaagctcgctgcttaagaatgatgtccctctcgccgggcccctgatcgctggaggcatgttgattgcatgttatgtaatctcaggttctagtgccgacttatccctggagaaagcggctgaggtgagctgggaacaagaggccgaacattctgggacgagccacaacatactcgttgaggtgcaggatgacggaactatgaagattaaagatgaagagcgagacgataccctgacaatccttctgaaggcaaccttgctagccgtctccggcgtgtacccaatgtcaatccctgctacactgtttgtatggtatttctggcagaaaaagaagcagcgcagtggcgtgctctgggacactcccagcccaccggaggtcgaacgggcagttctggatgacgggatttacagaatacttcaaaggggattactgggtcgttctcaggtgggcgtgggggtcttccaggacggagtgtttcataccatgtggcacgttacgcgcggcgccgtactcatgtatcagggtaaacggttggagccttcctgggcgtcagtgaagaaagatctgatcagttacgggggaggctggagattccaaggcagctggaatacaggggaagaggtccaggtgattgctgttgagcccggaaagaacccaaaaaatgtgcagactacccccggtacatttaagacccctgaaggcgaggtcggggccatcgcactcgacttcaagccaggaacttccggctctcccattgtgaacagggaaggtaaaatcgtagggctgtacggaaatggcgtcgtgaccacatcgggcacgtatgttagcgccatagctcaagccaaggcatcacaggaggggcctcttccggaaatcgaggatgaggtgtttaaaaagcgaaacctgactattatggacttgcacccaggatccggtaaaacccggcgctacctacccgctatcgtcagagaagccattaagaggaagctgcggacactcatcttagcgcctacccgagtggttgccagtgagatggcagaagctctgaaaggcatgccaataagatatcagactacagccgtgaagtctgagcataccgggcgcgaaattgtcgatcttatgtgccacgctacgttcactatgaggctgctcagccccgtgcgtgtacctaattacaacatgatcatcatggacgaggcacattttacagatccggcctccattgccgctcggggatatatctcaaccagagtgggcatgggtgaggcggcagccatattcatgaccgctactcccccagggtctgttgaagcctttcctcagagcaatgcagtcattcaagacgaggaaagggatatccccgagcgcagttggaactccggatacgactggattacagatttcccaggcaaaaccgtgtggtttgtgcctagcatcaagtctggcaatgacatagccaactgtttgcgaaaaaacgggaagagagtcattcagctgtcacggaagacattcgacactgaatatcagaaaacgaagaataacgattgggactacgtagtgaccacagatatctccgagatgggagctaatttcagggcggaccgcgttatcgatccccgtagatgcctcaaaccagtgattctgaaggacggtccggagcgggtcatccttgccggccctatgcccgtgactgttgcaagtgctgcccagaggcgcgggcgaattggaagaaaccaaaataaagaaggcgatcagtacgtgtatatgggtcagccactaaacaatgacgaggatcacgcacattggaccgaagccaagatgctgttggacaacataaatacacccgaggggatcattcctgctttatttgagccagaacgggagaagagcgccgcgatcgatggcgaatacaggctgcgcggagaggcaagaaaaaccttcgtcgaactcatgaggcggggcgacctgcccgtgtggctttcgtataaggtagcctctgaggggtttcagtactccgatcgtcgctggtgcttcgacggagagcgaaacaatcaagtgctggaagagaacatggacgttgaaatctggactaaagagggtgaaagaaagaaactcaggcctcggtggttggatgctcgcacgtatagcgacccgctggccctaagagagtttaaggagttcgctgcaggcaggcggtcagtcagtggggatctgattctcgaaataggaaaacttccacagcacctgaccttacgagcccagaatgctttggacaacctggtgatgctccacaattctgagcagggcggtaaggcctacagacatgcaatggaagagctgcccgatacaatcgaaactcttatgctgctcgcgttgattgccgtgctgaccgggggcgtcacattatttttcctatccggaaagggcctggggaaaaccagcatcggactcctttgtgttactgcttcaagtgccctgttgtggatggcaagcgtggagcctcactggattgctgcctccatcatactggagtttttcctcatggtactgcttatccccgaaccagaccgccaaaggacacctcaggataaccagctcgcatatgtggtcattggtctgttgtttatgatcctgacggtggccgctaacgagatgggcttactagaaaccactaagaaagacctggggattggacatgttgcggccgagaatcaccaacacgcaacaatgctcgatgtggaccttcggcccgcttctgcctggaccctgtacgccgtcgcaaccacagtaatcactccaatgatgcgtcatacgatagagaacaccacagctaatattagcttgactgccatcgcgaaccaggctgccattctgatgggcctcgataagggttggcctatctccaaaatggacataggggtgccgctgcttgcattaggctgctactcacaggttaatcccctgaccctcacagccgctgtgttgatgctggtcgcacactatgccatcattggaccaggcctacaggcgaaggctaccagagaagcccaaaagaggactgcagccgggatcatgaaaaaccctacggtggatggaattgtcgctatcgacctggaccccgtggtttacgatgccaagttcgagaaacagctcggccagataatgcttctgattttgtgtacatctcagatcctgctcatgcgcaccacttgggcactgtgcgaaagtatcaccttagctacaggtccacttactaccctgtgggaggggtcgcctggaaagttttggaatacaacgattgccgtgagcatggcgaacatcttccggggctcctatctcgccggtgcaggcctagctttctctctgatgaaatcattggggggaggccgaagagggaccggagcccaaggcgaaactctgggtgagaagtggaagaggcagctcaatcagcttagcaaatccgagtttaacacatacaagcgcagtgggataatggaagtagaccggtctgaggcaaaagaaggactgaagagaggcgagaccactaaacatgctgtgagccgtggtacagccaagttgaggtggttcgtcgaacggaatctggttaagcccgagggcaaagtgattgatctcgggtgtggacgcggcgggtggtcatattactgcgccggattaaagaaagtcaccgaggtgaagggctatacgaaaggtgggccgggacacgaagagccaatccctatggcgacctacggctggaacctggtaaagcttcattccggcaaagacgtgtttttcatgcccccagaaaagtgtgatacactgctatgcgacattggggagagtagccccaatcctactatcgaagagggacgaaccctcagagttctgaagatggtggagccgtggttgaggggtaaccagttttgtataaaaatcctgaatccctacatgccatctgtcgtggaaacactcgagcaaatgcagcggaagcacggcgggatgcttgtccgcaaccctctgtccagaaattcaactcacgaaatgtattgggtgagctgcggaaccggcaacattgtttcggctgtaaacatgacatctaggatgttactgaatcgattcaccatggcacatcggaaacccacttttgagcgtgatgtggacttgggtgccgggacgagacacgtcgctgtggagcctgaagttgccaacctcgatatcattggacagcgcatcgagaatattaagaacgaacataaaagtacatggcactacgacgaggataatccatataagacctgggcataccacggctcctatgaagtgaagcccagcggctcagcctcctctatggtcaacggggtggtaaggctgctaactaaaccttgggacgtgatcccaatggttacccaaatagctatgacagacacgacccccttcggacagcagcgggtctttaaggagaaagtggatactagaacaccgcgcgcgaagaggggtaccactcagattatggaggtgacagccaaatggctttggggcttcctgagccgaaataagaagcctcggatctgtaccagagaagagtttacaaggaaagtccgcagtaacgcagctatcggggccgttttcgtggacgaaaatcaatggaactccgcaaaggaggccgtagaagatgagcgtttttgggacctcgtgcatcgggagagagaactgcacaaacagggaaagtgcgctacttgcgtctacaatatgatgggcaaaagggagaagaagttgggtgaattcgggaaagccaagggaagccgcgcgatttggtatatgtggctgggcgcacgattcctcgagtttgaagcccttggcttcatgaacgaggatcattggttttctcgggagaattcactgagtggggtggaaggagagggtttacacaaactgggctacatattgagagacatctccaagattccagggggaaacatgtacgctgatgacaccgccggctgggatacgaggatcaccgaagacgatctccagaatgaggcaaaaattacagacatcatggagcccgaacatgctctgctagccactagcatattcaagcttacctatcagaacaaagttgtgcgcgtccaaagacctgctaagaacggtacagtgatggatgtaatctctcggagggaccagcgtgggtcgggacaggttggcacttacggcctgaatacctttacgaacatggaggtgcagctcattcgacaaatggaatcagaggggatcttcctgccaagcgaattggagacacccaatttagccgagcgcgtcctggactggctcgaaaagcacggagcagagagacttaaacggatggcgatttccggtgatgactgtgtggtgaagccgatcgatgacaggtttgccaccgctctgactgccctaaacgatatgggcaaagtccgcaaggacatacctcagtgggaacccagtaaagggtggaatgattggcagcaggttccattctgctctcaccattttcaccaactgattatgaaggacggaagagagatcgtggtaccttgtcggaaccaggatgaactcgtgggcagggcacgagtcagccagggtgctgggtggtccttgcgtgagacagcctgcctgggaaagtcatatgcacaaatgtggcagcttatgtacttccatagacgcgacctgcggctcgccgcgaatgctatctgtagtgccgtgcccgttgattgggtgccaacctctaggactacctggagcattcacgcacaccatcagtggatgacaacggaggacatgttatccgtctggaacagagtgtggatagaagagaatccctggatggaagacaaaacccacgtatcaagctgggaggaagttccttatctgggcaagcgcgaggatcagtggtgcggctctttgatcgggctgactgcccgggctacatgggccaccaacattcaagtggcaatcaatcaggtcaggcgactcattggaaacgagaattaccttgactatatgacttccatgaaaagatttaagaacgaaagtgatccagagggtgctctgtggtga

SEQ ID NO: 13331 - RNA, 9879 nt, synthetic construct
  misc_feature 1..9879: note = derived and/or modified CDS sequence (opt3) from DENV-1__GU131965__SS-prME
  source 1..9879: mol_type = other RNA
agcgtgaccatgctgctcatgcttctgccaacagcattggctttccacttaactacgagaggaggggaacctcatatgatcgtctccaagcaggaaaggggaaaatctctgttgtttaagacctcagccggtgttaacatgtgcacactcattgccatggacctgggcgaactttgtgaagatactatgacctacaaatgcccacagataacagaggcggaaccggacgatgtggactgttggtgcaatgctaccgatacttgggtaacatatgggacctgtagtcagacgggagagcaccggcgcgacaagcgaagcgtggccctggcaccccatgtcggcttgggtctcgagactcgtaccgaaacatggatgtcctctgagggggcctggaaacagatccagagagtggaaacttgggttctgaggcaccctggattcaccgtgattgctctgtttctcgcacatgccatcggcacatcgattacccaaaagggcatcatattcatcttactgatgcttgtcacgccatcaatggctatgcggtgcgtggggattggaaaccgcgattttgttgagggtttgagcggcgccacttgggttgacgtggtcctggagcacgggagttgtgtgacaaccatggcgaagaataaacccactctagatatcgaactcctgaagacagaggtgaccaaccctgcaattcttagaaaactgtgcatcgaagccaagatatccaatacgaccacagactctaggtgtccaactcagggagaggctaccttggtcgaagaacaggatgccaacttcgtttgccggcgcacatttgtggaccgaggctggggtaatgggtgtggactcttcggcaaaggcagcctgttaacttgcgcaaagtttaagtgcgtaaccaaactggaggggaagattgtgcagtacgaaaacctcaaatattccgtcatcgtgacagttcacaccggagatcaacatcaggtgggtaatgagactacggaacacggcacaattgctaccatcactccccaggcccctacctcagagatccagcttacagactacggggcgctgaccttggactgtagtccaagaactggactagatttcaacgaaatggtcctgctcacaatgaaggagaaaagctggctggtgcataagcaatggtttcttgacctgccgttgccctggacgtctggcgcctccacctcacaggagacttggaataggcaggatctcctggtaacattcaaaaccgcacacgctaagaagcaagaagttgtggtcttaggtagccaggagggggccatgcacacagctctgactggcgccaccgaaattcagacgagtggaaccacaactatatttgcaggccatctaaaatgccggctcaagatggacaaactgacccttaaggggacatcttatgtgatgtgtactggatccttcaaattggagaaggaagtcgccgagacccagcacggtacggtgctggttcaagtgaagtacgagggcacagatgctccttgcaaaatcccattcagcacccaggacgaaaagggggtaactcagaacggacgtctcattacagcgaatcccatcgtcaccgataaagagaagcctgtgaacatagaaactgagccaccctttggcgagtcgtatattgttgtgggtgcaggggaaaaagccctgaaactttcttggttcaagaaaggctcctcaatcggaaagatgtttgaggctaccgcccgcggcgcaagaaggatggccatcctgggggacacagcttgggatttcggaagtattggtggcgtctttacgagcgtggggaaattggtacatcaggtgttcggaaccgcctacggcgttctcttttccggtgtctcttggactatgaagatcgggattggcatactgttaacatggctgggactaaatagccggaacacctcactcagtatgacatgtatcgcagtgggcatggtgactctgtaccttggggtcatggttcaagcggactccggatgcgtgattaactggaaaggccgagaattgaagtgtggtagcgggatcttcgtgaccaatgaggtacacacgtggacagaacagtataagtttcaggctgattctccgaaacgcctgtcagccgcaatcggaaaggcctgggaggagggcgtctgcggtattagaagtgctaccaggctcgaaaacataatgtggaaacagatcagcaatgagctgaaccatattttactggaaaatgacatgaagttcactgtggttgtgggcgacgccaacgggatccttgcacaaggcaagaagatgattcggcctcagcccatggagcacaaatactcctggaagtcttggggcaaggctaaaatcataggggccgatatccagaataccacatttattatcgacggaccagatactcctgaatgtcccgacaaccagcgcgcgtggaatatttgggaggtcgaggattatggcttcggtatctttaccacaaacatatggttgaagctcagagactcgtacacgcaaatgtgcgatcacaggctgatgagcgccgctattaaagactccaaggcagtgcatgccgatatggggtattggatcgaatcagagaaaaatgaaacctggaagctagctcgtgccagtttcattgaggttaagacttgtacatggccaaaatctcacaccctgtggagcaacggagtgctcgaatccgagatgatcatacccaagatctacggcggtcctatttcacagcataattatcggccaggctacttcactcagacagcagggccgtggcacctgggaaaacttgagttggactttgatctgtgcgaaggcaccacggtagtcgtggacgagcactgcgggaaccgaggacccagcttaagaactaccacagcgaccggcaagatcattcatgaatggtgttgcaggtcttgtactctccctccactgcgcttccggggtgaggatgggtgctggtacggaatggagatcagacccgtgaaagaaaaggaggaaaatcttgtcaggtccatggttagtgccggcagcggtgaggtggactctttttccctgggcatattgtgtgcttcaattatgatcgaagaggtaatgcgcagtcgatggagccggaagatgctcatgacagggaccctggccgtgttcctactgctcgtcatgggacaactgacatggaacgaccttatccgtttgtgcattatggtgggcgcaaacgcttcggatagaatggggatgggaactacctatctggccttaatggcaacgtttaaaatgaggcctatgttcgccgttggcctcctgtttcgccggcttacatccagagaggtgctgctactcaccatcggtctgtctttggtcgctagcgtggaactgccaaattcattagaggaactcggggacggactggcgatgggcattatgatgcttaagctgttgactgagttccagccccaccagctctggaccacactgctaagtctgacttttataaaaaccacgctttccctcgattacgcctggaagacaaccgcaatggctctgtctatcgttagcttgttcccgctgtgtttatccactacatcacagaaaaccacttggctccctgtgctgcttggcagctttgggtgcaagccactgacaatgttcttgattaccgaaaacaagatctggggaaggaaaagttggcccctcaatgagggtattatggccatcggcatagtctctatcctgctatccagcctgcttaagaacgacgtacctctcgccgggcccctgattgctggaggcatgttgatcgcatgttatgtgatttcgggttcatctgccgatttaagtctggagaaagcggctgaagtttcctgggagcaagaagccgagcatagcgggacgtctcacaatatcctcgtggaagtccaggacgatggaactatgaagataaaagacgaggagcgagatgacaccctgacaattcttctgaaggcaaccttgctagccgtgagcggcgtatacccaatgtccatccctgctacactgtttgtgtggtatttctggcagaaaaagaagcagcgctcaggcgtcctctgggatactcccagtccaccggaagttgagcgggcagtgctggacgatgggatctacaggattcttcaacgaggattactgggtcgtagccaggtgggcgtcggggtgttccaggacggagtttttcataccatgtggcacgtaacgcgcggcgccgtgctcatgtatcagggtaaacggttggaaccttcttgggcgtccgtcaagaaagacctgatatcatacgggggaggctggagattccaaggcagttggaacacaggggaggaggtgcaggttatcgctgtggaacccggaaagaatcccaagaacgtccagactacccccggtacatttaagacccctgagggcgaagtgggggccattgcactcgatttcaagccaggaactagcggctcccccatcgtaaatagggagggtaaaattgtcgggctgtacggaaacggcgtggttaccacatctggcacgtatgtgtcggccatcgctcaagccaaggcaagccaggaagggcctcttccggagatagaggacgaagtctttaaaaagcgaaatctgactatcatggatttgcacccaggatcaggtaaaacccggcgctacctacccgctattgtgagagaggccatcaagaggaagctgcggacactcattttagcgcctacccgagttgtggcctccgaaatggcagaggctctgaaaggcatgccaatcagatatcagactacagccgtcaagagtgaacataccgggcgcgagatagtggaccttatgtgccacgctacgttcactatgaggctgctctctcccgtacgtgtgcctaactacaatatgattatcatggatgaggcacattttacagacccggccagcatcgccgctcggggatatatttccaccagagttggcatgggtgaagcggcagccatcttcatgaccgctactcccccagggtcagtcgaggcctttcctcagtctaacgcagtgatacaagatgaagagagggacattcccgaacgcagctggaatagtggatacgattggatcacagacttcccaggcaaaaccgtgtggtttgtcccttccattaagagcggcaacgatatcgccaactgtttgagaaagaatgggaagagagtaatacagctgtctcggaagacattcgacactgagtatcagaaaacgaagaacaatgactgggattacgtggttaccacagacatttcagagatgggagctaacttcagggcggatcgcgtgatcgacccccgtagatgcctcaaaccagtcatcctgaaggatggtccggaacgggtgattcttgccggccctatgcccgttactgtggcatccgctgcccagaggcgcgggcgaatcggaagaaatcaaaacaaagagggcgaccagtacgtctatatgggtcagccactaaataacgatgaagaccacgcacattggaccgaggccaagatgctgttggataatattaacacacccgaggggataatccctgctttatttgaaccagagcgggaaaagagtgccgcgattgacggcgagtacaggctgcgcggagaagcaagaaaaaccttcgtggagctcatgaggcggggcgatctgcccgtatggcttagctataaggtggcctcggaggggtttcagtactctgaccgtcgctggtgcttcgatggagaacgaaataaccaagttctggaggaaaatatggacgtcgagatctggactaaagaaggtgagagaaagaaactcaggcctcggtggttggacgctcgcacgtattccgatccgctggccctaagagagtttaaggagttcgctgcaggcaggcggagcgtgtcaggggacctgatcctcgagattggaaaacttccacagcacctgaccttacgagcccagaacgctttggataatctggtgatgctccacaacagtgaacagggcggtaaggcctacagacatgcaatggaggaactgcccgacacaatagagactcttatgctgctcgcgttgatcgccgtcctgaccgggggcgttacattatttttcctatctggaaagggcctggggaaaacctccattggactcctttgtgtgactgctagctcagccctgttgtggatggcaagtgtagagcctcactggatcgctgccagcattatcctggaatttttcctcatggtgctgcttatacccgagccagatcgccaaaggacacctcaggacaaccagctcgcatatgtcgtgatcggtctgttgtttatgattctgacggttgccgctaatgaaatgggcttactagagaccactaagaaagatctggggatcggacatgtggcggccgagaaccaccaacacgcaacaatgctcgacgtcgatcttcggcccgcttccgcctggaccctgtacgccgtagcaaccacagtgattactccaatgatgcgtcatacgatcgaaaataccacagctaacatatctttgactgccattgcgaatcaggctgccatcctgatgggcctcgacaagggttggcctattagcaaaatggatatcggggttccgctgcttgcattaggctgctactcccaggtgaaccccctgaccctcacagccgctgtcttgatgctggtggcacactatgccataatcggaccaggcctacaggcgaaggctaccagagaggcccaaaagaggactgcagccgggattatgaaaaatcctacggtcgacggaatcgtggctattgatctggaccccgttgtgtacgacgccaagttcgaaaaacagctcggccagatcatgcttctgatattgtgtacatcacagattctgctcatgcgcaccacttgggcactgtgcgagtctatcaccttagctacaggtccacttactaccctgtgggaagggagtcctggaaagttttggaacacaacgatcgccgtatcgatggcgaatattttccggggcagctatctcgccggtgcaggcctagctttctccctgatgaaatctctagggggaggccgaagagggaccggagcccaaggcgagactctgggtgagaagtggaagaggcagctcaaccagctttcaaaaagcgaatttaatacatacaagcgctccgggatcatggaggtggatcggagtgaagcaaaagagggactgaagagaggcgaaaccactaaacatgctgtctctcgtggtacagccaagttgaggtggttcgttgagcggaacctggtgaagcccgagggcaaagtcatagacctcgggtgtggacgcggcgggtggagctattactgcgccggattaaagaaagtgaccgaagtaaagggctatacgaaaggtgggccgggacacgaggaaccaattcctatggcgacctacggctggaatctggtgaaacttcattcaggcaaagatgtatttttcatgcccccagagaagtgtgacacactgctatgcgatatcggggaatccagtcccaaccctactattgaggagggacgaaccctcagagtgctgaagatggtcgaaccgtggttgaggggtaatcagttttgtatcaaaatactgaacccctacatgccaagcgtggtcgagacactcgaacaaatgcagcggaagcacggcgggatgcttgtgcgcaatcctctgtctagaaactccactcacgagatgtattgggtttcatgcggaaccggcaacatcgtaagcgctgtgaatatgacatcgaggatgttactgaaccgattcaccatggcacatcggaaacccacttacgagcgtgacgtcgatttgggtgccgggacgagacacgtggctgttgaacctgaggtggccaatctcgacattatcggacagcgcattgaaaacatcaagaatgagcataaatctacatggcactatgatgaagacaacccatacaagacctgggcatatcacggcagttacgaggtcaagccctccggcagcgcctcatccatggtgaatggggtagtgaggctgctaactaaaccttgggatgttattccaatggtcacccaaatcgctatgacagacacgaccccctttggacagcagcgggtgttcaaggagaaagtggacactagaacaccgcgcgcgaagaggggtaccactcagataatggaagtcacagccaaatggctttggggctttctgtctcgaaacaagaagcctcggatttgtaccagagaggagttcacaaggaaagttcgcagcaatgcagctatcggggccgtgtttgtagatgagaaccaatggaatagtgcaaaggaagccgtggaggacgagcgtttctgggatctcgtccatcgggaaagagagctgcacaaacagggaaagtgcgctacttgcgtgtataacatgatgggcaaaagggaaaagaagttgggtgagtttgggaaagccaagggatcccgcgcgatctggtacatgtggctgggcgcacgattcctcgagttcgaggcccttggctttatgaatgaggaccattggttcagccgggaaaactctctgtcaggggttgagggagaaggtttacacaaactgggctacattttgagagatataagtaagatcccagggggaaatatgtatgctgacgataccgccggctgggacacgaggattaccgaggatgacctccagaacgaggcaaaaatcacagaaattatggagcccgaacatgctctgctagccacttccatctttaaacttacctaccagaacaaagtggtccgcgtgcaaagacctgctaagaatggtacagtaatggatgttataagccggagggaccagcgtgggtctggacaggtgggcacttatggcctgaacaccttcacgaatatggaggtccagctcatccgacaaatggaatcggaggggatttttctgccatcagagttggaaacacccaacttagccgagcgcgtgctggattggctcgaaaagcacggagcagagagacttaaacggatggcgatcagcggtgacgactgtgtggtcaagccgattgatgacaggttcgccaccgctctgactgccctaaatgatatgggcaaagttcgcaaggacatccctcagtgggaaccctccaaagggtggaacgattggcaacaggtgccattttgcagtcaccatttccaccaactgataatgaaggacggaagagagattgtagtgccttgtcggaatcaggatgagctcgtcggcagggcacgagtgtctcagggtgctgggtggagcttgcgtgaaacagcctgcctgggaaagtcctacgcacaaatgtggcagcttatgtattttcatagacgcgacctgcggctcgccgcgaacgctatctgttcagccgttcccgtggattgggtcccaaccagtaggactacctggtctatccacgcacaccatcagtggatgacaacggaggacatgttaagcgtgtggaatagagtatggattgaagagaacccctggatggaagataaaacccacgtttcctcatgggaggaggtgccttacctgggcaagcgcgaagaccagtggtgcggcagcttgatagggctgactgcccgggctacatgggccaccaatatccaagtcgcaattaaccaggtgaggcgactcatcggaaatgagaactatcttgactacatgacttctatgaaaagattcaagaatgaatccgatccagagggtgctctgtggtga

SEQ ID NO: 13332 - RNA, 9879 nt, synthetic construct
  misc_feature 1..9879: note = derived and/or modified CDS sequence (opt3) from DENV-1__GU131966__SS-prME
  source 1..9879: mol_type = other RNA
agcgtgaccatgctgctcatgcttctgccaacagcattggctttccacttaactacgcgaggaggggaacctcatatgatcgtctccaagcaggaaaggggaaaatctctgttatttaagacctcagccggtgttaacatgtgcacactcattgccatggacctgggcgagctttgtgaagatactatgacctacaaatgcccacaaataacagaggcggaaccggacgatgtggactgttggtgcaatgctaccgatacttgggtaacatatgggacctgtagtcagacgggagagcaccggcgcgacaagcgaagcgtggccctggcaccccatgtcggcttgggtctcgagactcgtaccgaaacatggatgtcctctgagggggcctggaaacagatccagagggtggaaacttgggctctgaggcaccctggattcaccgttattgcactgtttctcgcccatgctatcggcacatcgattacccaaaagggcatcatattcatcttactgatgcttgtgacgccatcaatggccatgcggtgcgtcgggattggaaaccgcgattttgtggagggtttgagcggcgcgacttgggtagacgttgtgctggagcacgggagttgtgtcacaaccatggcaaagaataaacccactttggatatcgaactcctgaagacagaggtgaccaaccctgccattcttagaaaactgtgcatcgaagctaagatatccaatacgaccacagactctaggtgtccaactcagggagaggccaccttggtggaagaacaggatgcaaacttcgtctgccggcgcacatttgttgaccgaggctggggtaatgggtgtggactcttcggcaaaggcagcctgttaacttgcgctaagtttaagtgcgtgaccaaactggaggggaagattgtacagtacgaaaacctcaaatattccgtgatcgtcacagtgcacaccggagatcaacatcaggttggtaatgagactacggaacacggcacaattgccaccatcactccccaggcgcctacctcagagatccagcttacagactacggggccctgaccttggactgtagtccaagaactggactagatttcaacgaaatggtgctgctcacaatgaaggagaaaagctggctggtccataagcaatggtttcttgacctgccgttgccctggacgtctggcgcatccacctcacaggagacttggaataggcaggatctcctggtgacattcaaaaccgctcacgccaagaagcaagaagtagttgtgttaggtagccaggagggggctatgcacacagccctgactggcgcaaccgaaattcagacgagtggaaccacaactatatttgccggccatctaaaatgccggctcaagatggacaaactgacccttaaggggacatcttatgtcatgtgtactggatccttcaaattggagaaggaagtggctgagacccagcacggtacggtcctggtgcaagttaagtacgagggcacagatgcgccttgcaaaatcccattcagcacccaggacgaaaagggggtgactcagaacggacgtctcattacagcaaatcccatcgtaaccgataaagagaagcctgtcaacatagaaactgagccaccctttggcgagtcgtatattgtggttggtgccggggaaaaagctctgaaactttcttggttcaagaaaggctcctcaatcggaaagatgtttgaggccaccgcacgcggcgccagaaggatggctatcctgggggacacagcctgggatttcggaagtattggtggcgtgtttacgagcgtcgggaaattggtgcatcaggtattcggaaccgcatacggcgtgctcttttccggtgtttcttggactatgaagatcgggattggcatactgttaacatggctgggactaaatagccggtcaaccagtctctccatgacatgtatcgcggtcggcatggtgactctgtaccttggggtgatggtccaagctgacagcggatgcgttattaactggaaaggccgagaattgaagtgtggttctgggatcttcgtgaccaacgaggtgcacacgtggacagaacagtataagtttcaggccgattcaccgaaacgcctgagtgcagccatcggaaaggcttgggaggagggcgtatgcggtattagaagcgccaccaggctcgaaaatataatgtggaaacagatctccaacgagctgaatcatattttactggaaaacgacatgaagttcactgtcgtggttggcgacgcaaatgggatccttgctcaaggcaagaagatgattcggcctcagcccatggagcacaaatactcttggaagtcgtggggcaaggccaaaatcataggggcggatatccagaacaccacatttattatcgacggaccagatactcctgaatgtcccgacaatcagcgcgcctggaacatttgggaggtggaggattatggcttcggtatctttaccacaaatatatggttgaagctcagagacagctacacgcaaatgtgcgatcacaggctgatgtccgctgcaattaaagactcaaaggccgtccatgctgatatggggtattggatcgaaagtgagaaaaacgaaacctggaagctagcccgtgcatctttcattgaggtgaagacttgtacatggccaaaaagccacaccctgtggtccaatggagttctcgaatcagagatgatcatacccaagatctacggcggtcctattagccagcataactatcggccaggctacttcactcagacagcggggccgtggcacctgggaaaacttgagttggactttgatctgtgcgaaggcaccacggtggtagtcgacgagcactgcgggaatcgaggaccctctttaagaactaccacagtgaccggcaagatcattcatgaatggtgttgcaggtcctgtactctccctccactgcgcttccggggtgaggatgggtgctggtacggaatggagatcagacccgtgaaagaaaaggaggaaaaccttgtcaggagtatggttagcgccggctctggtgaggtggactccttttcactgggcatattgtgtgctagtattatgatcgaagaggtaatgcgcagccgatggtcgcggaagatgctcatgacagggaccctggccgtgttcctactgctcatcatgggacaactgacatggaatgaccttattcgtttgtgcatcatggtcggcgcaaacgcttccgatagaatggggatgggaactacctatctggccttaatggcaacgtttaaaatgaggcctatgttcgccgtgggcctcctgtttcgccggcttacatctagagaggttctgctactcaccattggtctgagcttggtggcttcagtcgaactgccaaacagtttagaggaactcggggacggactggcgatgggcataatgatgcttaagctgttgactgagttccagccccaccagctctggaccacactgctatccctgacttttatcaaaaccacgctttctctcgattacgcctggaagacaaccgcaatggctctgagcattgtgtccttgttcccgctgtgtttatcaactacaagccagaaaaccacttggctccctgttctgcttggcagttttgggtgcaagccactgacaatgttcttgatcaccgaaaataagatttggggaaggaaatcttggcccctcaacgagggtatcatggccataggcatcgtgtccattctgctaagctcgctgcttaagaatgacgtccctctcgccgggcccctgatcgctggaggcatgttgattgcatgttatgtaatctcaggttctagtgccgatttatccctggagaaagcggctgaagtgagctgggagcaagaagccgagcattctgggacgagccacaacatactcgttgaagtgcaggacgatggaactatgaagattaaagacgaggagcgagatgacaccctgacaatccttctgaaggcaaccttgctagccgtctccggcgtgtacccaatgtcaatccctgctacactgtttgtatggtatttctggcagaaaaagaagcagcgcagtggcgtgctctgggatactcccagcccaccggaagtcgagcgggcagttctggacgatgggatttacagaatacttcaaaggggattactgggtcgttctcaggtgggcgtgggggtcttccaggacggagtgtttcataccatgtggcacgttacgcgcggcgccgtactcatgtatcagggtaaacggttggaaccttcctgggcgtcagtgaagaaagacctgatcagttacgggggaggctggagattccaaggcagctggaatacaggggaggaggtccaggtgattgctgttgaacccggaaagaaccccaaaaatgtgcagactacccccggtacatttaagacccctgagggcgaagtcggggccatcgcactcgatttcaagccaggaacttccggctctcccattgtgaacagggagggtaaaatcgtagggctgtacggaaatggcgtcgtgaccacatcgggcacgtatgttagcgccatagctcaagccaaggcatcacaggaagggcctcttccggagatcgaggacgaagtgtttaaaaagcgaaacctgactattatggatttgcacccaggatccggtaaaacccggcgctacctacccgctatcgtcagagaggccattaagaggaagctgcggacactcatcttagcgcctacccgagtggttgccagtgaaatggcagaggctctgaaaggcatgccaataagatatcagactacagccgtgaagtctgaacataccgggcgcgagattgtcgaccttatgtgccacgctacgttcactatgaggctgctcagccccgtgcgtgtacctaattacaacatgatcatcatggatgaggcacattttacagacccggcctccattgccgctcggggatatatctcaaccagagtgggcatgggtgaagcggcagccatattcatgaccgctactcccccagggtctgttgaggcctttcctcagagcaatgcagtcattcaagatgaagagagggacatccccgaacgcagttggaactccggatacgattggattacagacttcccaggcaaaaccgtgtggtttgtgcctagcatcaagtctggcaatgatatagccaactgtttgcggaaaaacgggaagagagtcattcagctgtcaagaaagacattcgacactgagtatcagaaaacgaagaataacgactgggattacgtagtgaccacagacatctccgagatgggagctaatttcagggcggatcgcgttatcgacccccgtagatgcctcaaaccagtgattctgaaggatggtccggaacgggtcatccttgccggccctatgcccgtgactgttgcaagtgctgcccagaggcgcgggcgaattggaagaaaccaaaataaagagggcgaccagtacgtgtatatgggtcagccactaaacaatgatgaagaccacgcacattggaccgaggccaagatgctgttggataacataaatacacccgaggggatcattcctgctttatttgaaccagagcgggaaaagagcgccgcgatcgacggcgagtacaggctgcgcggagaagcaagaaaaaccttcgtcgagctcatgaggcggggcgatctgcccgtgtggctttcgtataaggtagcctctgaggggtttcagtactccgaccgtcgctggtgcttcgatggagaacgaaacaatcaagtgctggaggaaaacatggacgttgagatctggactaaagaaggtgagagaaagaaactcaggcctcggtggttggacgctcgcacgtatagcgatccgctggccctaagagagtttaaggagttcgctgcaggcaggcggtcagtcagtggggacctgattctcgagataggaaaacttccacagcacctgaccttacgagcccagaatgctttggataacctggtgatgctccacaattctgaacagggcggtaaggcctacagacatgcaatggaggaactgcccgacacaatcgagactcttatgctgctcgcgttgattgccgtgctgaccgggggcgtcacattatttttcctatccggaaagggcctggggaaaaccagcatcggactcctttgtgttactgcttcaagtgccctgttgtggatggcaagcgtggagcctcactggattgctgcctccatcatactggaatttttcctcatggtactgcttatccccgagccagatcgccaaaggacacctcaggacaaccagctcgcatatgtggtcattggtctgttgtttatgatcctgacggtggccgctaacgaaatgggcttactagagaccactaagaaagatctggggattggacatgttgcggccgagaatcaccaacacgcaacaatgctcgacgtggatcttcggcccgcttctgcctggaccctgtacgccgtcgcaaccacagtaatcactccaatgatgcgtcatacgatagaaaacaccacagctaatattagcttgactgccatcgcgaaccaggctgccattctgatgggcctcgacaagggttggcctatctccaaaatggatataggggtgccgctgcttgcattaggctgctactcacaggttaatcccctgaccctcacagccgctgtgttgatgctggtcgcacactatgccatcattggaccaggcctacaggcgaaggctaccagagaggcccaaaagaggactgcagccgggatcatgaaaaaccctacggtggacggaattgtcgctatcgatctggaccccgtggtttacgacgccaagttcgaaaaacagctcggccagataatgcttctgattttgtgtacatctcagatcctgctcatgcgcaccacttgggcactgtgcgagagtatcaccttagctacaggtccacttactaccctgtgggaagggtcgcctggaaagttttggaatacaacgattgccgtgagcatggcgaacatcttccggggctcctatctcgccggtgcaggcctagctttctctctgatgaaatcactagggggaggccgaagagggaccggagcccaaggcgagactctgggtgagaagtggaagaggcagctcaatcagcttagcaaatccgaatttaacacataccgccggagtgggataatggaggtagatagatctgaagcaaaggagggactgaaacgtggcgaaaccactaagcatgctgtgagcaggggtacagccaaattgcggtggttcgtcgagcgcaatctggttaagcccgagggcaaggtgattgacctcgggtgtggacgaggcgggtggtcatattactgcgccggactgaaaaaggtcaccgaagtgaaaggctatacgaagggtgggccgggacacgaggaaccaatccctatggcgacctacggctggaacctagtaaaacttcattccggcaaggatgtgtttttcatgcccccagagaaatgtgacacactgctatgcgatattggggaaagtagccccaatcctactatcgaggagggaagaaccctcagggttctgaagatggtggaaccgtggttgcggggtaaccagttttgtataaagatcctgaatccctacatgccatctgtcgtggagacactcgaacaaatgcagcgcaaacacggcgggatgcttgtcagaaaccctctgtccagaaattcaactcacgagatgtattgggtgagctgcggaaccggcaacattgtttcggctgtaaacatgacatctcgaatgttactgaatcggttcaccatggcacatcgtaagcccacttttgagagagacgtggatttgggtgccgggacgcgccacgtcgctgtggaacctgaggttgccaacctcgacatcattggacagaggatcgaaaatattaaaaacgagcataagagtacatggcactacgatgaagacaatccatataaaacctgggcataccacggctcctatgaggtgaagcccagcggctcagcctcctctatggtcaacggggtggtacggctgctaactaagccttgggatgtgatcccaatggttacccaaatagctatgacagacacgacccccttcggacagcagagagtctttaaagagaaggtggacactcgcacaccgagggcgaaacgaggtaccactcagattatggaagtgacagccaagtggctttggggcttcctgagccggaataaaaagcctagaatctgtaccagggaggaatttacacgcaaggtccgtagtaacgcagctatcggggccgttttcgtggatgagaatcaatggaactccgcaaaagaagccgtagaggacgagcggttttgggatctcgtgcatagagaaagggagctgcacaagcagggaaaatgcgctacttgcgtctacaatatgatgggcaagcgcgagaaaaagttgggtgagttcgggaaggccaaaggaagccgagcgatttggtatatgtggctgggcgcacggttcctcgaatttgaggcccttggcttcatgaacgaggaccattggttttctagagaaaattcactgagtggggtggagggagaaggtttacacaagctgggctacatattgagggatatctccaaaattccagggggaaacatgtacgctgacgataccgccggctgggacacgcgcatcaccgaggatgacctccagaatgaggcaaagattacagatatcatggaacccgagcatgctctgctagccactagcatattcaaacttacctatcagaacaaggttgtgagagtccaacggcctgctaaaaacggtacagtgatggacgtaatctctaggcgtgatcagcgagggtcgggacaggttggcacttacggcctgaatacctttacgaacatggaagtgcagctcattcgccaaatggagtcagaagggatcttcctgccaagcgagttggagacacccaatttagccgaaagagtcctggactggctcgagaagcacggagcagaacggcttaagaggatggcgatttccggtgacgattgtgtggtgaaaccgatcgacgatcgctttgccaccgctctgactgccctaaacgacatgggcaaggtcagaaaagatatacctcagtgggagcccagtaaggggtggaatgactggcagcaggttccattctgctctcaccattttcaccaactgattatgaaagatggacgggaaatcgtggtaccttgtaggaaccaggacgagctcgtgggccgagcacgtgtcagccagggtgctgggtggtccttgagagagacagcctgcctgggaaagtcatatgcacaaatgtggcagcttatgtacttccatcgccgggatctgaggctcgccgcgaatgctatctgtagtgccgtgcccgttgactgggtgccaacctctagaactacctggagcattcacgcacaccatcagtggatgacaacggaagatatgttatccgtctggaaccgcgtgtggatagaggaaaatccctggatggaggacaagacccacgtatcaagctgggaagaggttccttatctgggcaaacgggaggaccagtggtgcggctctttgatcgggctgactgccagggctacatgggccaccaacattcaagtggcaatcaatcaggtccgaagactcattggaaacgaaaattaccttgattatatgacttccatgaagcggtttaaaaacgagagtgacccagaaggtgctctgtggtga

SEQ ID NO: 13333 - RNA, 9879 nt, synthetic construct
  misc_feature 1..9879: note = derived and/or modified CDS sequence (opt3) from DENV-1__GQ868501__SS-prME
  source 1..9879: mol_type = other RNA
agcgtgaccatgctgctcatgcttctgcccacagccttggctttccacttaactacgagaggaggggagcctcatatgatcgtctccaagcaggaaagaggaaaatctctgttatttaagacctcagccggtgttaacatgtgcacactcattgccatggacctgggagagctttgtgaagatactatgacctacaaatgcccacaaataacagaggcggaaccggacgatgtggactgttggtgcaatgctaccgatacttgggtaacatatgggacctgtagtcagacgggagagcaccggcgcgacaagcgaagcgtggccctggcaccccatgtcggcttgggtctcgagactcgtaccgaaacatggatgtcctctgagggggcctggaaacagatccagagagtggaaacttgggctctgaggcaccctggattcaccgttattgcactgtttctcgcccatgctatcggcacatcgattacccaaaagggcatcatattcatcttactgatgcttgtgacgccatcaatggccatgcggtgcgtcgggattggaaaccgcgattttgtggagggtttgagcggcgcgacttgggtagacgttgtgctggagcacgggagttgtgtcacaaccatggcaaagaataaacccactttggatatcgaactcctgaagacagaggtgaccaaccctgccattcttagaaaactgtgcatcgaagctaagatatccaatacgaccacagactctaggtgtccaactcagggagaggccaccttggtggaagaacaggatgcaaacttcgtctgccggcgcacatttgttgaccgaggctggggtaatgggtgtggactcttcggcaaaggcagcctgttaacttgcgctaagtttaagtgcgtgaccaaactggaggggaagattgtacagtacgaaaacctcaaatattccgtgatcgtcacagtgcacaccggagatcaacatcaggttggtaatgagactacggaacacggcacaattgccaccatcactccccaggcgcctacctcagagatccagcttacagactacggggccctgaccttggactgtagtccaagaactggactagatttcaacgaaatggtgctgctcacaatgaaggagaaaagctggctggtccataagcaatggtttcttgacctgccgttgccctggacgtctggcgcatccacctcacaggagacttggaataggcaggatctcctggtgacattcaaaaccgctcacgccaagaagcaagaagtagttgtgttaggtagccaggagggggctatgcacacagccctgactggcgcaaccgaaattcagacgagtggaaccacaactatatttgccggccatctaaaatgccggctcaagatggacaaactgacccttaaggggacatcttatgtcatgtgtactggatccttcaaattggagaaggaagtggctgagacccagcacggtacggtcctggtgcaagttaagtacgagggcacagatgcgccttgcaaaatcccattcagcacccaggacgaaaagggggtgactcagaacggacgtctcattacagcaaatcccatcgtaaccgataaagagaagcctgtcaacatagaaactgagccaccctttggcgagtcgtatattgtggttggtgccggggaaaaagctctgaaactttcttggttcaagaaaggctcctcaatcggaaagatgtttgaggccaccgcacgcggcgccagaaggatggctatcctgggggacacagcctgggatttcggaagtattggtggcgtgtttacgagcgtcgggaaattggtgcatcaggtattcggaaccgcatacggcgtgctcttttccggtgtttcttggactatgaagatcgggattggcatactgttaacatggctgggactaaatagccggtcaaccagtctctccatgacatgtatcgcggtcggcatggtgactctgtaccttggggtgatggtccaagctgacagcggatgcgttattaactggaaaggccgagaattgaagtgtggttctgggatcttcgtgaccaacgaggtgcacacgtggacagaacagtataagtttcaggccgattcaccgaaacgcctgagtgcagccatcggaaaggcttgggaggagggcgtatgcggtattagaagcgccaccaggctcgaaaatataatgtggaaacagatctccaacgagctgaatcatattttactggaaaacgacatgaagttcactgtcgtggttggcgacgcaaatgggatccttgctcaaggcaagaaaatgattcggcctcagcccatggagcacaaatactcttggaagtcgtggggcaaggccaaaatcataggggcggatatccagaacaccacatttattatcgacggaccagatactcctgaatgtcccgacaatcagcgcgcctggaacatttgggaggtggaggattatggcttcggtatctttaccacaaatatatggttgaagctcagagacagctacacgcaaatgtgcgatcacaggctgatgtccgctgcaattaaagactcaaaggccgtccatgctgatatggggtattggatcgaaagtgagaaaaacgaaacctggaagctagcccgtgcatctttcattgaggtgaagacttgtacatggccaaaaagccacaccctgtggtccaatggagttctcgaatcagagatgatcatacccaagatctacggcggtcctattagccagcataactatcggccaggctacttcactcagacagcggggccgtggcacctgggaaaacttgagttggactttgatctgtgcgaaggcaccacggtggtagtcgacgagcactgcgggaatcgaggaccctctttaagaactaccacagtgaccggcaagatcattcatgaatggtgttgcaggtcctgtactctccctccactgcgcttccggggtgaggatgggtgctggtacggaatggagatcagacccgtgaaagaaaaggaggaaaaccttgtcaggagtatggttagcgccggctctggtgaggtggactccttttcactgggcatattgtgtgctagtattatgatcgaagaggtaatgcgcagccgatggtcgcggaagatgctcatgacagggaccctggccgtgttcctactgctcatcatgggacaactgacatggaatgaccttattcgtttgtgcatcatggtcggcgcaaacgcttccgatagaatggggatgggaactacctatctggccttaatggcaacgtttaaaatgaggcctatgttcgccgtgggcctcctgtttcgccggcttacatctagagaggttctgctactcaccattggtctgagcttggtggcttcagtcgaactgccaaacagtttagaggaactcggggacggactggcgatgggcataatgatgcttaagctgttgactgagttccagccccaccagctctggaccacactgctatccctgacttttatcaaaaccacgctttctctcgattacgcctggaagacaaccgcaatggctctgagcattgtgtccttgttcccgctgtgtttatcaactacaagccagaaaaccacttggctccctgttctgcttggcagttttgggtgcaagccactgacaatgttcttgatcaccgaaaatcaaatttggggaaggaagtcttggcccctcaacgagggtatcatggccataggcatcgtgtccattctgctaagctcgctgcttaaaaatgacgtccctctcgccgggcccctgatcgctggaggcatgttgattgcatgttatgtaatctcaggttctagtgccgatttatccctggagaagacggcggaagtgagctgggagcaggaagctgagcattctgggactagccacaacatactcgttgaagtgcaggacgatggaaccatgaaaattaaggacgaggagcgagatgacacactgaccatccttctgaaagccacattgctagcagtctccggcgtgtacccaatgtcaatccctgccactctgtttgtatggtatttctggcagaagaaaaagcaacgcagtggcgtgctctgggatacccccagcccaccggaagtcgagcgggctgttctggacgatgggatttacagaatacttcagaggggattactgggtcgttctcaggtgggcgtgggggtcttccaggacggagtgtttcatacgatgtggcacgttacacgcggcgcagtactcatgtatcaaggtaagcggttggaaccttcctgggcctcagtgaaaaaggacctgatcagttacgggggaggctggagattccagggcagctggaatactggggaggaggtccaggtgattgcggttgaacccggcaagaacccaaagaatgtgcaaaccacacccggtacctttaaaactcctgagggcgaagtcggggctatcgccctcgatttcaagccaggaacctccggctctcccattgtgaacagggagggtaagatcgtagggctgtacggaaatggcgtcgtgacaacgtcgggcacttatgttagcgcaatagcccaggctaaagcctcacaggaagggcctcttccggagatcgaggacgaagtgtttaagaaacgaaacctgaccattatggatttgcacccaggatccggtaagacacggcgctacctacccgcaatcgtcagagaggctattaaaaggaagctgcggaccctcatcttagcccctactcgagtggttgcgagtgaaatggccgaggcactgaagggcatgccaataagatatcagacaaccgctgtgaaatctgaacatacggggcgcgagattgtcgaccttatgtgccacgccactttcacaatgaggctgctcagccccgtgcgtgtacctaattacaacatgatcatcatggatgaggctcattttaccgacccggcatccattgccgcccggggatatatctcaaccagagtgggcatgggtgaagctgcggcaatattcatgactgccacacccccagggtctgttgaggcttttcctcaaagcaatgccgtcattcaggatgaagagagggacatccccgaacgcagttggaactccggatacgattggattaccgacttcccaggcaagacagtgtggtttgtgcctagcatcaaatctggcaatgatatagcaaactgtttgcgaaagaacgggaaaagagtcattcagctgtcacggaagactttcgacacggagtatcagaagaccaaaaataacgactgggattacgtagtgacaactgacatctccgagatgggagccaatttcagggctgatcgcgttatcgacccccgtagatgcctcaagccagtgattctgaaagatggtccggaacgggtcatccttgcgggccctatgcccgtgaccgttgccagtgcagctcaaaggcgcgggcgaattggaagaaaccagaataaggagggcgaccagtacgtgtatatgggtcagccactaaacaatgatgaagaccacgcccattggacagaggcaaaaatgctgttggataacataaatacccccgaggggatcattcctgccttatttgaaccagagcgggaaaagagcgctgccatcgacggcgagtacaggctgcgcggagaagcgagaaagactttcgtcgagctcatgaggcggggcgatctgcccgtgtggctttcgtataaagtagcatctgaggggtttcaatactccgaccgtcgctggtgcttcgatggagaacgaaacaatcaggtgctggaggaaaacatggacgttgagatctggacgaaggaaggtgagaggaaaaagctcaggcctcggtggttggacgcccgcacctatagcgatccgctggctctaagagagtttaaagagttcgccgctggcaggcggtcagtcagtggggacctgattctcgagataggaaaacttccacagcacctgacattacgagcacagaatgccttggataacctggtgatgctccacaattctgaacaaggcggtaaggcttacagacatgccatggaggaactgcccgacactatcgagacccttatgctgctcgcattgattgcggtgctgacagggggcgtcaccttatttttcctatccggaaagggcctggggaagactagcatcggactcctttgtgttacagcctcaagtgctctgttgtggatggccagcgtggagcctcactggattgcagcttccatcatactggaatttttcctcatggtactgcttatccccgagccagatcgccagaggacgcctcaggacaaccaactcgcctatgtggtcattggtctgttgtttatgatcctgaccgtggcagccaacgaaatgggcttactagagactaccaaaaaggatctggggattggacatgttgctgcggagaatcaccagcacgccaccatgctcgacgtggatcttcggcccgcatctgcttggaccctgtacgccgtcgccacaactgtaatcacgccaatgatgcgtcataccatagaaaacacaactgcaaatattagcttgaccgctatcgccaaccaggcggctattctgatgggcctcgacaaaggttggcctatctccaagatggatataggggtgccgctgcttgccttaggctgctactcacaggttaatcccctgacactcaccgcagccgtgttgatgctggtcgctcactatgcaatcattggaccaggcctacaagccaaagcgactagagaggctcagaagaggacggccgcagggatcatgaagaaccctacagtggacggaattgtcgccatcgatctggaccccgtggtttacgacgctaaattcgaaaagcagctcggccagataatgcttctgattttgtgtacctctcaaatcctgctcatgcgcactacctgggccctgtgcgagagtatcacattagcaactggtccacttaccacactgtgggaagggtcgcctggaaaattttggaatacgaccattgctgtgagcatggccaacatcttccggggctcctatctcgcgggtgccggcctagcattctctctgatgaagtcactagggggaggccgaagagggactggagctcagggcgagacactgggtgagaaatggaagaggcagctcaatcagcttagcaagtccgaatttaacacctacaaacgcagtgggataatggaggtagatcggtctgaagccaaggagggactgaaaagaggcgaaactacaaagcatgcagtgagccgtggtaccgctaaattgaggtggttcgtcgagcggaatctggttaagcccgagggcaaggtgattgacctcgggtgtggacgcggcgggtggtcatattactgcgccggactgaaaaaggtcacggaagtgaaaggctataccaagggtgggccgggacacgaggaaccaatcctaatggccacatacggctggaaccttgtagagctgcattccggcaaagatgtgtttttcatgcctcccgaaaagtgtgacactctactctgcgatattggggagagtagcccaaatcccaccatcgaggaaggacgaacactgagagttttgaaaatggtggagccttggctgaggggtaaccaattttgtataaagatcctcaatccgtacatgccctctgtcgtggaaactcttgagcagatgcagcggaagcacggcgggatgctggtccgcaacccattatccagaaattcaacccacgagatgtattgggtgagctgcggaacaggcaacattgtttcggcggtaaacatgacctctaggatgctgttgaatcgattcactatggctcatcggaaacctacgtttgaacgtgacgtggatctcggtgcagggacaagacacgtcgccgtggagcccgaagttgctaacctggacatcattggacaacgcatcgagaatattaagaacgaacataaaagtacctggcactacgatgaggacaatccttataagacttgggcctaccacggctcctatgaggtgaaaccaagcggctcagcatcctctatggtcaacggggtggtaaggctacttaccaagccctgggatgtgatccctatggttacacagatagccatgacggacaccactccattcggacagcagcgggtctttaaggaaaaagtggacacaagaacaccccgcgctaagaggggtactacacaaattatggaggtgaccgcgaaatggctgtggggcttcctcagccgaaataagaaaccgcggatctgtacaagagaagagtttactaggaaggtccgcagtaacgccgcaatcggggctgttttcgtggatgaaaatcagtggaactccgccaaggaggcagtagaggacgaacgtttttgggatctggtgcatcgggagagagaattgcacaaacagggaaagtgcgcaacctgcgtctacaatatgatgggcaaaagggagaagaaactgggtgagttcgggaaggctaagggaagccgcgccatttggtatatgtggctcggcgcgcgattccttgagtttgaggcactgggcttcatgaacgaagaccattggttttctcgggaaaattcattaagtggggtggaaggagagggtctgcacaaattgggctacatactcagagatatctccaagattcctgggggaaacatgtacgccgacgatacggctggctgggacaccaggatcacagaggatgacctgcagaatgaagccaaaattactgatatcatggagccagaacatgcactacttgctaccagcatattcaagctgacatatcaaaacaaagttgtgcgcgtccagagacccgccaagaacggtactgtgatggacgtaatctctcggagggatcagcgtgggtcgggacaggttggcacctacggcctcaatacgtttacaaacatggaggtgcaactgattcgacagatggaatcagaggggatcttcttgcctagcgagttagaaaccccaaatctggctgagcgcgtcctcgactggcttgaaaaacacggagccgagagactgaagcggatggcaatttccggtgacgattgtgtggtgaagcccatcgacgataggtttgcgactgccctaacagctctgaacgacatgggcaaagtccgcaaggatataccgcagtgggaacctagtaaagggtggaatgactggcagcaagttcccttctgctctcaccattttcaccagctcattatgaaggatggaagagagatcgtggtaccatgtcggaaccaggacgagttggtgggcagggcccgagtcagccaaggtgcagggtggtccctgcgtgaaaccgcttgccttggaaaatcatatgcccagatgtggcagctgatgtacttccatagacgcgatctccggttagcagccaatgcgatctgtagtgctgtgcctgttgactgggtgcccacttctaggaccacatggagcattcacgcccaccatcagtggatgacgaccgaggatatgctgtccgtctggaacagagtgtggatagaagagaatccatggatggaagacaagactcacgtatcaagctgggaggaggttccctatttgggcaagcgcgaagaccaatggtgcggctctctgatcgggctcacagcacgggccacctgggctactaacattcaggtggccatcaatcaggtcaggcgacttattggaaacgagaattacctggattatatgacatccatgaaaagatttaagaacgaaagtgaccctgagggtgcactatggtga

SEQ ID NO: 13334 - RNA, 9879 nt, synthetic construct
  misc_feature 1..9879: note = derived and/or modified CDS sequence (opt3) from DENV-1__HQ166035__SS-prME
  source 1..9879: mol_type = other RNA
agcgtgaccatgctgctcatgcttctgcccacagcattggctttccacttaactacgaggggaggggagcctcatatgatcgtctccaagcaggaaaggggaaaatctctgctatttaagacctcagccggtgttaacatgtgcacactcattgccatggacctgggagagctttgtgaagatactatgacctacaaatgcccacagataacagaggcggaaccggacgatgtggactgttggtgcaatgctaccgatacttgggtaacatatgggacctgtagtcagacgggagagcaccggcgcgacaagcgaagcgtggccctggcaccccatgtcggcttgggtctcgagactcgtaccgaaacatggatgtcctctgagggggcctggaaacagatccagagagtggaaacttgggctctgaggcaccctggattcaccgttattgcactgtttctcgcccatgctatcggcacatcgattacccaaaagggcatcatattcatcttactgatgcttgtgacgccatcaatggccatgcggtgcgtcgggattggaaaccgcgattttgtggagggtttgagcggcgcgacttgggtagacgttgtgctggagcacgggagttgtgtcacaaccatggcaaagaataaacccactctagatatcgaactcctgaagacagaggtgaccaaccctgccattcttagaaaactgtgcatcgaagctaagatatccaatacgaccacagactctaggtgtccaactcagggagaggccaccttggtggaggaacaggatgcaaacttcgtctgccggcgcacatttgttgaccgaggctggggtaatgggtgtggactcttcggcaaaggcagcctgttaacttgcgctaagtttaagtgcgtgaccaaactggaggggaagattgtacagtacgaaaacctcaaatattccgtgatcgtcacagtgcacaccggagatcaacatcaggttggtaatgagactacggaacacggcacaattgccaccatcactccccaggcgcctacctcagagatcagacttacagactacggggccctgaccttggactgtagtccaaggactggactagatttcaacgaaatggtgctgctcacaatgaaggagaaaagctggctggtccataagcagtggtttcttgacctgccgttgccctggacgtctggcgcatccacctcacaagagacttggaatcggcaggatctcctggtgacattcaaaaccgctcacgccaagaagcaggaagtagttgtgttaggtagccaagagggggctatgcacacagccctgactggcgcaaccgaaattcagacgagtggaaccacaactatatttgccggccatctaaaatgccgtctcaagatggacaaactgacccttaaggggacatcttatgtcatgtgtactggatccttcaaattggagaaggaagtggctgagacccagcacggtacggtcctggtgcaggttaagtacgagggcacagatgcgccttgcaaaatcccattcagcacccaagacgaaaagggggtgactcagaacggacgcctcattacagcaaatcccatcgtaaccgataaagagaagcctgtcaacatagaaactgagccaccctttggcgagtcgtatattgtggttggtgccggggaaaaagctctgaaactttcttggttcaagaaaggctcctcaatcggaaagatgtttgaggccaccgcaagaggcgccaggcggatggctatcctgggggacacagcctgggatttcggaagtattggtggcgtgtttacgagcgtcgggaaattggtgcatcaggtattcggaaccgcatacggcgtgctcttttccggtgtttcttggactatgaagatcgggattggcatactgttaacatggctgggactaaatagccgatcaaccagtctctccatgacatgtatcgcggtcggcatggtgactctgtaccttggggtgatggtccaggctgacagcggatgcgttattaactggaaaggccgcgaattgaagtgtggttctgggatcttcgtgaccaacgaggtgcacacgtggacagaacaatataagtttcaggccgattcaccgaaaagactgagtgcagccatcggaaaggcttgggaggagggcgtatgcggtattaggagcgccacccggctcgaaaatataatgtggaaacagatctccaacgagctgaatcatattttactggaaaacgacatgaagttcactgtcgtggttggcgacgcaaatgggatccttgctcagggcaagaagatgattcgccctcaacccatggagcacaaatactcttggaagtcgtggggcaaggccaaaatcataggggcggatatccagaacaccacatttattatcgacggaccagatactcctgaatgtcccgacaatcagagagcctggaacatttgggaggtggaggattatggcttcggtatctttaccacaaatatatggttgaagctcagggacagctacacgcagatgtgcgatcaccgtctgatgtccgctgcaattaaagactcaaaggccgtccatgctgatatggggtattggatcgaaagtgagaaaaacgaaacctggaagctagcccgggcatctttcattgaggtgaagacttgtacatggccaaaaagccacaccctgtggtccaatggagttctcgaatcagagatgatcatacccaagatctacggcggtcctattagccaacataactatcgaccaggctacttcactcagacagcggggccgtggcacctgggaaaacttgagttggactttgatctgtgcgaaggcaccacggtggtagtcgacgagcactgcgggaatagaggaccctctttaaggactaccacagtgaccggcaagatcattcatgaatggtgttgccgctcctgtactctccctccactgcggttcagaggtgaggatgggtgctggtacggaatggagatcaggcccgtgaaagaaaaggaggaaaaccttgtccgcagtatggttagcgccggctctggtgaggtggactccttttcactgggcatattgtgtgtaagtattatgatcgaagaggtgatgcgaagccggtggtcgcgtaagatgctcatgacagggaccctggctgtcttcctactgctcgtgatgggacagctgacatggaatgaccttatcagattgtgcattatggttggcgccaacgcatccgataggatggggatgggaactacctatctggctttaatggccacgtttaaaatgcgccctatgttcgcagtgggcctcctgtttcggagacttacatctagggaggtcctgctactcaccatcggtctgagcttggtggcctcagttgaactgccaaacagtttagaggaactcggggacggactggctatgggcattatgatgcttaagctgttgactgagttccaaccccaccagctctggaccacactgctatccctgacttttataaaaaccacgctttctctcgattacgcgtggaagacaaccgccatggcactgagcatcgtgtccttgttcccgctgtgtttatcaactacaagccagaaaaccacttggctccctgtcctgcttggcagttttgggtgcaagccactgacaatgttcttgattaccgaaaataagatctggggacgaaaatcttggcccctcaacgagggtattatggctatcggcatagtatccatcctgctaagctcgctgcttaagaatgacgtgcctctcgccgggcccctgattgccggaggcatgttgatcgcttgttatgttatttcaggttctagtgcagatttatccctggagaaagccgcggaagtgagctgggagcaggaagctgagcattctgggacgagccacaacatcctcgtcgaagtgcaagacgatggaactatgaagataaaagacgaggagcgcgatgacaccctgacaattcttctgaaggccaccatgttggcagtatccggcgtgtacccaatgtcaatccctgccacaccctttgtctggtatttctggcagaaaaagaagcagcggatcagagttctatgggatactccaagtccgcctgaagtggagagggctgtgctggacgatggcatttaccgtatactccagcgcgggctgcttggacggagccaagtcggtgtgggcgttttccaggacggggtatttcataccatgtggcacgtgacgagaggagcagtcttaatgtatcagggcaaaaggctggaaccctcttgggcctccgtgaagaaagacctcatctcatacggtgggggatggcgattccagggcagttggaatacaggcgaggaggttcaagtgattgcggtcgaaccagggaagaaccccaaaaatgtgcagactacccctggaacatttaagaccccagagggtgaagtaggcgctatcgccttggatttcaagcccgggactagcggatcccctattgtcaaccgggaggagaagatcgtgggcctgtacggtaatggggttgtgaccacatctggaacgtatgtctcggcaatagcccaggctaaggccagccaagagggcccgctcccagagatcgaagacgaggtgtttaaaaagcgcaacctgactattatggatcttcaccccggctcagggaaaaccagaaggtacctgcctgcaatcgttcgggaagctattaagcgaaagttgagaacactaatcctggccccaacccgcgtggtcgcgtccgagatggccgaagcactcaaaggaatgcccataaggtatcagactacagctgtgaagagtgagcataccggtcgtgagattgtagacttaatgtgccacgccacgttcactatgcggctgctttctcctgtgagagttccgaattacaacatgatcatcatggatgaagctcattttacagaccccgcaagcattgccgccaggggctatatctccacccgcgtcgggatgggagaggctgcggcaatattcatgaccgccactccacctggctcagtggaggcttttccccagtctaatgccgtgattcaggatgaagaacgagacatcccagagagaagctggaacagtggttacgattggattacagacttccctgggaaaaccgtctggtttgtaccctccatcaagagcggaaatgatatagcaaactgtctgcggaaaaacggcaagagggtgattcaactctctcgcaagacattcgacactgagtatcagaaaacgaagaataacgactgggattacgttgtgaccacagacatctcagaaatgggcgccaatttccgtgctgatagagtcatcgacccacggaggtgcttgaaaccggtgattctgaaggatgggcctgagcgcgttatcctcgcgggacccatgccagtgactgtcgcctccgcagctcagcgaagaggtcggattggcaggaaccagaataaagaaggggaccaatacgtgtatatgggacagcccctgaacaatgatgaggaccacgcccattggaccgaggcaaagatgcttctagataacataaatacacctgaaggcatcattccagccctgtttgagcccgaacgcgagaagagtgctgccatcgacggtgaatacagattgaggggcgaagcgcggaaaaccttcgtagagttaatgcgtcgcggggatctgcctgtgtggctcagctataaggttgcatcggaaggatttcagtactctgaccgaagatggtgcttcgatggcgagaggaacaatcaggtcctggaagagaacatggacgtggaaatctggactaaagagggggagcggaagaaacttcgcccgagatggctggacgccaggacgtattccgatccactcgctttgcgggaatttaaggagttcgccgctggacgaagaagcgtgtcaggtgacctgattctagaaataggcaaactgccccaacacctcacccttcgcgcacagaatgccctggataacttagtcatgttgcacaatagtgagcaagggggaaaggcttacaggcatgccatggaggaactgcctgacacaatcgagactctcatgctgcttgcactgattgcggttctcaccggcggtgtgacattgtttttcctgtctgggaagggcttaggaaaaacctccatcggcctactgtgtgtaactgccagctcagctctcctttggatggccagtgtggaaccccactggattgcagctagcatcatactggagtttttcttgatggtcctgctcatcccagaacctgatcggcagcgtacaccccaagacaaccagctggcctatgtggttattgggcttctctttatgatcctgacggtggcagccaacgagatgggattgctggagaccactaagaaagatttaggtattggccatgtcgctgcggaaaatcaccagcacgccacaatgctagacgtagatctgagaccagcatccgcttggaccctctacgccgtggccaccacagttatcactcctatgatgaggcatacgatagagaacaccacagcaaatatttctcttactgctatcgccaaccaagcggctattctgatggggttggacaagggatggccgatcagcaaaatggatataggcgtgcccctgctcgccctgggttgctactcccaggtcaatccacttaccttaacagcagccgtgctgatgctcgtcgctcactatgcaatcattgggcctggcttgcaggccaaggcgacccgcgaagctcagaagcggactgccgcaggaatcatgaaaaaccccacggtggacggcattgttgccatcgatctggacccagtggtatacgacgctaagttcgagaaacaactagggcagataatgctgctcattctttgtacatcacagatcctgttgatgcgaaccacttgggccctgtgcgaatctatcaccctcgcaacaggacctctgactaccttatgggagggcagtcccggtaagttttggaatacaacgattgctgtgtcgatggccaacatcttcagagggagctatcttgcgggagccggcctggcattctccctcatgaaatctctaggtggcgggaggcgcggaaccggcgctcagggggagactctgggagaaaagtggaagcggcaattgaatcagctgtcaaaaagcgagtttaacacatacaagagatccggcataatggaagtcgatcgtagtgaggccaaagaaggtctcaagagaggggaaaccactaaacatgcagtttctcggggaacagctaaacttcgctggttcgtggagcgaaatctggtcaagccggaaggcaaagtgattgacttgggttgtggcagagggggatggagctattactgcgccggcctgaagaaagtaaccgaggtgaaggggtatacgaaaggaggcccaggtcacgaggagcctatccccatggccacctacgggtggaacctcgttaagttacattcaggaaaagatgtgtttttcatgccacccgaaaagtgtgacacactgctttgcgatattggcgagtccagtcctaatccgactatcgaggaaggcaggaccctgcgggtcctaaagatggtggagccctggctccgcgggaaccagttttgtataaaaatcctgaatccatacatgcctagcgtcgtggaagcgttggagcagatgcaaagaaagcacggaggtatgctggttaggaaccccctctctcgaaattccacacacgagatgtattgggtatcatgcggcactgggaacattgtgagcgctgtcaacatgacctcgcggatgcttctgaatcgtttcacaatggcacatagaaaacctacctacgaacgcgacgtggatttaggagccggcactaggcacgttgctgtggagccagaagtcgccaacctggacatcattggtcagcggatcgagaatattaagaacgaacataaatctacgtggcactatgatgaggacaatccctacaagacatgggcatatcacgggagttacgaggtgaagccttccggaagcgcctcatccatggtaaacggcgtggttagattgctcaccaaaccatgggatgtcatccccatggtgactcagatagctatgaccgacacaacgccgtttggccaacagcgcgtgttcaaggaaaaagtcgacaccaggactcctcgagcgaagcgggggacaacccagattatggaggttactgccaaatggctgtggggatttctatctagaaataagaagccaaggatctgtacacgcgaagagttcacccgtaaagtgcggagcaacgcagctatcggtgccgtatttgtggatgaaaatcagtggaacagtgcaaaggaggccgtcgaggacgaaagattctgggatcttgtgcatagggagcgcgaactgcacaaacaaggcaagtgcgctacatgcgtttataatatgatggggaaacgagagaagaagctcggagaatttggcaaagccaagggttcccgggcgatttggtacatgtggctgggggcaagattcttggagttcgaggccctgggatttatgaacgaagaccattggttcagcagggaaaattctctctcaggcgtggaaggcgaggggcttcacaaactgggatacatattacgcgatatcagtaagattcccggtggcaacatgtatgctgacgatactgccgggtgggacaccagaatcacggaggatgacctgcagaatgaagcaaaaattaccgagatcatggaacctgagcatgctttgctcgccacatccatatttaagctgacttaccagaacaaagtcgtgcgggtacagaggccagctaagaacggaaccgttatggatgtgatcagccgtcgagaccaacgcggctctggtcaggtcgggacatatggactaaatactttcaccaacatggaagtgcagcttattagacagatggagtcggagggcatctttctgccctcagaactcgagacgccgaatctggccgaacgggtgttggattggttagagaagcacggcgcagaaaggctgaaacgcatggcgattagcggggacgactgtgtcgttaagcctatcgatgacagattcgccacagctctcaccgcccttaacgatatgggaaaagtgcggaaggacataccccaatgggagccatccaaaggttggaatgattggcagcaggtacctttttgcagtcaccatttccaccagctgattatgaaggacggcagggagatcgtggtcccctgtcgaaaccaagatgagctagtggggcgtgcaagagtttctcagggagctggctggagcctgcgcgagactgcctgcctcggtaagtcctacgcacagatgtggcaattgatgtattttcatcggagggacctgagacttgccgcgaatgctatctgttcagccgtgccagtcgattgggtgcccacaagtcgcaccacttggtctattcacgcacaccatcagtggatgaccacagaagacatgctgagcgtatggaaccgggtttggatagaggaaaatccttggatggaggataaaacgcacgtgtcctcatgggaggaagtcccatacctcgggaagagggaggaccagtggtgcggcagcttaatcggcctgaccgcccgagctacttgggccacaaacattcaggtggcaatcaatcaagttagacggttgattggcaacgaaaattatctggactacatgacctctatgaaaaggttcaagaacgagtccgatccggagggggctctctggtga

SEQ ID NO: 13335 - RNA, 9879 nt, synthetic construct
  misc_feature 1..9879: note = derived and/or modified CDS sequence (opt3) from DENV-1__GQ868502__SS-prME
  source 1..9879: mol_type = other RNA
agcgtgaccatgctgctcatgcttctgcccacagccttggctttccacttaactacgagaggcggggagcctcatatgatcgtctccaagcaggaaaggggaaaatctctgctatttaagacctcagcaggtgttaacatgtgcacactcattgccatggacctgggcgagctttgtgaagatactatgacctacaaatgcccacaaataacagaggcggaaccggacgatgtggactgttggtgcaatgctaccgatacttgggtaacatatgggacctgtagtcagacgggagagcaccggcgcgacaagcgaagcgtggccctggcaccccatgtcggcttgggtctcgagactcgtaccgaaacatggatgtcctctgagggggcctggaaacagatccagagagtggaaacttgggctctgaggcaccctggattcaccgttattgcactgtttctcgcccatgctatcggcacatcgattacccaaaagggcacgatcttcatattactgatgcttgccactccatcaatggcgatgcggtgcgtggggatcggaaaccgcgattttgtcgagggtttgagcggcgcaacatgggtggacgtagttctggagcacgggagttgtgtgaccactatggccaagaataaacccacactagatattgaactcctgaagaccgaggtcacgaaccctgctatccttagaaaactgtgcattgaagccaagatctccaataccacaactgactctaggtgtccaacccagggagaggcaacattggtggaagagcaggatgctaacttcgtgtgccggcgcacttttgtcgaccgaggctggggtaatgggtgtggactcttcggcaaaggcagcctgttaacctgcgccaagtttaagtgcgttacaaaactggaggggaagaccgtgcagtacgaaaacctcaaatattccgtaatagtgactgtccacacgggagatcaacatcaggtgggtaatgagacaaccgaacacggcactattgcgaccatcacaccccaggcccctacctcagagattcagcttactgactacggggcactgacattggactgtagtccaagaacgggactagatttcaacgaaatggttctgctcaccatgaaggagaaaagctggctggtgcataagcaatggtttcttgacctgccgttgccctggacttctggcgcttccacatcacaggagacctggaataggcaggatctcctggtcacattcaaaactgcccacgctaagaagcaagaagtggtagttttaggtagccaggagggggccatgcacaccgcactgacgggcgccaccgaaatccagacaagtggaactaccacaatctttgctggccatctaaaatgccggctcaagatggacaaactgactcttaaggggacctcttatgtgatgtgtacgggatccttcaaattggagaaggaagtcgcggagacacagcacggtaccgtgctggtccaagtgaagtacgagggcactgatgcaccttgcaaaattccattcagcacacaggacgaaaagggggttacccagaacggacgtctcataactgccaatcccatcgtgaccgataaagagaagcctgtaaacattgaaacagagccaccctttggcgagtcgtatatcgtcgtgggtgctggggaaaaagccctgaagctttcttggttcaagaaaggctcctcaataggaaagatgtttgaggcaacggcccgcggcgctagaaggatggccattctgggggacaccgcatgggatttcggaagtatcggtggcgtttttactagcgtggggaaattggtccatcaggtgttcggaacagcgtacggcgtactcttttccggtgtgtcttggaccatgaagatcgggattggcatcctgttaacatggctgggactaaatagccggtcaactagtctctccatgacctgtattgctgttggcatggtcacgctgtaccttggggtgatggtgcaagccgacagcggatgcgtcataaactggaaaggccgagaattgaagtgtggttctgggatcttcgttacaaacgaggtgcacacctggactgaacagtataagtttcaggcagattcaccgaaacgcctgagtgccgctattggaaaggcctgggaggagggcgtgtgcggtatcagaagcgcaaccaggctcgaaaatatcatgtggaaacagatttccaacgagctgaatcatatattactggaaaacgacatgaagttcacagtagtcgtgggcgacgctaatgggatccttgcccaaggaaaaaagatgattcggcctcagcccatggagcacaaatactcttggaagtcgtggggcaaggcgaaaatcattggggccgatatccagaacactacctttataatcgacggaccagatacacctgaatgtcccgacaatcagcgcgcttggaacatttgggaggttgaggattatggcttcggtatctttacgaccaatatttggttgaagctcagagacagctacactcaaatgtgcgatcacaggctgatgtccgcagccatcaaagactcaaaggctgtgcatgccgatatggggtattggatagaaagtgagaaaaacgaaacatggaagctagcacgtgcgtctttcattgaggtcaagacctgtacttggccaaaaagccacacactgtggtccaatggagtgctcgaatcagagatgatcattcccaagatctacggcggtcctataagccagcataactatcggccaggctacttcacccagacggccgggccgtggcacctgggaaaacttgagttggactttgatctgtgcgaaggcactaccgttgtggtagacgagcactgcgggaatcgaggaccctctttaagaacaaccactgtcacaggcaagatcattcatgaatggtgttgcaggtcctgtaccctccctccactgcgcttccggggtgaggatgggtgctggtacggaatggagatcagacccgtgaaagaaaaggaggaaaaccttgtgaggagtatggtcagcgctggctctggtgaggttgactccttttcactgggcattttgtgtgccagtatcatgatagaagaggtgatgcgcagccgatggtcgcggaagatgctcatgacagggactctggcagtattcctactgctcgtgatgggacaactgacctggaatgaccttattcgtttgtgcatcatggtcggcgctaacgcctccgatagaatggggatgggaacgacatatctggcattaatggccacctttaaaatgaggcctatgttcgctgtgggcctcctgtttcgccggcttacttctagagaggttctgctactcaccatcggtctgagcttggtggcgtcagtcgaactgccaaacagtttagaggaactcggggacggactggccatgggcattatgatgcttaagctgttgacagagttccagccccaccagctctggactaccctgctatccctgacgtttatcaaaacaaccctttctctcgattacgcatggaagactacagctatggccctgagcattgtgtccttgttcccgctgtgtttatcaaccactagccagaaaacaacctggctccctgttctgcttggcagttttgggtgcaagccactgacgatgttcttgataactgaaaataagatctggggaaggaaatcttggcccctcaacgagggtattatggccatcggcattgtgtccatcctgctaagctcgctgcttaagaatgacgtccctctcgctgggcccctgatagcaggaggcatgttgatcgcctgttatgtaatttcaggttctagtgcggatttatccctggagaaagctgccgaagtgagctgggagcaagaagcagagcattctgggaccagccacaacatcctcgttgaagtgcaggacgatggaacaatgaagattaaagacgaggagcgagatgacaccctgacaatccttctgaaggccactttgctagctgtctccggcgtgtacccaatgtcaatacctgcaaccctgtttgtatggtatttctggcagaaaaagaagcagcgcagtggcgtgctctgggatacgcccagcccaccggaagtcgagcgggccgttctggacgatgggatttacagaatccttcaaaggggattactgggtcgttctcaggtgggcgtgggggtcttccaggacggagtgtttcatacaatgtggcacgttactcgcggcgcggtactcatgtatcagggtaaacggttggaaccttcctgggcttcagtgaagaaagacctgatcagttacgggggaggctggagattccaaggcagctggaataccggggaggaggtccaggtgattgccgttgaacccggaaagaacccaaaaaatgtgcagacaacccccggtacttttaagacccctgagggcgaagtcggggcaatagccctcgatttcaagccaggaacatccggctctcccatcgtgaacagggagggtaaaattgtagggctgtacggaaatggcgtcgtgacgacttcgggcacctatgttagcgctatcgcccaagcaaaggcttcacaggaagggcctcttccggagattgaggacgaagtgtttaaaaagcgaaacctgacaatcatggatttgcacccaggatccggtaaaacccggcgctacctacccgccatggtcagagaggcgataaagaggaagctgcggactctcatcttagcccctacacgagtggttgcaagtgaaatggctgaggccctgaaaggcatgccaattagatatcagaccacggctgtgaagtctgaacatactgggcgcgagatcgtcgaccttatgtgccacgcaacattcaccatgaggctgctcagccccgtgcgtgtacctaattacaacatgattatcatggatgaggcccattttaccgacccggcctccatagctgcgcggggatatatttcaactagagtgggcatgggtgaagcagccgctatcttcatgacagccacccccccagggtctgttgaggcatttcctcagagcaatgccgtcatccaagatgaagagagggacattcccgaacgcagttggaactccggatacgattggatcacagacttcccaggcaaaactgtgtggtttgtgcctagcataaagtctggcaatgatattgctaactgtttgcgaaaaaacgggaagagagtcatccagctgtcacggaagacgttcgacaccgagtatcagaaaacaaagaataacgactgggattacgtagtgactaccgacatttccgagatgggagcgaatttcagggccgatcgcgttatcgacccccgtagatgcctcaaaccagtgatactgaaggatggtccggaacgggtcattcttgcaggccctatgcccgtgacagttgctagtgccgcacagaggcgcgggcgaatcggaagaaaccaaaataaagagggcgaccagtacgtgtatatgggtcagccactaaacaatgatgaagaccacgcccattggaccgaggctaagatgctgttggataacatcaatactcccgaggggattatccctgccttatttgaaccagagcgggaaaagagcgcggcaattgacggcgagtacaggctgcgcggagaagccagaaaaacgttcgtcgagctcatgaggcggggcgatctgcccgtgtggctttcgtataaggtagcttctgaggggtttcagtactccgaccgtcgctggtgcttcgatggagaacgaaacaatcaagtgctggaggaaaacatggacgttgagatatggaccaaagaaggtgagagaaagaaactcaggcctcggtggttggacgcccgcacatatagcgatccgctggctctaagagagtttaaggaattcgcagccggcaggcggtcagtcagtggggacctgatcctcgagattggaaaacttccacagcacctgactttacgagctcagaatgccttggataacctggtgatgctccacaattctgaacagggcggtaaggcatacagacatgcgatggaggaactgcccgacaccatcgagacacttatgctgctcgccttgatcgctgtgctgaccgggggcgtcactttatttttcctatccggaaagggcctggggaaaacaagcattggactcctttgtgttacggcctcaagtgcactgttgtggatggctagcgtggagcctcactggatagccgcatccatcattctggaatttttcctcatggtactgcttatccccgagccagatcgccaaaggacccctcaggacaaccagctcgcctatgtggtcattggtctgttgtttatgatcctgactgtggctgcgaacgaaatgggcttactagagacaaccaagaaagatctggggataggacatgttgccgcagagaatcaccaacacgctaccatgctcgacgtggatcttcggcccgcctctgcctggacactgtacgcagtcgctactacggtaatcaccccaatgatgcgtcatacaattgaaaacactaccgccaatatcagcttgacagcgattgctaaccaggccgcaatcctgatgggcctcgacaagggttggcctatatccaaaatggatattggggtgccgctgcttgccttaggctgctactcacaggttaatcccctgaccctcactgctgcagtgttgatgctggtcgcccactatgcgatcattggaccaggcctacaggctaaggccacgagagaggcacaaaagaggacagccgctgggatcatgaaaaaccctaccgtggacggaatagtcgccatcgatctggaccccgtggtttacgacgcaaagttcgaaaaacagctcggccagattatgcttctgatcttgtgtacttctcagattctgctcatgcgcaccacatgggctctgtgcgagagtatcactttagccaccggtccacttacaacgctgtgggaagggtcgcctggaaagttttggaataccactatagcggtgagcatggccaacattttccggggctcctatctcgcaggtgctggcctagccttctctctgatgaaatcattggggggaggccgaagagggacaggagcacaaggcgagaccctgggtgagaagtggaagaggcagctcaatcagcttagcaaatccgaatttaacacttacaagcgcagtgggatcatggaggtagatcggtctgaagctaaagagggactgaagagaggcgaaacaaccaaacatgccgtgagccgtggtacggccaagttgaggtggttcgtcgagcggaatctggttaagcccgagggcaaagtgatcgacctcgggtgtggacgcggcgggtggtcatattactgcgcgggattaaagaaagtcaccgaagtgaagggctatacaaaaggtgggccgggacacgaggaaccaattcctatggctacttacggctggaacctggtaaagcttcattccggcaaagatgtgtttttcatgcccccagagaagtgtgacaccctgctatgcgatatcggggaaagtagccccaatcctacaatagaggagggacgaactctcagagttctgaagatggtggaaccgtggttgaggggtaaccagttttgtattaaaatcctgaatccctacatgccatctgtcgtggagaccctcgaacaaatgcagcggaagcacggcgggatgcttgtccgcaaccctctgtccagaaattcaacacacgagatgtattgggtgagctgcggaaccggcaacattgtttcggcagtaaacatgacttctaggatgttactgaatcgattcacgatggcccatcggaaacccacatacgagcgtgacgtggatttgggtgctgggaccagacacgtcgccgtggaacctgaggttgcaaacctcgacatcataggacagcgcatcgaaaatattaagaacgagcataaaagtacttggcactatgatgaagacaatccatacaagacctgggcctatcacggctcctacgaggtgaagcccagcggctcagcttcctctatggtcaacggggtggtaaggctgctaacaaaaccttgggatgtgatcccaatggttacgcaaattgcgatgaccgacactacaccctttggacagcagcgggtcttcaaggagaaagtggacaccagaactccgcgcgccaagaggggtacaacccagatcatggaagtgacagcaaaatggctttggggctttctgagccgaaataagaagcctcggatttgtactagagaggaattcaccaggaaagtccgcagtaacgctgccatcggggcagtttttgtggatgagaatcaatggaactccgccaaggaagctgtagaggacgagcgtttctgggatctcgtgcatcgggaaagagagctgcacaaacagggaaagtgcgccacgtgcgtctataatatgatgggcaaaagggaaaagaagttgggtgagtttgggaaagcgaagggaagccgcgcaatatggtacatgtggctgggcgcccgattcctcgaattcgaggctcttggctttatgaacgaggaccattggttctctcgggaaaattcactgagtggggtggagggagaaggtttacacaaactgggctacattttgagagatatctccaagatcccagggggaaacatgtatgccgacgataccgcaggctgggacacaaggattactgaggatgacctccagaatgaggctaaaataaccgaaatcatggagcccgaacatgccctgctagctacaagcatttttaagcttacttaccagaacaaagttgtgcgcgtccaaagacctgccaagaacggtaccgtgatggatgtaatctctcggagggaccagcgtgggtcgggacaggttggcacgtatggcctgaatacattcaccaacatggaggtgcagctcattcgacaaatggaatcagaggggatctttctgccaagcgagttggaaactcccaatttagcagagcgcgtcctggattggctcgaaaagcacggagcggagagacttaaacggatggccatatccggtgacgactgtgtggtgaagccgatcgatgacaggttcgctacagccctgaccgcactaaacgatatgggcaaagtccgcaaggacattcctcagtgggaacccagtaaagggtggaatgattggcagcaggttccattttgctctcaccatttccaccaactgatcatgaaggacggaagagagattgtggtaccttgtcggaaccaggatgagctcgtgggcagggctcgagtcagccagggtgccgggtggtccttgcgtgaaactgcatgcctgggaaagtcatacgcccaaatgtggcagcttatgtattttcatagacgcgacctgcggctcgcggctaatgccatctgtagtgcagtgcccgttgattgggtgccaacctctaggacaacgtggagcatacacgcccaccatcagtggatgaccactgaggacatgttatccgtctggaacagagtgtggattgaagagaatccctggatggaagataaaacacacgtatcaagctgggaggaggttccttacctgggcaagcgcgaagaccagtggtgcggctctttgatcgggctgaccgctcgggccacttgggcaacaaacatccaagtggctattaatcaggtcaggcgactcataggaaacgagaattatcttgactacatgacctccatgaaaagattcaagaacgaaagtgatccagagggtgccctgtggtga

SEQ ID NO: 13336 - RNA, 9879 nt, synthetic construct
  misc_feature 1..9879: note = derived and/or modified CDS sequence (opt3) from DENV-1__GQ868503__SS-prME
  source 1..9879: mol_type = other RNA
agcgtgaccatgctgctcatgcttctgcccacagcattggctttccacttaactacgagaggaggggagcctcatatgatcgtctccaagcaggaaaggggaaaatctctgttatttaagacctcagccggtgttaatatgtgcaccctcattgccatggacctgggagagctttgtgaagatactatgacctacaaatgcccacaaataacagaggcggaaccggacgatgtggactgttggtgcaatgctaccgatacttgggtaacatatgggacctgtagtcagacgggagagcaccggcgcgacaagcgaagcgtggccctggcaccccatgtcggcttgggtctcgagactcgtaccgaaacatggatgtcctctgagggggcctggaaacagatccagagagtggaaacttgggctctgaggcaccctggattcaccgttattgcactgtttctcgcccatgctatcggcacatcgattacccaaaagggcatcatattcatcttactgatgcttgtgacgccatcaatggccatgcggtgcgtcgggattggaaatcgcgattttgtggagggtttgagcggcgcgacttgggtagacgttgtgctggagcacgggagttgtgtcacaaccatggcaaagaataaacccactttggatatcgaactcctgaagacagaggtgaccaaccctgccattcttagaaaactgtgcatcgaagctaagatatccaatacgaccacagactctaggtgtccaactcagggagaggccaccttggtggaggaacaggatgcaaacttcgtctgccggcgcacatttgttgaccgaggctggggtaatgggtgtggactcttcggcaaaggcagcctgttaacttgcgctaagtttaagtgcgtgaccaaactggaggggaagattgtacagtacgaaaacctcaaatattccgtgatcgtcacagtgcacaccggagatcaacatcaggttggtaatgagactacggaacacggcacaattgccaccatcactccccaggcgcctacctcagagatccagcttacagactacggggccctgaccttggactgtagtccaagaactggactagatttcaacgaaatggtgctgctcacaatgaaggagaaaagctggctggtccataagcaatggtttcttgacctgccgttgccctggacgtctggcgcatccacctcacaggagacttggaataggcaggatctcctggtgacattcaaaaccgctcacgccaagaagcaagaagtagttgtgttaggtagccaggagggggctatgcacacagccctgactggcgcaaccgaaattcagacgagtggaaccacaactatatttgccggccatctaaaatgccggctcaagatggacaaactgacccttaaggggacatcttatgtcatgtgtactggatccttcaaattggagaaggaagtggctgagacccagcacggtacggtcctggtgcaagttaagtacgagggcacagatgcgccttgcaaaatcccattcagcacccagaacgaaaagggggtgactcagaatggacgtctcattacagcaaaccccatcgtaaccgacaaagagaagcctgtcaatatagaaactgagccaccctttggcgagtcgtatattgtggttggtgccggggaaaaagctctgaaactttcttggttcaagaaaggctcctcaatcggaaagatgtttgaggccaccgcacgcggcgccagaaggatggctatcctgggggatacagcctgggacttcggaagtattggtggcgtgtttacgagcgtcgggaaattggtgcatcaggtattcggaaccgcatacggcgtgctcttttccggtgtttcttggactatgaagatcgggattggcatactgttaacatggctgggactaaacagccggtcaaccagtctctccatgacatgtatcgcggtcggcatggtgactctgtaccttggggtgatggtccaagctgatagcggatgcgttattaactggaaaggccgagaattgaagtgtggttctgggatcttcgtgaccaatgaggtgcacacgtggacagaacagtataagtttcaggccgactcaccgaaacgcctgagtgcagccatcggaaaggcttgggaggagggcgtatgcggtattagaagcgccaccaggctcgaaaacataatgtggaaacagatctccaatgagctgaaccatattttactggaaaatgatatgaagttcactgtcgtggttggcgacgcaaacgggatccttgctcaaggcaagaaaatgattcggcctcagcccatggagcacaaatactcttggaagtcgtggggcaaggccaaaatcataggggcggacatccagaataccacatttattatcgatggaccagacactcctgaatgtcccgataaccagcgcgcctggaatatttgggaggtggaggactatggcttcggtatctttaccacaaacatatggttgaagctcagagatagctacacgcaaatgtgcgaccacaggctgatgtccgctgcaattaaagattcaaaggccgtccatgctgacatggggtattggatcgaaagtgagaaaaatgaaacctggaagctagagcgtgcctctttcattgaagtgaagacttgtacatggccaaaaagccacaccctgtggtccaacggagttctcgagtcagagatgatcatacccaagatctacggcggtcctattagccagcataattatcggccaggctacttcactcagacagcagggccgtggcacctgggaaaacttgaattggattttgacctgtgcgagggcaccacggtggtagtcgatgaacactgcgggaaccgaggaccctctttaagaactaccacagtgaccggcaagatcattcatgagtggtgttgcaggtcctgtactctccctccactgcgcttccggggtgaggacgggtgctggtacggaatggaaatcagacccgtgaaagagaaggaagagaatcttgtcaggagtatggttagcgcgggctctggtgaagtggattccttttcactgggcatattgtgtgccagtattatgatcgaggaggtaatgcgcagccgatggtcgcggaagatgctcatgacagggaccctggctgtgttcctactgctcatcatgggacaactgacatggaacgaccttattcgtttgtgcatcatggtcggcgccaacgcatccgacagaatggggatgggaactacctatctggctttaatggccacgtttaaaatgaggcctatgttcgcagtgggcctcctgtttcgccggcttacatctagagaagttctgctactcaccattggtctgagcttggtggcctcagtcgagctgccaaatagtttagaagaactcggggatggactggctatgggcataatgatgcttaagctgttgactgagttccagccccaccagctctggaccacactgctatccctgacttttatcaaaaccacgctttctctcgactacgcgtggaagacaaccgccatggcactgagcattgtgtccttgttcccgctgtgtttatcaactacaagccagaaaaccacttggctccctgttctgcttggcagttttgggtgcaagccactgacaatgttcttgatcaccgagaacaagatttggggaaggaaatcttggcccctcaatgagggtatcatggctataggcatcgtgtccattctgctaagctcgctgcttaagaacgatgtccctctcgccgggcccctgatcgccggaggcatgttgattgcttgttatgtaatctcaggttctagtgcagacttatccctggaaaaagccgcggaggtgagctgggaacaagaggctgaacattctgggacgagccacaatatactcgttgaggtgcaggatgacggaactatgaagattaaagatgaggaacgagacgataccctgacaatccttctgaaggccaccttgctagcagtctccggcgtgtacccaatgtcaatccctgccacactgtttgtatggtatttctggcagaaacgcaagcagcggagtggcgtgctctgggacactcccagcccaccggaggtcgaaagagctgttctggatgacgggatttacaggatacttcaacgtggattactgggtcgctctcaggtgggcgtgggggtcttccaggatggagtgtttcataccatgtggcacgttacgcggggcgcagtactcatgtatcagggtaagagattggagccttcctgggcctcagtgaaaaaggacctgatcagttacgggggaggctggaggttccaaggcagctggaacacaggggaggaagtccaggtgattgcggttgagcccggcaagaatccaaagaacgtgcagactacccccggtatctttaaaacacctgaaggcgaggtcggggctattgccctcgacttcaagccaggaacctccggctctcccatcgtgaatcgagaaggtaagatagtagggctgtacggaaacggcgtcgtgactacctcgggcacatatgttagcgcaatcgcccaagctaaagcctcacaggaggggcctcttccggagattgaagatgaggtgtttaagaaacggaatctgacgatcatggacttgcacccaggatccggtaagactcgcagatacctacccgcaattgtcagggaagctatcaaacggaagctgcgaaccctcatattagcccctacaagagtggttgcgagtgagatggccgaagcactgaagggcatgccaattcgctatcagaccactgctgtgaaatctgagcatacagggagggagatcgtcgatcttatgtgccacgccaccttcacgatgcgtctgctcagccccgtgcgggtacctaactacaatatgatcattatggacgaagctcattttactgatccggcatccatcgccgccagaggatatatatcaacaagggtgggcatgggtgaggctgcggcaattttcatgaccgccacacccccagggtctgttgaggcttttcctcagagcaacgccgtcatccaagacgaagaacgcgatattcccgagcgaagttggaactccggatacgactggatcactgatttcccaggcaagacagtgtggtttgtgcctagcataaaatctggcaacgacattgcaaactgtttgagaaagaatgggaaacgggtcatccagctgtcaaggaagaccttcgatacagagtatcagaagactaaaaacaatgactgggactacgtagtgacgaccgatatctccgaaatgggagccaacttccgcgctgaccgtgttattgatcccagacggtgcctcaagccagtgatcctgaaagacggtccggagagggtcattcttgcgggccctatgcccgtgacagttgccagtgcagctcagcgccgagggagaataggacggaatcaaaacaaggaaggcgatcagtacgtgtatatgggtcagccactaaataacgacgaggatcacgcccattggactgaggcaaaaatgctgttggacaatatcaacacccccgaagggattatccctgccttatttgagccagaaagggaaaagagcgctgccatcgatggcgaataccgcctgagaggagaggcgaggaagacattcgtcgagctcatgcggcgtggcgacctgcccgtgtggctttcgtataaagtagcatctgaagggtttcagtactccgatcgccgatggtgcttcgacggagagagaaataaccaagtgctggaagagaatatggatgttgaaatttggaccaaggagggtgagaggaaaaagctccggcctcgctggttggacgccagaacttatagcgacccgctggctctaagggaatttaaagagttcgccgctggccggcgatcagtcagtggggatctgatactcgaaatcggaaaacttccacagcacctgacgttaagagcacagaacgccttggacaatctggtgatgctccacaactctgagcagggcggtaaggcttaccgccatgccatggaggaactgcccgataccattgagacacttatgctgctcgcattgatcgcggtgctgactgggggcgtcaccttatttttcctatccggaaagggcctggggaagacaagcattggactcctttgtgttaccgcctcaagtgctctgttgtggatggccagcgtggaacctcactggatcgcagcttccataatcctggagtttttcctcatggtactgcttattcccgaaccagacaggcaacggactcctcaggataaccagctcgcctatgtggtcatcggtctgttgtttatgattctgacagtggcagccaatgagatgggcttactagagacgaccaaaaaggacctggggatcggacatgttgctgcggaaaaccaccaacacgccactatgctcgatgtggaccttcgtcccgcatctgcttggacactgtacgccgtcgccaccaccgtaataacaccaatgatgagacatactattgagaatacgaccgcaaacatcagcttgacagctattgccaatcaggcggctatcctgatgggcctcgataaaggttggcctatatccaagatggacatcggggtgccgctgcttgccttaggctgctactcacaggttaaccccctgactctcaccgcagccgtgttgatgctggtcgctcactatgcaattatcggaccaggcctacaggccaaagcgacaagggaagctcaaaagcgcaccgccgcagggattatgaagaatcctactgtggatggaatcgtcgccatagacctggatcccgtggtttacgacgctaaattcgagaagcagctcggccagattatgcttctgatcttgtgtacgtctcagatcctgctcatgcggacaacctgggccctgtgcgaaagtattactttagcaaccggtccacttacaactctgtgggaggggtcgcctggaaaattttggaacaccacaatcgctgtgagcatggccaatatattccgaggctcctatctcgcgggtgccggcctagcattctctctgatgaagtcactagggggaggcagaagggggacgggagctcaaggcgagaccctgggtgaaaaatggaagcgccagctcaaccagcttagcaagtccgagtttaatacttacaaacggagtgggattatggaagtagacagatctgaggccaaggaaggactgaaacgtggcgagacaaccaagcatgcagtgagcaggggtactgctaaattgcggtggttcgtcgagcgcaacctggttaagcccgaaggcaaggtgatcgatctcgggtgtggacgaggcgggtggtcatattactgcgccggactgaaaaaggtcacagaggtgaaaggctataccaagggtgggccgggacacgaggaaccaattcctatggccacgtacggctggaatctagtaaaacttcattccggcaaggacgtgtttttcatgcccccagaaaaatgtgataccctgctatgcgacatcggggagagtagccccaaccctacaatagaggaaggaagaactctcagggttctgaagatggtggagccgtggttgcggggtaatcagttttgtatcaagattctgaacccctacatgccatctgtcgtggaaaccctcgagcaaatgcagcgcaaacacggcgggatgcttgtcagaaatcctctgtccaggaactcaacacacgagatgtattgggtgagctgcggaactggcaacatcgtttcggcggtaaatatgacctctcgaatgttactgaaccggttcacaatggctcatcgtaagcccacctttgaaagagatgtggacttgggtgcagggactcgccacgtcgccgtggagcctgaagttgctaatctcgatattatcggacagaggattgagaacatcaaaaatgaacataagagtacgtggcactacgacgaggataacccatataaaacatgggcctaccacggctcctatgaggtgaagcccagcggctcagcatcctctatggtcaatggggtggtacggctgctaaccaagccttgggacgtgataccaatggttactcaaattgccatgaccgatacaacgcccttcggacagcagagagtctttaaagaaaaggtggacacccgcactccgagggctaaacgaggtacaacccagatcatggaggtgactgcgaagtggctttggggcttcctgagccggaacaaaaagcctagaatctgtacaagggaagagtttacccgcaaggtccgtagtaatgccgcaattggggctgttttcgtggacgaaaaccaatggaactccgccaaagaggcagtagaggatgaacggttttgggacctcgtgcatagagagagggaactgcacaagcagggaaaatgcgccacatgcgtctacaacatgatgggcaagcgcgagaaaaagttgggtgagttcgggaaggctaaaggaagccgagccatatggtatatgtggctgggcgcgcggttcctcgagtttgaggcacttggcttcatgaatgaagatcattggttttctagagagaactcactgagtggggtggaaggagagggtttacacaagctgggctacatcttgagggacatttccaaaatcccagggggaaatatgtacgccgatgacactgctggctgggatacccgcattacggaggacgatctccagaacgaagccaagatcaccgacataatggagcccgaacatgcactgctagctacaagcatcttcaaacttacttatcagaacaaggttgtgagagtccaacggcctgccaaaaatggtaccgtgatggatgtaatttctaggcgtgaccagcgagggtcgggacaggttggcacatacggcctgaacacttttaccaatatggaggtgcagctcatccgccaaatggaatcagaggggattttcctgccaagcgagttggaaacgcccaacttagctgagagagtcctggattggctcgaaaagcacggagccgagcggcttaagaggatggcaatctccggtgacgactgtgtggtgaaaccgatagatgaccgctttgcgacagccctgaccgctctaaatgatatgggcaaggtcagaaaagacattcctcagtgggaacccagtaaggggtggaacgattggcagcaggttccattctgctctcaccattttcaccaactgatcatgaaagacggacgggagatcgtggtaccttgtaggaatcaggatgagctcgtgggccgagcccgtgtcagccagggtgcagggtggtccttgagagaaactgcttgcctgggaaagtcatatgcccaaatgtggcagcttatgtacttccatcgccgggacctgaggctcgcagccaacgcgatttgtagtgctgtgcccgttgattgggtgccaacatctagaaccacttggagcatacacgcccaccatcagtggatgaccacagaggacatgttatccgtctggaatcgcgtgtggatcgaagagaacccctggatggaagataagacgcacgtatcaagctgggaggaggttccttatctgggcaaacgggaagaccagtggtgcggctctttgattgggctgaccgcaagggccacttgggctacaaatatccaagtggccattaaccaggtccgaagactcatcggaaatgagaactaccttgactatatgacctccatgaagcggtttaaaaatgaaagtgatccagagggtgcactgtggtga

SEQ ID NO: 13337 - RNA, 9879 nt, synthetic construct
  misc_feature 1..9879: note = derived and/or modified CDS sequence (opt3) from DENV-1__GQ868504__SS-prME
  source 1..9879: mol_type = other RNA
agcgtgaccatgctgctcatgcttctgccaacagcattggctttccacttaactacgcggggaggggaacctcatatgatcgtctccaagcaggaaaggggaaaatctctgctatttaagacctcagccggtgttaacatgtgcacactcattgccatggacctgggcgaactttgtgaagatactatgacctacaaatgcccacaaataacagaggcggaaccggacgatgtggactgttggtgcaatgctaccgatacttgggtaacatatgggacctgtagtcagacgggagagcaccggcgcgacaagcgaagcgtggccctggcaccccatgtcggcttgggtctcgagactcgtaccgaaacatggatgtcctctgagggggcctggaaacagatccagagagtggaaacttgggctctgaggcaccctggattcaccgttattgcactgtttctcgcccatgctatcggcacatcgattacccaaaagggcatcatattcatcttactgatgcttgtgacgccatcaatggccatgcggtgcgtcgggattggaaaccgcgattttgtggagggtttgagcggcgcgacttgggtagacgttgtgctggagcacgggagttgtgtcacaaccatggcaaagaataaacccactctagatatcgaactcctgaagacagaggtgaccaaccctgccattcttagaaaactgtgcatcgaagctaagatatccaatacgaccacagactctaggtgtccaactcagggagaggccaccttggtggaagaacaggatgcaaacttcgtctgccggcgcacatttgttgaccgaggctggggtaatgggtgtggactcttcggcaaaggcagcctgttaacttgcgctaagtttaagtgcgtgaccaaactggaggggaagattgtacagtacgaaaacctcaaatattccgtgatcgtcacagtgcacaccggagatcaacatcaggttggtaatgagactacggaacacggcacaattgccaccatcactccccaggcgcctacctcagagatccagcttacagactacggggccctgaccttggactgtagtccaagaactggactagatttcaacgaaatggtgctgctcacaatgaaggagaaaagctggctggtccataagcaatggtttcttgacctgccgttgccctggacgtctggcgcatccacctcacaggagacttggaataggcaggatctcctggtgacattcaaaaccgctcacgccaagaagcaagaagtagttgtgttaggtagccaggagggggctatgcacacagccctgactggcgcaaccgaaattcagacgagtggaaccacaactatatttgccggccatctaaaatgccggctcaagatggacaaactgacccttaaggggacatcttatgtcatgtgtactggatccttcaaattggagaaggaagtggctgagacccagcacggtacggtcctggtgcaagttaagtacgagggcacagatgcgccttgcaaaatcccattcagcacccaggacgaaaagggggtgactcagaacggacgtctcattacagcaaatcccatcgtaaccgataaagagaagcctgtcaacatagaaactgagccaccctttggcgagtcgtatattgtggttggtgccggggaaaaagctctgaaactttcttggttcaagaaaggctcctcaatcggaaagatgtttgaggccaccgcacgcggcgccagaaggatggctatcctgggggacacagcctgggatttcggaagtattggtggcgtgtttacgagcgtcgggaaattggtgcatcaggtattcggaaccgcatacggcgtgctcttttccggtgtttcttggactatgaagatcgggattggcatactgttaacatggctgggactaaatagccggtcaaccagtctctccatgacatgtatcgcggtcggcatggtgactctgtaccttggggtgatggtccaagctgacagcggatgcgttattaactggaaaggccgagaattgaagtgtggttctgggatcttcgtgaccaacgaggtgcacacgtggacagaacagtataagtttcaggccgattcaccgaaacgcctgagtgcagccatcggaaaggcttgggaggagggcgtatgcggtattagaagcgccaccaggctcgaaaatataatgtggaaacagatctccaacgagctgaatcatattttactggaaaacgacatgaagttcactgtcgtggttggcgacgcaaatgggatccttgctcaaggcaagaagatgattcggcctcagcccatggagcacaaatactcttggaagtcgtggggcaaggccaaaatcataggggcggatatccagaacaccacatttattatcgacggaccagatactcctgaatgtcccgacaatcagcgcgcctggaacatttgggaggtggaggattatggcttcggtatctttaccacaaatatatggttgaagctcagagacagctacacgcaaatgtgcgatcacaggctgatgtccgctgcaattaaagactcaaaggccgtccatgctgatatggggtattggatcgaaagtgagaaaaacgaaacctggaagctagcccgtgcatctttcattgaggtgaagacttgtacatggccaaaaagccacaccctgtggtccaatggagttctcgaatcagagatgatcatacccaagatctacggcggtcctattagccagcataactatcggccaggctacttcactcagacagcggggccgtggcacctgggaaaacttgagttggactttgatctgtgcgaaggcaccacggtggtagtcgacgagcactgcgggaatcgaggaccctctttaagaactaccacagtgaccggcaagatcattcatgaatggtgttgcaggtcctgtactctccctccactgcgcttccggggtgaggatgggtgctggtacggaatggagatcagacccgtgaaagaaaaggaggaaaaccttgtcaggagtatggttagcgccggctctggtgaggtggactccttttcactgggcatattgtgtgtaagtattatgatcgaagaggtgatgcgcagccgatggtcgcggaagatgctcatgacagggaccctggctgtcttcctactgctcgtgatgggacaactgacatggaatgaccttatccgtttgtgcattatggttggcgccaacgcatccgatagaatggggatgggaactacctatctggctttaatggccacgtttaaaatgaggcctatgttcgcagtgggcctcctgtttcgccggcttacatctagagaggtcctgctactcaccatcggtctgagcttggtggcctcagttgaactgccaaacagtttagaggaactcggggacggactggctatgggcattatgatgcttaagctgttgactgagttccagccccaccagctctggaccacactgctatccctgacttttataaaaaccacgctttctctcgattacgcgtggaagacaaccgccatggcactgagcatcgtgtccttgttcccgctgtgtttatcaactacaagccagaaaaccacttggctccctgtcctgcttggcagttttgggtgcaagccactgacaatgttcttgattaccgaaaataagatctggggaaggaaatcttggcccctcaacgagggtattatggctatcggcatagtatccatcctgctaagctcgctgcttaagaatgacgtgcctctcgccgggcccctgattgccggaggcatgttgatcgcttgttatgttatttcaggttctagtgcagatttatccctggagaaagccgcggaagtgagctgggagcaagaagctgagcattctgggacgagccacaacatcctcgtcgaagtgcaggacgatggaactatgaagataaaagacgaggagcgagatgacaccctgacaattcttctgaaggccaccttgctagcagtatccggcgtgtacccaatgtcaatccctgccacactgtttgtctggtatttctggcagaaaaagaagcagcgcagtggcgttctctgggatactcccagcccaccggaagtggagcgggctgtgctggacgatgggatctacaggattcttcaacgaggattactgggtcgttctcaggtcggcgtgggggttttccaggacggagtatttcataccatgtggcacgtgacgcgcggcgcagtcctcatgtatcagggtaaacggttggaaccttcctgggcctcagtgaagaaagacctgataagttacgggggaggctggagattccaaggcagctggaatacaggggaggaggttcaggtgatcgcggtcgaacccggaaagaaccccaagaatgtgcagactacccccggtacatttaagacccctgagggcgaagtaggggctattgccctcgatttcaagccaggaacttccggctctcccatcgtcaacagggagggtaaaattgtggggctgtacggaaatggcgttgtgaccacatcgggcacgtatgtcagcgcaatcgcccaagctaaggcctcacaggaagggcctcttccggagatagaggacgaagtgtttaaaaagcgaaacctgactatcatggatttgcacccaggatccggtaaaacccggcgctacctacccgcaattgttagagaggctatcaagaggaagctgcggacactcattttagcccctacccgagtggtcgcgagtgaaatggccgaggcactgaaaggcatgccaatcagatatcagactacagctgtgaagggggaacataccggacgcgagatagtagaccttatgtgccacgccacgttcactatgaggctgctctctcccgtgcgtgttcctaattacaacatgattatcatggatgaggctcattttacagacccggcaagcatcgccgcccggggctatatttccaccagagtcggtatgggggaagctgcggcaatcttcatgaccgccactcccccaggatcagtggaggcttttcctcagtctaatgccgtgatacaagatgaagagagggacattcccgaacgcagctggaacagtggctacgattggatcacagacttcccaggcaaaaccgtctggtttgtaccttccattaagagcgggaatgatatcgcaaactgtttgagaaagaacggaaagagagtgatacagctgtctcggaagacattcgacactgagtatcagaaaacgaagaataacgactgggattacgttgtgaccacagacatttcagagatgggtgccaatttcagggctgatcgcgtcatcgacccccgtagatgcctcaaaccagtgatcctgaaggatggcccggaacgggttattcttgcggggcctatgcccgtgactgtcgcctccgcagctcagaggcgcggacgaatcggcagaaaccaaaataaagagggtgaccagtacgtgtatatggggcagccactaaacaatgatgaagaccacgcccattggaccgaggcaaagatgctgttggataacattaatacacccgagggcataatccctgccttatttgaaccagagcgggaaaagagtgctgccattgacggagagtacaggctgcgcggcgaagcgagaaaaaccttcgtagagctcatgaggagaggggatctgcccgtgtggcttagctataaggttgcatcggagggatttcagtaccctgaccgtcgctggtgcttcgatggtgaacgaaacaatcaagtcctggaggaaaacatggacgtggagatctggactaaagaaggcgagagaaagaaactcaggccgcggtggttggacgcccgcacgtattctgatccactggctctaagagagtttaaggagttcgccgctgggaggcggtccgtgagcggagacctgatcctcgagattggcaaacttccccagcacctgaccttacgagcacagaatgccttggataacctggtcatgctccacaattcagaacagggtgggaaggcttacagacatgccatggaggaactgcctgacacaatagagactcttatgctgctcgcattgatcgcggttctgaccggcggagtgacattatttttcctaagtggcaaggggctgggaaaaacctctattggtctcctttgtgtaactgcctccagcgctctgttgtggatggcctcagtggagccccactggatcgcagctagtattatcctggaatttttcctcatggtcctgcttataccagagcctgatcgccaaaggacaccccaggacaaccagctcgcctatgtggttatcggcctgttgtttatgattctgacggtggcagccaacgaaatggggttactagagaccactaagaaagatctgggaatcggccatgtcgctgcggagaatcaccaacacgccacaatgctcgacgtagatcttcggccagcaagcgcttggaccctgtacgccgtggccaccacagttattactcctatgatgcgtcatacgatcgaaaacaccacagcaaatatatccttgactgctattgccaaccaggcggctatcctgatgggtctcgacaaggggtggccgatttctaaaatggatatcggcgtgcccctgcttgccttaggatgctacagccaggtcaatccactgaccctcacagcagccgtgttgatgctggtcgctcactatgcaataatcggccctgggctacaggccaaggcgaccagagaggctcaaaagaggactgccgcaggaattatgaaaaaccccacggtggacggcatcgttgccattgatctggacccagtggtatacgacgctaagttcgaaaaacagctcggtcagatcatgcttctgatattgtgtacatcccagattctgctcatgcgcaccacttgggccctgtgcgagtcaatcaccttagcaacagggcctcttactaccctgtgggaaggatctcccggcaagttttggaatacaacgatcgctgtgagtatggccaacattttccggggttcgtatctcgcgggcgccgggctagcattcagcctgatgaaatccttgggaggcgggcgaagaggaaccggcgctcaaggtgagactctgggggagaagtggaagaggcagctcaatcagctttctaaatcagaatttaacacatacaagcgcagcggaatcatggaggtcgatcggtccgaagccaaagagggcctgaagagaggtgaaaccactaaacatgcagttagtcgtggcacagctaagttgaggtggttcgtggagcggaatctggtcaagccggaggggaaagtgatagacctcggatgtggccgcgggggatggtcttattactgcgccggcttaaagaaagtaaccgaagtgaagggttatacgaaagggggaccaggccacgaggaacctattcccatggccacctacggctggaacctggttaaacttcatagcgggaaagatgtgtttttcatgccacccgagaagtgtgacacactgctatgcgatatcggagaatcatcccctaatccgactattgaggagggtcgaaccctcagagtcctgaagatggtggaaccctggttgaggggcaaccagttttgtatcaaaatactgaatccatacatgcctagtgtcgtggaggcgctcgaacaaatgcagcggaagcacgggggaatgcttgttcgcaaccccctgagcagaaattctacacacgagatgtattgggtatcctgcggcactggtaacatcgtgtcagctgtcaacatgaccagcaggatgttactgaatcgattcacaatggcacatcggaaacctacctacgagcgtgacgtggatttgggggccggaactagacacgttgctgtggaaccagaggtcgccaacctcgacattatcggccagcgcattgaaaatatcaagaacgagcataaatcgacgtggcactatgatgaagacaatccctacaagacatgggcatatcacggctcttacgaggtgaagcctagtgggtccgccagctcaatggtaaacggagtggttaggctgctaaccaaaccatgggatgtcattcccatggtgactcaaatcgctatgaccgacacaacgccgtttggtcagcagcgggtgttcaaggagaaagtcgacaccagaactcctcgcgcgaagaggggcacaacccagataatggaagttactgccaaatggctttgggggtttctgtcccgaaataagaagccacggatttgtacaagagaggagttcaccaggaaagtgcgctctaacgcagctatcggagccgtatttgtggatgagaatcaatggaacagcgcaaaggaagccgtcgaggacgagcgtttctgggatctcgtgcatcgggaaagagagctgcacaaacagggcaagtgcgctacatgcgtttataatatgatgggtaaaagggaaaagaagttgggggagtttggaaaagccaagggcagtcgcgcgatctggtacatgtggctgggcgcacgattcctcgagttcgaggcccttgggtttatgaacgaggaccattggttctcccgggaaaatagcctgtctggagtggagggtgaaggcttacacaaactggggtacattttgagagatatatcaaagatccccggaggcaacatgtatgctgacgatactgccggttgggacaccaggattacggaggatgacctccagaatgaggcaaaaatcaccgaaattatggagcctgaacatgctctgctagccacaagtatctttaaacttacttaccagaacaaagtcgtgcgcgtacaaagaccagctaagaacgggaccgttatggatgtgatatcccggagggaccagcgtggaagcggccaggtcggcacatatgggctgaatactttcaccaacatggaggtgcagctcatccgacaaatggaatctgagggaatttttctgccctcggagttggaaacgccgaatttagccgagcgcgtgctggattggctcgaaaagcacggtgcagagagacttaaacggatggcgatctcaggcgacgactgtgtcgttaagcctattgatgacaggttcgccacagctctgaccgccctaaacgatatggggaaagtgcgcaaggacatcccccagtgggaaccaagcaaaggatggaatgattggcagcaggtacctttttgctcccaccatttccaccaactgataatgaaggacggcagagagattgtggtcccctgtcggaaccaggatgagctcgtgggtagggcacgagttagtcagggggctggatggtctttgcgtgaaactgcctgcctgggcaagagctacgcacaaatgtggcagcttatgtattttcatagacgcgacctgcggctcgccgcgaatgctatctgttccgccgtgccagtcgattgggtgcccacatcaaggaccacttggagtatccacgcacaccatcagtggatgaccacagaggacatgttatctgtatggaacagagtttggattgaagagaatccttggatggaagataaaacgcacgtgagctcctgggaggaggtcccatacctgggcaagcgcgaagaccagtggtgcgggtcattgataggactgaccgcccgggctacttgggccacaaacatccaagtggcaattaatcaggttaggcgactcatcggtaacgagaattatcttgactacatgaccagcatgaaaagattcaagaacgaatctgatccggagggcgctctgtggtga

SEQ ID NO: 13338 - RNA, 9879 nt, synthetic construct
  misc_feature 1..9879: note = derived and/or modified CDS sequence (opt3) from DENV-1__GU131967__SS-prME
  source 1..9879: mol_type = other RNA
agcgtgaccatgctgctcatgcttctgccaacagcattggctttccacttaactacgagaggaggggagcctcatatgatcgtctccaagcaggaaaggggaaaatctctgttgtttaagacctcagccggtgttaacatgtgcacactcattgccatggacctgggcgagctttgtgaagatactatgacctacaaatgcccacaaattacagaggcggaaccggacgatgtggactgttggtgcaatgctaccgatacttgggtaacatatgggacctgtagtcagacgggagagcaccggcgcgacaagcgaagcgtggccctggcaccccatgtcggcttgggtctcgagactcgtaccgaaacatggatgtcctctgagggggcctggaaacagatccagagagtggaaacttgggctctgaggcaccctggattcaccgttattgcactgtttctcgcccatgctatcggcacatcgattacccaaaagggcatcatattcatcttactgatgcttgtgacgccatcaatggccatgcggtgcgtcgggattggaaaccgcgattttgtggagggtttgagcggcgcgacttgggtagacgttgtgctggagcacgggagttgtgtcacaaccatggcaaagaataaacccactctagatatcgaactcctgaagacagaggtgaccaaccctgccattcttagaaaactgtgcatcgaagctaagatatccaatacgaccacagactctaggtgtccaactcagggagaggccaccttggtggaggaacaggatgcaaacttcgtctgccggcgcacatttgttgaccgaggctggggtaatgggtgtggactcttcggcaaaggcagcctgttaacttgcgctaagtttaagtgcgtgaccaaactggaggggaagattgtacagtacgaaaacctcaaatattccgtgatcgtcacagtgcacaccggagatcaacatcaggttggtaatgagactacggaacacggcacaattgccaccatcactccccaggcgcctacctcagagatccagcttacagactacggggccctgaccttggactgtagtccaagaactggactagatttcaacgaaatggtgctgctcacaatgaaggagaaaagctggctggtccataagcaatggtttcttgacctgccgttgccctggacgtctggcgcatccacctcacaggagacttggaataggcaggatctcctggtgacattcaaaaccgctcacgccaagaagcaagaagtagttgtgttaggtagccaggagggggctatgcacacagccctgactggcgcaaccgaaattcagacgagtggaaccacaactatatttgccggccatctaaaatgccggctcaagatggacaaactgacccttaaggggacatcttatgtcatgtgtactggatccttcaaattggagaaggaagtggctgagacccagcacggtacggtcctggtgcaagttaagtacgagggcacagatgcgccttgcaaaatcccattcagcacccaggacgaaaagggggtgactcagaacggacgtctcattacagcaaatcccatcgtaaccgataaagagaagcctgtcaacatagaaactgagccaccctttggcgagtcgtatattgtggttggtgccggggaaaaagctctgaaactttcttggttcaagaaaggctcctcaatcggaaagatgtttgaggccaccgcacgcggcgccagaaggatggctatcctgggggacacagcctgggatttcggaagtattggtggcgtgtttacgagcgtcgggaaattggtgcatcaggtattcggaaccgcatacggcgtgctcttttccggtgtttcttggactatgaagatcgggattggcatactgttaacatggctgggactaaatagccggtcaaccagtctctccatgacatgtatcgcggtcggcatggtgactctgtaccttggggtgatggtccaagctgacagcggatgcgttattaactggaaaggccgagaattgaagtgtggttctgggatcttcgtgaccaacgaggtgcacacgtggacagaacagtataagtttcaggccgattcaccgaaacgcctgagtgcagccatcggaaaggcttgggaggagggcgtatgcggtattagaagcgccaccaggctcgaaaatataatgtggaaacagatctccaacgagctgaatcatattttactggaaaacgacatgaagttcactgtcgtggttggcgacgcaaatgggatccttgctcaaggcaagaagatgattcggcctcagcccatggagcacaaatactcttggaagtcgtggggcaaggccaaaatcataggggcggatatccagaacaccacatttattatcgacggaccagatactcctgaatgtcccgacaatcagcgcgcctggaacatttgggaggtggaggattatggcttcggtatctttaccacaaatatatggttgaagctcagagacagctacacgcaaacctgcgatcacaggctgatgtccgctgcaattaaagactcaaaggccgtccatgctgatatggggtattggatcgaaagtgagaaaaacgaaacttggaagctagcccgtgcatctttcattgaggtgaagacatgtacctggccaaaaagccacactctgtggtccaatggagttctcgaatcagagatgatcatacccaagatctacggcggtcctattagccagcataactatcggccaggctacttcacacagaccgcggggccgtggcacctgggaaaacttgagttggactttgatctgtgcgaaggcacgactgtggtagtcgacgagcactgcgggaatcgaggaccctctttaagaaccacaaccgtgactggcaagatcattcatgaatggtgttgcaggtcctgtacactccctccactgcgcttccggggtgaggatgggtgctggtacggaatggagatcagacccgtgaaagaaaaggaggaaaaccttgtcaggagtatggttagcgccggctctggtgaggtggactccttttcactgggcatattgtgtgtaagtattatgatcgaagaggtgatgcgcagccgatggtcgcggaagatgctcatgaccgggacactggctgtcttcctactgctcgtgatgggacaactgacttggaatgaccttatccgtttgtgcattatggttggcgccaacgcatccgatagaatggggatgggaaccacgtatctggctttaatggccacatttaaaatgaggcctatgttcgcagtgggcctcctgtttcgccggcttacctctagagaggtcctgctactcactatcggtctgagcttggtggcctcagttgaactgccaaacagtttagaggaactcggggacggactggctatgggcattatgatgcttaagctgttgaccgagttccagccccaccagctctggacaactctgctatccctgacctttataaaaacgacactttctctcgattacgcgtggaagaccactgccatggcactgagcatcgtgtccttgttcccgctgtgtttatcaacaaccagccagaaaactacatggctccctgtcctgcttggcagttttgggtgcaagccactgaccatgttcttgattacggaaaataagatctggggaaggaaatcttggcccctcaacgagggtattatggctatcggcatagtatccatcctgctaagctcgctgcttaagaatgacgtgcctctcgccgggcccctgattgccggaggcatgttgatcgcttgttatgttatttcaggttctagtgcagatttatccctggagaaagccgcggaagtgagctgggagcaagaagctgagcattctgggactagccacaacatcctcgtcgaagtgcaggacgatggaaccatgaagataaaagacgaggagcgagatgacacactgaccattcttctgaaggccacattgctagcagtatccggcgtgtacccaatgtcaatccctgccactctgtttgtctggtatttctggcagaaaaagaagcagcgcagtggcgttctctgggatacccccagcccaccggaagtggagcgggctgtgctggacgatgggatctaccgaatacttcaaaggggattactgggtcgttctcaggtcggcgtgggggttttccaggacggagtatttcatacgatgtggcacgtgacacgcggcgcagtcctcatgtatcagggtaaacggttggaaccttcctgggcctcagtgaagaaagacctgataagttacgggggaggctggagattccaaggcagctggaatactggggaggaggttcaggtgatcgcggtcgaacccggaaagaaccccaaaaatgtgcagaccacacccggtacctttaagactcctgagggcgaagtaggggctattgccctcgatttcaagccaggaacctccggctctcccatcgtcaacagggagggtaaaattgtggggctgtacggaaatggcgttgtgacaacgtcgggcacttatgtcagcgcaatcgcccaagctaaggcctcacaggaagggcctcttccggagatagaggacgaagtgtttaaaaagcgaaacctgaccatcatggatttgcacccaggatccggtaaaacacggcgctacctacccgcaattgttagagaggctatcaagaggaagctgcggaccctcattttagcccctactcgagtggtcgcgagtgaaatggccgaggcactgaaaggcatgccaatcagatatcagacaaccgctgtgaagtctgaacatacggggcgcgagatagtagaccttatgtgccacgccactttcacaatgaggctgctcagccccgtgcgtgttcctaattacaacatgattatcatggatgaggctcattttaccgacccggcatccatcgccgcccggggatatatttcaaccagagtcggcatgggtgaagctgcggcaatcttcatgactgccacacccccagggtctgtggaggcttttcctcagagcaatgccgtgatacaagatgaagagagggacattcccgaacgcagttggaactccggatacgattggatcaccgacttcccaggcaaaacagtctggtttgtacctagcattaagtctggcaatgatatcgcaaactgtttgcggaaaaacgggaagagagtgatacagctgtcaagaaagactttcgacacggagtatcagaaaaccaagaataacgactgggattacgttgtgacaactgacatttccgagatgggagccaatttcagggctgatcgcgtcatcgacccccgtagatgcctcaaaccagtgatcctgaaggatggtccggaacgggttattcttgcgggccctatgcccgtgaccgtcgccagtgcagctcagaggcgcgggcgaatcggaagaaaccaaaataaagagggcgaccagtacgtgtatatgggtcagccactaaacaatgatgaagaccacgcccattggacagaggcaaagatgctgttggataacattaatacccccgaggggataatccctgccttatttgaaccagagcgggaaaagagcgctgccattgacggcgagtacaggctgcgcggagaagcgagaaaaactttcgtagagctcatgaggcggggcgatctgcccgtgtggctttcgtataaggttgcatctgaggggtttcagtactccgaccgtcgctggtgcttcgatggagaacgaaacaatcaagtcctggaggaaaacatggacgtggagatctggacgaaagaaggtgagagaaagaaactcaggcctcggtggttggacgcccgcacctatagcgatccgctggctctaagagagtttaaggagttcgccgctggcaggcggtcagtgagtggggacctgatcctcgagattggaaaacttccacagcacctgacattacgagcacagaatgccttggataacctggtcatgctccacaattctgaacagggcggtaaggcttacagacatgccatggaggaactgcccgacactatagagacccttatgctgctcgcattgatcgcggttctgacagggggcgtgaccttatttttcctatccggaaagggcctggggaaaactagcattggactcctttgtgtaacagcctcaagtgctctgttgtggatggccagcgtggagcctcactggatcgcagcttccattatcctggaatttttcctcatggtcctgcttatacccgagccagatcgccaaaggacgcctcaggacaaccagctcgcctatgtggttatcggtctgttgtttatgattctgaccgtggcagccaacgaaatgggcttactagagactacaaagaaagatctggggatcggacatgtcgctgcggagaatcaccaacacgccaccatgctcgacgtagatcttcggcccgcatctgcttggaccctgtacgccgtggccacaactgttattacgccaatgatgcgtcataccatcgaaaacacaactgcaaatattagcttgaccgctattgccaaccaggcggctatcctgatgggcctcgacaagggttggcctatttccaaaatggatatcggggtgccgctgcttgccttaggctgctactcacaggtcaatcccctgacactcaccgcagccgtgttgatgctggtcgctcactatgcaataatcggaccaggcctacaggccaaggcgactagagaggctcaaaagaggacggccgcagggattatgaaaaaccctacagtggacggaatcgttgccattgatctggaccccgtggtatacgacgctaagttcgaaaaacagctcggccagatcatgcttctgatattgtgtacctctcagattctgctcatgcgcactacctgggccctgtgcgagagtatcacattagcaactggtccacttaccacactgtgggaagggtcgcctggaaagttttggaatacgaccatcgctgtgagcatggccaacattttccggggctcctatctcgcgggtgccggcctagcattctctctgatgaaatcactagggggaggccgaagagggactggagctcaaggcgagacactgggtgagaagtggaagaggcagctcaatcagcttagcaaatccgaatttaacacctacaagcgcagtgggatcatggaggtcgatcggtctgaagccaaagagggactgaagagaggcgaaactacaaaacatgcagttagccgtggtaccgctaagttgaggtggttcgtggagcggaatctggtcaagcccgagggcaaagtgatagacctcgggtgtggacgcggcgggtggtcatattactgcgccggattaaagaaagtaacggaagtgaagggctataccaaaggtgggccgggacacggcgagccaattcctctggccacatacggctggaaccttgttaagctgcattccgggaaagatgtgtttttcatgcccccagaaaagtgtgacactctactctgcgatatcggagagagtagccccaatcctaccattgaagagggtcgaacactgagagtcttgaagatggtggagccgtggctgaggggcaaccagttttgtatcaaaatactcaatccctacatgccatctgtcgtggaagcgcttgagcaaatgcagcggaagcacgggggaatgctggttcgcaaccctttatccagaaattcaactcacgaaatgtattgggtaagctgcggcaccggtaacatcgtgtcggctgtcaacatgacatctaggatgctgttgaatcgattcaccatggcacatcggaaacccacttacgagcgtgacgtggatctcggggccggaacgagacacgttgctgtggagcctgaagtcgccaacctggacattatcggccagcgcattgagaatatcaagaacgaacataaaagtacatggcactatgatgaggacaatccatacaagacctgggcatatcacggctcctacgaagtgaagcccagcgggtcagcctcctctatggtaaacggagtggttaggctacttactaaaccttgggatgtcattccaatggtgacccaaatcgctatgacagacacgaccccctttggtcagcagcgggtgttcaaggagaaagtcgacactagaacaccgcgcgcgaagaggggcaccactcagataatggaggttacagccaaatggctgtgggggtttctcagccgaaataagaagcctcggatttgtaccagagaagagttcacaaggaaagtgcgcagtaacgcagctatcggagccgtatttgtggatgaaaatcaatggaactccgcaaaggaggccgtcgaagacgagcgtttctgggatctggtgcatcgggagagagaattgcacaaacagggcaagtgcgctacttgcgtttataatatgatgggtaaaagggagaagaagctgggggaatttggaaaagccaagggcagccgcgcgatctggtacatgtggctcggcgcacgattccttgagttcgaagccctggggtttatgaacgaggaccattggttctctcgggaaaattcattaagtggagtggaaggtgagggcctgcacaaattggggtacattctcagagatatatccaagatcccaggaggcaacatgtatgctgacgataccgccggttgggacacgaggattaccgaagatgacctgcagaatgaggcaaaaatcacagagattatggaacccgagcatgctctacttgccactagcatctttaagctgacctaccagaacaaagtcgtgcgcgtacaaagacctgctaagaacgggacagttatggatgtgatatctcggagggaccagcgtggatcgggccaggtcggcacttatgggctcaataccttcacgaacatggaagtgcagctgatccgacaaatggagtcagaaggaatatttttgccaagcgagttagagacacccaatctggccgaacgcgtgctcgattggcttgagaagcacggtgcagaaagactgaaacggatggcgatctccggcgacgactgtgtcgttaagccgattgatgacaggttcgccaccgctctaactgccctgaacgatatggggaaagtgcgcaaggacatccctcagtgggagcccagtaaaggatggaatgattggcagcaggtaccattttgctctcaccatttccaccaactcataatgaaggacggcagagaaattgtggtcccttgtcggaaccaggatgagttggtgggtagggcacgagttagccagggggctggatggtccctgcgtgagacagcctgccttggcaagtcatacgcacaaatgtggcagctgatgtattttcatagacgcgacctccggttagccgcgaatgctatctgtagtgccgtgcccgtcgattgggtgccaacctctaggactacctggagcatccacgcacaccatcagtggatgacaacggaagacatgctgtccgtatggaacagagtttggattgaggaaaatccctggatggaggataaaacccacgtgtcaagctgggaagaggtcccttacttgggcaagcgcgaggaccagtggtgcgggtctctgataggactcactgcccgggctacatgggccaccaacatccaagtggcaattaatcaggttaggcgacttatcggtaacgaaaattatctggactacatgacttccatgaaaagattcaagaacgagagtgatccagaaggcgctctatggtga

SEQ ID NO: 13339 - RNA, 9879 nt, synthetic construct
  misc_feature 1..9879: note = derived and/or modified CDS sequence (opt3) from DENV-1__GU131968__SS-prME
  source 1..9879: mol_type = other RNA
agcgtgaccatgctgctcatgcttctgcccacagcattggctttccacttaactacgagaggaggggagcctcatatgatcgtctccaagcaggaaaggggaaaatctctgttatttaagacctcagccggtgttaatatgtgcacactcattgccatggacctgggagagctttgtgaagatactatgacctacaaatgcccacaaataacagaggcggaaccggacgatgtggactgttggtgcaatgctaccgatacttgggtaacatatgggacctgtagtcagacgggagagcaccggcgcgacaagcgaagcgtggccctggcaccccatgtcggcttgggtctcgagactcgtaccgaaacatggatgtcctctgagggggcctggaaacagatccagagagtggaaacttgggctctgaggcaccctggattcaccgttattgcactgtttctcgcccatgctatcggcacatcgattacccaaaagggcatcatattcatcttactgatgcttgtgacgccatcaatggccatgcggtgcgtcgggattggaaatcgcgattttgtggagggtttgagcggcgcgacttgggtagacgttgtgctggagcacgggagttgtgtcacaaccatggcaaagaataaacccactttggatatcgaactcctgaagacagaggtgaccaaccctgccattcttagaaaactgtgcatcgaagctaagatatccaatacgaccacagactctaggtgtccaactcagggagaggccaccttggtggaggaacaggatgcaaacttcgtctgccggcgcacatttgttgaccgaggctggggtaatgggtgtggactcttcggcaaaggcagcctgttaacttgcgctaagtttaagtgcgtgaccaaactggaggggaagattgtacagtacgaaaacctcaaatattccgtgatcgtcacagtgcacaccggagatcaacatcaggttggtaatgagactacggaacacggcacaattgccaccatcactccccaggcgcctacctcagagatccagcttacagactacggggccctgaccttggactgtagtccaagaactggactagatttcaacgaaatggtgctgctcacaatgaaggagaaaagctggctggtccataagcaatggtttcttgacctgccgttgccctggacgtctggcgcatccacctcacaggagacttggaataggcaggatctcctggtgacattcaaaaccgctcacgccaagaagcaagaagtagttgtgttaggtagccaggagggggctatgcacacagccctgactggcgcaaccgaaattcagacgagtggaaccacaactatatttgccggccatctaaaatgccggctcaagatggacaaactgacccttaaggggacatcttatgtcatgtgtactggatccttcaaattggagaaggaagtggctgagacccagcacggtacggtcctggtgcaagttaagtacgagggcacagatgcgccttgcaaaatcccattcagcacccagaacgaaaagggggtgactcagaatggacgtctcattacagcaaaccccatcgtaaccgacaaagagaagcctgtcaatatagaaactgagccaccctttggcgagtcgtatattgtggttggtgccggggaaaaagctctgaaactttcttggttcaagaaaggctcctcaatcggaaagatgtttgaggccaccgcacgcggcgccagaaggatggctatcctgggggatacagcctgggacttcggaagtattggtggcgtgtttacgagcgtcgggaaattggtgcatcaggtattcggaaccgcatacggcgtgctcttttccggtgtttcttggactatgaagatcgggattggcatactgttaacatggctgggactaaacagccggtcaaccagtctctccatgacatgtatcgcggtcggcatggtgactctgtaccttggggtgatggtccaagctgatagcggatgcgttattaactggaaaggccgagaattgaagtgtggttctgggatcttcgtgaccaatgaggtgcacacgtggacagaacagtataagtttcaggccgactcaccgaaacgcctgagtgcagccatcggaaaggcttgggaggagggcgtatgcggtattagaagcgccaccaggctcgaaaacataatgtggaaacagatctccaatgagctgaaccatattttactggaaaatgatatgaagttcactgtcgtggttggcgacgcaaacgggatccttgctcaaggcaagaaaatgattcggcctcagcccatggagcacaaatactcttggaagtcgtggggcaaggccaaaatcataggggcggacatccagaataccacatttattatcgatggaccagacactcctgaatgtcccgataaccagcgcgcctggaatatttgggaggtggaggactatggcttcggtatctttaccacaaacatatggttgaagctcagagatagctacacgcaaatgtgcgaccacaggctgatgtccgctgcaattaaagattcaaaggccgtccatgctgacatggggtattggatcgaaagtgagaaaaatgaaacctggaagctagagcgtgcctctttcattgaagtgaagacttgtacatggccaaaaagccacaccctgtggtccaacggagttctcgagtcagagatgatcatacccaagatctacggcggtcctattagccagcataattatcggccaggctacttcactcagacagcagggccgtggcacctgggaaaacttgaattggattttgacctgtgcgagggcaccacggtggtagtcgatgaacactgcgggaaccgaggaccctctttaagaactaccacagtgaccggcaagatcattcatgagtggtgttgcaggtcctgtactctccctccactgcgcttccggggtgaggacgggtgctggtacggaatggaaatcagacccgtgaaagagaaggaagagaatcttgtcaggagtatggttagcgcgggctctggtgaagtggattccttttcactgggcatattgtgtgccagtattatgatcgaggaggtaatgcgcagccgatggtcgcggaagatgctcatgacagggaccctggctgtgttcctactgctcatcatgggacaactgacatggaacgaccttattcgtttgtgcatcatggtcggcgccaacgcatccgacagaatggggatgggaactacctatctggctttaatggccacgtttaaaatgaggcctatgttcgcagtgggcctcctgtttcgccggcttacatctagagaagttctgctactcaccattggtctgagcttggtggcctcagtcgagctgccaaatagtttagaagaactcggggatggactggctatgggcataatgatgcttaagctgttgactgagttccagccccaccagctctggaccacactgctatccctgacttttatcaaaaccacgctttctctcgactacgcgtggaagacaaccgccatggcactgagcattgtgtccttgttcccgctgtgtttatcaactacaagccagaaaaccacttggctccctgttctgcttggcagttttgggtgcaagccactgacaatgttcttgatcaccgagaacaagatttggggaaggaaatcttggcccctcaatgagggtatcatggctataggcatcgtgtccattctgctaagctcgctgcttaagaacgatgtccctctcgccgggcccctgatcgccggaggcatgttgattgcttgttatgtaatctcaggttctagtgcagacttatccctggaaaaagccgcggaggtgagctgggaacaagaggctgaacattctgggacgagccacaatatactcgttgaggtgcaggatgacggaactatgaagattaaagatgaggaacgagacgataccctgacaatccttctgaaggccaccttgctagcagtctccggcgtgtacccaatgtcaatccctgccacactgtttgtatggtatttctggcagaaacgcaagcagcggagtggcgtgctctgggacactcccagcccaccggaggtcgaaagagctgttctggatgacgggatttacaggatacttcaacgtggattactgggtcgctctcaggtgggcgtgggggtcttccaggatggagtgtttcataccatgtggcacgttacgcggggcgcagtactcatgtatcagggtaagagattggagccttcctgggcctcagtgaaaaaggacctgatcagttacgggggaggctggaggttccaaggcagctggaacacaggggaggaagtccaggtgattgcggttgagcccggcaagaatccaaagaacgtgcagactacccccggtacatttaaaacccctgaaggcgaggtcggggctatcgccctcgacttcaagccaggaacttccggctctcccattgtgaatcgagaaggtaagatcgtagggctgtacggaaacggcgtcgtgaccacatcgggcacgtatgttagcgcaatagcccaagctaaagcctcacaggaggggcctcttccggagatcgaagatgaggtgtttaagaaacggaatctgactattatggacttgcacccaggatccggtaagacccgcagatacctacccgcaatcgtcagggaagctattaaacggaagctgcgaacactcatcttagcccctaccagagtggttgcgagtgagatggccgaagcactgaagggcatgccaatacgctatcagactacagctgtgaaatctgagcataccgggagggagattgtcgatcttatgtgccacgccacgttcactatgcgtctgctcagccccgtgcgggtacctaactacaatatgatcatcatggacgaagctcattttacagatccggcatccattgccgccagaggatatatctcaaccagggtgggcatgggtgaggctgcggcaatattcatgaccgccactcccccagggtctgttgaggcttttcctcagagcaacgccgtcattcaagacgaagaacgcgatatccccgagcgaagttggaactccggatacgactggattacagatttcccaggcaagaccgtgtggtttgtgcctagcatcaaatctggcaacgacatagcaaactgtttgagaaagaatgggaaacgggtcattcagctgtcaaggaagacattcgatactgagtatcagaagacgaaaaacaatgactgggactacgtagtgaccacagatatctccgaaatgggagccaacttccgcgctgaccgtgttatcgatcccagacggtgcctcaagccagtgattctgaaagacggtccggagagggtcatccttgcgggccctatgcccgtgactgttgccagtgcagctcagcgccgagggagaattggacggaatcaaaacaaggaaggcgatcagtacgtgtatatgggtcagccactaaataacgacgaggatcacgcccattggaccgaggcaaaaatgctgttggacaatataaacacacccgaagggatcattcctgccttatttgagccagaaagggaaaagagcgctgccatcgatggcgaataccgcctgagaggagaggcgaggaagaccttcgtcgagctcatgcggcgtggcgacctgcccgtgtggctttcgtataaagtagcatctgaagggtttcagtactccgatcgccgatggtgcttcgacggagagagaaataaccaagtgctggaagagaatatggatgttgaaatctggactaaggagggtgagaggaaaaagctccggcctcgctggttggacgccagaacgtatagcgacccgctggctctaagggaatttaaagagttcgccgctggccggcgatcagtcagtggggatctgattctcgaaataggaaaacttccacagcacctgaccttaagagcacagaacgccttggacaatctggtgatgctccacaactctgagcagggcggtaaggcttaccgccatgccatggaggaactgcccgatacaatcgagactcttatgctgctcgcattgattgcggtgctgaccgggggcgtcacattatttttcctatccggaaagggcctggggaagaccagcatcggactcctttgtgttactgcctcaagtgctctgttgtggatggccagcgtggaacctcactggattgcagcttccatcatactggagtttttcctcatggtactgcttatccccgaaccagacaggcaacggacacctcaggataaccagctcgcctatgtggtcattggtctgttgtttatgatcctgacggtggcagccaatgagatgggcttactagagaccactaaaaaggacctggggattggacatgttgctgcggaaaaccaccaacacgccacaatgctcgatgtggaccttcgtcccgcatctgcttggaccctgtacgccgtcgccaccacagtaatcactccaatgatgagacatacgatagagaataccacagcaaacattagcttgactgctatcgccaatcaggcggctattctgatgggcctcgataaaggttggcctatctccaagatggacataggggtgccgctgcttgccttaggctgctactcacaggttaaccccctgaccctcacagcagccgtgttgatgctggtcgctcactatgcaatcattggaccaggcctacaggccaaagcgaccagggaagctcaaaagcgcactgccgcagggatcatgaagaatcctacggtggatggaattgtcgccatcgacctggatcccgtggtttacgacgctaaattcgagaagcagctcggccagataatgcttctgattttgtgtacatctcagatcctgctcatgcggaccacttgggccctgtgcgaaagtatcaccttagcaacaggtccacttactaccctgtgggaggggtcgcctggaaaattttggaacacaacgattgctgtgagcatggccaatatcttccgaggctcctatctcgcgggtgccggcctagcattctctctgatgaagtcactagggggaggcagaagggggaccggagctcaaggcgagactctgggtgaaaaatggaagcgccagctcaaccagcttagcaagtccgagtttaatacatacaaacggagtgggataatggaagtagacagatctgaggccaaggaaggactgaaacgtggcgagaccactaagcatgcagtgagcaggggtacagctaaattgcggtggttcgtcgagcgcaacctggttaagcccgaaggcaaggtgattgatctcgggtgtggacgaggcgggtggtcatattactgcgccggactgaaaaaggtcaccgaggtgaaaggctatacgaagggtgggccgggacacgaggaaccaatccctatggccacctacggctggaatctagtaaaacttcattccggcaaggacgtgtttttcatgcccccagaaaaatgtgatacactgctatgcgacattggggagagtagccccaaccctactatcgaggaaggaagaaccctcagggttctgaagatggtggagccgtggttgcggggtaatcagttttgtataaagatcctgaacccctacatgccatctgtcgtggaaacactcgagcaaatgcagcgcaaacacggcgggatgcttgtcagaaatcctctgtccaggaactcaactcacgagatgtattgggtgagctgcggaaccggcaacattgtttcggcggtaaatatgacatctcgaatgttactgaaccggttcaccatggctcatcgtaagcccacttttgaaagagatgtggacttgggtgcagggacgcgccacgtcgccgtggagcctgaagttgctaatctcgatatcattggacagaggatcgagaacattaaaaatgaacataagagtacatggcactacgacgaggataacccatataaaacctgggcctaccacggctcctatgaggtgaagcccagcggctcagcatcctctatggtcaatggggtggtacggctgctaactaagccttgggacgtgatcccaatggttacccaaatagccatgacagatacgacccccttcggacagcagagagtctttaaagaaaaggtggacactcgcacaccgagggctaaacgaggtaccactcagattatggaggtgacagcgaagtggctttggggcttcctgagccggaacaaaaagcctagaatctgtaccagggaagagtttacacgcaaggtccgtagtaatgccgcaatcggggctgttttcgtggacgaaaaccaatggaactccgccaaagaggcagtagaggatgaacggttttgggacctcgtgcatagagagagggaactgcacaagcagggaaaatgcgccacttgcgtctacaacatgatgggcaagcgcgagaaaaagttgggtgagttcgggaaggctaaaggaagccgagccatttggtatatgtggctgggcgcgcggttcctcgagtttgaggcacttggcttcatgaatgaagatcattggttttctagagagaactcactgagtggggtggaaggagagggtttacacaagctgggctacatattgagggacatctccaaaattccagggggaaatatgtacgccgatgacaccgctggctgggatacgcgcatcaccgaggacgatctccagaacgaagccaagattacagacatcatggagcccgaacatgcactgctagctactagcatattcaaacttacctatcagaacaaggttgtgagagtccaacggcctgccaaaaatggtacagtgatggatgtaatctctaggcgtgaccagcgagggtcgggacaggttggcacttacggcctgaacacctttacgaatatggaggtgcagctcattcgccaaatggaatcagaggggatcttcctgccaagcgagttggaaacacccaacttagctgagagagtcctggattggctcgaaaagcacggagccgagcggcttaagaggatggcaatttccggtgacgactgtgtggtgaaaccgatcgatgaccgctttgcgaccgccctgactgctctaaatgatatgggcaaggtcagaaaagacatacctcagtgggaacccagtaaggggtggaacgattggcagcaggttccattctgctctcaccattttcaccaactgattatgaaagacggacgggagatcgtggtaccttgtaggaatcaggatgagctcgtgggccgagcccgtgtcagccagggtgcagggtggtccttgagagaaacagcttgcctgggaaagtcatatgcccaaatgtggcagcttatgtacttccatcgccgggacctgaggctcgcagccaacgcgatctgtagtgctgtgcccgttgattgggtgccaacctctagaactacctggagcattcacgcccaccatcagtggatgacaacggaggacatgttatccgtctggaatcgcgtgtggatagaagagaacccctggatggaagataagacccacgtatcaagctgggaggaggttccttatctgggcaaacgggaagaccagtggtgcggctctttgatcgggctgactgcaagggccacatgggctaccaatattcaagtggccatcaaccaggtccgaagactcattggaaatgagaactaccttgactatatgacttccatgaagcggtttaaaaatgaaagtgatccagagggtgcactgtggtga

SEQ ID NO: 13340 - RNA, 9879 nt, synthetic construct
  misc_feature 1..9879: note = derived and/or modified CDS sequence (opt3) from DENV-1__GQ868506__SS-prME
  source 1..9879: mol_type = other RNA
agcgtgaccatgctgctcatgcttctgccaacagccttggctttccacttaactacgcggggaggggaacctcatatgatcgtctccaagcaggaaaggggaaaatctctgctatttaagacctcagctggtgttaacatgtgcacactcattgccatggacctgggcgagctttgtgaagatactatgacctacaaatgcccacagataacagaggcggaaccggacgatgtggactgttggtgcaatgctaccgatacttgggtaacatatgggacctgtagtcagacgggagagcaccggcgcgacaagcgaagcgtggccctggcaccccatgtcggcttgggtctcgagactcgtaccgaaacatggatgtcctctgagggggcctggaaacagatccagagagtggaaacttgggctctgaggcaccctggattcaccgttattgcatttttcctggcccatgctatcggcacatcgattacccaaaagggcatcatatttatcctcttaatgctggtgacgccatcaatggccatgcggtgcgtcgggattggaaaccgcgatttcgtggagggtcttagcggcgcgacttgggtagacgttgtgttggagcacgggagttgtgtcacaaccatggcaaagaataaacccactctggatatcgaactactcaagacagaggtgaccaaccctgccattctgagaaaactttgcatcgaagctaagatatccaatacgaccacagactctaggtgtccaactcagggagaggccaccctggtggaagaacaggatgcaaactttgtctgccggcgcacattcgttgaccgaggctggggtaatgggtgtggattgtttggcaaaggcagcctcctgacttgcgctaagttcaagtgcgtgaccaaattagaggggaagattgtacagtacgaaaacctgaaatattccgtgatcgtcacagtgcacaccggagatcaacatcaggttggtaatgagactacggaacacggcacaattgccaccatcactccccaggcgcctacctcagagatccagctcacagactacggggcccttaccctggactgtagtccaagaactggattggattttaacgaaatggtgctactgacaatgaaggagaaaagctggctcgtccataagcaatggttcctggaccttccgctgccctggacgtctggcgcatccacctcacaggagacttggaataggcaggatttgctcgtgacatttaaaaccgctcacgccaagaagcaagaagtagttgtgctgggtagccaggagggggctatgcacacagccttaactggcgcaaccgaaattcagacgagtggaaccacaactatattcgccggccatctgaaatgccggctaaagatggacaaactcaccctgaaggggacatcttatgtcatgtgtactggatccttcaaacttgagaaggaagtggctgagacccagcacggtacggtcttggtgcaagttaagtacgagggcacagatgcgccttgcaaaatcccatttagcacccaggacgaaaagggggtgactcagaacggacgtctgattacagcaaatcccatcgtaaccgataaagagaagcctgtcaacatagaaactgagccacccttcggcgagtcgtatattgtggttggtgccggggaaaaagctctcaagctgtcttggtttaagaaaggctcctcaatcggaaagatgttcgaggccaccgcacgcggcgccagaaggatggctatccttggggacacagcctgggattttggaagtattggtggcgtgttcacgagcgtcgggaaactggtgcatcaggtatttggaaccgcatacggcgtgttgttctccggtgtttcttggactatgaagatcgggattggcatactcctgacatggttaggactgaatagccggtcaaccagtctatccatgacatgtatcgcggtcggcatggtgactctctacctgggggtgatggtccaagctgacagcggatgcgttattaactggaaaggccgagaacttaagtgtggttctgggatctttgtgaccaacgaggtgcacacgtggacagaacagtataagttccaggccgattcaccgaaacgcttgagtgcagccatcggaaaggcttgggaggagggcgtatgcggtattagaagcgccaccaggctggaaaatataatgtggaaacagatctccaacgagctcaatcatattctgttagaaaacgacatgaagtttactgtcgtggttggcgacgcaaatgggatcctggctcaaggcaagaagatgattcggcctcagcccatggagcacaaatactcttggaagtcgtggggcaaggccaaaatcataggggcggatatccagaacaccacattcattatcgacggaccagatactcctgaatgtcccgacaatcagcgcgcctggaacatttgggaggtggaggattatggctttggtatcttcaccacaaatatatggcttaagttgagagacagctacacgcaaatgtgcgatcacaggctcatgtccgctgcaattaaagactcaaaggccgtccatgctgatatggggtattggatcgaaagtgagaaaaacgaaacctggaagctggcccgtgcatctttcattgaggtgaagacttgtacatggccaaaaagccacaccctatggtccaatggagttctggaatcagagatgatcatacccaagatctacggcggtcctattagccagcataactatcggccaggctactttactcagacagcggggccgtggcacctcggaaaactggagcttgacttcgatttgtgcgaaggcaccacggtggtagtcgacgagcactgcgggaatcgaggaccctctctgagaactaccacagtgaccggcaagatcattcatgaatggtgttgcaggtcctgtactttacctccactccgctttcggggtgaggatgggtgctggtacggaatggagatcagacccgtgaaagaaaaggaggaaaacctggtcaggagtatggttagcgccggctctggtgaggtggactccttctcacttggcatactgtgtgtaagtattatgatcgaagaggtgatgcgcagccgatggtcgcggaagatgttgatgacagggaccctcgctgtctttctgctactggtgatgggacaactcacatggaatgacctgatccgtctttgcattatggttggcgccaacgcatccgatagaatggggatgggaactacctatttggctctgatggccacgttcaaaatgaggcctatgtttgcagtgggcttactcttccgccggctgacatctagagaggtccttctgctaaccatcggtctcagcctggtggcctcagttgaattgccaaacagtctggaggaattaggggacggactcgctatgggcattatgatgctgaaacttctgactgagtttcagccccaccagttgtggaccacactcctgtccctaactttcataaaaaccacgctgtctcttgattacgcgtggaagacaaccgccatggcactcagcatcgtgtccctgtttccgttgtgtctgtcaactacaagccagaaaaccacttggttacctgtcctcctgggcagtttcgggtgcaagccacttacaatgtttctgattaccgaaaataagatctggggaaggaaatcttggcccttgaacgagggtattatggctatcggcatagtatccatcctcctgagctcgctactgaagaatgacgtgcctcttgccgggcccctcattgccggaggcatgctgatcgcttgttatgttatttcaggttctagtgcagatttgtccttagagaaagccgcggaagtgagctgggagcaagaagctgagcattctgggacgagccacaacatcctggtcgaagtgcaggacgatggaactatgaagataaaagacgaggagcgagatgacaccctcacaattctgcttaaggccaccctgttggcagtatccggcgtgtacccaatgtcaatccctgccacactattcgtctggtatttctggcagaaaaagaagcagcgcagtggcgttctgtgggatactcccagcccaccggaagtggagcgggctgtgctcgacgatgggatctacaggattctgcaacgaggacttttaggtcgttctcaggtcggcgtgggggtttttcaggacggagtattccataccatgtggcacgtgacgcgcggcgcagtcctgatgtatcagggtaaacggctcgaaccttcctgggcctcagtgaagaaagacttgataagttacgggggaggctggagatttcaaggcagctggaatacaggggaggaggttcaggtgatcgcggtcgaacccggaaagaaccccaaaaatgtgcagactacccccggtacattcaagacccctgagggcgaagtaggggctattgccctggattttaagccaggaacttccggctctcccatcgtcaacagggagggtaaaattgtggggctctacggaaatggcgttgtgaccacatcgggcacgtatgtcagcgcaatcgcccaagctaaggcctcacaggaagggcctctgccggagatagaggacgaagtgttcaaaaagcgaaaccttactatcatggatctgcacccaggatccggtaaaacccggcgctacttgcccgcaattgttagagaggctatcaagaggaagctacggacactgattctcgcccctacccgagtggtcgcgagtgaaatggccgaggcattaaaaggcatgccaatcagatatcagactacagctgtgaagtctgaacataccgggcgcgagatagtagacctgatgtgccacgccacgtttactatgaggcttctgagccccggacgtgtgcctaattacaacatgattatcatggatgaggctcatttcacagacccggcatccatcgccgcccggggctatatttcaaccagagttggtatgggggaagctgcggcaatctttatgaccgccactcccccaggatctgtcgaggctttccctcagagcaatgccgtgatacaagatgaagagagggacattcccgaacgcagttggaactccggctacgattggatcacagactttccaggcaaaaccgtgtggttcgtccctagcattaagtctgggaatgatatcgcaaactgtctcagaaagaacggaaaaagagtaatacagttgtcacggaagacattcgacactgagtatcagaaaacgaagaataacgactgggattacgtggttaccacagacatttccgagatgggtgccaattttagggctgatcgcgtgatcgacccccgtagatgcctgaaaccagtcatcctcaaggatggcccggaacgggtgattctggcggggcctatgcccgttactgtggccagtgcagctcagaggcgcggacgaatcggcagaaaccaaaataaagagggtgaccagtacgtctatatggggcagccacttaacaatgatgaagaccacgcccattggaccgaggcaaagatgctactggataacattaatacacccgagggcataatccctgccttgttcgaaccagagcgggaaaagagcgctgccattgacggagagtacaggttacgcggcgaagcgagaaaaacctttgtggagctgatgaggagaggggatctccccgtatggctgtcgtataaggtggcatctgagggattccagtactccgaccgtcgctggtgctttgatggtgaacgaaacaatcaagttcttgaggaaaacatggacgtcgagatctggactaaagaaggcgagagaaagaaactgaggcctcggtggctcgacgcccgcacgtatagcgatccgttggctctgagagagttcaaggaatttgccgctgggaggcggtcagtgagtggagacctaatcctggagattggcaaactcccacagcaccttaccctgcgagcacagaatgccttagataacttggtgatgctgcacaattctgaacagggtgggaaggcttacagacatgccatggaggaactccccgacacaatagagactctgatgcttctggcactcatcgcggtcttgaccggcggagttacactgttctttttatccggcaaggggctaggaaaaaccagcattggtctgctctgtgtgactgcctcaagtgcacttctgtggatggccagcgtagagcctcactggatcgcagcttccattatcttggagttctttctgatggtgctcctgatacccgagccagatcgccaaaggacacctcaggacaaccagcttgcctatgtcgtgatcggcctcctgttcatgattttgacggttgcagccaacgaaatggggctgttagagaccactaagaaagatctaggaatcggccatgtggctgcggagaatcaccaacacgccacaatgctggacgtcgatctccggcccgcatctgcttggaccctttacgccgtagccaccacagtgattactccaatgatgcgtcatacgatcgaaaacaccacagcaaatataagcctgactgctattgccaaccaggcggctatcttgatgggtctggacaaggggtggcctatttccaaaatggatatcggcgttccgctcctggcccttggatgctactcacaggtgaatcccttaaccctgacagcagccgtcctcatgttggtggctcactatgcaataatcggcccagggctgcaggccaaggcgaccagagaggctcaaaagaggactgccgcaggaattatgaaaaaccctacggtcgacggcatcgtggccattgatctagaccccgttgtgtacgacgctaagtttgaaaaacagctgggtcagatcatgctccttatactgtgtacatctcagattttgctgatgcgcaccacttgggccctctgcgagagtatcaccctggcaacagggccattaactaccctttgggaaggatcgcctggcaagttctggaatacaacgatcgctgtaagcatggccaacattttccggggttcctatctggcgggcgccgggctcgcattttctctaatgaaatcactgggaggcgggcgaagaggaaccggcgctcaaggtgagactttgggggagaagtggaagaggcagctgaatcagctcagcaaatccgagttcaacacatacaagcgcagtggaatcatggaggtggatcggtctgaagccaaagagggccttaagagaggtgaaaccactaaacatgcagtcagccgtggcacagctaagctgaggtggtttgttgagcggaatttggtgaagcccgaggggaaagtcatagacctgggatgtggccgcgggggatggtcatattactgcgccggcctcaagaaagtgaccgaagtaaagggttatacgaaagggggaccgggccacgaggaaccaattcctatggccacctacggctggaacttagtgaagctgcattccgggaaagatgttttctttatgcccccagagaagtgtgacacacttctgtgcgatatcggagaaagtagccccaatcctactattgaggagggtcgaaccctaagagtgctcaagatggtcgaaccgtggctgaggggcaaccagttctgtatcaaaatattgaatccctacatgccatctgtggtcgaggcgctggaacaaatgcagcggaagcacgggggaatgctcgtgcgcaaccctctttccagaaattcaacacacgagatgtattgggttagctgcggcactggtaacatcgtatcggctgtgaacatgacctctaggatgctgttaaatcgatttacaatggcacatcggaaacccacctacgagcgtgacgtcgatctgggggccggaactagacacgtggctgttgaacctgaggtggccaacttggacattatcggccagcgcattgaaaatatcaagaacgagcataaaagtacgtggcactatgatgaagacaatccatacaagacatgggcatatcacggctcctacgaggtcaagcccagcgggtcagcctcctctatggtgaacggagtagtgaggctcctgaccaaaccttgggatgttattccaatggtcactcaaatcgctatgaccgacacaacgcccttcggtcagcagcgggtgtttaaggagaaagtggacaccagaactccgcgcgcgaagaggggcacaacccagataatggaagtcactgccaaatggctatgggggttccttagccgaaataagaagcctcggatttgtacaagagaggaatttaccaggaaagttcgcagtaacgcagctatcggagccgtgttcgtagatgagaatcaatggaactccgcaaaggaagccgtggaggacgagcgtttttgggatctggtccatcgggaaagagagctccacaaacagggcaagtgcgctacatgcgtgtataatatgatgggtaaaagggaaaagaagctgggggagttcggaaaagccaagggcagccgcgcgatctggtacatgtggttgggcgcacgattcctggaatttgaggccctcgggttcatgaacgaggaccattggttttctcgggaaaattcacttagtggagttgagggtgaaggcctgcacaaattagggtacattctgagagatatatccaagatcccaggaggcaacatgtatgctgacgatactgccggttgggacaccaggattacggaggatgacttgcagaatgaggcaaaaatcaccgaaattatggagcccgaacatgctctcctggccacaagcatcttcaagctaacttaccagaacaaagtggtccgcgtgcaaagacctgctaagaacgggaccgtaatggatgttatatctcggagggaccagcgtggatcgggccaggtgggcacatatgggcttaatacttttaccaacatggaggtccagctgatccgacaaatggaatcagagggaattttcctcccaagcgagctggaaacgcccaatttggccgagcgcgtgttagattggctggaaaagcacggtgcagagagactcaaacggatggcgatctccggcgacgactgtgtggtcaagccgattgatgacaggtttgccacagctcttaccgccctgaacgatatggggaaagttcgcaaggacatccctcagtgggaacccagtaaaggatggaatgattggcaacaggtgccattctgctctcaccattttcaccaactaataatgaaggacggcagagagattgtagtgccttgtcggaaccaggatgagctggtcggtagggcacgagtgagccagggggctggatggtccctccgtgaaactgcctgcttgggcaagtcatacgcacaaatgtggcagctgatgtatttccatagacgcgaccttcggctggccgcgaatgctatctgtagtgccgttcccgtggattgggtcccaacatctaggaccacttggagcatccacgcacaccatcagtggatgaccacagaggacatgctctccgtgtggaacagagtatggattgaagagaatccctggatggaagataaaacgcacgtttcaagctgggaggaggtgccttacttaggcaagcgcgaagaccagtggtgcgggtctctgataggattgaccgcccgggctacttgggccacaaacatccaagtcgcaattaatcaggtgaggcgactgatcggtaacgagaattatctcgactacatgacctccatgaaaagatttaagaacgaaagtgatccagagggcgctctttggtga

SEQ ID NO: 13341 - RNA, 9879 nt, synthetic construct
  misc_feature 1..9879: note = derived and/or modified CDS sequence (opt3) from DENV-1__GQ868507__SS-prME
  source 1..9879: mol_type = other RNA
agcgtgaccatgctgctcatgcttctgcccacagccttggctttccacttaactacgagaggcggggagcctcatatgatcgtctccaagcaggaaaggggaaaatctctgctatttaagacctcagcaggtgttaacatgtgcacactcattgccatggacctgggcgagctttgtgaagatactatgacctacaaatgcccacaaataacagaggcggaaccggacgatgtggactgttggtgcaatgctaccgatacttgggtaacatatgggacctgtagtcagacgggagagcaccggcgcgacaagcgaagcgtggccctggcaccccatgtcggcttgggtctcgagactcgtaccgaaacatggatgtcctctgagggggcctggaaacagatccagagagtggaaacttgggctctgaggcaccctggattcaccgttattgcactgtttctcgcccatgctatcggcacatcgattacccaaaagggcatcatattcatcttactgatgcttgtgacgccatcaatggccatgcggtgcgtcgggattggaaaccgcgattttgtggagggtttgagcggcgcgacttgggtagacgttgtgctggagcacgggagttgtgtcacaaccatggcaaagaataaacccactctagatatcgaactcctgaagacagaggtgaccaaccctgccattcttagaaaactgtgcatcgaagctaagatatccaatacgaccacagactctaggtgtccaactcagggagaggccaccttggtggaagagcaggatgcaaacttcgtctgccggcgcacatttgttgaccgaggctggggtaatgggtgtggactcttcggcaaaggcagcctgttaacttgcgctaagtttaagtgcgtgaccaaactggaggggaagattgtacagtacgaaaacctcaaatattccgtgatcgtcacagtgcacaccggagatcaacatcaggttggtaatgagactacggaacacggcacaattgccaccatcactccccaggcgcctacctcagagatccagcttacagactacggggccctgaccttggactgtagtccaagaactggactagatttcaacgaaatggtgctgctcacaatgaaggagaaaagctggctggtccataagcaatggtttcttgacctgccgttgccctggacgtctggcgcatccacctcacaggagacttggaataggcaggatctcctggtgacattcaaaaccgctcacgccaagaagcaagaagtagttgtgttaggtagccaggagggggctatgcacacagccctgactggcgcaaccgaaattcagacgagtggaaccacaactatatttgccggccatctaaaatgccggctcaagatggacaaactgacccttaaggggacatcttatgtcatgtgtactggatccttcaaattggagaaggaagtggctgagacccagcacggtacggtcctggtgcaagttaagtacgagggcacagatgcgccttgcaaaatcccattcagcacccaggacgaaaagggggtgactcagaacggacgtctcattacagcaaatcccatcgtaaccgataaagagaagcctgtcaacatagaaactgagccaccctttggcgagtcgtatattgtggttggtgccggggaaaaagctctgaagctttcttggttcaagaaaggctcctcaatcggaaagatgtttgaggccaccgcacgcggcgccagaaggatggctatcctgggggacacagcctgggatttcggaagtattggtggcgtgtttacgagcgtcgggaaattggtgcatcaggtattcggaaccgcatacggcgtgctcttttccggtgtttcttggactatgaagatcgggattggcatactgttaacatggctgggactaaatagccggtcaaccagtctctccatgacatgtatcgcggtcggcatggtgactctgtaccttggggtgatggtccaagctgacagcggatgcgttattaactggaaaggccgagaattgaagtgtggttctgggatcttcgtgaccaacgaggtgcacacgtggacagaacagtataagtttcaggccgattcaccgaaacgcctgagtgcagccatcggaaaggcttgggaggagggcgtatgcggtattagaagcgccaccaggctcgaaaatataatgtggaaacagatctccaacgagctgaatcatattttactggaaaacgacatgaagttcactgtcgtggttggcgacgcaaatgggatccttgctcaaggaaaaaagatgattcggcctcagcccatggagcacaaatactcttggaagtcgtggggcaaggccaaaatcataggggcggatatccagaacaccacatttattatcgacggaccagatactcctgaatgtcccgacaatcagcgcgcctggaacatttgggaggtggaggattatggcttcggtatctttaccacaaatatatggttgaagctcagagacagctacacgcaaatgtgcgatcacaggctgatgtccgctgcaattaaagactcaaaggccgtccatgctgatatggggtattggatcgaaagtgagaaaaacgaaacctggaagctagcccgtgcatctttcattgaggtgaagacttgtacatggccaaaaagccacaccctgtggtccaatggagttctcgaatcagagatgatcatacccaagatctacggcggtcctattagccagcataactatcggccaggctacttcactcagacagcggggccgtggcacctgggaaaacttgagttggactttgatctgtgcgaaggcaccacggtggtagtcgacgagcactgcgggaatcgaggaccctctttaagaactaccacagtgaccggcaagatcattcatgaatggtgttgcaggtcctgtactctccctccactgcgcttccggggtgaggatgggtgctggtacggaatggagatcagacccgtgaaagaaaaggaggaaaaccttgtcaggagtatggttagcgccggctctggtgaggtggactccttttcactgggcatattgtgtgctagtattatgatcgaagaggtaatgcgcagccgatggtcgcggaagatgctcatgacagggaccctggccgtgttcctactgctcgtcatgggacaactgacatggaatgaccttatccgtttgtgcattatggtgggcgcaaacgcttccgatagaatggggatgggaactacctatctggccttaatggcaacgtttaaaatgaggcctatgttcgccgttggcctcctgtttcgccggcttacatctagagaggtgctgctactcaccatcggtctgagcttggtcgcttcagtggaactgccaaacagtttagaggaactcggggacggactggcgatgggcattatgatgcttaagctgttgactgagttccagccccaccagctctggataaccctgctatccctgacatttatcaaaactaccctttctctcgattacgcctggaagacgacagcaatggctctgagcattgtttccttgttcccgctgtgtttatcaaccactagccagaaaacaacctggctccctgtgctgcttggcagttttgggtgcaagccactgactatgttcttgatcacagaaaataagatttggggaaggaaatcttggcccctcaacgagggtatcatggccataggcatcgtctccattctgctaagctcgctgcttaagaatgacgtacctctcgccgggcccctgatcgctggaggcatgttgattgcatgttatgtgatctcaggttctagtgccgatttatccctggagaaagcggctgaagttagctgggagcaagaagccgagcattctgggaccagccacaacatactcgtggaagtccaggacgatggaacgatgaagattaaagacgaggagcgagatgacactctgaccatccttctgaaggcaacattgctagccgtgtccggcgtatacccaatgtcaatccctgctaccctgtttgtgtggtatttctggcagaaaaagaagcagcgcagtggcgtcctctgggatacacccagcccaccggaagttgagcgggcagtgctggacgatgggatttacagaatacttcaaaggggattactgggtcgttctcaggtgggcgtcggggtgttccaggacggagtttttcatactatgtggcacgtaacccgcggcgccgtgctcatgtatcagggtaaacggttggaaccttcctgggcgtcagtcaagaaagacctgatcagttacgggggaggctggagattccaaggcagctggaatacgggggaggaggtgcaggttattgctgtggaacccggaaagaacccaaaaaatgtccagacaatgcccggtacttttaagacccctgagggcgaagtgggggccatcgcactcgatttcaagccaggaacatccggctctcccattgtaaacagggagggtaaaatcgtcgggctgtacggaaatggcgtggttaccacttcgggcacctatgtgagcgccatagctcaagccaaggcatcacaggaagggcctcttccggagatcgaggacgaagtctttaaaaagcgaaacctgacaattatggatttgcacccaggatccggtaaaacgcggcgctacctacccgctatggtgagagaggccatcaagaggaagctgcggactctcattttagcgcctacccgagttgtggccagtgaaatggcagaggctctgaaaggcatgccaatcagatatcagacaaccgccgtcaagtctgaacatactgggcgcgagatagtggaccttatgtgccacgctacattcaccatgaggctgctcagccccgtacgtgtgcctaattacaacatgattatcatggatgaggcacattttacggacccggcctccatcgccgctcggggatatatttcaactagagttggcatgggtgaagcggcagccatcttcatgacagctacccccccagggtctgtcgaggcctttcctcagagcaatgcagtgatacaagatgaagagagggacattcccgaacgcagttggaactccggatacgattggatcaccgacttcccaggcaaaactgtgtggtttgtccctagcattaagtctggcaatgatatcgccaactgtttgcgaaaaaacgggaagagagtaatacagctgtcacggaagacattcgacaccgagtatcagaaaacaaagaataacgactgggattacgtggttactacggacatttccgagatgggagctaatttcagggcggatcgcgtgatcgacccccgtagatgcctcaaaccagtcatcctgaaggatggtccggaacgggtgattcttgccggccctatgcccgttaccgtggcaagtgctgcccagaggcgcgggcgaatcggaagaaaccaaaataaagagggcgaccagtacgtctatatgggtcagccactaaacaatgatgaagaccacgcacattggacagaggccaagatgctgttggataacattaatactcccgaggggataatccctgctttatttgaaccagagcgggaaaagagcgccgcgattgacggcgagtacaggctgcgcggagaagcaagaaaaaccttcgtggagctcatgaggcggggcgatctgcccgtatggctttcgtataaggtggcctctgaggggtttcagtactccgaccgtcgctggtgcttcgatggagaacgaaacaatcaagttctggaggaaaacatggacgtcgagatctggacaaaagaaggtgagagaaagaaactcaggcctcggtggttggacgctcgcacctatagcgatccgctggccctaagagagtttaaggaattcgctgcaggcaggcggtcagtgagtggggacctgatcctcgagattggaaaacttccacagcacctgactttacgagcccagaatgctttggataacctggtgatgctccacaattctgaacagggcggtaaggcctacagacatgcaatggaggaactgcccgacacgatagagacccttatgctgctcgcgttgatcgccgtcctgacagggggcgttactttatttttcctatccggaaagggcctggggaaaaccagcattggactcctttgtgtgacagcttcaagtgccctgttgtggatggcaagcgtagagcctcactggatcgctgcctccattatcctggaatttttcctcatggtgctgcttatacccgagccagatcgccaaaggacccctcaggacaaccagctcgcatatgtcgtgatcggtctgttgtttatgattctgactgttgccgctaacgaaatgggcttactagagacaacgaagaaagatctggggatcggacatgtggcggccgagaatcaccaacacgcaaccatgctcgacgtcgatcttcggcccgcttctgcctggactctgtacgccgtagcaacaaccgtgattaccccaatgatgcgtcatacaatcgaaaacactacggctaatataagcttgaccgccattgcgaaccaggctgccatcctgatgggcctcgacaagggttggcctatttccaaaatggatatcggggttccgctgcttgcattaggctgctactcacaggtgaatcccctgacactcactgccgctgtcttgatgctggtggcacactatgccataatcggaccaggcctacaggcgaaggctaccagagaggcccaaaagaggacagcagccgggattatgaaaaaccctaccgtcgacggaatcgtggctattgatctggaccccgttgtgtacgacgccaagttcgaaaaacagctcggccagatcatgcttctgatattgtgtacttctcagattctgctcatgcgcacgacatgggcactgtgcgagagtatcaccttagctactggtccacttaccacactgtgggaagggtcgcctggaaagttttggaatactaccatcgccgtaagcatggcgaacattttccggggctcctatctcgccggtgcaggcctagctttctctctgatgaaatcattggggggaggccgaagagggacaggagcccaaggcgagacgctgggtgagaagtggaagaggcagctcaatcagcttagcaaatccgaatttaacacctacaagcgcagtgggatcatggaggtggatcggtctgaagcaaaagagggactgaagagaggcgaaactacaaaacatgctgtcagccgtggtaccgccaagttgaggtggttcgttgagcggaatctggtgaagcccgagggcaaagtcatagacctcgggtgtggacgcggcgggtggtcatattactgcgccggattaaagaaagtgactgaagtaaagggctatacaaaaggtgggccgggacacgaggaaccaattcctatggcgacctacggctggaacctggtgaagcttccctccggcaaagatgtttttttcatgccacccgagaagtgtgacacgctgctatgcgatatcggggaaagtagccctaatccgaccattgaggagggacgaacactcagagtgctgaagatggtcgaaccctggttgaggggtaaccagttttgtatcaaaatactgaatccatacatgccttctgtggtcgagactctcgaacaaatgcagcggaagcatggcgggatgcttgtgcgcaaccccctgtccagaaattcaacccacgagatgtattgggttagctgcggaacaggcaacatcgtatcggctgtgaacatgacttctaggatgttactgaatcgattcaccatggcacaccggaaacctacatacgagcgtgacgtcgatttgggtgccgggaccagacatgtggctgttgaaccagaggtggccaacctcgacattatcggacagcgcattgaaaatatcaagaacgagcacaaaagtacttggcattatgatgaagacaatccctacaagacgtgggcatatcacggctcctacgaggtcaagcctagcggctcagcctcctctatggtgaacggggtagtgaggctgctaacaaaaccatgggatgttattcccatggtcacccaaatcgctatgactgacaccacaccgtttggacagcagcgggtgttcaaggagaaagtggacacgagaacccctcgcgcgaagaggggtactacacagataatggaagtcaccgccaaatggctttggggctttctgagccgaaataagaagccacggatttgtactagagaggaattcacaaggaaagttcgcagtaacgcagctatcggggccgtgtttgtagatgagaatcaatggaactccgcaaaggaagccgtggaggacgagcgtttctgggatctcgtccaccgggaaagagagctgcataaacagggaaagtgcgctacctgcgtgtataatatgatgggcaaaagggaaaagaagttgggtgagtttgggaaagccaagggaagccgcgcgatctggtacatgtggctgggcgcacgattcctcgaattcgaggcccttggctttatgaacgaggaccactggttctctcgggaaaattcactgagtggggttgagggagaaggtttacataaactgggctacattttgagagatatatccaagatccccgggggaaacatgtatgctgacgatacagccggctgggacactaggattaccgaggatgacctccagaatgaggcaaaaatcacggaaattatggagcctgaacacgctctgctagccaccagcatctttaagcttacataccagaacaaagtggtccgcgtgcaaagaccagctaagaacggtactgtaatggatgttatatctcggagggaccagcgtgggtcgggacaggtgggcacctatggcctgaatacattcactaacatggaggtccagctcatccgacaaatggaatcagaggggatttttctgcccagcgagttggaaaccccgaatttagccgagcgcgtgctggattggctcgaaaagcatggagcagagagacttaaacggatggcgatctccggtgacgactgtgtggtcaagcctattgatgacaggttcgccacggctctgacagccctaaacgatatgggcaaagttcgcaaggacatcccccagtgggaaccaagtaaagggtggaatgattggcagcaggtgcctttttgctctcaccacttccatcaactgataatgaaggacggaagagagattgtagtgccctgtcggaaccaggatgagctcgtcggcagggcacgagtgagccagggtgctgggtggtccttgcgtgaaaccgcctgcctgggaaagtcatacgcacaaatgtggcagcttatgtattttcacagacgcgacctgcggctcgccgcgaatgctatctgtagtgccgttccagtggattgggtccccacttctaggacaacctggagcatccatgcacaccaccagtggatgactaccgaggacatgttatccgtgtggaacagagtatggattgaagagaatccttggatggaagataaaacacatgtttcaagctgggaggaggtgccatacctgggcaagcgcgaagaccagtggtgcggctctttgatagggctgacggcccgggctacctgggccactaacatccaagtcgcaattaatcaggtgaggcgactcatcggaaacgagaattatcttgactacatgacatccatgaaaagattcaagaacgaaagtgatccggagggtgctctgtggtga

SEQ ID NO: 13342 - RNA, 9879 nt, synthetic construct
  misc_feature 1..9879: note = derived and/or modified CDS sequence (opt3) from DENV-1__GQ868508__SS-prME
  source 1..9879: mol_type = other RNA
agcgtgaccatgctgctcatgcttctgcccacagccttggctttccacttaactacgagaggcggggagcctcatatgatcgtctccaagcaggaaaggggaaaatctctgctatttaagacctcagcaggtgttaacatgtgcacactcattgccatggacctgggcgagctttgtgaagatactatgacctacaaatgcccacaaataacagaggcggaaccggacgatgtggactgttggtgcaatgctaccgatacttgggtaacatatgggacctgtagtcagacgggagagcaccggcgcgacaagcgaagcgtggccctggcaccccatgtcggcttgggtctcgagactcgtaccgaaacatggatgtcctctgagggggcctggaaacagatccagagagtggaaacttgggctctgaggcaccctggattcaccgttattgcactgtttctcgcccatgctatcggcacatcgattacccaaaagggcatcatattcatcttactgatgcttgtgacgccatcaatggccatgcggtgcgtcgggattggaaaccgcgattttgtggagggtttgagcggcgcgacttgggtagacgttgtgctggagcacgggagttgtgtcacaaccatggcaaagaataaacccactctagatatcgaactcctgaagacagaggtgaccaaccctgccattcttagaaaactgtgcatcgaagctaagatatccaatacgaccacagactctaggtgtccaactcagggagaggccaccttggtggaagagcaggatgcaaacttcgtctgccggcgcacatttgttgaccgaggctggggtaatgggtgtggactcttcggcaaaggcagcctgttaacttgcgctaagtttaagtgcgtgaccaaactggaggggaagattgtacagtacgaaaacctcaaatattccgtgatcgtcacagtgcacaccggagatcaacatcaggttggtaatgagactacggaacacggcacaattgccaccatcactccccaggcgcctacctcagagatccagcttacagactacggggccctgaccttggactgtagtccaagaactggactagatttcaacgaaatggtgctgctcacaatgaaggagaaaagctggctggtccataagcaatggtttcttgacctgccgttgccctggacgtctggcgcatccacctcacaggagacttggaataggcaggatctcctggtgacattcaaaaccgctcacgccaagaagcaagaagtagttgtgttaggtagccaggagggggctatgcacacagccctgactggcgcaaccgaaattcagacgagtggaaccacaactatatttgccggccatctaaaatgccggctcaagatggacaaactgacccttaaggggacatcttatgtcatgtgtactggatccttcaaattggagaaggaagtggctgagacccagcacggtacggtcctggtgcaagttaagtacgagggcacagatgcgccttgcaaaatcccattcagcacccaggacgaaaagggggtgactcagaacggacgtctcattacagcaaatcccatcgtaaccgataaagagaagcctgtcaacatagaaactgagccaccctttggcgagtcgtatattgtggttggtgccggggaaaaagctctgaagctttcttggttcaagaaaggctcctcaatcggaaagatgtttgaggccaccgcacgcggcgccagaaggatggctatcctgggggacacagcctgggatttcggaagtattggtggcgtgtttacgagcgtcgggaaattggtgcatcaggtattcggaaccgcatacggcgtgctcttttccggtgtttcttggactatgaagatcgggattggcatactgttaacatggctgggactaaatagccggtcaaccagtctctccatgacatgtatcgcggtcggcatggtgactctgtaccttggggtgatggtccaagctgacagcggatgcgttattaactggaaaggccgagaattgaagtgtggttctgggatcttcgtgaccaacgaggtgcacacgtggacagaacagtataagtttcaggccgattcaccgaaacgcctgagtgcagccatcggaaaggcttgggaggagggcgtatgcggtattagaagcgccaccaggctcgaaaatataatgtggaaacagatctccaacgagctgaatcatattttactggaaaacgacatgaagttcactgtcgtggttggcgacgcaaatgggatccttgctcaaggaaaaaagatgattcggcctcagcccatggagcacaaatactcttggaagtcgtggggcaaggccaaaatcataggggcggatatccagaacaccacatttattatcgacggaccagatactcctgaatgtcccgacaatcagcgcgcctggaacatttgggaggtggaggattatggcttcggtatctttaccacaaatatatggttgaagctcagagacagctacacgcaaatgtgcgatcacaggctgatgtccgctgcaattaaagactcaaaggccgtccatgctgatatggggtattggatcgaaagtgagaaaaacgaaacctggaagctagcccgtgcatctttcattgaggtgaagacttgtacatggccaaaaagccacaccctgtggtccaatggagttctcgaatcagagatgatcatacccaagatctacggcggtcctattagccagcataactatcggccaggctacttcactcagacagcggggccgtggcacctgggaaaacttgagttggactttgatctgtgcgaaggcaccacggtggtagtcgacgagcactgcgggaatcgaggaccctctttaagaactaccacagtgaccggcaagatcattcatgaatggtgttgcaggtcctgtactctccctccactgcgcttccggggtgaggatgggtgctggtacggaatggagatcagacccgtgaaagaaaaggaggaaaaccttgtcaggagtatggttagcgccggctctggtgaggtggactccttttcactgggcatattgtgtgctagtattatgatcgaagaggtaatgcgcagccgatggtcgcggaagatgctcatgacagggaccctggccgtgttcctactgctcgtcatgggacaactgacatggaatgaccttatccgtttgtgcattatggtgggcgcaaacgcttccgatagaatggggatgggaactacctatctggccttaatggcaacgtttaaaatgaggcctatgttcgccgttggcctcctgtttcgccggcttacatctagagaggtgctgctactcaccatcggtctgagcttggtcgcttcagtggaactgccaaacagtttagaggaactcggggacggactggcgatgggcattatgatgcttaagctgttgactgagttccagccccaccagctctggataaccctgctatccctgacatttatcaaaactaccctttctctcgattacgcctggaagacgacagcaatggctctgagcattgtttccttgttcccgctgtgtttatcaaccactagccagaaaacaacctggctccctgtgctgcttggcagttttgggtgcaagccactgactatgttcttgatcacagaaaataagatttggggaaggaaatcttggcccctcaacgagggtatcatggccataggcatcgtctccattctgctaagctcgctgcttaagaatgacgtacctctcgccgggcccctgatcgctggaggcatgttgattgcatgttatgtgatctcaggttctagtgccgatttatccctggagaaagcggctgaagttagctgggagcaagaagccgagcattctgggaccagccacaacatactcgtggaagtccaggacgatggaacgatgaagattaaagacgaggagcgagatgacactctgaccatccttctgaaggcaacattgctagccgtgtccggcgtatacccaatgtcaatccctgctaccctgtttgtgtggtatttctggcagaaaaagaagcagcgcagtggcgtcctctgggatacacccagcccaccggaagttgagcgggcagtgctggacgatgggatttacagaatacttcaaaggggattactgggtcgttctcaggtgggcgtcggggtgttccaggacggagtttttcatactatgtggcacgtaacccgcggcgccgtgctcatgtatcagggtaaacggttggaaccttcctgggcgtcagtcaagaaagacctgatcagttacgggggaggctggagattccaaggcagctggaatacgggggaggaggtgcaggttattgctgtggaacccggaaagaacccaaaaaatgtccagacaatgcccggtacttttaagacccctgagggcgaagtgggggccatcgcactcgatttcaagccaggaacatccggctctcccattgtaaacagggagggtaaaatcgtcgggctgtacggaaatggcgtggttaccacttcgggcacctatgtgagcgccatagctcaagccaaggcatcacaggaagggcctcttccggagatcgaggacgaagtctttaaaaagcgaaacctgacaattatggatttgcacccaggatccggtaaaacgcggcgctacctacccgctatggtgagagaggccatcaagaggaagctgcggactctcattttagcgcctacccgagttgtggccagtgaaatggcagaggctctgaaaggcatgccaatcagatatcagacaaccgccgtcaagtctgaacatactgggcgcgagatagtggaccttatgtgccacgctacattcaccatgaggctgctcagccccgtacgtgtgcctaattacaacatgattatcatggatgaggcacattttacggacccggcctccatcgccgctcggggatatatttcaactagagttggcatgggtgaagcggcagccatcttcatgacagctacccccccagggtctgtcgaggcctttcctcagagcaatgcagtgatacaagatgaagagagggacattcccgaacgcagttggaactccggatacgattggatcaccgacttcccaggcaaaactgtgtggtttgtccctagcattaagtctggcaatgatatcgccaactgtttgcgaaaaaacgggaagagagtaatacagctgtcacggaagacattcgacaccgagtatcagaaaacaaagaataacgactgggattacgtggttactacggacatttccgagatgggagctaatttcagggcggatcgcgtgatcgacccccgtagatgcctcaaaccagtcatcctgaaggatggtccggaacgggtgattcttgccggccctatgcccgttaccgtggcaagtgctgcccagaggcgcgggcgaatcggaagaaaccaaaataaagagggcgaccagtacgtctatatgggtcagccactaaacaatgatgaagaccacgcacattggacagaggccaagatgctgttggataacattaatactcccgaggggataatccctgctttatttgaaccagagcgggaaaagagcgccgcgattgacggcgagtacaggctgcgcggagaagcaagaaaaaccttcgtggagctcatgaggcggggcgatctgcccgtatggctttcgtataaggtggcctctgaggggtttcagtactccgaccgtcgctggtgcttcgatggagaacgaaacaatcaagttctggaggaaaacatggacgtcgagatctggacaaaagaaggtgagagaaagaaactcaggcctcggtggttggacgctcgcacctatagcgatccgctggccctaagagagtttaaggaattcgctgcaggcaggcggtcagtgagtggggacctgatcctcgagattggaaaacttccacagcacctgactttacgagcccagaatgctttggataacctggtgatgctccacaattctgaacagggcggtaaggcctacagacatgcaatggaggaactgcccgacacgatagagacccttatgctgctcgcgttgatcgccgtcctgacagggggcgttactttatttttcctatccggaaagggcctggggaaaaccagcattggactcctttgtgtgacagcttcaagtgccctgttgtggatggcaagcgtagagcctcactggatcgctgcctccattatcctggaatttttcctcatggtgctgcttatacccgagccagatcgccaaaggacccctcaggacaaccagctcgcatatgtcgtgatcggtctgttgtttatgattctgactgttgccgctaacgaaatgggcttactagagacaacgaagaaagatctggggatcggacatgtggcggccgagaatcaccaacacgcaaccatgctcgacgtcgatcttcggcccgcttctgcctggactctgtacgccgtagcaacaaccgtgattaccccaatgatgcgtcatacaatcgaaaacactacggctaatataagcttgaccgccattgcgaaccaggctgccatcctgatgggcctcgacaagggttggcctatttccaaaatggatatcggggttccgctgcttgcattaggctgctactcacaggtgaatcccctgacactcactgccgctgtcttgatgctggtggcacactatgccataatcggaccaggcctacaggcgaaggctaccagagaggcccaaaagaggacagcagccgggattatgaaaaaccctaccgtcgacggaatcgtggctattgatctggaccccgttgtgtacgacgccaagttcgaaaaacagctcggccagatcatgcttctgatattgtgtacttctcagattctgctcatgcgcacgacatgggcactgtgcgagagtatcaccttagctactggtccacttaccacactgtgggaagggtcgcctggaaagttttggaatactaccatcgccgtaagcatggcgaacattttccggggctcctatctcgccggtgcaggcctagctttctctctgatgaaatcattggggggaggccgaagagggacaggagcccaaggcgagacgctgggtgagaagtggaagaggcagctcaatcagcttagcaaatccgaatttaacacctacaagcgcagtgggatcatggaggtggatcggtctgaagcaaaagagggactgaagagaggcgaaactacaaaacatgctgtcagccgtggtaccgccaagttgaggtggttcgttgagcggaatctggtgaagcccgagggcaaagtcatagacctcgggtgtggacgcggcgggtggtcatattactgcgccggattaaagaaagtgactgaagtaaagggctatacaaaaggtgggccgggacacgaggaaccaattcctatggcgacctacggctggaacctggtgaagcttcattccggcaaagatgtttttttcatgcccccagagaagtgtgacacgctgctatgcgatatcggggaaagtagccccaatcctaccattgaggagggacgaacactcagagtgctgaagatggtcgaaccgtggttgaggggtaaccagttttgtatcaaaatactgaatccctacatgccatctgtggtcgagactctcgaacaaatgcagcggaagcacggcgggatgcttgtgcgcaaccctctgtccagaaattcaacccacgagatgtattgggttagctgcggaacaggcaacatcgtatcggctgtgaacatgacttctaggatgttactgaatcgattcaccatggcacatcggaaacccacatacgagcgtgacgtcgatttgggtgccgggaccagacacgtggctgttgaacctgaggtggccaacctcgacattatcggacagcgcattgaaaatatcaagaacgagcataaaagtacttggcactatgatgaagacaatccatacaagacgtgggcatatcacggctcctacgaggtcaagcccagcggctcagcctcctctatggtgaacggggtagtgaggctgctaacaaaaccttgggatgttattccaatggtcacccaaatcgctatgactgacaccacaccctttggacagcagcgggtgttcaaggagaaagtggacacgagaaccccgcgcgcgaagaggggtactacacagataatggaagtcaccgccaaatggctttggggctttctgagccgaaataagaagcctcggatttgtactagagaggaattcacaaggaaagttcgcagtaacgcagctatcggggccgtgtttgtagatgagaatcaatggaactccgcaaaggaagccgtggaggacgagcgtttctgggatctcgtccatcgggaaagagagctgcacaaacagggaaagtgcgctacctgcgtgtataatatgatgggcaaaagggaaaagaagttgggtgagtttgggaaagccaagggaagccgcgcgatctggtacatgtggctgggcgcacgattcctcgaattcgaggcccttggctttatgaacgaggaccattggttctctcgggaaaattcactgagtggggttgagggagaaggtttacacaaactgggctacattttgagagatatatccaagatcccagggggaaacatgtatgctgacgatacagccggctgggacactaggattaccgaggatgacctccagaatgaggcaaaaatcacggaaattatggagcccgaacatgctctgctagccaccagcatctttaagcttacataccagaacaaagtggtccgcgtgcaaagacctgctaagaacggtactgtaatggatgttatatctcggagggaccagcgtgggtcgggacaggtgggcacctatggcctgaatacattcactaacatggaggtccagctcatccgacaaatggaatcagaggggatttttctgccaagcgagttggaaacccccaatttagccgagcgcgtgctggattggctcgaaaagcacggagcagagagacttaaacggatggcgatctccggtgacgactgtgtggtcaagccgattgatgacaggttcgccacggctctgacagccctaaacgatatgggcaaagttcgcaaggacatccctcagtgggaacccagtaaagggtggaatgattggcagcaggtgccattttgctctcaccatttccaccaactgataatgaaggacggaagagagattgtagtgccttgtcggaaccaggatgagctcgtcggcagggcacgagtgagccagggtgctgggtggtccttgcgtgaaaccgcctgcctgggaaagtcatacgcacaaatgtggcagcttatgtattttcatagacgcgacctgcggctcgccgcgaatgctatctgtagtgccgttcccgtggattgggtcccaacttctaggacaacctggagcatccacgcacaccatcagtggatgactaccgaggacatgttatccgtgtggaacagagtatggattgaagagaatccctggatggaagataaaacacacgtttcaagctgggaggaggtgccttacctgggcaagcgcgaagaccagtggtgcggctctttgatagggctgacggcccgggctacctgggccactaacatccaagtcgcaattaatcaggtgaggcgactcatcggaaacgagaattatcttgactacatgacatccatgaaaagattcaagaacgaaagtgatccagagggtgctctgtggtga

SEQ ID NO: 13343 - RNA, 9879 nt, synthetic construct
  misc_feature 1..9879: note = derived and/or modified CDS sequence (opt3) from DENV-1__GQ868509__SS-prME
  source 1..9879: mol_type = other RNA
agcgtgaccatgctgctcatgcttctgccaacagcattggctttccacttaactacgcgaggaggggagcctcatatgatcgtctccaagcaggaaaggggaaaatctctgctgtttaagacctcagccggtgttaacatgtgcaccctcattgccatggacctgggcgagctttgtgaagatactatgacctacaaatgcccacaaataacagaggcggaaccggacgatgtggactgttggtgcaatgctaccgatacttgggtaacatatgggacctgtagtcagacgggagagcaccggcgcgacaagcgaagcgtggccctggcaccccatgtcggcttgggtctcgagactcgtaccgaaacatggatgtcctctgagggggcctggaaacagatccagagagtggaaacttgggctctgaggcaccctggattcaccgttattgcactgtttctcgcccatgctatcggcacatcgattacccaaaagggcatcatattcatcttactgatgcttgtgacgccatcaatggccatgcggtgcgtcgggattggaaaccgcgattttgtggagggtttgagcggcgcgacttgggtagacgttgtgctggagcacgggagttgtgtcacaaccatggcaaagaataaacccactctagatatcgaactcctgaagacagaggtgaccaaccctgccattcttagaaaactgtgcatcgaagctaagatatccaatacgaccacagactctaggtgtccaactcagggagaggccaccttggtggaagaacaggatgcaaacttcgtctgccggcgcacatttgttgaccgaggctggggtaatgggtgtggactcttcggcaaaggcagcctgttaacttgcgctaagtttaagtgcgtgaccaaactggaggggaagattgtacagtacgaaaacctcaaatattccgtgatcgtcacagtgcacaccggagatcaacatcaggttggtaatgagactacggaacacggcacaattgccaccatcactccccaggcgcctacctcagagatccagcttacagactacggggccctgaccttggactgtagtccaagaactggactagatttcaacgaaatggtgctgctcacaatgaaggagaaaagctggctggtccataagcaatggtttcttgacctgccgttgccctggacgtctggcgcatccacctcacaggagacttggaataggcaggatctcctggtgacattcaaaaccgctcacgccaagaagcaagaagtagttgtgttaggtagccaggagggggctatgcacacagccctgactggcgcaaccgaaattcagatgagtggaacgaccacaatatttgccggccatctaaaatgccggctcaagatggacaaactgactcttaaggggacctcttatgtcatgtgtacaggatccttcaaattggagaaggaagtggctgagactcagcacggtaccgtcctggtgcaagttaagtacgagggcacggatgcgccttgcaaaatcccattcagcacacaggacgaaaagggggtgacccagaacggacgtctcattactgcaaatcccatcgtaacagataaagagaagcctgtcaacatagaaaccgagccaccctttggcgagtcgtatattgtggttggtgccggggaaaaagctctgaaactttcttggttcaagaaaggctcctcaatcggaaagatgtttgaggccactgcacgcggcgccagaaggatggctatcctgggggacaccgcctgggatttcggaagtattggtggcgtgtttacaagcgtcgggaaattggtgcatcaggtattcggaacggcatacggcgtgctcttttccggtgtttcttggaccatgaagatcgggattggcatactgttaacttggctgggactaaatagccggtcaacaagtctctccatgacctgtatcgcggtcggcatggtgacactgtaccttggggtgatggtccaagctgacagcggatgcgttattaactggaaaggccgagaattgaagtgtggttctgggatcttcgtgactaacgaggtgcacacctggacggaacagtataagtttcaggccgattcaccgaaacgcctgagtgcagccatcggaaaggcttgggaggagggcgtatgcggtattagaagcgtcacaaggctcgaaaatataatgtggaaacagatctccaacgagctgaatcatattttactggaaaacgacatgaagttcaccgtggttgtgggcgacgccaatgggatccttgcacaaggcaagaagatgattcggcctcagcccatggagcacaaatactcttggaagtcgtggggcaaggctaaaatcataggggccgatatccagaacactacctttattatcgacggaccagatacacctgaatgtcccgacaatcagcgcgcgtggaacatttgggaggtcgaggattatggcttcggtatctttactaccaatatatggttgaagctcagagacagctacacacaaatgtgcgatcacaggctgatgtccgccgctattaaagactcaaaggcagtgcatgccgatatggggtattggatcgaaagtgagaaaaacgaaacgtggaagctagctcgtgcctctttcattgaggttaagacctgtacttggccaaaaagccacacactgtggtccaatggagtgctcgaatcagagatgatcatacccaagatctacggcggtcctattagccagcataactatcggccaggctacttcacccagactgcagggccgtggcacctgggaaaacttgagttggactttgatctgtgcgaaggcacaaccgtagtcgtggacgagcactgcgggaatcgaggaccctctttaagaacgactaccgtgacaggcaagatcattcatgaatggtgttgcaggtcctgtaccctccctccactgcgcttccggggtgaggatgggtgctggtacggaatggagatcagacccgtcaaagaaaaggaggaaaaccttgttaggagtatggtgagcgcgggctctggtgaggtagactccttttcactgggcatattgtgtgccagtattatgatcgaagaggtgatgcgcagccgatggtcgcggaagatgctcatgactgggacactggctgtcttcctactgctcatcatgggacaactgacctggaatgaccttattcgtttgtgcatcatggtgggcgccaacgcatccgatagaatggggatgggaacaacttatctggctttaatggccacctttaaaatgaggcctatgttcgcagttggcctcctgtttcgccggcttacgtctagagaggtgctgctactcacaattggtctgagcttggtcgcctcagtggaactgccaaacagtttagaggaactcggggacggactggctatgggcataatgatgcttaagctgttgaccgagttccagccccaccagctctggactaccctgctatccctgacatttatcaaaactaccctttctctcgattacgcgtggaagacgacagccatggcactgagcattgtttccttgttcccgctgtgtttatcaaccactagccagaaaacaacctggctccctgtgctgcttggcagttttgggtgcaagccactgactatgttcttgatcacagaaaataagatttggggaaggaaatcttggcccctcaacgagggtatcatggctataggcatcgtctccattctgctaagctcgctgcttaagaatgacgtacctctcgccgggcccctgatcgccggaggcatgttgattgcttgttatgtgatctcaggttctagtgcagatttatccctggagaaagccgcggaagttagctgggagcaagaagctgagcattctgggaccagccacaacatactcgtggaagtccaggacgatggaacgatgaagattaaagacgaggagcgagatgacactctgaccatccttctgaaggccacattgctagcagtgtccggcgtatacccaatgtcaatccctgccaccctgtttctctggtatttctggcagaaaaagaagcagcgcagtggcgtgctgtgggatacacccagcccaccggaagtcgagcgggctgttcttgacgatgggatttacagaatattacaaaggggactgctcggtcgttctcaggtgggcgtgggggtcttccaggacggagtgtttcatactatgtggcacgttacccgcggcgcagtattgatgtatcagggtaaacggctggaaccttcctgggcctcagtgaagaaagacctcatcagttacgggggaggctggagattccaaggcagctggaatacgggggaggaggtccaggtgattgcggttgaacccggaaagaaccccaaaaatgtgcagacaactcccggtacctttaagacacctgagggcgaagtcggggctatcgccctggatttcaagccaggaacctccggctctcccattgtgaacagggagggtaaaatcgtagggctttacggaaatggcgtcgtgactacctcgggcacatatgttagcgcaatagcccaagctaaggcctcacaggaagggcctctgccggagatcgaggacgaagtgtttaaaaagcgaaacttgacgattatggatctacacccaggatccggtaaaactcggcgctacctgcccgcaatcgtcagagaggctattaagaggaagctccggaccttaatcctggcccctacacgagtggttgcgagtgaaatggccgaggcacttaaaggcatgccaataagatatcagaccactgctgtgaagtctgaacatacagggcgcgagattgtcgacctgatgtgccacgccaccttcacgatgaggctcttgagccccgtgcgtgtacctaattacaacatgatcatcatggatgaggctcattttactgacccggcatccattgccgcccggggatatatctcaacaagagtgggcatgggtgaagctgcggcaatattcatgaccgccacacccccagggtctgttgaggcttttcctcagagcaatgccgtcattcaagatgaagagagggacatccccgaacgcagttggaactccggatacgattggattactgacttcccaggcaaaacagtgtggtttgtgcctagcatcaagtctggcaatgatatagcaaactgtctgcggaaaaacgggaagagagtcattcagctctcaagaaagaccttcgacacagagtatcagaaaactaagaataacgactgggattacgtagtgacgaccgacatctccgagatgggagccaatttcagggctgatcgcgttatcgacccccgtagatgcctgaaaccagtgattcttaaggatggtccggaacgggtcatcctagcgggccctatgcccgtgacagttgccagtgcagctcagaggcgcgggcgaattggaagaaaccaaaataaagagggcgaccagtacgtgtatatgggtcagccactgaacaatgatgaagaccacgcccattggactgaggcaaagatgttgttagataacataaatacccccgaggggatcattcctgccctgtttgaaccagagcgggaaaagagcgctgccatcgacggcgagtacaggctccgcggagaagcgagaaaaacattcgtcgagctgatgaggcggggcgatcttcccgtgtggctgtcgtataaggtagcatctgaggggtttcagtactccgaccgtcgctggtgcttcgatggagaacgaaacaatcaagtgctcgaggaaaacatggacgttgagatctggaccaaagaaggtgagagaaagaaattgaggcctcggtggctggacgcccgcacttatagcgatccgctagctctgagagagtttaaggagttcgccgctggcaggcggtcagtcagtggggacctcattcttgagataggaaaactgccacagcacttaacgttgcgagcacagaatgccctggataacctcgtgatgctgcacaattctgaacagggcggtaaggcttacagacatgccatggaggaacttcccgacaccatcgagacactgatgctcttggcactgattgcggtgttaactgggggcgtcaccctatttttcctgtccggaaagggcctcgggaaaacaagcatcggacttctgtgtgttaccgcctcaagtgctttgctgtggatggccagcgtggagcctcactggattgcagcttccatcatactcgaatttttcctgatggtacttctcatccccgagccagatcgccaaaggactcctcaggacaaccagctggcctatgtggtcattggtttgctgtttatgatcttaacagtggcagccaacgaaatgggcctactggagacgaccaagaaagatctcgggattggacatgttgctgcggagaatcaccaacacgccactatgcttgacgtggatctgcggcccgcatctgcttggacattgtacgccgtcgccaccaccgtaatcacaccaatgatgcgtcatactatagaaaacacgaccgcaaatattagcctgacagctatcgccaaccaggcggctattctcatgggcctggacaagggttggcctatctccaaaatggatataggggtgccgcttttagccctgggctgctactcacaggttaatcccctcactttgaccgcagccgtgctgatgctagtcgctcactatgcaatcattggaccaggcctgcaggccaaggcgacaagagaggctcaaaagaggaccgccgcagggatcatgaaaaaccctactgtggacggaattgtcgccatcgatctcgaccccgtggtttacgacgctaagttcgaaaaacagcttggccagataatgctgttgattctgtgtacgtctcagatcctcctgatgcgcacaacctgggccttatgcgagagtatcactcttgcaaccggtccactgacaactctctgggaagggtcgcctggaaagttttggaataccacaattgctgtgagcatggccaacatcttccggggctcctatctagcgggtgccggcctggcattctctttgatgaaatcactagggggaggccgaagagggacgggagctcaaggcgagaccctcggtgagaagtggaagaggcagcttaatcagctgagcaaatccgaatttaacacttacaagcgcagtgggataatggaggtagatcggtctgaagccaaagagggattgaagagaggcgaaacaaccaaacatgcagtgagccgtggtactgctaagctgaggtggttcgtcgagcggaatctcgttaagcccgagggcaaagtgattgacttagggtgtggacgcggcgggtggtcatattactgcgccggactgaagaaagtcacagaagtgaagggctataccaaaggtgggccgggacacgaggaaccaatccctatggccacgtacggctggaaccttgtaaagctgcattccggcaaagatgtgtttttcatgcccccagagaagtgtgacaccctactctgcgatattggggaaagtagccccaatcctacaatcgaggagggacgaactctgagagttttgaagatggtggaaccgtggctgaggggtaaccagttttgtataaaaatcctcaatccctacatgccatctgtcgtggagacccttgaacaaatgcagcggaagcacggcgggatgctggtccgcaaccctttatccagaaattcaacacacgagatgtattgggtgagctgcggaactggcaacattgtttcggcggtaaacatgacctctaggatgctgttgaatcgattcacaatggctcatcggaaacccacctttgagcgtgacgtggatctcggtgcagggactagacacgtcgccgtggaacctgaggttgctaacctggacatcattggacagcgcatcgaaaatattaagaacgagcataaaagtacgtggcactacgatgaagacaatccatataagacatgggcctaccacggctcctatgaggtgaagcccagcggctcagcatcctctatggtcaacggggtggtaaggctacttaccaaaccttgggatgtgatcccaatggttactcaaatagccatgaccgacacaacgcccttcggacagcagcgggtctttaaggagaaagtggacaccagaactccgcgcgctaagaggggtacaacccagattatggaagtgactgcgaaatggctgtggggcttcctcagccgaaataagaagcctcggatctgtacaagagaggaatttaccaggaaagtccgcagtaacgccgcaatcggggctgttttcgtggatgagaatcaatggaactccgccaaggaagcagtagaggacgagcgtttttgggatctggtgcatcgggaaagagagttgcacaaacagggaaagtgcgccacatgcgtctacaatatgatgggcaaaagggaaaagaagctgggtgagttcgggaaagctaagggaagccgcgccatttggtatatgtggctcggcgcgcgattccttgaatttgaggcactgggcttcatgaacgaggaccattggttttctcgggaaaattcattaagtggggtggagggagaaggtctgcacaaattgggctacatactcagagatatctccaagattccagggggaaacatgtacgccgacgatactgctggctgggacaccaggatcacggaggatgacctgcagaatgaggccaaaattaccgatatcatggaacccgagcatgcactacttgctacaagcatattcaagctgacttatcagaacaaagttgtgcgcgtccaaagacctgccaagaacggtaccgtgatggacgtaatctctcggagggatcagcgtgggtcgggacaggttggcacatacggcctcaatacttttaccaacatggaagtgcagctgattcgacaaatggagtcagaagggatcttcttgccaagcgagttagagacgcccaatctggctgaacgcgtcctcgactggcttgagaagcacggagccgaaagactgaaacggatggcaatttccggtgacgattgtgtggtgaagccgatcgacgataggtttgcgacagccctaaccgctctgaacgacatgggcaaagtccgcaaggatatacctcagtgggagcccagtaaagggtggaatgactggcagcaggttccattctgctctcaccattttcaccaactcattatgaaggatggaagagaaatcgtggtaccttgtcggaaccaggacgagttggtgggcagggcccgagtcagccagggtgcagggtggtccctgcgtgagactgcttgccttggaaagtcatatgcccaaatgtggcagctgatgtacttccatagacgcgatctccggttagcagccaatgcgatctgtagtgctgtgcccgttgactgggtgccaacatctaggaccacttggagcattcacgcccaccatcagtggatgaccacagaagatatgctgtccgtctggaacagagtgtggatagaggaaaatccctggatggaggacaaaacgcacgtatcaagctgggaagaggttccttatttgggcaagcgcgaggaccagtggtgcggctctctgatcgggctcaccgcacgggccacttgggctacaaacattcaagtggccatcaatcaggtcaggcgacttattggaaacgaaaattacctggattatatgacctccatgaaaagatttaagaacgagagtgacccagaaggtgcactatggtga

SEQ ID NO: 13344 - RNA, 9879 nt, synthetic construct
  misc_feature 1..9879: note = derived and/or modified CDS sequence (opt3) from DENV-1__GQ868510__SS-prME
  source 1..9879: mol_type = other RNA
agcgtgaccatgctgctcatgcttctgcccacagcattggctttccacttaactacgcggggcggggaacctcatatgatcgtctccaagcaggaaaggggaaaatctctgctatttaagacctcagccggtgttaacatgtgcacactcattgccatggacctgggcgaactttgtgaagatactatgacctacaaatgcccacaaataacagaggcggaaccggacgatgtggactgttggtgcaatgctaccgatacttgggtaacatatgggacctgtagtcagacgggaggccaccggcgcgagaagcgaagcgtggccctggcaccccatgtcggtttggggctcgagactcgtaccgaaacatggatgtcctctgagggagcctggaaacagatccagcgggtggaaacttgggctctgaggcaccctggcttcaccgttattgcactgtttctcgcccatgctatcggcacatcgattacccaaaaggggatcatattcatcttactgatgcttgtgacgccatcaatggccatgcggtgcgtcggaattggtaaccgcgactttgtggagggcttgagcggggcgacttgggtagatgttgtgctggagcacggaagttgtgtcacaaccatggcaaagaataaacccactctagacatcgaactcctgaagacagaggtgaccaaccctgccattcttagaaaactgtgcatcgaagctaagatatccaatacgaccacagattctaggtgtccaactcagggcgaggccaccttggtggaagaacaggacgcaaacttcgtctgccggcgcacatttgttgatcgaggttgggggaatggatgtggcctcttcggcaaagggagcctgttaacttgcgctaagtttaagtgcgtgaccaaactggagggaaagattgtacagtacgaaaacctcaaatattccgtgatcgtcacagtgcacaccggtgaccaacatcaggttggcaatgagactacggaacacgggacaattgccaccatcactccccaggcgcctacctcagagatccagcttacagattacggagccctgaccttggactgtagtccaagaactggcctagacttcaacgaaatggtgctgctcacaatgaaggagaaaagctggctggtccataagcaatggtttcttgatctgccgttgccctggacgtctggtgcatccacctcacaggagacttggaataggcaggacctcctggtgacattcaaaaccgctcacgccaagaagcaagaagtagttgtgttagggagccaggagggcgctatgcacacagccctgactggagcaaccgaaattcagacgagtggcaccacaactatatttgccgggcatctaaaatgccggctcaagatggataaactgacccttaagggaacatcttatgtcatgtgtactggttccttcaaattggagaaggaagtggctgagacccagcacggcacggtcctggtgcaagttaagtacgaggggacagacgcgccttgcaaaatcccattcagcacccaggatgaaaagggagtgactcagaacggccgtctcattacagcaaatcccatcgtaaccgacaaagagaagcctgtcaacatagaaactgagccaccctttggtgagtcgtatattgtggttggggccggcgaaaaagctctgaaactttcttggttcaagaaaggatcctcaatcggcaagatgtttgaggccaccgcacgcggggccagaaggatggctatcctgggagatacagcctgggacttcggtagtattggcggggtgtttacgagcgtcggaaaattggtgcatcaggtattcggcaccgcatacggtgtgctcttttccggggtttcttggactatgaagatcggcattggaatactgttaacatggctgggcctaaatagccggtcaaccagtctctccatgacatgtatcgcggtcgggatggtgactctgtaccttggagtgatggtccaagctgatagcggctgcgttattaactggaaaggtcgagaattgaagtgtgggtctggaatcttcgtgaccaacgaggtgcacacgtggacagaacagtataagtttcaggccgactcaccgaaacgcctgagtgcagccatcggcaaggcttgggaggagggtgtatgcggcattagaagcgccaccaggctcgaaaatataatgtggaaacagatctccaacgagctgaatcatattttactggaaaacgatatgaagttcactgtcgtggttggggacgcaaatggaatccttgctcaaggcaaaaagatgattcggcctcagcccatggagcacaaatactcttggaagtcgtgggggaaggccaaaatcataggagcggacatccagaacaccacatttattatcgatggcccagacactcctgaatgtcccgatattcagcgcgcctggaatatctgggaggtggaggactatggtttcgggatatttaccacaaacatttggttgaagctcagagatagctacacgcaaatgtgcgaccacaggctgatgtccgctgcaatcaaagattcaaaggccgtccatgctgacatgggatattggattgaaagtgagaaaaatgaaacctggaagctagcccgtgcatctttcatcgaggtgaagacttgtacatggccaaaaagccacaccctgtggtccaacggcgttctcgaatcagagatgataatccccaagatttacggtggccctatcagccagcataattatcggccagggtacttcactcagacagcgggaccgtggcacctgggcaaacttgagttggattttgacctgtgcgaagggaccacggtggtagtcgatgagcactgcggaaaccgaggcccctctttaagaactaccacagtgaccggtaagattatccatgaatggtgttgcaggtcctgtactctccctccactgcgcttcagaggggaagacggatgctggtacggcatggagataagacccgtgaaagaaaaggaggaaaatcttgtcaggagtatggttagcgccggttctggcgaggtggattccttttcactggggattttgtgtgctagtatcatgatcgaagaggtaatgcgcagccgatggtcgcggaagatgctcatgacaggaaccctggccgtgttcctactgctcattatgggccaactgacatggaaagaccttatccgtttgtgcattatggtcggggcaaacgcttccgacagaatgggaatgggcactacctatctggccttaatggcaacgtttaagatgaggcctatgttcgccgtgggtctcctgtttcgccggcttacatctagagaggttctgctactcaccatagggctgagcttggtggcttcagtcgaactgccaaatagtttagaggaactcggagatggcctggcgatgggcatcatgatgcttaaactgttgactgagttccagccccaccagctctggaccacactgctatccctgacttttattaagaccacgctttctctcgactacgcctggaaaacaaccgcaatggctctgagcatcgtgtccttgttcccgctgtgtttatcaactacaagccagaagaccacttggctccctgttctgcttgggagtctgggatgcaagccattgacaatgtttctcattaccgaaaacaaaatctggggtaggaagtcttggcccctgaacgagggcataatggccatcgggattgtgtccatcctactgagctcgcttctcaaaaatgatgtccctctggccggacccttgattgctggcggtatgttaatcgcatgttatgtaatatcagggtctagtgccgacctgtccctcgagaaggcggctgaagtgagctgggagcaagaagccgagcattctggaacgagccacaacattctggttgaagtgcaggatgacggcactatgaaaatcaaggatgaggagcgagacgatacccttacaatcctgttgaaagcaaccctactggccgtctccggcgtgtacccaatgtcaattcctgctacactcttcgtatggtatttttggcagaagaagaaacagcgcagtggggtgctgtgggacactcccagcccaccggaagtcgagcgggcagttcttgatgacggaatatacagaatcttacaaaggggtctgctcggccgttctcaggtgggggtgggagtcttccaggatggcgtgttccataccatgtggcacgttacgcgcggtgccgtattgatgtatcaggggaagcggctggaaccttcctgggcgtcagtgaaaaaggacctcattagttacggaggcggctggagatttcaagggagctggaatacaggagaggaggtccaggtgatcgctgttgaacccggtaaaaacccaaagaatgtgcagactacccccggcacattcaagacccctgagggggaagtcggagccattgcactggactttaaaccaggcacttccggttctcccatcgtgaacagggaggggaagatagtaggactttacggcaatggcgtcgtgaccacatcggggacgtatgttagcgccatcgctcaagccaaagcatcacaggaaggacctctgccggagattgaggatgaagtgttcaagaaacgaaacttgactatcatggacctacacccaggttccggcaagacccggcgctacctgcccgctattgtcagagaggccatcaagaggaaactccggacattaatactggcgcctacccgagtggttgccagtgaaatggcagaggctcttaaggggatgccaattagatatcagactacagccgtgaaatctgaacataccggacgcgagatcgtcgatctgatgtgccacgctacgtttactatgaggctcttgagccccgtgcgtgtacctaattacaacatgatcattatggacgaggcacatttcacagatccggcctccatcgccgctcggggctatatatcaaccagagtgggtatgggggaagcggcagccatttttatgaccgctactcccccaggatctgttgaggccttccctcagagcaatgcagtcatccaagacgaagagagggatattcccgaacgcagttggaactccggctacgactggatcacagattttccaggcaagaccgtgtggttcgtgcctagcataaaatctgggaatgacattgccaactgtctgcgaaagaatggaaagagagtcatccagctctcacggaaaacatttgatactgagtatcagaagacgaaaaacaacgactgggactacgtagtgaccacagatatctccgagatgggtgctaatttcagggcggaccgcgttattgatccccgtagatgcctgaagccagtgatccttaaagacggcccggaacgggtcattctagccgggcctatgcccgtgactgttgcaagtgctgcccagaggcgcggacgaataggcagaaaccaaaataaggagggtgatcagtacgtgtatatggggcagccactgaacaatgacgaagatcacgcacattggaccgaggccaagatgttgttagacaacatcaatacacccgagggcattatccctgctctgttcgaaccagagcgggagaaaagcgccgcgatcgatggagagtacaggctccgcggcgaagcaagaaagacctttgtcgagctgatgaggagaggggaccttcccgtgtggctgtcgtataaagtagcctctgagggattccagtactccgatcgtcgctggtgctttgacggtgaacgaaacaatcaagtgctcgaggaaaacatggatgttgagatttggactaaggaaggcgagaggaagaagttgaggcctcggtggctggacgctcgcacgtatagcgacccgctagccctgagagagttcaaagaatttgctgcagggaggcggtcagtcagtggagatctcatacttgagatcggcaagctgccacagcacttaaccttgcgagcccagaatgctctggacaacctcgtgatgctgcacaattctgaacagggtgggaaggcctacagacatgcaatggaggaacttcccgatacaattgagactctgatgctcttggcgctgatcgccgtgttaaccggcggagtcacactattctttctgtccggcaaagggctcggaaagaccagcattggtcttctgtgtgttactgcttcaagtgccttgctgtggatggcaagcgtggagcctcactggatcgctgcctccataatcctcgagttctttctgatggtacttctcattcccgagccagaccgccaaaggacacctcaggataaccagctggcatatgtggtcatcggcttgctgttcatgattttaacggtggccgctaatgaaatggggctactggagaccactaaaaaggacctcggaatcggccatgttgcggccgagaaccaccaacacgcaacaatgcttgatgtggacctgcggcccgcttctgcctggaccttgtacgccgtcgcaaccacagtaataactccaatgatgcgtcatacgattgaaaacaccacagctaatatcagcctgactgccattgcgaaccaggctgccatcctcatgggtctggataaagggtggcctatatccaagatggacatcggcgtgccgcttttagcactgggatgctactcacaggttaatcccctcaccttgacagccgctgtgctgatgctagtcgcacactatgccattatcggcccagggctgcaggcgaaggctaccagagaggcccaaaagagaactgcagccggaattatgaagaaccctacggtggatggcatcgtcgctatagacctcgatcccgtggtttacgacgccaaatttgaaaagcagcttggtcagattatgctgttgatcctgtgtacatctcagatcctcctgatgcgcaccacttgggcattatgcgagagtattacccttgctacagggccactgactaccctctgggaaggatcgcctggcaaattctggaatacaacgatcgccgtgagcatggcgaacatatttcggggttcctatctagccggcgcagggctggctttctctttgatgaagtcactgggaggcgggcgaagaggaaccggcgcccaaggtgagactctcggggagaagtggaaaaggcagcttaatcagctgagcaagtccgagttcaacacatacaaacgcagtggaattatggaggtagaccggtctgaagcaaaggagggcttgaaaagaggtgaaaccactaagcatgctgtgagccgtggcacagccaagctgaggtggtttgtcgagcggaatctcgttaaacccgaggggaaggtgatcgatttaggatgtggccgcgggggatggtcatattactgcgccggcctgaaaaaggtcaccgaagtgaaaggttatacgaaagggggaccgggccacgaggaaccaattcctatggcgacctacggctggaaccttgtaaaactgcattccgggaaggacgtgttctttatgcccccagagaagtgtgatacactactctgcgacatcggagaaagtagccccaatcctactatagaggagggtcgaaccctgagagttttgaaaatggtggaaccgtggctgaggggcaaccagttctgtatcaagattctcaatccctacatgccatctgtcgtggagacacttgaacaaatgcagcggaaacacgggggaatgctggtccgcaaccctttatccagaaattcaactcacgagatgtattgggtgagctgcggcaccggtaacatcgtttcggctgtaaatatgacatctaggatgctgttgaaccgatttaccatggcacatcggaagcccacttacgagcgtgatgtggacctcggggccggaacgagacacgtcgctgtggaacctgaggttgccaacctggatattatcggccagcgcattgaaaatatcaaaaacgagcataagagtacatggcactatgacgaagataatccatacaagacctgggcatatcacggctcctacgaggtgaaacccagcgggtcagcctcctctatggtcaacggagtggtaaggctacttactaagccttgggacgtgataccaatggttacccaaattgctatgacagatacgacccccttcggtcagcagcgggtctttaaagagaaggtggacactagaacaccgcgcgcgaaaaggggcaccactcagatcatggaagtgacagccaagtggctgtgggggttcctcagccgaaataagaaacctcggatctgtaccagagaggaatttacaaggaaggtccgcagtaacgcagctattggagccgttttcgtggacgagaatcaatggaactccgcaaaagaagccgtagaggatgagcgtttttgggacctggtgcatcgggaaagagagttgcacaagcagggcaaatgcgctacttgcgtctataatatgatgggtaagagggaaaagaaactgggggagttcggaaaggccaaaggcagccgcgcgatatggtacatgtggctcggcgcacgatttcttgagttcgaggccctggggttcatgaacgaggatcattggttttctcgggaaaattcattaagtggagtggagggtgaaggcctgcacaagttggggtacatcctcagagacatttccaaaatcccaggaggcaacatgtatgctgatgacaccgccggttgggatacgaggattaccgaggacgatctgcagaatgaggcaaagatcacagacataatggaacccgagcatgctctacttgccactagcatcttcaaactgacctaccagaacaaggttgtgcgcgtccaaagacctgctaagaatgggacagtgatggatgtaatttctcggagggaccagcgtggatcgggccaggttggcacttatgggctcaacacctttacgaacatggaagtgcagctgatccgacaaatggagtcagaaggaattttcttgccaagcgagttagagacacccaatctggccgaacgcgtcctcgattggcttggtaaacacggcgcagagagactgaagcggatggcgatctccggggacgactgtgtggtgaaaccgatagatgacaggtttgccaccgctctaactgccctgaacgatatgggaaaggtccgcaaagacattcctcagtgggaacccagtaagggctggaatgattggcagcaggttccattctgctctcaccattttcaccaactcatcatgaaggacggtagagagatcgtggtaccttgtcggaaccaggatgaattggtggggagggcacgagtcagccagggagctggctggtccctgcgtgagacagcctgccttggcaaatcatacgcacaaatgtggcagctgatgtatttccatagacgcgacctccggttagccgcgaatgctatttgtagtgccgtgcccgttgattgggtgccaacctctaggactacctggagcatacacgcacaccatcagtggatgacaacggaggacatgctgtccgtctggaacagagtgtggatcgaagagaatccctggatggaagataagacccacgtatcaagctgggaggaagttccttacttggggaaacgcgaggaccagtggtgcggatctctgattggtctcactgcccgggctacatgggccaccaacatccaagtggcaattaatcaggtcaggcgacttatcggcaacgagaattatctggactacatgacttccatgaagagatttaaaaacgaaagtgatccagagggggctctatggtga

SEQ ID NO: 13345 - RNA, 9879 nt, synthetic construct
  misc_feature 1..9879: note = derived and/or modified CDS sequence (opt3) from DENV-1__GQ868511__SS-prME
  source 1..9879: mol_type = other RNA
agcgtgaccatgctgctcatgcttctgcccacagccttggctttccacttaactacgagaggcggggagcctcatatgatcgtctccaagcaggaaaggggaaaatctctgctatttaagacctcagcaggtgttaacatgtgcacactcattgccatggacctgggcgagctttgtgaagatactatgacctacaaatgcccacaaataacagaggcggaaccggacgatgtggactgttggtgcaatgctaccgatacttgggtaacatatgggacctgtagtcagacgggagagcaccggcgcgacaagcgaagcgtggccctggcaccccatgtcggcttgggtctcgagactcgtaccgaaacatggatgtcctctgagggggcctggaaacagatccagagagtggaaacttgggctctgaggcaccctggattcaccgttattgcactgtttctcgcccatgctatcggcacatcgattacccaaaagggcatcatattcatcttactgatgcttgtgacgccatcaatggccatgcggtgcgtcgggattggaaaccgcgattttgtggagggtttgagcggcgcgacttgggtagacgttgtgctggagcacgggagttgtgtcacaaccatggcaaagaataaacccactctagatatcgaactcctgaagacagaggtgaccaaccctgccattcttagaaaactgtgcatcgaagctaagatatccaatacgaccacagactctaggtgtccaactcagggagaggccaccttggtggaagagcaggatgcaaacttcgtctgccggcgcacatttgttgaccgaggctggggtaatgggtgtggactcttcggcaaaggcagcctgttaacttgcgctaagtttaagtgcgtgaccaaactggaggggaagattgtacagtacgaaaacctcaaatattccgtgatcgtcacagtgcacaccggagatcaacatcaggttggtaatgagactacggaacacggcacaattgccaccatcactccccaggcgcctacctcagagatccagcttacagactacggggccctgaccttggactgtagtccaagaactggactagatttcaacgaaatggtgctgctcacaatgaaggagaaaagctggctggtccataagcaatggtttcttgacctgccgttgccctggacgtctggcgcatccacctcacaggagacttggaataggcaggatctcctggtgacattcaaaaccgctcacgccaagaagcaagaagtagttgtgttaggtagccaggagggggctatgcacacagccctgactggcgcaaccgaaattcagacgagtggaaccacaactatatttgccggccatctaacctgccggctcaaaatggacaagctgacacttaaagggacttcttatgtcatgtgtaccggatccttcaagttggagaaagaagtggctgagacgcagcacggtacagtcctggtgcaagttaagtacgagggcaccgatgcgccttgcaagatcccattcagcactcaggacgaaaaaggggtgacacagaacggacgtctcattaccgcaaatcccatcgtaactgataaggagaaacctgtcaacatagaaaccgagccaccctttggcgagtcgtatattgtggttggtgccggggaaaaggctctgaaactttcttggttcaagaagggctcctcaatcggaaaaatgtttgaggccacagcacgcggcgccagaaggatggctatcctgggggacacggcctgggatttcggaagtattggtggcgtgtttaccagcgtcgggaagttggtgcatcaggtattcggaactgcatacggcgtgctcttttccggtgtttcttggacaatgaaaatcgggattggcatactgttaacctggctgggactaaatagccggtcaacaagtctctccatgacttgtatcgcggtcggcatggtgaccctgtaccttggggtgatggtccaagctgacagcggatgcgttattaactggaagggccgagaattgaaatgtggttctgggatcttcgtgacgaacgaggtgcacacatggaccgaacagtataagtttcaggccgattcaccgaagcgcctgagtgcagccatcggaaaagcttgggaggagggcgtatgcggtattagaagcgccactaggctcgaaaatataatgtggaagcagatctccaacgagctgaatcatattttactggaaaacgacatgaaattcaccgtcgtggttggcgacgcaaatgggatccttgctcaaggaaagaaaatgattcggcctcagcccatggagcacaagtactcttggaaatcgtggggcaaggccaagatcataggggcggatatccagaacacaacttttattatcgacggaccagatacccctgaatgtcccgacaatcagcgcgcctggaacatttgggaggtggaggattatggcttcggtatctttacaacgaatatatggttgaaactcagagacagctacacccaaatgtgcgatcacaggctgatgtccgctgcaattaaggactcaaaagccgtccatgctgatatggggtattggatcgaaagtgagaagaacgaaacttggaaactagcccgtgcatctttcattgaggtgaagacatgtacctggccaaagagccacactctgtggtccaatggagttctcgaatcagagatgatcatacccaaaatctacggcggtcctattagccagcataactatcggccaggctacttcacacagaccgcggggccgtggcacctgggaaagcttgagttggactttgatctgtgcgaaggcacgactgtggtagtcgacgagcactgcgggaatcgaggaccctctttaagaaccacaaccgtgactggcaaaatcattcatgaatggtgttgcaggtcctgtacactccctccactgcgcttccggggtgaggatgggtgctggtacggaatggagatcagacccgtgaaggaaaaagaggaaaaccttgtcaggagtatggttagcgccggctctggtgaggtggactccttttcactgggcatattgtgtgctagtattatgatcgaagaggtaatgcgcagccgatggtcgcggaagatgctcatgaccgggacactggccgtgttcctactgctcgtcatgggacaactgacttggaatgaccttatccgtttgtgcattatggtgggcgcaaacgcttccgatagaatggggatgggaaccacgtatctggccttaatggcaacatttaagatgaggcctatgttcgccgttggcctcctgtttcgccggcttacctctagagaggtgctgctactcactatcggtctgagcttggtcgcttcagtggaactgccaaacagtttagaggaactcggggacggactggcgatgggcattatgatgcttaaactgttgaccgagttccagccccaccagctctggacaactctgctatccctgacctttataaagacgacactttctctcgattacgcctggaaaaccactgcaatggctctgagcatcgtttccttgttcccgctgtgtttatcaacaaccagccagaagactacatggctccctgtgctgcttggcagttttgggtgcaaaccactgaccatgttcttgattacggaaaataagatctggggaaggaagtcttggcccctcaacgagggtattatggccatcggcatagtctccatcctgctaagctcgctgcttaaaaatgacgtacctctcgccgggcccctgattgctggaggcatgttgatcgcatgttatgtgatttcaggttctagtgccgatttatccctggagaaggcggctgaagttagctgggagcaagaagccgagcattctgggactagccacaacatcctcgtggaagtccaggacgatggaaccatgaaaataaaggacgaggagcgagatgacacactgaccattcttctgaaagcaacattgctagccgtgtccggcgtatacccaatgtcaatccctgctactctgtttgtgtggtatttctggcagaagaaaaagcagcgcagtggcgtcctctgggatacccccagcccaccggaagttgagcgggcagtgctggacgatgggatctacagaattcttcaaaggggattactgggtcgttctcaggtgggcgtcggggtgttccaggacggagtttttcatacgatgtggcacgtaacacgcggcgccgtgctcatgtatcagggtaagcggttggaaccttcctgggcgtcagtcaaaaaggacctgataagttacgggggaggctggagattccaaggcagctggaatactggggaggaggtgcaggttatcgctgtggaacccggaaaaaacccaaagaatgtccagaccacacccggtacctttaaaactcctgagggcgaagtgggggccattgcactcgatttcaagccaggaacctccggctctcccatcgtaaacagggagggtaagattgtcgggctgtacggaaatggcgtggttacaacgtcgggcacttatgtgagcgccatcgctcaagccaaagcatcacaggaagggcctcttccggagatagaggacgaagtctttaagaaacgaaacctgaccatcatggatttgcacccaggatccggtaagacacggcgctacctacccgctattgtgagagaggccatcaaaaagaagctgaggaccctcattttagcgcctactcgggttgtggccagtgaaatggcagaggctctgaaaggcatgccaatccgatatcagacaaccgccgtcaagtctgaacatacggggagagagatagtggaccttatgtgccacgctactttcacaatgcgcctgctcagccccgtaagggtgcctaattacaacatgattatcatggatgaggcacattttaccgacccggcctccatcgccgctcgtggatatatttcaacccgggttggcatgggtgaagcggcagccatcttcatgactgctacacccccagggtctgtcgaggcctttcctcagagcaatgcagtgatacaagatgaagagagagacattcccgaaaggagttggaactccggatacgattggatcaccgacttcccaggcaaaacagtgtggtttgtccctagcattaagtctggcaatgatatcgccaactgtttgcgcaaaaacgggaagcgagtaatacagctgtcaagaaagactttcgacacggagtatcagaaaaccaagaataacgactgggattacgtggttacaactgacatttccgagatgggagctaatttccgggcggatagggtgatcgacccccgccgttgcctcaaaccagtcatcctgaaggatggtccggaaagagtgattcttgccggccctatgcccgttaccgtggcaagtgctgcccagcggagggggcgcatcggacgaaaccaaaataaagagggcgaccagtacgtctatatgggtcagccactaaacaatgatgaagaccacgcacattggacagaggccaagatgctgttggataacattaatacccccgaggggataatccctgctttatttgaaccagagagagaaaagagcgccgcgattgacggcgagtaccggctgaggggagaagcacgcaaaactttcgtggagctcatgagaaggggcgatctgcccgtatggctttcgtataaggtggcctctgaggggtttcagtactccgaccggcgttggtgcttcgatggagaacgcaacaatcaagttctggaggaaaacatggacgtcgagatctggacgaaagaaggtgagcgaaagaaactcagacctaggtggttggacgctcggacctatagcgatccgctggccctacgcgagtttaaggaattcgctgcaggcagaaggtcagtgagtggggacctgatcctcgagattggaaaacttccacagcacctgacattacgggcccagaatgctttggataacctggtgatgctccacaattctgaacagggcggtaaggcctaccgacatgcaatggaggaactgcccgacactatagagacccttatgctgctcgcgttgatcgccgtcctgacagggggcgttaccttatttttcctatccggaaagggcctggggaaaactagcattggactcctttgtgtgacagcttcaagtgccctgttgtggatggcaagcgtagagcctcactggatcgctgcctccattatcctggaatttttcctcatggtgctgcttatacccgagccagatagacaacgcacgcctcaggacaaccagctcgcatatgtcgtgatcggtctgttgtttatgattctgaccgttgccgctaacgaaatgggcttactagagactacaaagaaagatctggggatcggacatgtggcggccgagaatcaccaacacgcaaccatgctcgacgtcgatcttaggcccgcttctgcctggaccctgtacgccgtagcaacaactgtgattacgccaatgatgcggcataccatcgaaaacacaactgctaatataagcttgaccgccattgcgaaccaggctgccatcctgatgggcctcgacaagggttggcctatttccaaaatggatatcggggttccgctgcttgcattaggctgctactcacaggtgaatcccctgacactcaccgccgctgtcttgatgctggtggcacactatgccataatcggaccaggcctacaggcgaaggctactcgtgaggcccaaaagagaacggcagccgggattatgaaaaaccctacagtcgacggaatcgtggctattgatctggaccccgttgtgtacgacgccaagttcgaaaaacagctcggccagatcatgcttctgatattgtgtacctctcagattctgctcatgaggactacctgggcactgtgcgagagtatcacattagctactggtccacttaccacactgtgggaagggtcgcctggaaagttttggaatacgaccatcgccgtaagcatggcgaacattttccgcggctcctatctcgccggtgcaggcctagctttctctctgatgaaatcattggggggaggccggcgagggactggagcccaaggcgagacactgggtgagaagtggaagagacagctcaatcagcttagcaaatccgaatttaacgcatacaagaggagtgggatcatggaggtggatcgctctgaagctaaagagggactgaagcggggcgaaaccactaaacatgccgtcagcagaggtacagccaagttgcgttggttcgttgagaggaatctggtgaagcccgagggcaaagtcatagacctcgggtgtggacggggcgggtggtcatattactgcgcgggattaaagaaagtgaccgaagtaaagggctatacgaaaggtgggccgggacacgaggaaccaattcctatggctacctacggctggaacctggtgaagcttcattccggcaaagatgtttttttcatgcccccagagaagtgtgacacactgctatgcgatatcggggaaagtagccccaatcctactattgaggagggacgcaccctccgagtgctgaagatggtcgaaccgtggttgagaggtaaccagttttgtatcaaaatactgaatccctacatgccatctgtggtcgagacactcgaacaaatgcagaggaagcacggcgggatgcttgtgcggaaccctctgtcccgcaattcaactcacgagatgtattgggttagctgcggaaccggcaacatcgtatcggcagtgaacatgacatctagaatgttactgaataggttcaccatggcccatcgaaaacccacttacgagcgggacgtcgatttgggtgctgggacgcgtcacgtggccgttgaacctgaggtggcaaacctcgacattatcggacagagaattgaaaatatcaagaacgagcataaaagtacatggcactatgatgaagacaatccatacaagacctgggcctatcacggctcctacgaggtcaagcccagcggctcagcttcctctatggtgaacggggtagtgcgcctgctaactaaaccttgggatgttattccaatggtcacccaaatcgcgatgacagacacgaccccctttggacagcagagggtgttcaaggagaaagtggacactcggacaccgagagccaagcgcggtaccactcagataatggaagtcacagcaaaatggctttggggctttctgagcaggaataagaagcctcgaatttgtacccgggaggaattcacaagaaaagttaggagtaacgctgccatcggggcagtgtttgtagatgagaatcaatggaactccgccaaggaagctgtggaggacgagagcttctgggatctcgtccataaagaacgcgagctgcacaagcagggaaaatgcgccacttgcgtgtataatatgatgggcaagcgtgaaaagaaattgggtgagtttgggaaggcgaaaggatctcgggcaatctggtacatgtggctgggcgccagattcctcgaattcgaggctcttggctttatgaacgaggaccattggttctcaagggaaaatagtctgtccggggttgagggagaaggtttacacaagctgggctacattttgcgcgatataagcaaaatcccagggggaaacatgtatgccgacgataccgcaggctgggacacgcgaattaccgaggatgacctccagaatgaggctaagatcacagaaattatggagcccgaacatgccctgctagctacttctatctttaaacttacctaccagaacaaggtggtccgggtgcaaagacctgccaagaacggtacagtaatggatgttatatcgaggcgcgaccagagagggtcaggacaggtgggcacttatggcctgaataccttcacgaacatgggggtccagctcatccggcaaatggagagcgaaggaatttttctgccatccgagttggagacacccaatttagcagaaagggtgctggattggctcgagaaacacggtgcggaacgtcttaagcgaatggccatcagtggcgacgactgtgtggtcaaaccgattgatgaccgcttcgctaccgccctgactgcactaaacgatatggggaaggttagaaaagacatccctcagtgggagccctctaagggatggaatgattggcagcaggtgccattttgcagccaccatttccaccaactgataatgaaggacggccgggaaattgtagtgccttgtaggaaccaggatgagctcgtcggtcgcgctagagtgtcccagggggccggatggtcattgcgggagacagcatgcctgggcaaaagttacgcccaaatgtggcagcttatgtattttcataggcgagacctgcgtctcgcggctaatgccatctgttctgcagttcccgtggattgggtcccaaccagcagaactacctggtccatccacgcccaccatcagtggatgacaacggaagacatgttatcagtgtggaaccgcgtatggattgaggaaaatccctggatggaggataagacccacgttagctcttgggaagaggtgccttacctgggcaaacgggaggaccagtggtgcgggtccttgataggactgactgctagggccacatgggcaaccaacatccaagtcgctattaatcaggtgagacgcctcatcggtaacgaaaattatcttgactacatgactagtatgaagcggttcaaaaacgagagcgatccagaaggcgccctgtggtga

SEQ ID NO: 13346 - RNA, 9879 nt, synthetic construct
  misc_feature 1..9879: note = derived and/or modified CDS sequence (opt3) from DENV-1__GQ868512__SS-prME
  source 1..9879: mol_type = other RNA
agcgtgaccatgctgctcatgcttctgccaacagcattggctttccacttaactacgagaggaggggaacctcatatgatagtctccaagcaggaaaggggaaaatctctgttgtttaagacctcagccggtgttaacatgtgcacactcattgccatggacctgggcgaactttgtgaagatactatgacctacaaatgcccacaaataacagaggcggaaccggacgatgtggactgttggtgcaatgctaccgatacttgggtaacatatgggacctgtagtcagacgggagagcaccggcgcgacaagcgaagcgtggccctggcaccccatgtcggcttgggtctcgagactcgtaccgaaacatggatgtcctctgagggggcctggaaacagatccagagagtggaaacttgggctctgaggcaccctggattcaccgttattgcactgtttctcgcccatgctatcggcacatcgattacccaaaagggcatcatattcatcttactgatgcttgtgacgccatcaatggccatgcggtgcgtcgggattggaaaccgcgattttgtggagggtttgagcggcgcgacttgggtagacgttgtgctggagcacgggagttgtgtcacaaccatggcaaagaataaacccactctagatatcgaactcctgaagacagaggtgaccaaccctgccattcttagaaaactgtgcatcgaagctaagatatccaatacgaccacagactctaggtgtccaactcagggagaggccaccttggtggaagaacaggatgcaaacttcgtctgccggcgcacatttgttgaccgaggctggggtaatgggtgtggactcttcggcaaaggcagcctgttaacttgcgctaagtttaagtgcgtgaccaaactggaggggaagattgtacagtacgaaaacctcaaatattccgtgatcgtcacagtgcacaccggagatcaacatcaggttggtaatgagactacggaacacggcacaattgccaccatcactccccaggcgcctacctcagagatccagcttacagactacggggccctgaccttggactgtagtccaagaactggactagatttcaacgaaatggtgctgctcacaatgaaggagaaaagctggctggtccataagcaatggtttcttgacctgccgttgccctggacgtctggcgcatccacctcacaggagacttggaataggcaggatctcctggtgacattcaaaaccgctcacgccaagaagcaagaagtagttgtgttaggtagccaggagggggctatgcacacagccctgactggcgcaaccgaaattcagacgagtggaaccacaactatatttgccggccatctaaaatgccggctcaagatggacaaactgacccttaaggggacatcttatgtcatgtgtactggatccttcaaattggagaaggaagtggctgagacccagcacggtacggtcctggtgcaagttaagtacgagggcacagatgcgccttgcaaaatcccattcagcacccaggacgaaaagggggtgactcagaacggacgtctcattacagcaaatcccatcgtaaccgataaagagaagcctgtcaacatagaaactgagccaccctttggcgagtcgtatattgtggttggtgccggggaaaaagctctgaaactttcttggttcaagaaaggctcctcaatcggaaagatgtttgaggccaccgcacgcggcgccagaaggatggctatcctgggggacacagcctgggatttcggaagtattggtggcgtgtttacgagcgtcgggaaattggtgcatcaggtattcggaaccgcatacggcgtgctcttttccggtgtttcttggactatgaagatcgggattggcatactgttaacatggctgggactaaatagccggtcaaccagtctctccatgacatgtatcgcggtcggcatggtgactctgtaccttggggtgatggtccaagctgacagcggatgcgttattaactggaaaggccgagaattgaagtgtggttctgggatcttcgtgaccaacgaggtgcacacgtggacagaacagtataagtttcaggccgattcaccgaaacgcctgagtgcagccatcggaaaggcttgggaggagggcgtatgcggtattagaagcgccaccaggctcgaaaatataatgtggaaacagatctccaacgagctgaatcatattttactggaaaacgacatgaagttcactgtcgtggttggcgacgcaaatgggatccttgctcaaggcaagaagatgattcggcctcagcccatggagcacaaatactcttggaagtcgtggggcaaggccaaaatcataggggcggatatccagaacaccacatttattatcgacggaccagatactcctgaatgtcccgacaatcagcgcgcctggaacatttgggaggtggaggattatggcttcggtatctttaccacaaatatatggttgaagctcagagacagctacacgcaaatgtgcgatcacaggctgatgtccgctgcaattaaagactcaaaggccgtccatgctgatatggggtattggatcgaaagtgagaaaaacgaaacctggaagctagcccgtgcatctttcattgaggtgaagacttgtacatggccaaaaagccacaccctgtggtccaatggagttctcgaatcagagatgatcatacccaagatctacggcggtcctattagccagcataactatcggccaggctacttcactcagacagcggggccgtggcacctgggaaaacttgagttggactttgatctgtgcgaaggcaccacggtggtagtcgacgagcactgcgggaatcgaggaccctctttaagaactaccacagtgaccggcaagatcattcatgaatggtgttgcaggtcctgtactctccctccactgcgcttccggggtgaggatgggtgctggtacggaatggagatcagacccgtgaaagaaaaggaggaaaaccttgtcaggagtatggttagcgccggctctggtgaggtggactccttttcactgggcatattgtgtgtaagtattatgatcgaagaggtgatgcgcagccgatggtcgcggaagatgctcatgacagggaccctggctgtcttcctactgctcgtgatgggacaactgacatggaatgaccttatccgtttgtgcattatggttggcgccaacgcatccgatagaatggggatgggaactacctatctggctttaatggccacgtttaaaatgaggcctatgttcgcagtgggcctcctgtttcgccggcttacatctagagaggtcctgctactcaccatcggtctgagcttggtggcctcagttgaactgccaaacagtttagaggaactcggggacggactggctatgggcattatgatgcttaagctgttgactgagttccagccccaccagctctggaccacactgctatccctgacttttataaaaaccacgctttctctcgattacgcgtggaagacaaccgccatggcactgagcatcgtgtccttgttcccgctgtgtttatcaactacaagccagaaaaccacttggctccctgtcctgcttggcagttttgggtgcaagccactgacaatgttcttgattaccgaaaataagatctggggaaggaaatcttggcccctcaacgagggtattatggctatcggcatagtatccatcctgctaagctcgctgcttaagaatgacgtgcctctcgccgggcccctgattgccggaggcatgttgatcgcttgttatgttatttcaggttctagtgcagatttatccctggagaaagccgcggaagtgagctgggagcaagaagctgagcattctgggacgagccacaacatcctcgtcgaagtgcaggacgatggaactatgaagataaaagacgaggagcgagatgacaccctgacaattcttctgaaggccaccttgctagcagtatccggcgtgtacccaatgtcaatccctgccacactgtttgtctggtatttctggcagaaaaagaagcagcgcagtggcgttctctgggatactcccagcccaccggaagtggagcgggctgtgctggacgatgggatctacaggattcttcaacgaggattactgggtcgttctcaggtcggcgtgggggttttccaggacggagtatttcataccatgtggcacgtgacgcgcggcgcagtcctcatgtatcagggtaaacggttggaaccttcctgggcctcagtgaagaaagacctgataagttacgggggaggctggagattccaaggcagctggaatacaggggaggaggttcaggtgatcgcggtcgaacccggaaagaaccccaagaatgtgcagactacccccggtacatttaagacccctgagggcgaagtaggggctattgccctcgatttcaagccaggaacttccggctctcccatcgtcaacagggagggtaaaattgtggggctgtacggaaatggcgttgtgaccacatcgggcacgtatgtcagcgcaatcgcccaagctaaggcctcacaggaagggcctcttccggagatagaggacgaagtgtttaaaaagcgaaacctgactatcatggatttgcacccaggatccggtaaaacccggcgctacctacccgcaattgttagagaggctatcaagaggaagctgcggacactcattttagcccctacccgagtggtcgcgagtgaaatggccgaggcactgaaaggcatgccaatcagatatcagactacagctgtgaagtctgaacataccgggcgcgagatagtagaccttatgtgccacgccacgttcactatgaggctgctcagccccgtgcgtgttcctaattacaacatgattatcatggatgaggctcattttacagacccggcatccatcgccgcccggggatatatttcaaccagagtcggcatgggtgaagctgcggcaatcttcatgaccgccactcccccagggtctgtggaggcttttcctcagagcaatgccgtgatacaagatgaagagagggacattcccgaacgcagttggaactccggatacgattggatcacagacttcccaggcaaaaccgtctggtttgtacctagcattaagtctggcaatgatatcgcaaactgtttgagaaagaacgggaagagagtgatacagctgtcacggaagacattcgacactgagtatcagaaaacgaagaataacgactgggattacgttgtgaccacagacatttccgagatgggagccaatttcagggctgatcgcgtcatcgacccccgtagatgcctcaaaccagtgatcctgaaggatggtccggaacgggttattcttgcgggccctatgcccgtgactgtcgccagtgcagctcagaggcgcgggcgaatcggaagaaaccaaaataaagagggcgaccagtacgtgtatatgggtcagccactaaacaatgatgaagaccacgcccattggaccgaggcaaagatgctgttggataacattaatacacccgaggggataatccctgccttatttgaaccagagcgggaaaagagcgctgccattgacggcgagtacaggctgcgcggagaagcgagaaaaaccttcgtagagctcatgaggcggggcgatctgcccgtgtggctttcgtataaggttgcatctgaggggtttcagtactccgaccgtcgctggtgcttcgatggagaacgaaacaatcaagtcctggaggaaaacatggacgtggagatctggactaaagaaggtgagagaaagaaactcaggcctcggtggttggacgcccgcacgtatagcgatccgctggctctaagagagtttaaggagttcgccgctggcaggcggtcagtgagtggggacctgatcctcgagattggaaaacttccacagcacctgaccttacgagcacagaatgccttggataacctggtcatgctccacaattctgaacagggcggtaaggcttacagacatgccatggaggaactgcccgacacaatagagactcttatgctgctcgcattgatcgcggttctgaccgggggcgtgacattatttttcctatccggaaagggcctggggaaaaccagcattggactcctttgtgtaactgcctcaagtgctctgttgtggatggccagcgtggagcctcactggatcgcagcttccattatcctggaatttttcctcatggtcctgcttatacccgagccagatcgccaaaggacacctcaggacaaccagctcgcctatgtggttatcggtctgttgtttatgattctgacggtggcagccaacgaaatgggcttactagagaccactaagaaagatctggggatcggacatgtcgctgcggagaatcaccaacacgccacaatgctcgacgtagatcttcggcccgcatctgcttggaccctgtacgccgtggccaccacagttattactccaatgatgcgtcatacgatcgaaaacaccacagcaaatatcagcttgactgctattgccaaccaggcggctatcctgatgggcctcgacaagggttggcctatttccaaaatggatatcggggtgccgctgcttgccttaggctgctactcacaggtcaatcccctgaccctcacagcagccgtgttgatgctggtcgctcactatgcaataatcggaccaggcctacaggccaaggcgaccagagaggctcaaaagaggactgccgcagggattatgaaaaaccctacggtggacggaatcgttgccattgatctggaccccgtggtatacgacgctaagttcgaaaaacagctcggccagatcatgcttctgatattgtgtacatctcagattctgctcatgcgcaccacttgggccctgtgcgagagtatcaccttagcaacaggtccacttactaccctgtgggaagggtcgcctggaaagttttggaatacaacgatcgctgtgagcatggccaacattttccggggctcctatctcgcgggtgccggcctagcattctctctgatgaaatcactagggggaggccgaagagggaccggagctcaaggcgagactctgggtgagaagtggaagaggcagctcaatcagcttagcaaatccgaatttaacacatacaagcgcagtgggatcatggaggtcgatcggtctgaagccaaagagggactgaagagaggcgaaaccactaaacatgcagttagccgtggtacagctaagttgaggtggttcgtggagcggaatctggtcaagcccgagggcaaagtgatagacctcgggtgtggacgcggcgggtggtcatattactgcgccggattaaagaaagtaaccgaagtgaagggctatacgaaaggtgggccgggacacgaggaaccaattcctatggccacctacggctggaacctggttaaacttcattccggcaaagatgtgtttttcatgcccccagagaagtgtgacacactgctatgcgatatcggggaaagtagccccaatcctactattgaggagggacgaaccctcagagtcctgaagatggtggaaccgtggttgaggggtaaccagttttgtatcaaaatactgaatccctacatgccatctgtcgtggaggcgctcgaacaaatgcagcggaagcacggcgggatgcttgttcgcaaccctctgtccagaaattcaacacacgagatgtattgggtaagctgcggaactggcaacatcgtgtcggctgtcaacatgacctctaggatgttactgaatcgattcacaatggcacatcggaaacccacctacgagcgtgacgtggatttgggtgccgggactagacacgttgctgtggaacctgaggtcgccaacctcgacattatcggacagcgcattgaaaatatcaagaacgagcataaaagtacgtggcactatgatgaagacaatccatacaagacatgggcatatcacggctcctacgaggtgaagcccagcggctcagcctcctctatggtaaacggggtggttaggctgctaaccaaaccttgggatgtcattccaatggtgactcaaatcgctatgaccgacacaacgccctttggacagcagcgggtgttcaaggagaaagtcgacaccagaactccgcgcgcgaagaggggtacaacccagataatggaagttactgccaaatggctttggggctttctgagccgaaataagaagcctcggatttgtacaagagaggagttcaccaggaaagtgcgcagtaacgcagctatcggggccgtatttgtggatgagaatcaatggaactccgcaaaggaagccgtcgaggacgagcgtttctgggatctcgtgcatcgggaaagagagctgcacaaacagggaaagtgcgctacatgcgtttataatatgatgggcaaaagggaaaagaagttgggtgagtttgggaaagccaagggaagccgcgcgatctggtacatgtggctgggcgcacgattcctcgagttcgaggcccttggctttatgaacgaggaccattggttctctcgggaaaattcactgagtggggtggagggagaaggtttacacaaactgggctacattttgagagatatatccaagatcccagggggaaacatgtatgctgacgatactgccggctgggacaccaggattacggaggatgacctccagaatgaggcaaaaatcaccgaaattatggagcccgaacatgctctgctagccacaagcatctttaaacttacttaccagaacaaagtcgtgcgcgtacaaagacctgctaagaacggtaccgttatggatgtgatatctcggagggaccagcgtgggtcgggacaggtcggcacatatggcctgaatactttcaccaacatggaggtgcagctcatccgacaaatggaatcagaggggatttttctgccaagcgagttggaaacgcccaatttagccgagcgcgtgctggattggctcgaaaagcacggagcagagagacttaaacggatggcgatctccggtgacgactgtgtcgttaagccgattgatgacaggttcgccacagctctgaccgccctaaacgatatgggcaaagtgcgcaaggacatccctcagtgggaacccagtaaagggtggaatgattggcagcaggtaccattttgctctcaccatttccaccaactgataatgaaggacggaagagagattgtggtcccttgtcggaaccaggatgagctcgtgggcagggcacgagttagccagggtgctgggtggtccttgcgtgaaactgcctgcctgggaaagtcatacgcacaaatgtggcagcttatgtattttcatagacgcgacctgcggctcgccgcgaatgctatctgtagtgccgtgcccgtcgattgggtgccaacatctaggaccacttggagcatccacgcacaccatcagtggatgaccacagaggacatgttatccgtatggaacagagtttggattgaagagaatccctggatggaagataaaacgcacgtgtcaagctgggaggaggtcccttacctgggcaagcgcgaagaccagtggtgcggctctttgatagggctgaccgcccgggctacttgggccacaaacatccaagtggcaattaatcaggttaggcgactcatcggaaacgagaattatcttgactacatgacctccatgaaaagattcaagaacgaaagtgatccagagggtgctctgtggtga

SEQ ID NO: 13347 - RNA, 9879 nt, synthetic construct
  misc_feature 1..9879: note = derived and/or modified CDS sequence (opt3) from DENV-1__GU131970__SS-prME
  source 1..9879: mol_type = other RNA
agcgtgaccatgctgctcatgcttctgcccacagccttggctttccacttaactacgagaggaggggagcctcatatgatcgtctccaagcaggaaagaggaaaatctctgttatttaagacctcagccggtgttaatatgtgcacactcattgccatggacctgggagagctttgtgaagatactatgacctacaaatgcccacagataacagaggcggaaccggacgatgtggactgttggtgcaatgctaccgatacttgggtaacatatgggacctgtagtcagacgggagagcaccggcgcgagaagcgaagcgtggccctggcaccccatgtcggcttgggtctcgaaactcgtaccgagacatggatgtcctctgaaggggcctggaaacagatccagagagtggagacttgggctctgaggcaccctggattcaccgttattgcactgtttctcgcccatgctatcggcacatcgattacccaaaagggcatcatattcatcttactgatgcttgtgacgccatcaatggccatgcggtgcgtcgggattggaaaccgcgactttgtggagggtttgagcggcgcgacttgggttgatgttgtgctggaacacgggagttgtgtcacaaccatggcaaagaataaacccactttggacatcgagctcctgaagacagaagtgaccaaccctgccattcttagaaaactgtgcatcgaggctaagatatccaatacgaccacagattctaggtgtccaactcagggagaagccaccttggtggaggagcaggacgcaaacttcgtctgccggcgcacatttgttgatcgaggctggggtaatgggtgtggactcttcggcaaaggcagcctgttaacttgcgctaagtttaagtgcgtgaccaaactggaagggaagattgtacagtacgagaacctcaaatattccgtgatcgtcacagtgcacaccggagaccaacatcaggttggtaatgaaactacggagcacggcacaattgccaccatcactccccaggcgcctacctcagaaatccagcttacagattacggggccctgaccttggactgtagtccaagaactggactagacttcaacgagatggtgctgctcacaatgaaggagaaaagctggctggtccataagcaatggtttcttgatctgccgttgccctggacgtctggcgcatccacctcacaggaaacttggaataggcaggacctcctggtgacattcaaaaccgctcacgccaagaagcaagaggtagttgtgttaggtagccaggaaggggctatgcacacagccctgactggcgcaaccgagattcagacgagtggaaccacaactatatttgccggccatctaaaatgccggctcaagatggataaactgacccttaaggggacatcttatgtcatgtgtactggatccttcaaattggaaaaggaggtggctgagacccagcacggtacggtcctggtgcaagttaagtacgaaggcacagacgcgccttgcaaaatcccattcagcacccaggatgagaagggggtgactcagaacggacgtctcattacagcaaatcccatcgtaaccgacaaagaaaagcctgtcaacatagagactgagccaccctttggcgaatcgtatattgtggttggtgccggggagaaagctctgaaactttcttggttcaagaaaggctcctcaatcggaaagatgtttgaagccaccgcacgcggcgccagaaggatggctatcctgggggatacagcctgggacttcggaagtattggtggcgtgtttacgagcgtcgggaaattggtgcatcaggtattcggaaccgcatacggcgtgctcttttccggtgtttcttggactatgaagatcgggattggcatactgttaacatggctgggactaaatagccggtcaaccagtctctccatgacatgtatcgcggtcggcatggtgactctgtaccttggggtgatggtccaagctgatagcggatgcgttattaactggaaaggccgagagttgaagtgtggttctgggatcttcgtgaccaacgaagtgcacacgtggacagagcagtataagtttcaggccgactcaccgaaacgcctgagtgcagccatcggaaaggcttgggaggaaggcgtatgcggtattagaagcgccaccaggctcgagaatataatgtggaaacagatctccaacgaactgaatcatattttactggagaacgatatgaagttcactgtcgtggttggcgacgcaaatgggatccttgctcaaggcaagaagaccattcggcctcagcccatggaacacaaatactcttggaagtcgtggggcaaggccaaaatcataggggcggacatccagaacacaacttttattatcgatggaccagacacccctgagtgtcccgataatcagcgcgcctggaacatttgggaggtggaagactatggcttcggtatctttacaacgaatatatggttgaagctcagagatagctacacccaaatgtgcgaccacaggctgatgtccgctgcaattaaagattcaaaggccgtccatgctgacatggggtattggatcgagagtgagaagaatgagacttggaagctagcccgtgcatctttcattgaagtgaagacatgtacctggccaaaaagccacactctgtggtccaatggagttctcgagtcagagatgatcatacccaagatctacggcggtcctattagccagcataactatcggccaggctacttcacacagaccgcggggccgtggcacctgggaaaacttgaattggattttgacctgtgcgagggcacgactgtggtagtcgatgaacactgcgggaatcgaggaccctctttaagaaccacaaccgtgactggcaagatcattcatgagtggtgttgcaggtcctgtacactccctccactgcgcttccggggtgaggacgggtgctggtacggaatggaaatcagacccgtgaaagagaaggaagagaaccttgtcaggagtatggttagcgccggctctggtgaagtggattccttttcactgggcatattgtgtgtaagtattatgatcgaggaggtgatgcgcagccgatggtcgcggaagatgctcatgaccgggacactggctgtcttcctactgctcatcatgggacaactgacttggaaagaccttattcgtttgtgcatcatggtgggcgccaatgcatccgacagaatggggatgggaaccacgtatctggctttaatggccacatttaagatgaggcctatgttcgcagttggcctcctgtttcgccggcttacctctagagaagtgctgctactcactattggtctgagcttggtcgcctcagtggagctgccaaacagtttagaagaactcggggatggactggctatgggcataatgatgcttaaactgttgaccgagttccacccccatcagctctggacaactctgctatccctgacctttatcaagacgacactttctctcgactacgcgtggaaaaccactgccatggcactgagcattgtttccttgttcccgctgtgtttatcaacaaccagccagaagactacatggctccctgtgctgcttggcagttttgggtgcaagccactgaccatgttcttgatcacggagaacaaaatttggggaaggaagtcttggcccctcaatgagggtatcatggctataggcatcgtctccattctgctaagctcgctgcttaaaaacgatgtacctctcgccgggcccctgatcgccggaggcatgttgattgcttgttatgtgatctcaggttctagtgcagacttatccctggaaaaggccgcggaggttagctgggaacaggaggctgaacactctgggactagccataatatactcgtggaggtccaagatgacggaaccatgaaaattaaggatgaggaacgagacgatacactgaccatccttctgaaagccacattgctagcagtgtccggcgtatacccaatgtcaatccctgccactctgtttgtgtggtatttctggcagaagaagaaacagcgcagtggcgtcctctgggacacccccagcccaccggaggttgaacgggctgtgctggatgacgggatttacagaatacttcagaggggattactgggtcgttctcaagtgggcgtcggggtgttccaggatggagtttttcacacgatgtggcacgtaacacgcggcgcagtgctcatgtatcagggtaagcggttggagccttcctgggcctcagtcaaaaaggacctgatcagttacgggggaggctggagattccagggcagctggaacactggggaggaagtgcaagttattgcggtggagcccggcaaaaatccaaagaacgtccagaccacacccggtacctttaagactcctgaaggcgaggtgggggctatcgccctcgacttcaaaccaggaacctccggctctcccattgtaaatagggaaggtaagatcgtcgggctgtacggaaacggcgtggttacaacgtcgggcacttatgtgagcgcaatagcccaggctaaagcctcacaagaggggcctcttccggagatcgaagatgaggtctttaagaaacgaaatctgaccattatggacttgcatccaggatccggtaagacacggcgctacctacccgcaatcgtgagagaagctattaagaggaaactgcggaccctcatcttagcccctactcgagttgtggcgagtgagatggccgaagcactgaagggcatgccaataagatatcagacaaccgctgtcaaatctgagcacacggggcgcgagattgtggatcttatgtgccatgccactttcacaatgaggctgctcagccccgtacgtgtgcctaactacaatatgatcatcatggacgaagctcactttaccgatccggcatccattgccgcccggggatatatctcaaccagagttggcatgggtgaggctgcggcaatattcatgactgccacacccccagggtctgtcgaggcttttcctcagagcaacgccgtgattcaggacgaagaaagggatatccccgagcgcagttggaactccggatacgactggattaccgatttcccaggcaagacagtgtggtttgtccctagcatcaaatctggcaacgacatagcaaattgtttgcgaaagaacgggaagagagtaattcaactgtcacggaaaactttcgatacggagtatcagaagaccaaaaacaatgactgggactacgtggttacaactgatatctccgaaatgggagccaacttcagggctgaccgcgtgatcgatccccgtagatgcctcaagccagtcattctgaaagacggtccggagcgggtgatccttgcgggccctatgcccgttaccgtggccagtgcagctcagaggcgcgggcgaattggaagaaatcagaacaaggaaggcgatcaatacgtctatatgggtcagccactaaataacgacgaggatcatgcccactggacagaggcaaagatgctgttggacaatataaacacccccgaagggatcattcctgccttatttgagccagaacgggagaaaagcgctgccatcgatggcgaatacaggctgcgcggagaggcgagaaagactttcgtggagctcatgaggcggggcgacctgcccgtatggctttcgtataaagtggcatctgaagggtttcagtactccgatcgtcgctggtgcttcgacggagagcgaaataaccaggttctggaagagaatatggatgtcgaaatctggacgaaggagggtgagaggaaaaagctcaggcctcggtggttggacgcccgcacctatagcgacccgctggctctaagagaatttaaagagttcgccgctggcaggcggtcagtgagtggggatctgattctcgaaataggaaaacttccacaacacctgacattacgagcacagaacgccttggacaatctggtgatgctccataactctgagcagggcggtaaggcttacagacacgccatggaagaactgcccgatactatcgagacccttatgctgctcgcattgattgcggtcctgacagggggcgttaccttatttttcctatccggaaaaggcctggggaagactagcatcggactcctttgtgtgacagcctcaagtgctctgttgtggatggccagcgtagaacctcattggattgcagcttccatcatactggagtttttcctcatggtgctgcttatccccgaaccagaccgccagaggacgcctcaagataatcagctcgcctatgtcgtgattggtctgttgtttatgatcctgaccgttgcagccaacgagatgggcttactagagactaccaaaaaggacctggggattggacacgtggctgcggaaaaccaccagcatgccaccatgctcgatgtcgaccttcggcccgcatctgcttggaccctgtacgccgtagccacaactgtgatcacgccaatgatgcgtcacaccatagagaatacaactgcaaacattagcttgaccgctatcgccaatcaagcggctattctgatgggcctcgataaaggttggcctatctccaagatggacataggggttccgctgcttgccttaggctgctactcacaggtgaaccccctgacactcaccgcagccgtcttgatgctggtggctcattatgcaatcattggaccaggcctacaggccaaggcgactagagaagctcagaaaaggacggccgcagggatcatgaagaatcctacagtcgatggaattgtggccatcgacctggatcccgttgtgtacgacgctaaattcgagaagcaactcggccagataatgcttctgattttgtgtacctctcagatcctgctcatgcgcactacctgggccctgtgcgaaagtatcacattagcaactggtccacttaccacactgtgggaggggtcgcctggaaaattttggaacacgaccattgctgtaagcatggccaatatcttccggggctcctatctcgcgggtgccggcctagcattctctctgatgaagtcactagggggaggccgaagagggactggagctcagggcgagacactgggtgaaaagtggaaaaggcaactcaaccagcttagcaagtccgagtttaatacctacaaacgcagtgggataatggaagtggaccggtctgaggccaaggaaggactgaaaagaggcgagactacaaagcacgcagtcagccgtggtaccgctaagttgaggtggttcgttgagcggaacctggtgaaacccgaaggcaaggtcattgatctcgggtgtggacgcggcgggtggtcatattactgcgccggactgaaaaaggtgacggaggtaaaaggctataccaagggtgggccgggacatgaggaaccaatccctatggccacatacggctggaatctagtgaaacttcactccggcaaggacgtatttttcatgcccccagaaaagtgtgatactctgctatgcgacattggggagagtagccccaaccctaccatcgaggaaggacgaacactcagagtgctgaaaatggtcgagccgtggttgaggggtaatcagttttgtataaagatcctgaacccctacatgccatctgtggtcgaaactctcgagcagatgcaacggaaacacggcgggatgcttgtgcgcaatcctctgtccagaaactcaacccatgagatgtattgggttagctgcggaacaggcaatattgtatcggcggtgaacatgacctctaggatgttactgaaccgattcactatggctcaccggaagcccacgtacgaacgtgatgtcgacttgggtgcagggacaagacatgtggccgttgagcctgaagtggctaatctcgatatcattggacagcgcatcgagaacattaaaaatgaacacaagagtacctggcactatgacgaggataacccatacaagacttgggcctatcatggctcctacgaggtcaaacccagcggctcagcatcctctatggtgaatggggtagtgaggctgctaaccaagccttgggacgttatcccaatggtcacacagatagccatgacggataccactccctttggacaacagcgggtgttcaaagaaaaggtggacacaagaaccccgcgcgctaaaaggggtactacacagattatggaggtcaccgcgaagtggctttggggctttctgagccgaaacaagaaacctcggatctgtacaagagaagagttcactaggaaggttcgcagtaatgccgcaatcggggctgtgtttgtagacgaaaaccagtggaactccgccaaagaggcagtggaggatgaacgtttctgggacctcgtccaccgggagagagaactgcataagcaaggaaaatgcgcaacatgcgtgtataacatgatgggcaagagggagaagaaattgggtgaatttgggaaggctaaaggaagccgcgccatttggtacatgtggctgggcgcgcgattcctcgagttcgaggcacttggctttatgaatgaagatcactggttctctcgggagaactcactgagtggggttgaaggagagggtttacataagctgggctacatattgagagacatctccaaaattccagggggaaatatgtatgccgatgacacggctggctgggataccaggatcacagaggacgatctccagaacgaagccaagattactgacatcatggagcccgaacacgcactgctagctaccagcatatttaaacttacataccagaataaggtggtccgcgtgcagagacctgccaagaacggtactgtaatggatgttatctctcggagggaccaacgtgggtcgggacaggtgggcacctatggcctgaacacgttcacaaatatggaggtccagctcattcgacagatggaatcagaggggatctttctgccaagcgagttggaaacccccaacttagctgagcgcgtgctggattggctcgaaaaacacggagccgagagacttaagcggatggcaatttccggtgacgactgtgtggtcaaaccgatcgatgacaggttcgcgactgccctgacagctctaaatgatatgggcaaggttcgcaaagacatacctcaatgggaacccagtaaggggtggaacgattggcaacaggtgccattttgctctcatcacttccatcagctgattatgaaggacggaagagagatcgtagtgccttgtcggaatcaagatgagctcgtcggcagggcccgagtgagccagggtgcagggtggtccttgaaagaaaccgcttgcctgggaaagtcatacgcccagatgtggcaacttatgtattttcaccgtagagacctgcgcctcgcagccaacgcgatctgtagtgctgttcccgtggattgggtcccaacttctcggaccacatggagcattcacgcccatcaccagtggatgacgaccgaggacatgttatccgtgtggaatagggtatggatagaagagaacccctggatggaagataaaactcatgtttcaagctgggaggaggtgccttacctgggcaagagagaagaccagtggtgcggctctttgatcgggctgacagcacgcgccacctgggctactaatattcaggtcgccatcaaccaagtgcggaggctcattggaaatgagaactatcttgactacatgacatccatgaaacgattcaagaatgaaagtgatccagagggtgcactgtggtga

SEQ ID NO: 13348 - RNA, 9879 nt, synthetic construct
  misc_feature 1..9879: note = derived and/or modified CDS sequence (opt3) from DENV-1__KF955427__SS-prME
  source 1..9879: mol_type = other RNA
agcgtgaccatgctgctcatgcttctgcccacagccttggctttccacttaactacgagaggcggggagcctcatatgatcgtctccaagcaggaaaggggaaaatctctgctatttaagacctcagcaggtgttaacatgtgcacactcattgccatggacctgggcgagctttgtgaagatactatgacctacaaatgcccacaaataacagaggcggaaccggacgatgtggactgttggtgcaatgctaccgatacttgggtaacatatgggacctgtagtcagacgggagagcaccggcgcgacaagcgaagcgtggccctggcaccccatgtcggcttgggtctcgagactcgtaccgaaacatggatgtcctctgagggggcctggaaacagatccagagagtggaaacttgggctctgaggcaccctggattcaccgttattgcactgtttctcgcccatgctatcggcacatcgattacccaaaagggcatcatattcatcttactgatgcttgtgacgccatcaatggccatgcggtgcgtcgggattggaaaccgcgattttgtggagggtttgagcggcgcgacttgggtagacgttgtgctggagcacgggagttgtgtcacaaccatggcaaagaataaacccactctagatatcgaactcctgaagacagaggtgaccaaccctgccattcttagaaaactgtgcatcgaagctaagatatccaatacgaccacagactctaggtgtccaactcagggagaggccaccttggtggaagagcaggatgcaaacttcgtctgccggcgcacatttgttgaccgaggctggggtaatgggtgtggactcttcggcaaaggcagcctgttaacttgcgctaagtttaagtgcgtgaccaaactggaggggaagattgtacagtacgaaaacctcaaatattccgtgatcgtcacagtgcacaccggagatcaacatcaggttggtaatgagactacggaacacggcacaattgccaccatcactccccaggcgcctacctcagagatccagcttacagactacggggccctgaccttggactgtagtccaagaactggactagatttcaacgaaatggtgctgctcacaatgaaggagaaaagctggctggtccataagcaatggtttcttgacctgccgttgccctggacgtctggcgcatccacctcacaggagacttggaataggcaggatctcctggtgacattcaaaaccgctcacgccaagaagcaagaagtagttgtgttaggtagccaggagggggctatgcacacagcctggactggcgcaaccgaaattcagacgagtggaaccacaactatatttgccggccatctgaaatggcggctaaagatggacaaactcaccctgaaggggacatcttatgtcatgtgcactggatccttcaaacttgagaaggaagtggctgagacccagcacggtacgggcttggtccaagtgaagtacgaggggacagatgcgccttgtaaaatcccattcagcgcacaggacgaaaagggagttacccagaacggccgtctgattactgccaatcccatcgtgacagataaagagaagcctgtaaacatagaaaccgagccaccctttggtgagtcgtatattgtcgtgggggctggcgaaaaagccctcaagctgtcttggttcaagaaaggatcctcaatcggcaagatgtttgaggcaactgcccgcggggctagaaggatggccatccttggagacaccgcatgggatttcggtagtattggcggggtttttacaagcgtgggaaaactggtccatcaggtgttcggcacggcgtacggtgtattgttttccggggtgtcttggaccatgaagatcggcattggaatactcctgacttggttaggcctgaatagccggtcaacaagtctatccatgacctgcatcgctgttgggatggtcacactctacctgggagtgatggtgcaagccgacagcggctgtgtcattaactggaaaggtcgagaacttaagtgcgggtctggaatcttcgttactaacgaggtgcacacctggacggaacagtataagtttcaggcagattcaccgaaacgcttgagtgccgctatcggcaaggcctgggaggagggtgtgtgtggcattagaagcgcaacaaggctggaaaatataatgtggaaacagatctccaacgagctcaatcatattctgttagaaaacgacatgaagttcaccgtagtcgtgggggacgctaatggaatcctggcccaaggcaaaaagatgattcggcctcagcccatggagcacaaatactcttggaagtcgtgggggaaggcgaaaatcataggagccgatatccagaacactacctttattatcgacggcccagatacacctgaatgccccgacaatcagcgcgcttggaacatttgggaggttgaggattatggtttcgggatctttactaccaatatatggcttaagttgagagacagctacacacaaatgtgtgatcacaggctcatgtccgcagccattaaagactcaaaggctgtgcatgccgatatgggatattggatcgaaagtgagaaaaacgaaacgtggaagctggcacgtgcgtctttcattgaggtcaagacctgcacttggccaaaaagccacacactatggtccaatggcgtgctggaatcagagatgatcatacccaagatctacggtggccctattagccagcataactatcggccagggtacttcacccagactgccggaccgtggcacctcggcaaactggagcttgactttgatttgtgtgaagggacaaccgttgtggtagacgagcactgcggaaatcgaggcccctctctgagaacgactaccgtcacaggtaagatcattcatgaatggtgctgtaggtcctgcaccttacctccactccgcttccggggggaggatggatgttggtacggcatggagatcagacccgtgaaagaaaaggaggaaaacctggtgaggagtatggtcagcgctggttctggcgaggttgactccttttcacttgggatactgtgcgccagtattatgatcgaagaggtgatgcgcagccgatggtcgcggaagatgttgatgactggaacactcgcagtattcctgctactggtgatgggccaactcacctggaatgacctgatccgtctttgtattatggtcggggctaacgcctccgatagaatgggaatgggcacaacttatttggcactgatggccacctttaaaatgaggcctatgttcgctgtgggtttactctttcgccggctgacgtctagagaggttcttctgctaacaatcgggctcagcctggtggcgtcagtcgaattgccaaacagtctggaggaattaggagacggcctcgccatgggcattatgatgctgaagcttctgaccgagttccagccccaccagttgtggactaccctcctgtccctaacatttataaaaactaccctgtctcttgattacgcatggaagacgacagctatggccctcagcatcgtgtccctgttcccgttgtgcctgtcaaccactagccagaaaacaacctggttacctgttctcctggggagttttggatgtaagccacttactatgttcctgattacagaaaataagatctggggtaggaaatcttggcccttgaacgagggcattatggccatcgggatagtgtccatcctcctgagctcgctactgaagaatgacgtccctcttcccgatccactcattgctggaggcatcctgattgcatgctatgtaatctcaggttctagtgccgacttgtccttagagaaagcggctgaaatgagctgggagcaagaagccgagcattctgggaccagccacaacatactggtggaagttcaggatgacggacctatgaagattaaagatgaggagcgagacgatacgctcactatcctgcttaaggcaaccctgttggccgtgtccggcgtctaccccatgtcaatcccaggcacactatttgtgtggtatttctggcagaaaaagaagcagcgcagtggggtactgtgggacaccccgagccctcccaaagtggaacgggctgtcctcgatgacggaatttacagaatactgcaaaggggtcttttaggccgttctcaggttggggtgggagtgttccaggacggcgtctttcatacaatgtggcacgtgactcgcggtgcagttctgatgtatcaggggaagcggctcgagccatcctgggcctcagtaaaaaaggatttgatcagttacggaggcggctggagattccaagggagctggaataccggagaagaggtgcaggtcattgcggtggagcccggtaaaaaccctaagaatgttcagacgacaccaggcacttttaagacccccgaaggggaggtgggagctatcgccctggacttcaaacctggcacatccggttctccgattgtcaacagggaagggaagatcgtgggactctacggcaatggcgtagtcaccacttcggggacctatgtgagcgcaatagcccaagctaaagcctcacaggagggaccactgcccgaaatcgaggatgaggtttttaagaaacgaaaccttacaattatggacctgcaccctggttccggcaagacgcggcgctacttgccagcaatcgtgagagaagctattaagaggaaactacggactctgatcctcgcccccacccgagtcgtggcgagtgagatggccgaagcattaaaggggatgcctataagatatcagacaaccgctgttaaatctgagcatactggacgcgaaattgtggatctgatgtgtcacgccacattcaccatgaggcttctgagcccggtccgtgtgcccaattacaacatgatcatcatggacgaggctcattttacggatccagcatccattgccgcccggggctatatctcaactagagtaggtatgggggaggctgcggcaatattcatgacagccacccctcccggatctgtggaagcttttccacagagcaatgccgttattcaagacgaggaaagggatatccctgagcgcagttggaactccggctacgactggattaccgatttccccggcaagactgtctggtttgtgccaagcatcaaatctgggaatgacatagcaaactgcctccgaaagaacggaaagagagtgattcagttgtcacggaaaacattcgacaccgaatatcagaagacaaaaaataacgattgggactacgtcgtaactacggatatctccgagatgggtgccaatttcagggctgaccgcgtgatcgatccgcgtagatgtctgaagcctgttattctcaaagacggccccgagcgggtgatcctggcggggccaatgcccgtcaccgtggccagtgcagctcagaggcgcggacgaattggcagaaaccaaaataaggaaggtgatcagtacgtttatatggggcagcctcttaacaatgacgaggatcacgcccattggacagaagcaaagatgctactggacaacataaatactccagagggcatcattcccgccttgtttgagcctgaacgggagaaaagcgctgccatcgatggagaatacaggttacgcggcgaggcgagaaagaccttcgtggaactgatgaggcggggggacctcccggtctggctgtcgtataaagtggcatctgagggatttcagtactccgatcgtcgctggtgcttcgacggtgagcgaaacaatcaagtacttgaagagaacatggacgtggaaatctggacaaaggagggcgaaagaaaaaagctgaggccacggtggctcgatgcccgcacctatagcgaccccttggctctgagagagtttaaagagttcgccgctgggaggcggtcaattagtggagatctaatactggaaatcggcaagctccctcagcaccttactctgcgagcacagaatgccttagacaacttggttatgctgcacaattctgagcagggtgggaaggcttacagacatgccatggaagagctccccgatacgattgaaaccctgatgcttctggcactcatcgcggtcttgacaggcggagtgactctgtttttcttatccggcaaagggctaggaaagaccagcattggtctgctctgcgtgacagcctcaagtgctcttctgtggatggccagcgtcgagccacactggatcgcagcttccataatcttggagtttttcctgatggttctcctgattcctgaacccgaccgccaaaggaccccacaggataaccagcttgcctatgtggtaatcggcctcctgtttatgattttgactgtggcagccaacgagatggggctgttagaaacaacgaaaaaggacctaggaatcggccatgtcgctgcggagaatcaccaacacgccaccatgctggatgtggacctccggcctgcatctgcttggactctttacgccgttgccacaaccgtgataaccccgatgatgcgtcatacaattgagaacactacggcaaatatcagcctgaccgctattgccaaccaggcggctatcttgatgggtctggataaagggtggcccatatccaagatggacatcggcgtcccactcctggcccttggatgttactcacaggtaaatcctttaacactgactgcagccgtgctcatgttggttgctcactatgcaattatcggccccgggctgcaggccaaggcgaccagagaagctcaaaaaaggacagccgcaggaattatgaagaacccaaccgtggatggcatcgtcgccatagacctagaccctgtggtctacgatgctaaattcgagaagcagctgggtcagattatgctccttatcctgtgcacttctcagatcttgctgatgcgcacgacatgggccctctgtgaaagtattaccctggcaactgggcccttaaccacactttgggagggatcgccgggcaaattttggaatactaccatcgctgtgagcatggccaacatattccggggttcctatctggcgggcgccgggctcgcattctctctaatgaagtcactgggaggcgggcgaagaggaacaggcgctcaaggtgaaacgttgggggagaagtggaaaaggcagctgaatcagctcagcaagtccgagtttaacacctacaaacgcagtggaattatggaagttgaccggtctgaggccaaggaaggccttaaaagaggtgagactacaaagcatgcagtgagccgtggcaccgctaagctgaggtggttcgtagaacggaatttggtgaaaccagaggggaaggtcatcgatctgggatgcggccgcgggggatggtcatattactgtgccggcctcaaaaaggttactgaggtgaaaggttatacaaaggggggacctggccacgaagagcccattccaatggccacctacggctggaacttagtcaaactgcattccgggaaggacgtgtttttcatgccccctgaaaagtgcgatacgcttctgtgtgacatcggagagagtagcccgaatcccaccatagaagagggtcgaacactaagagtactcaaaatggtggagccatggctgaggggcaaccagttttgcatcaagattttgaatccttacatgccctctgttgtggaaactctggagcaaatgcagcggaaacacgggggaatgctcgtccgcaaccctctttccagaaattcaacccacgaaatgtattgggtgagctgtggcacaggtaacatcgtctcggcggtgaacatgacttctaggatgctgttaaatcgattcaccatggctcatcggaagccaacatacgagcgtgatgttgacctgggggcaggaaccagacacgtagccgtggagcccgaagtcgctaacttggatattatcggccagcgcattgagaatatcaaaaacgaacataagagtacttggcactatgacgaggataatccttacaagacgtgggcctatcacggctcctacgaagtgaaaccaagcgggtcagcatcctctatggttaacggagtggtcaggctcctgacaaagccctgggacgtgataccgatggtaacccaaattgccatgactgacaccacaccttttggtcagcagcgggtgttcaaagagaaggttgatacgagaaccccacgcgctaaaaggggcactacacagatcatggaggtcaccgcgaagtggctatgggggtttcttagccgaaataagaaaccccggatctgcactagagaagagttcacaaggaaggtgcgcagtaacgccgcaattggagctgtgtttgtcgacgaaaatcaatggaactccgccaaagaggcagttgaagatgagcgtttctgggacctggtgcatcgggagagagaactccacaagcagggcaaatgtgccacctgcgtatataatatgatgggtaagagggagaagaaactgggggaatttggaaaggctaaaggcagccgcgccatatggtacatgtggttgggcgcgcgattcctggagttcgaagcactcgggtttatgaacgaggatcattggttctctcgggagaattcacttagtggagtggaaggtgagggcctgcacaagttagggtacatcctgagagacatttccaaaatccctggaggcaacatgtatgccgatgacacagctggttgggatactaggattaccgaagacgatttgcagaatgaggccaagatcacggagataatggaaccagagcatgcactcctggctaccagcatctttaaactaacataccagaacaaggtcgtgcgcgttcaaagacccgccaagaacgggactgtgatggacgtcatttctcggagggatcagcgtggatcgggccaggtgggcacctatgggcttaatacattcactaacatggaagtacagctgatccgacaaatggagtcagaaggaatttttctcccgagcgagctggagacccctaatttggctgaacgcgttttagactggctggagaaacacggtgccgaaagactcaagcggatggcaatctccggcgacgattgcgtggtcaaacccatagacgataggttcgcgacggcccttacagctctgaacgacatggggaaggtgcgcaaagatattccacagtgggagcctagtaagggatggaatgactggcagcaggtgcccttttgttctcaccatttccaccaactaatcatgaaggatggcagagaaatcgtcgttccatgccggaaccaggacgagctggtgggtagggcccgagtaagccagggggcaggatggtccctccgtgagaccgcttgtttgggcaaatcatacgcccaaatgtggcagctgatgtattttcatagacgcgatcttcggctggcagccaatgcgatttgcagtgctgtgcccgtcgactgggtgcctacttctaggacaacctggagcatacacgcccaccatcagtggatgactaccgaagatatgctctccgtttggaacagagtgtggatcgaggaaaatccatggatggaggacaagacacacgtctcaagctgggaagaggtgccgtacttaggcaaacgcgaggaccagtggtgtgggtctctgattggattgacggcacgggccacctgggctactaacatccaagtagccattaatcaggttaggcgactgatcggtaacgaaaattatctcgattacatgacatccatgaagagattcaaaaacgagagtgaccccgaaggcgcactttggtga

SEQ ID NO: 13349 - RNA, 9879 nt, synthetic construct
  misc_feature 1..9879: note = derived and/or modified CDS sequence (opt3) from DENV-1__GQ868513__SS-prME
  source 1..9879: mol_type = other RNA
agcgtgaccatgctgctcatgcttctgcccacagccttggctttccacttaactacgagaggcggggagcctcatatgatcgtctccaagcaggaaaggggaaaatctctgctatttaagacctcagcaggtgttaacatgtgcacactcattgccatggacctgggcgagctttgtgaagatactatgacctacaaatgcccacaaataacagaggcggaaccggacgatgtggactgttggtgcaatgctaccgatacttgggtaacatatgggacctgtagtcagacgggagagcaccggcgcgacaagcgaagcgtggccctggcaccccatgtcggcttgggtctcgagactcgtaccgaaacatggatgtcctctgagggggcctggaaacagatccagagagtggaaacttgggctctgaggcaccctggattcaccgttattgcactgtttctcgcccatgctatcggcacatcgattacccaaaagggcatcatattcatcttactgatgcttgtgacgccatcaatggccatgcggtgcgtcgggattggaaaccgcgattttgtggagggtttgagcggcgcgacttgggtagacgttgtgctggagcacgggagttgtgtcacaaccatggcaaagaataaacccactctagatatcgaactcctgaagacagaggtgaccaaccctgccattcttagaaaactgtgcatcgaagctaagatatccaatacgaccacagactctaggtgtccaactcagggagaggccaccttggtggaagagcaggatgcaaacttcgtctgccggcgcacatttgttgaccgaggctggggtaatgggtgtggactcttcggcaaaggcagcctgttaacttgcgctaagtttaagtgcgtgaccaaactggaggggaagattgtacagtacgaaaacctcaaatattccgtgatcgtcacagtgcacaccggagatcaacatcaggttggtaatgagactacggaacacggcacaattgccaccatcactccccaggcgcctacctcagagatccagcttacagactacggggccctgaccttggactgtagtccaagaactggactagatttcaacgaaatggtgctgctcacaatgaaggagaaaagctggctggtccataagcaatggtttcttgacctgccgttgccctggacgtctggcgcatccacctcacaggagacttggaataggcaggatctcctggtgacattcaaaaccgctcacgccaagaagcaagaagtagttgtgttaggtagccaggagggggctatgcctacagccctgactggcgcaaccgaaattcagacgagtggaaccacaactatatttgccggccacctaaaatgccggctcaagatggacaaactgacccttaaggggacatcttatgtcatgtgtactggatccttcaaattggagaaggaagtggctgagacccagcatggtacggtcctggtgcaagttaagtacgagggcacagatgcgccatgcaaaatccccttcagcacccaggacgaaaagggggtgactcagaacggacgtctcattacagcaaatcctatcgtaaccgataaagagaagccagtcaacatagaaactgagcccccgtttggcgagtcgtatattgtggttggtgccggggaaaaagctctgaagctttcttggttcaagaaaggctcctcaatcggaaagatgtttgaggccaccgcacgcggcgccagaaggatggctatcctgggggacacagcctgggatttcggaagtattggtggcgtgtttacgagcgtcgggaaattggtgcaccaggtattcggaaccgcatacggcgtgctcttttccggtgtttcttggactatgaagatcgggattggcatactgttaacatggctgggactaaatagccggtcaaccagtctctccatgacatgtatcgcggtcggcatggtgactctgtaccttggggtgatggtccaagctgacagcggatgcgttattaactggaaaggccgagaattgaagtgtggttctgggatcttcgtgaccaacgaggtgcatacgtggacagaacagtataagtttcaggccgattcacctaaacgcctgagtgcagccatcggaaaggcttgggaggagggcgtatgcggtattagaagcgccaccaggctcgaaaatataatgtggaaacagatctccaacgagctgaatcacattttactggaaaacgacatgaagttcactgtcgtggttggcgacgcaaatgggatccttgctcaaggaaaaaagatgattcggccccagccaatggagcataaatactcttggaagtcgtggggcaaggccaaaatcataggggcggatatccagaacaccacatttattatcgacggacctgatactcccgaatgtccagacaatcagcgcgcctggaacatttgggaggtggaggattatggcttcggtatctttaccacaaatatatggttgaagctcagagacagctacacgcaaatgtgcgatcacaggctgatgtccgctgcaattaaagactcaaaggccgtccacgctgatatggggtattggatcgaaagtgagaaaaacgaaacctggaagctagcccgtgcatctttcattgaggtgaagacttgtacatggcccaaaagccataccctgtggtccaatggagttctcgaatcagagatgatcatacctaagatctacggcggtccaattagccagcacaactatcggccgggctacttcactcagacagcggggccctggcatctgggaaaacttgagttggactttgatctgtgcgaaggcaccacggtggtagtcgacgagcactgcgggaatcgaggaccttctttaagaactaccacagtgaccggcaagatcattcacgaatggtgttgcaggtcctgtactctcccacccctgcgcttccggggtgaggatgggtgctggtacggaatggagatcagacctgtgaaagaaaaggaggaaaaccttgtcaggagtatggttagcgccggctctggtgaggtggactccttttcactgggcatattgtgtgctagtattatgatcgaagaggtaatgcgcagccgatggtcgcggaagatgctcatgacagggaccctggccgtgttcctactgctcgtcatgggacaactgacatggaatgaccttatccgtttgtgcattatggtgggcgcaaacgcttccgatagaatggggatgggaactacctatctggccttaatggcaacgtttaaaatgaggccaatgttcgccgttggcctcctgtttcgccggcttacatctagagaggtgctgctactcaccatcggtctgagcttggtcgcttcagtggaactgcccaacagtttagaggaactcggggacggactggcgatgggcattatgatgcttaagctgttgactgagttccagccgcatcagctctggataaccctgctatccctgacatttatcaaaactaccctttctctcgattacgcctggaagacgacagcaatggctctgagcattgtttccttgttccctctgtgtttatcaaccactagccagaaaacaacctggctcccagtgctgcttggcagttttgggtgcaagcccctgactatgttcttgatcacagaaaataagatttggggaaggaaatcttggcctctcaacgagggtatcatggccataggcatcgtctccattctgctaagctcgctgcttaagaatgacgtacccctcgccgggccactgatcgctggaggcatgttgattgcatgttatgtgatctcaggttctagtgccgatttatccctggagaaagcggctgaagttagctgggagcaagaagccgagcactctgggaccagccataacatactcgtggaagtccaggacgatggaacgatgaagattaaagacgaggagcgagatgacactctgaccatccttctgaaggcaacattgctagccgtgtccggcgtataccctatgtcaatccccgctaccctgtttgtgtggtatttctggcagaaaaagaagcagcgcagtggcgtcctctgggatacaccaagcccgcctgaagttgagcgggcagtgctggacgatgggatttacagaatacttcaaaggggattactgggtcgttctcaggtgggcgtcggggtgttccaggacggagtttttcacactatgtggcatgtaacccgcggcgccgtgctcatgtatcagggtaaacggttggaaccctcctgggcgtcagtcaagaaagacctgatcagttacgggggaggctggagattccaaggcagctggaatacgggggaggaggtgcaggttattgctgtggaaccaggaaagaaccccaaaaatgtccagacaatgcctggtacttttaagaccccagagggcgaagtgggggccatcgcactcgatttcaagcccggaacatccggctctcctattgtaaacagggagggtaaaatcgtcgggctgtacggaaatggcgtggttaccacttcgggcacctatgtgagcgccatagctcaagccaaggcatcacaggaagggccgcttccagagatcgaggacgaagtctttaaaaagcgaaacctgacaattatggatttgcaccccggatccggtaaaacgcggcgctacctacctgctatggtgagagaggccatcaagaggaagctgcggactctcattttagcgccaacccgagttgtggccagtgaaatggcagaggctctgaaaggcatgcccatcagatatcagacaaccgccgtcaagtctgaacacactgggcgcgagatagtggaccttatgtgccatgctacattcaccatgaggctgctcagccctgtacgtgtgccgaattacaacatgattatcatggatgaggcacactttacggaccccgcctccatcgccgctcggggatatatttcaactagagttggcatgggtgaagcggcagccatcttcatgacagctaccccacctgggtctgtcgaggcctttccccagagcaatgcagtgatacaagatgaagagagggacattccagaacgcagttggaactccggatacgattggatcaccgacttccctggcaaaactgtgtggtttgtccccagcattaagtctggcaatgatatcgccaactgtttgcgaaaaaacgggaagagagtaatacagctgtcacggaagacattcgacaccgagtatcagaaaacaaagaataacgactgggattacgtggttactacggacatttccgagatgggagctaatttcagggcggatcgcgtgatcgacccacgtagatgcctcaaaccggtcatcctgaaggatggtcctgaacgggtgattcttgccggccccatgccagttaccgtggcaagtgctgcccagaggcgcgggcgaatcggaagaaaccaaaataaagagggcgaccagtacgtctatatgggtcagcccctaaacaatgatgaagaccatgcacactggacagaggccaagatgctgttggataacattaatactcctgaggggataatcccagctttatttgaacccgagcgggaaaagagcgccgcgattgacggcgagtacaggctgcgcggagaagcaagaaaaaccttcgtggagctcatgaggcggggcgatctgcctgtatggctttcgtataaggtggcctctgaggggtttcagtactccgaccgtcgctggtgcttcgatggagaacgaaacaatcaagttctggaggaaaacatggacgtcgagatctggacaaaagaaggtgagagaaagaaactcaggccgcggtggttggacgctcgcacctatagcgatccactggccctaagagagtttaaggaattcgctgcaggcaggcggtcagtgagtggggacctgatcctcgagattggaaaacttccccagcatctgactttacgagcccagaatgctttggataacctggtgatgctccacaattctgaacagggcggtaaggcctacagacacgcaatggaggaactgcctgacacgatagagacccttatgctgctcgcgttgatcgccgtcctgacagggggcgttactttatttttcctatccggaaagggcctggggaaaaccagcattggactcctttgtgtgacagcttcaagtgccctgttgtggatggcaagcgtagagccccattggatcgctgcctccattatcctggaatttttcctcatggtgctgcttataccagagcctgatcgccaaaggaccccccaggacaaccagctcgcatatgtcgtgatcggtctgttgtttatgattctgactgttgccgctaacgaaatgggcttactagagacaacgaagaaagatctggggatcggacacgtggcggccgagaatcatcaacacgcaaccatgctcgacgtcgatcttcggccagcttctgcctggactctgtacgccgtagcaacaaccgtgattacccctatgatgcgtcacacaatcgaaaacactacggctaatataagcttgaccgccattgcgaaccaggctgccatcctgatgggcctcgacaagggttggccgatttccaaaatggatatcggggttcccctgcttgcattaggctgctactcacaggtgaatccactgacactcactgccgctgtcttgatgctggtggcacattatgccataatcggacctggcctacaggcgaaggctaccagagaggcccaaaagaggacagcagccgggattatgaaaaaccccaccgtcgacggaatcgtggctattgatctggacccagttgtgtacgacgccaagttcgaaaaacagctcggccagatcatgcttctgatattgtgtacttctcagattctgctcatgcgcacgacatgggcactgtgcgagagtatcaccttagctactggtcctcttaccacactgtgggaagggtcgcccggaaagttttggaatactaccatcgccgtaagcatggcgaacattttccggggctcctatctcgccggtgcaggcctagctttctctctgatgaaatcattggggggaggccgaagagggacaggagcccaaggcgagacgctgggtgagaagtggaagaggcagctcaatcagcttagcaaatccgaatttaacacctacaagcgcagtgggatcatggaggtggatcggtctgaagcaaaagagggactgaagagaggcgaaactacaaaacacgctgtcagccgtggtaccgccaagttgaggtggttcgttgagcggaatctggtgaagccggagggcaaagtcatagacctcgggtgtggacgcggcgggtggtcatattactgcgccggattaaagaaagtgactgaagtaaagggctatacaaaaggtgggccaggacatgaggaacctattcccatggcgacctacggctggaacctggtgaagcttcactccggcaaagatgtttttttcatgccacccgagaagtgtgacacgctgctatgcgatatcggggaaagtagccctaatccgaccattgaggagggacgaacactcagagtgctgaagatggtcgaaccctggttgaggggtaaccagttttgtatcaaaatactgaatccatacatgccttctgtggtcgagactctcgaacaaatgcagcggaagcatggcgggatgcttgtgcgcaaccccctgtccagaaattcaacccacgagatgtattgggttagctgcggaacaggcaacatcgtatcggctgtgaacatgacttctaggatgttactgaatcgattcaccatggcacaccggaaacctacatacgagcgtgacgtcgatttgggtgccgggaccagacatgtggctgttgaaccagaggtggccaacctcgacattatcggacagcgcattgaaaatatcaagaacgagcacaaaagtacttggcattatgatgaagacaatccctacaagacgtgggcatatcacggctcctacgaggtcaagcctagcggctcagcctcctctatggtgaacggggtagtgaggctgctaacaaaaccatgggatgttattcccatggtcacccaaatcgctatgactgacaccacaccgtttggacagcagcgggtgttcaaggagaaagtggacacgagaacccctcgcgcgaagaggggtactacacagataatggaagtcaccgccaaatggctttggggctttctgagccgaaataagaagccacggatttgtactagagaggaattcacaaggaaagttcgcagtaacgcagctatcggggccgtgtttgtagatgagaatcaatggaactccgcaaaggaagccgtggaggacgagcgtttctgggatctcgtccaccgggaaagagagctgcataaacagggaaagtgcgctacctgcgtgtataatatgatgggcaaaagggaaaagaagttgggtgagtttgggaaagccaagggaagccgcgcgatctggtacatgtggctgggcgcacgattcctcgaattcgaggcccttggctttatgaacgaggaccactggttctctcgggaaaattcactgagtggggttgagggagaaggtttacataaactgggctacattttgagagatatatccaagatccccgggggaaacatgtatgctgacgatacagccggctgggacactaggattaccgaggatgacctccagaatgaggcaaaaatcacggaaattatggagcctgaacacgctctgctagccaccagcatctttaagcttacataccagaacaaagtggtccgcgtgcaaagaccagctaagaacggtactgtaatggatgttatatctcggagggaccagcgtgggtcgggacaggtgggcacctatggcctgaatacattcactaacatggaggtccagctcatccgacaaatggaatcagaggggatttttctgcccagcgagttggaaaccccgaatttagccgagcgcgtgctggattggctcgaaaagcatggagcagagagacttaaacggatggcgatctccggtgacgactgtgtggtcaagcctattgatgacaggttcgccacggctctgacagccctaaacgatatgggcaaagttcgcaaggacatcccccagtgggaaccaagtaaagggtggaatgattggcagcaggtgcctttttgctctcaccacttccatcaactgataatgaaggacggaagagagattgtagtgccctgtcggaaccaggatgagctcgtcggcagggcacgagtgagccagggtgctgggtggtccttgcgtgaaaccgcctgcctgggaaagtcatacgcacaaatgtggcagcttatgtattttcacagacgcgacctgcggctcgccgcgaatgctatctgtagtgccgttccagtggattgggtccccacttctaggacaacctggagcatccatgcacaccaccagtggatgactaccgaggacatgttatccgtgtggaacagagtatggattgaagagaatccttggatggaagataaaacacatgtttcaagctgggaggaggtgccatacctgggcaagcgcgaagaccagtggtgcggctctttgatagggctgacggcccgggctacctgggccactaacatccaagtcgcaattaatcaggtgaggcgactcatcggaaacgagaattatcttgactacatgacatccatgaaaagattcaagaacgaaagtgatccggagggtgctctgtggtga

SEQ ID NO: 13350 - RNA, 9879 nt, synthetic construct
  misc_feature 1..9879: note = derived and/or modified CDS sequence (opt3) from DENV-1__GU131973__SS-prME
  source 1..9879: mol_type = other RNA
agcgtgaccatgctgctcatgcttctgccaacagccttggctttccacttaactacgagaggaggggaacctcatatgatcgtctccaagcaggaaaggggaaaatctctgctgtttaagacctcagctggtgttaacatgtgcacactcattgccatggacctgggcgaactttgtgaagatactatgacctacaaatgcccacaaataacagaggcggaaccggacgatgtggactgttggtgcaatgctaccgatacttgggtaacatatgggacctgtagtcagacgggagagcaccggcgcgacaagcgaagcgtggccctggcaccccatgtcggcttgggtctcgagactcgtaccgaaacatggatgtcctctgagggggcctggaaacagatccagagagtggaaacttgggctctgaggcaccctggattcaccgttattgcactgtttctcgcccatgctatcggcacatcgattacccaaaagggcatcatattcatcttactgatgcttgtgacgccatcaatggccatgcggtgcgtcgggattggaaaccgcgattttgtggagggtttgagcggcgcgacttgggtagacgttgtgctggagcacgggagttgtgtcacaaccatggcaaagaataaacccactctagatatcgaactcctgaagacagaggtgaccaaccctgccattcttagaaaactgtgcatcgaagctaagatatccaatacgaccacagactctaggtgtccaactcagggagaggccaccttggtggaagaacaggatgcaaacttcgtctgccggcgcacatttgttgaccgaggctggggtaatgggtgtggactcttcggcaaaggcagcctgttaacttgcgctaagtttaagtgcgtgaccaaactggaggggaagattgtacagtacgaaaacctcaaatattccgtgatcgtcacagtgcacaccggagatcaacatcaggttggtaatgagactacggaacacggcacaattgccaccatcactccccaggcgcctacctcagagatccagcttacagactacggggccctgaccttggactgtagtccaagaactggactagatttcaacgaaatggtgctgctcacaatgaaggagaaaagctggctggtccataagcaatggtttcttgacctgccgttgccctggacgtctggcgcatccacctcacaggagacttggaataggcaggatctcctggtgacattcaaaaccgctcacgccaagaagcaagaagtagttgtgttaggtagccaggagggggctatgcacacagccctgactggcgcaaccgaaattcagacgagtggaaccacaactatatttgccggccatctaaaatgccggctcaagatggacaaactgacccttaaggggacatcttatgtcatgtgtactggatccttcaaattggagaaggaagtggctgagacccagcacggtacggtcctggtgcaagttaagtacgagggcacagatgcgccttgcaaaatcccattcagcacccaggacgaaaagggggtgactcagaacggacgtctcattacagcaaatcccatcgtaaccgataaagagaagcctgtcaacatagaaactgagccaccctttggcgagtcgtatattgtggttggtgccggggaaaaagctctgaaactttcttggttcaagaaaggctcctcaatcggaaagatgtttgaggccaccgcacgcggcgccagaaggatggctatcctgggggacacagcctgggatttcggaagtattggtggcgtgtttacgagcgtcgggaaattggtgcatcaggtattcggaaccgcatacggcgtgctcttttccggtgtttcttggactatgaagatcgggattggcatactgttaacatggctgggactaaatagccggtcaaccagtctctccatgacatgtatcgcggtcggcatggtgactctgtaccttggggtgatggtccaagctgacagcggatgcgttattaactggaaaggccgagaattgaagtgtggttctgggatcttcgtgaccaacgaggtgcacacgtggacagaacagtataagtttcaggccgattcaccgaaacgcctgagtgcagccatcggaaaggcttgggaggagggcgtatgcggtattagaagcgccaccaggctcgaaaatataatgtggaaacagatctccaacgagctgaatcatattttactggaaaacgacatgaagttcactgtcgtggttggcgacgcaaatgggatccttgctcaaggcaagaagatgattcggcctcagcccatggagcacaaatactcttggaagtcgtggggcaaggccaaaatcataggggcggatatccagaacaccacatttattatcgacggaccagatactcctgaatgtcccgacaatcagcgcgcctggaacatttgggaggtggaggattatggcttcggtatctttaccacaaatatatggttgaagctcagagacagctacacgcaaatgtgcgatcacaggctgatgtccgctgcaattaaagactcaaaggccgtccatgctgatatggggtattggatcgaaagtgagaaaaacgaaacctggaagctagcccgtgcatctttcattgaggtgaagacttgtacatggccaaaaagccacaccctgtggtccaatggagttctcgaatcagagatgatcatacccaagatctacggcggtcctattagccagcataactatcggccaggctacttcactcagacagcggggccgtggcacctgggaaaacttgagttggactttgatctgtgcgaaggcaccacggtggtagtcgacgagcactgcgggaatcgaggaccctctttaagaactaccacagtgaccggcaagatcattcatgaatggtgttgcaggtcctgtactctccctccactgcgcttccggggtgaggatgggtgctggtacggaatggagatcagacccgtgaaagaaaaggaggaaaaccttgtcaggagtatggttagcgccggctctggtgaggtggactccttttcactgggcatattgtgtgtaagtattatgatcgaagaggtgatgcgcagccgatggtcgcggaagatgctcatgacagggaccctggctgtcttcctactgctcgtgatgggacaactgacatggaatgaccttatccgtttgtgcattatggttggcgccaacgcatccgatagaatggggatgggaactacctatctggctttaatggccacgtttaaaatgaggcctatgttcgcagtgggcctcctgtttcgccggcttacatctagagaggtcctgctactcaccatcggtctgagcttggtggcctcagttgaactgccaaacagtttagaggaactcggggacggactggctatgggcattatgatgcttaagctgttgactgagttccagccccaccagctctggaccacactgctatccctgacttttataaaaaccacgctttctctcgattacgcgtggaagacaaccgccatggcactgagcatcgtgtccttgttcccgctgtgtttatcaactacaagccagaaaaccacttggctccctgtcctgcttggcagttttgggtgcaagccactgacaatgttcttgattaccgaaaataagatctggggaaggaaatcttggcccctcaacgagggtattatggctatcggcatagtatccatcctgctaagctcgctgcttaagaatgacgtgcctctcgccgggcccctgattgccggaggcatgttgatcgcttgttatgttatttcaggttctagtgcagatttatccctggagaaagccgcggaagtgagctgggagcaagaagctgagcattctgggacgagccacaacatcctcgtcgaagtgcaggacgatggaactatgaagataaaagacgaggagcgagatgacaccctgacaattcttctgaaggccaccttgctagcagtatccggcgtgtacccaatgtcaatccctgccacactgtttgtctggtatttctggcagaaaaagaagcagcgcagtggcgttctctgggatactcccagcccaccggaagtggagcgggctgtgctggacgatgggatctacaggattcttcaacgaggattactgggtcgttctcaggtcggcgtgggggttttccaggacggagtatttcataccatgtggcacgtgacgcgcggcgcagtcctcatgtatcagggtaaacggttggaaccttcctgggcctcagtgaagaaagacctgataagttacgggggaggctggagattccaaggcagctggaatacaggggaggaggttcaggtgatcgcggtcgaacccggaaagaaccccaaaaatgtgcagactacccccggtacatttaagacccctgagggcgaagtaggggctattgccctcgatttcaagccaggaacttccggctctcccatcgtcaacagggagggtaaaattgtggggctgtacggaaatggcgttgtgaccacatcgggcacgtatgtcagcgcaatcgcccaagctaaggcctcacaggaagggcctcttccggagatagaggacgaagtgtttaaaaagcgaaacctgactatcatggatttgcacccaggatccggtaaaacccggcgctacctacccgcaattgttagagaggctatcaagaggaagatgcggacactgattctcgcccctacccgagtggtcgcgagtgaaatggccgaggcattaaaaggcatgccaatcagatatcagactacagctgtgaagtctgaacataccgggcgcgagatagtagacctgatgtgccacgccacgttcactatgaggcttctgagccccgtgcgtgttcctaattacaacatgattatcatggatgaggctcattttacagacccggcatccatcgccgcccggggatatatttcaaccagagtcggcatgggtgaagctgcggcaatcttcatgaccgccactcccccagggtctgtggaggcttttcctcagagcaatgccgtgatacaagatgaagagagggacattcccgaacgcagttggaactccggatacgattggatcacagacttcccaggcaaaaccgtctggtttgtacctagcattaagtctggcaatgatatcgcaaactgtctcagaaagaacgggaaaagagtgatacagttgtcacggaagacattcgacactgagtatcagaaaacgaagaataacgactgggattacgttgtgaccacagacatttccgagatgggagccaatttcagggctgatcgcgtcatcgacccccgtagatgcctgaaaccagtgatcctcaaggatggtccggaacgggttattctggcgggccctatgcccgtgactgtcgccagtgcagctcagaggcgcgggcgaatcggaagaaaccaaaataaagagggcgaccagtacgtgtatatgggtcagccacttaacaatgatgaagaccacgcccattggaccgaggcaaagatgctactggataacattaatacacccgaggggataatccctgccttgtttgaaccagagcgggaaaagagcgctgccattgacggcgagtacaggttacgcggagaagcgagaaaaaccttcgtagagctgatgaggcggggcgatctccccgtgtggctgtcgtataaggttgcatctgaggggtttcagtactccgaccgtcgctggtgcttcgatggagaacgaaacaatcaagtccttgaggaaaacatggacgtggagatctggactaaagaaggtgagagaaagaaactgaggcctcggtggctcgacgcccgcacgtatagcgatccgttggctctgagagagtttaaggagttcgccgctggcaggcggtcagtgagtggggacctaatcctggagattggaaaactcccacagcaccttaccctgcgagcacagaatgccttagataacttggtcatgctgcacaattctgaacagggcggtaaggcttacagacatgccatggaggaactccccgacacaatagagactctgatgcttctggcactcatcgcggttttgaccgggggcgtgacactgtttttcttatccggaaagggcctagggaaaaccagcattggactgctctgtgtaactgcctcaagtgcacttctgtggatggccagcgtggagcctcactggatcgcagcttccattatcttggaatttttcctgatggtcctcctgatacccgagccagatcgccaaaggacacctcaggacaaccagcttgcctatgtggttatcggtctcctgtttatgattttgacggtggcagccaacgaaatgggcctgttagagaccactaagaaagatctagggatcggacatgtcgctgcggagaatcaccaacacgccacaatgctggacgtagatctccggcccgcatctgcttggaccctttacgccgtggccaccacagttattactccaatgatgcgtcatacgatcgaaaacaccacagcaaatataagcctgactgctattgccaaccaggcggctatcttgatgggcctggacaagggttggcctatttccaaaatggatatcggggtgccgctcctggcccttggctgctactcacaggtcaatcccttaaccctgacagcagccgtgctcatgttggtcgctcactatgcaataatcggaccaggcctgcaggccaaggcgaccagagaggctcaaaagaggactgccgcagggattatgaaaaaccctacggtggacggaatcgttgccattgatctagaccccgtggtatacgacgctaagttcgaaaaacagctgggccagatcatgctccttatactgtgtacatctcagattttgctgatgcgcaccacttgggccctctgcgagagtatcaccctggcaacaggtccattaactaccctttgggaagggtcgcctggaaagttttggaatacaacgatcgctgtgagcatggccaacattttccggggctcctatctggcgggtgccggcctcgcattctctctaatgaaatcactagggggaggccgaagagggaccggagctcaaggcgagactttgggtgagaagtggaagaggcagctgaatcagctcagcaaatccgaatttaacacatacaagcgcagtgggatcatggaggtcgatcggtctgaagccaaagagggacttaagagaggcgaaaccactaaacatgcagttagccgtggtacagctaagctgaggtggttcgtggagcggaatttggtcaagcccgagggcaaagtgatagacctggggtgtggacgcggcgggtggtcatattactgcgccggactcaagaaagtaaccgaagtgaagggctatacgaaaggtgggccgggacacgaggaaccaattcctatggccacctacggctggaacttagttaagctgcattccggcaaagatgtgtttttcatgcccccagagaagtgtgacacacttctgtgcgatatcggggaaagtagccccaatcctactattgaggagggacgaaccctaagagtcctcaagatggtggaaccgtggctgaggggtaaccagttttgtatcaaaatattgaatccctacatgccatctgtcgtggaggcgctggaacaaatgcagcggaagcacggcgggatgctcgttcgcaaccctctttccagaaattcaacacacgagatgtattgggtaagctgcggaactggcaacatcgtgtcggctgtcaacatgacctctaggatgctgttaaatcgattcacaatggcacatcggaaacccacctacgagcgtgacgtggatctgggtgccgggactagacacgttgctgtggaacctgaggtcgccaacttggacattatcggacagcgcattgaaaatatcaagaacgagcataaaagtacgtggcactatgatgaagacaatccatacaagacatgggcatatcacggctcctacgaggtgaagcccagcggctcagcctcctctatggtaaacggggtggttaggctcctgaccaaaccttgggatgtcattccaatggtgactcaaatcgctatgaccgacacaacgccctttggacagcagcgggtgttcaaggagaaagtcgacaccagaactccgcgcgcgaagaggggtacaacccagataatggaagttactgccaaatggctatggggctttcttagccgaaataagaagcctcggatttgtacaagagaggagttcaccaggaaagtgcgcagtaacgcagctatcggggccgtatttgtggatgagaatcaatggaactccgcaaaggaagccgtcgaggacgagcgtttctgggatctggtgcatcgggaaagagagctccacaaacagggaaagtgcgctacatgcgtttataatatgatgggcaaaagggaaaagaagctgggtgagtttgggaaagccaagggaagccgcgcgatctggtacatgtggttgggcgcacgattcctggagttcgaggccctcggctttatgaacgaggaccattggttctctcgggaaaattcacttagtggggtggagggagaaggtctgcacaaattaggctacattctgagagatatatccaagatcccagggggaaacatgtatgctgacgatactgccggctgggacaccaggattacggaggatgacttgcagaatgaggcaaaaatcaccgaaattatggagcccgaacatgctctcctggccacaagcatctttaagctaacttaccagaacaaagtcgtgcgcgtacaaagacctgctaagaacggtaccgttatggatgtgatatctcggagggaccagcgtgggtcgggacaggtcggcacatatggccttaatactttcaccaacatggaggtgcagctgatccgacaaatggaatcagaggggatttttctcccaagcgagctggaaacgcccaatttggccgagcgcgtgttagattggctggaaaagcacggagcagagagactcaaacggatggcgatctccggtgacgactgtgtcgttaagccgattgatgacaggttcgccacagctcttaccgccctgaacgatatgggcaaagtgcgcaaggacatccctcagtgggaacccagtaaagggtggaatgattggcagcaggtaccattttgctctcaccatttccaccaactaataatgaaggacggaagagagattgtggtcccttgtcggaaccaggatgagctggtgggcagggcacgagttagccagggtgctgggtggtccctccgtgaaactgcctgcttgggaaagtcatacgcacaaatgtggcagctgatgtattttcatagacgcgaccttcggctggccgcgaatgctatctgtagtgccgtgcccgtcgattgggtgccaacatctaggaccacttggagcatccacgcacaccatcagtggatgaccacagaggacatgctctccgtatggaacagagtttggattgaagagaatccctggatggaagataaaacgcacgtgtcaagctgggaggaggtcccttacttaggcaagcgcgaagaccagtggtgcggctctctgatagggttgaccgcccgggctacttgggccacaaacatccaagtggcaattaatcaggttaggcgactgatcggaaacgagaattatctcgactacatgacctccatgaaaagattcaagaacgaaagtgatccagagggtgctctttggtga

SEQ ID NO: 13351 - RNA, 9879 nt, synthetic construct
  misc_feature 1..9879: note = derived and/or modified CDS sequence (opt3) from DENV-1__GQ868517__SS-prME
  source 1..9879: mol_type = other RNA
agcgtgaccatgctgctcatgcttctgccaacagcattggctttccacttaactacgcgaggcggggagcctcatatgatcgtctccaagcaggaaaggggaaaatctctgctgtttaagacctcagccggtgttaacatgtgcacactcattgccatggacctgggcgagctttgtgaagatactatgacctacaaatgcccacagataacagaggcggaaccggacgatgtggactgttggtgcaatgctaccgatacttgggtaacatatgggacctgtagtcagacgggagagcaccggcgcgacaagcgaagcgtggccctggcaccccatgtcggcttgggtctcgagactcgtaccgaaacatggatgtcctctgagggggcctggaaacagatccagagagtggaaacttgggctctgaggcaccctggattcaccgttattgcactgtttctcgcccatgctatcggcacatcgattacccaaaagggcatcatattcatcttactgatgcttgtgacgccatcaatggccatgcggtgcgtcgggattggaaaccgcgattttgtggagggtttgagcggcgcgacttgggttgacgttgtgctggagcacgggagttgtgtcacaaccatggcaaagaataaacccactctagatatcgaactcctgaagacagaggtgaccaaccctgccattcttagaaaactgtgcatcgaagctaagatatccaatacgaccacagactctaggtgtccaactcagggagaggccaccttggtggaagaacaggatgcaaacttcgtctgccggcgcacatttgttgaccgaggctggggtaatgggtgtggactcttcggcaaaggcagcctgttaacttgcgctaagtttaagtgcgtgaccaaactggaggggaagattgtacagtacgaaaacctcaaatattccgtgatcgtcacagtgcacaccggagatcaacatcaggttggtaatgagactacggaacacggcacaattgccaccatcactccccaggcgcctacctcagagatccagcttacagactacggggccctgaccttggactgtagtccaagaactggactagatttcaacgaaatggtgctgctcacaatgaaggagaaaagctggctggtccataagcaatggtttcttgacctgccgttgccctggacgtctggcgcatccacctcacaggagacttggaataggcaggatctcctggtgacattcaaaaccgctcacgccaagaagcaagaagtagttgtgttaggtagccaggagggggctatgcacacagccctgactggcgcaaccgaaattcagacgagtggaaccacaactatatttgccggccatctaaaatgccggctcaagatggacaaactgacccttaaggggacatcttatgtcatgtgtactggatccttcaaattggagaaggaagtggctgagacccagcacggtacggtcctggtgcaagttaagtacgagggcacagatgcgccttgcaaaatcccattcctcacccaggacgaaaagggggtgactcagaacggacgtctgattacagcaaatcccatcgtaaccgataaagagaagcctgtcaacatagaaactgagccaccctttggcgagagctatattgtggttggtgccggggaaaaagctcttaagctgtcgtggttcaagaaaggatcttccatcggaaagatgtttgaggccaccgcacgcggcgccagaaggatggctatcttgggggacacagcctgggatttcggatcaattggtggcgtgtttacgagtgtcgggaaactcgtgcatcaggtattcggaaccgcatacggcgtgctgtttagcggtgtttcctggactatgaagatcgggattggcatattactgacatggctaggactcaattctcggagcacctcactgagtatgacatgtatcgcggtcggcatggtgactctttacttgggggtgatggtccaagctgactccggatgcgttattaactggaaaggccgagaactgaagtgtggtagcgggatcttcgtgaccaacgaggtgcacacgtggacagaacagtataagtttcaggccgattctccgaaacgcctctcagcagccatcggaaaggcttgggaggagggcgtatgcggtattagaagtgccaccaggctggaaaatataatgtggaaacagatcagcaacgagttaaatcatattctgcttgaaaacgacatgaagttcactgtcgtggttggcgacgcaaatgggatcttggctcaaggcaaaaagatgattcggcctcagcccatggagcacaaatactcctggaagtcttggggcaaggccaaaatcataggggcggatatccagaacaccacatttattatcgacggaccagatactcctgaatgtcccgacaatcagcgcgcctggaacatttgggaggtggaggattatggcttcggtatctttaccacaaatatatggctcaagctgagagactcgtacacgcaaatgtgcgatcacaggctaatgagcgctgcaattaaagactccaaggccgtccatgctgatatggggtattggatcgaatcagagaaaaacgaaacctggaagctggcccgtgcaagtttcattgaggtgaagacttgtacatggccaaaatctcacaccctctggagcaatggagttctggaatccgagatgatcatacccaagatctacggcggtcctatttcacagcataactatcggccaggctacttcactcagacagcggggccgtggcaccttggaaaattggagctggactttgatttatgcgaaggcaccacggtggtagtcgacgagcactgcgggaatcgaggacccagcctcagaactaccacagtgaccggcaagatcattcatgaatggtgttgcaggtcttgtactctgcctccacttcgcttccggggtgaggatgggtgctggtacggaatggagatcagacccgtgaaagaaaaggaggaaaacctggtcaggtccatggttagtgccggcagcggtgaggtggactctttttccttgggcatactctgtgcttcaattatgatcgaagaggtaatgcgcagtcgatggagccggaagatgctgatgacagggaccctagccgtgttcctgctcctgatcatgggacaacttacatggaatgacttgattcgtctgtgcatcatggtcggcgcaaacgcttcggatagaatggggatgggaactacctatttagccctcatggcaacgtttaaaatgaggcctatgttcgccgtgggcctgctttttcgccggctgacatccagagaggttctactcctgaccattggtttgtctctggtggctagcgtcgaattaccaaactcactcgaggaactgggggacggacttgcgatgggcataatgatgctgaagttgctcactgagttccagccccaccagctgtggaccacactactgagtcttacttttatcaaaaccacgctctccctggattacgcctggaagacaaccgcaatggtgttgtctattgttagcctgttcccgttatgtctctccactacatcacagaaaaccacttggctgcctgtgcttctgggcagctttgggtgcaagccattgacaatgttcctcatcaccgaaaataagatttggggaaggaaaagttggcccctgaacgagggtatcatggctataggcatcgtctctattctactgtccagccttctcaagaatgacgtacctctggccgggcccttgatcgccggaggcatgttaattgcttgttatgtgatctcgggttcatctgcagatctgagtctcgagaaagccgcggaagtttcctgggagcaagaagctgagcatagcgggacgtctcacaacatactggtggaagtccaggacgatggaactatgaagattaaagacgaggagcgagatgacacccttacaatcctgttgaaggccaccctactggcagtgagcggcgtatacccaatgtccatccctgccacactctttgtgtggtatttctggcagaaaaagaagcagcgctcaggcgtcctgtgggatactcccagtccaccggaagttgagcgggctgtgcttgacgatgggatttacagaatattacaaaggggactgctcggtcgtagccaggtgggcgtcggggtgttccaggacggagtttttcataccatgtggcacgtaacgcgcggcgcagtgttgatgtatcagggtaaacggctggaaccttcttgggcctccgtcaagaaagacctcatctcatacgggggaggctggagattccaaggcagttggaatacaggggaggaggtgcaggttattgcggtggaacccggaaagaaccccaaaaatgtccagactacccccggtacatttaagacccctgagggcgaagtgggggctatcgccctggatttcaagccaggaactagcggctcccccattgtaaacagggagggtaaaatcgtcgggctttacggaaatggcgtggttaccacatctggcacgtatgtgtcggcaatagcccaagctaaggccagccaggaagggcctctgccggagatcgaggacgaagtctttaaaaagcgaaacttgactattatggatctacacccaggatcaggtaaaacccggcgctacctgcccgcaatcgtgagagaggctattaagaggaagctccggacattaatcctggcccctacccgagttgtggcgtccgaaatggccgaggcacttaaaggcatgccaataagatatcagactacagctgtcaagagtgaacataccgggcgcgagattgtggacctgatgtgccacgccacgttcactatgaggctcttgtctcccgtacgtgtgcctaattacaacatgatcatcatggatgaggctcattttacagacccggcaagcattgccgcccggggatatatctccaccagagttggcatgggtgaagctgcggcaatattcatgaccgccactcccccagggtcagtcgaggcttttcctcagtctaatgccgtgattcaagatgaagagagggacatccccgaacgcagctggaacagtggatacgattggattacagacttcccaggcaaaaccgtgtggtttgtcccttccatcaagagcggcaatgatatagcaaactgtctgcggaaaaacgggaagagagtaattcagctctctagaaagacattcgacactgagtatcagaaaacgaagaataacgactgggattacgtggttaccacagacatctcagagatgggagccaatttcagggctgatcgcgtgatcgacccccgtagatgcctgaaaccagtcattcttaaggatggtccggaacgggtgatcctagcgggccctatgcccgttactgtggcctccgcagctcagaggcgcgggcgaattggaagaaaccaaaataaagagggcgaccagtacgtctatatgggtcagccactgaacaatgatgaagaccacgcccattggaccgaggcaaagatgttgttagataacataaatacacccgaggggatcattcctgccctgtttgaaccagagcgggaaaagagtgctgccatcgacggcgagtacaggctccgcggagaagcgagaaaaaccttcgtggagctgatgaggcggggcgatcttcccgtatggctgagctataaggtggcatcggaggggtttcagtactctgaccgtcgctggtgcttcgatggagaacgaaacaatcaagttctcgaggaaaacatggacgtcgagatctggactaaagaaggtgagagaaagaaattgaggcctcggtggctggacgcccgcacgtattccgatccgctagctctgagagagtttaaggagttcgccgctggcaggcggagcgtgtcaggggacctcattcttgagataggaaaactgccacagcacttaaccttgcgagcacagaatgccctggataacctcgtgatgctgcacaatagtgaacagggcggtaaggcttacagacatgccatggaggaacttcccgacacaatcgagactctgatgctcttggcactgattgcggtcttaaccgggggcgttacactatttttcctgtctggaaagggcctcgggaaaacctccatcggacttctgtgtgtgactgccagctcagctttgctgtggatggccagtgtagagcctcactggattgcagctagcatcatactcgaatttttcctgatggtgcttctcatccccgagccagatcgccaaaggacacctcaggacaaccagctggcctatgtcgtgattggtttgctgtttatgatcttaacggttgcagccaacgaaatgggcctactggagaccactaagaaagatctcgggattggacatgtggctgcggagaatcaccaacacgccacaatgcttgacgtcgatctgcggcccgcatccgcttggaccttgtacgccgtagccaccacagtgatcactccaatgatgcgtcatacgatagaaaacaccacagcaaatatttctctgactgctatcgccaaccaggcggctattctcatgggcctggacaagggttggcctatcagcaaaatggatataggggttccgcttttagccctgggctgctactcccaggtgaatcccctcaccttgacagcagccgtcctgatgctagtggctcactatgcaatcattggaccaggcctgcaggccaaggcgaccagagaggctcaaaagaggactgccgcagggatcatgaaaaaccctacggtcgacggaattgtggccatcgatctcgaccccgttgtgtacgacgctaagttcgaaaaacagcttggccagataatgctgttgattctgtgtacatcacagatcctcctgatgcgcaccacttgggccttatgcgagtctatcacccttgcaacaggtccactgactaccctctgggaagggagtcctggaaagttttggaatacaacgattgctgtatcgatggccaacatcttccggggcagctatctagcgggtgccggcctggcattctccttgatgaaatctctagggggaggccgaagagggaccggagctcaaggcgagactctcggtgagaagtggaagaggcagcttaatcagctgtcaaaaagcgaatttaacacatacaagcgctccgggataatggaggtggatcggagtgaagccaaagagggattgaagagaggcgaaaccactaaacatgcagtctctcgtggtacagctaagctgaggtggttcgttgagcggaatctcgtgaagcccgagggcaaagtcattgacttagggtgtggacgcggcgggtggagctattactgcgccggactgaagaaagtgaccgaagtaaagggctatacgaaaggtgggccgggacacgaggaaccaatccctatggccacctacggctggaaccttgtgaagctgcattcaggcaaagatgtatttttcatgcccccagagaagtgtgacacactactctgcgatattggggaatccagtcccaatcctactatcgaggagggacgaaccctgagagtgttgaagatggtcgaaccgtggctgaggggtaaccagttttgtataaaaatcctcaatccctacatgccaagcgtggtcgagacacttgaacaaatgcagcggaagcacggcgggatgctggtgcgcaaccctttatctagaaattccactcacgagatgtattgggtttcatgcggaaccggcaacattgtaagcgcggtgaacatgacatcgaggatgctgttgaatcgattcaccatggctcatcggaaacccacttttgagcgtgacgtcgatctcggtgcagggacgagacacgtggccgttgaacctgaggtggctaacctggacatcattggacagcgcatcgaaaatattaagaacgagcataaatctacatggcactacgatgaagacaatccatataagacctgggcctaccacggcagttatgaggtcaagccctccggcagcgcatcatccatggtgaacggggtagtgaggctacttactaaaccttgggatgttatcccaatggtcacccaaatagccatgacagacacgacccccttcggacagcagcgggtgtttaaggagaaagtggacactagaacaccgcgcgctaagaggggtaccactcagattatggaagtcacagcgaaatggctgtggggcttcctctctcgaaataagaagcctcggatctgtaccagagaggaatttacaaggaaagttcgcagcaacgccgcaatcggggctgtgttcgtagatgagaatcaatggaacagtgccaaggaagcagtggaggacgagcgtttttgggatctggtccatcgggaaagagagttgcacaaacagggaaagtgcgccacttgcgtgtacaatatgatgggcaaaagggaaaagaagctgggtgagttcgggaaagctaagggatcccgcgccatttggtatatgtggctcggcgcgcgattccttgaatttgaggcactgggcttcatgaacgaggaccattggtttagccgggaaaattctttatcaggggttgagggagaaggtctgcacaaattgggctacatactcagagatatcagtaagattccagggggaaacatgtacgccgacgataccgctggctgggacacgaggatcaccgaggatgacctgcagaatgaggccaaaattacagatatcatggaacccgagcatgcactacttgctacttccatattcaagctgacctatcagaacaaagtggtccgcgtgcaaagacctgccaagaacggtacagtaatggacgttatcagccggagggatcagcgtgggtctggacaggtgggcacttacggcctcaatacctttacgaacatggaagtccagctgattcgacaaatggagtcggaagggatcttcttgccatcagagttagagacacccaatctggctgaacgcgtgctcgactggcttgagaagcacggagccgaaagactgaaacggatggcaattagcggtgacgattgtgtggtcaagccgatcgacgataggtttgcgaccgccctaactgctctgaacgacatgggcaaagttcgcaaggatatacctcagtgggagccctccaaagggtggaatgactggcaacaggtgccattctgcagtcaccattttcaccaactcattatgaaggatggaagagaaatcgtagtgccttgtcggaaccaggacgagttggtcggcagggcccgagtgtctcagggtgcagggtggagcctgcgtgagacagcttgccttggaaagtcctatgcccaaatgtggcagctgatgtacttccatagacgcgatctccggttagcagccaatgcgatctgttcagctgttcccgtggactgggtcccaaccagtaggactacctggtctattcacgcccaccatcagtggatgacaacggaagatatgctgagcgtgtggaacagagtatggatagaggaaaatccctggatggaggacaaaacccacgtttcctcatgggaagaggtgccttatttgggcaagcgcgaggaccagtggtgcggcagcctgatcgggctcactgcacgggccacatgggctaccaacattcaagtcgccatcaatcaggtgaggcgacttattggaaacgaaaattacctggattatatgacttctatgaaaagatttaagaacgagtccgacccagaaggtgcactatggtga

SEQ ID NO: 13352 - RNA, 9879 nt, synthetic construct
  misc_feature 1..9879: note = derived and/or modified CDS sequence (opt3) from DENV-1__GU131976__SS-prME
  source 1..9879: mol_type = other RNA
agcgtgaccatgctgctcatgcttctgccaacagcattggctttccacttaactacgagaggaggggagcctcatatgatcgtctccaagcaggaaaggggaaaatctctgctgtttaagacctcagccggtgttaacatgtgcacactcattgccatggacctgggcgagctttgtgaagatactatgacctacaaatgcccacaaataacagaggcggaaccggacgatgtggactgttggtgcaatgctaccgatacttgggtaacatatgggacctgtagtcagacgggagagcaccggcgcgacaagcgaagcgtggccctggcaccccatgtcggcttgggtctcgagactcgtaccgaaacatggatgtcctctgagggggcctggaaacagatccagagagtggaaacttgggctctgaggcaccctggattcaccgttattgcactgtttctcgcccatgctatcggcacatcgattacccaaaagggcatcatattcatcttactgatgcttgtgacgccatcaatggccatgcggtgcgtcgggattggaaaccgcgattttgtggagggtttgagcggcgcgacttgggtagacgttgtgctggagcacgggagttgtgtcacaaccatggcaaagaataaacccactctagatatcgaactcctgaagacagaggtgaccaaccctgccattcttagaaaactgtgcatcgaagctaagatatccaatacgaccacagactctaggtgtccaactcagggagaggccaccttggtggaagaacaggatgcaaacttcgtctgccggcgcacatttgttgaccgaggctggggtaatgggtgtggactcttcggcaaaggcagcctgttaacttgcgctaagtttaagtgcgtgaccaaactggaggggaagattgtacagtacgaaaacctcaaatattccgtgatcgtcacagtgcacaccggagatcaacatcaggttggtaatgagactacggaacacggcacaattgccaccatcactccccaggcgcctacctcagagatccagcttacagactacggggccctgaccttggactgtagtccaagaactggactagatttcaacgaaatggtgctgctcacaatgaaggagaaaagctggctggtccataagcaatggtttcttgacctgccgttgccctggacgtctggcgcatccacctcacaggagacttggaataggcaggatctcctggtgacattcaaaaccgctcacgccaagaagcaagaagtagttgtgttaggtagccaggagggggctatgcacacagccctgactggcgcaaccgaaattcagacgagtggaaccacaactatatttgccggccatctaaaatgccggctcaagatggacaaactgacccttaaggggacatcttatgtcatgtgtactggatccttcaaattggagaaggaagtggctgagacccagcacggtacggtcctggtgcaagttaagtacgagggcacagatgcgccttgcaaaatcccattcagcacccaggacgaaaagggggtgactcagaacggacgtctcattacagcaaatcccatcgtaaccgataaagagaagcctgtcaacatagaaactgagccaccctttggcgagtcgtatattgtggttggtgccggggaaaaagctctgaaactttcttggttcaagaaaggctcctcaatcggaaagatgtttgaggccaccgcacgcggcgccagaaggatggctatcctgggggacacagcctgggatttcggaagtattggtggcgtgtttacgagcgtcgggaaattggtgcatcaggtattcggaaccgcatacggcgtgctcttttccggtgtttcttggactatgaagatcgggattggcatactgttaacatggctgggactaaatagccggtcaaccagtctctccatgacatgtatcgcggtcggcatggtgactctgtaccttggggtgatggtccaagctgacagcggatgcgttattaactggaaaggccgagaattgaagtgtggttctgggatcttcgtgaccaacgaggtgcacacgtggacagaacagtataagtttcaggccgattcaccgaaacgcctgagtgcagccatcggaaaggcttgggaggagggcgtatgcggtattagaagcgccaccaggctcgaaaatataatgtggaaacagatctccaacgagctgaatcatattttactggaaaacgacatgaagttcactgtcgtggttggcgacgcaaatgggatccttgctcaaggcaagaagatgattcggcctcagcccatggagcacaaatactcttggaagtcgtggggcaaggccaaaatcataggggcggatatccagaacaccacatttattatcgacggaccagatactcctgaatgtcccgacaatcagcgcgcctggaacatttgggaggtggaggattatggcttcggtatctttaccacaaatatatggttgaagctcagagacagctacacgcaaatgtgcgatcacaggctgatgtccgctgcaattaaagactcaaaggccgtccatgctgatatggggtattggatcgaaagtgagaaaaacgaaacctggaagctagcccgtgcatctttcattgaggtgaagacttgtacatggccaaaaagccacaccctgtggtccaatggagttctcgaatcagagatgatcatacccaagatctacggcggtcctattagccagcataactatcggccaggctacttcactcagacagcggggccgtggcacctgggaaaacttgagttggactttgatctgtgcgaaggcaccacggtggtagtcgacgagcactgcgggaatcgaggaccctctttaagaactaccacagtgaccggcaagatcattcatgaatggtgttgcaggtcctgtactctccctccactgcgcttccggggtgaggatgggtgctggtacggaatggagatcagacccgtgaaagaaaaggaggaaaaccttgtcaggagtatggttagcgccggctctggtgaggtggactccttttcactgggcatattgtgtgctagtctcatgattgaagaggtaatgcgcagccgatggtcgcggaagatgctgatgacagggaccctagccgtgttcctgctcctgatcatgggacaacttacatggaatgacttgatccgtctgtgcattatggtcggcgcaaacgcttccgatagaatggggatgggaactacctatttagccctcatggcaacgtttaaaatgaggcctatgttcgccgtgggcctgctttttcgccggctgacatctagagaggttctactcctgaccatcggtttgagcctggtggcttcagtcgaattaccaaacagtctcgaggaactgggggacggacttgcgatgggcattatgatgctgaagttgctcactgagttccagccccaccagctgtggaccacactactgtcccttacttttataaaaaccacgctctctctggattacgcctggaagacaaccgcaatggctttgagcatcgtgtccctgttcccgttatgtctctcaactacaagccagaaaaccacttggctgcctgttcttctgggcagttttgggtgcaagccattgacaatgttcctcattaccgaaaataagatctggggaaggaaatcttggcccctgaacgagggtattatggccatcggcatagtgtccatcctactgagctcgcttctcaagaatgacgtccctctggccgggcccttgattgctggaggcatgttaatcgcatgttatgtaatttcaggttctagtgccgatctgtccctcgagaaagcggctgaagtgagctgggagcaagaagccgagcattctgggacgagccacaacatcctggttgaagtgcaggacgatggaactatgaagataaaagacgaggagcgagatgacacccttacaattctgttgaaggcaaccctactggccgtctccggcgtgtacccaatgtcaatccctgctacactctttgtatggtatttctggcagaaaaagaagcagcgcagtggcgtgctgtgggatactcccagcccaccggaagtcgagcgggcagttcttgacgatgggatctacagaattttacaaaggggactgctcggtcgttctcaggtgggcgtgggggtcttccaggacggagtgtttcataccatgtggcacgttacgcgcggcgccgtattgatgtatcagggtaaacggctggaaccttcctgggcgtcagtgaagaaagacctcataagttacgggggaggctggagattccaaggcagctggaatacaggggaggaggtccaggtgatcgctgttgaacccggaaagaaccccaaaaatgtgcagactacccccggtacatttaagacccctgagggcgaagtcggggccattgcactggatttcaagccaggaacttccggctctcccatcgtgaacagggagggtaaaattgtagggctttacggaaatggcgtcgtgaccacatcgggcacgtatgttagcgccatcgctcaagccaaggcatcacaggaagggcctctgccggagatagaggacgaagtgtttaaaaagcgaaacttgactatcatggatctacacccaggatccggtaaaacccggcgctacctgcccgctattgtcagagaggccatcaagaggaagctccggacattaattctggcgcctacccgagtggttgccagtgaaatggcagaggctcttaaaggcatgccaatcagatatcagactacagccgtgaagtctgaacataccgggcgcgagatagtcgacctgatgtgccacgctacgttcactatgaggctcttgagccccgtgcgtgtacctaattacaacatgattatcatggatgaggcacattttacagacccggcctccatcgccgctcggggatatatttcaaccagagtgggcatgggtgaagcggcagccatcttcatgaccgctactcccccagggtctgttgaggcctttcctcagagcaatgcagtcatacaagatgaagagagggacattcccgaacgcagttggaactccggatacgattggatcacagacttcccaggcaaaaccgtgtggtttgtgcctagcattaagtctggcaatgatatcgccaactgtctgcggaaaaacgggaagagagtcatacagctctcaagaaagacattcgacactgagtatcagaaaacgaagaataacgactgggattacgtagtgaccacagacatttccgagatgggagctaatttcagggcggatcgcgttatcgacccccgtagatgcctgaaaccagtgatccttaaggatggtccggaacgggtcattctagccggccctatgcccgtgactgttgcaagtgctgcccagaggcgcgggcgaatcggaagaaaccaaaataaagagggcgaccagtacgtgtatatgggtcagccactgaacaatgatgaagaccacgcacattggaccgaggccaagatgttgttagataacattaatacacccgaggggataatccctgctctgtttgaaccagagcgggaaaagagcgccgcgattgacggcgagtacaggctccgcggagaagcaagaaaaaccttcgtcgagctgatgaggcggggcgatcttcccgtgtggctgtcgtataaggtagcctctgaggggtttcagtactccgaccgtcgctggtgcttcgatggagaacgaaacaatcaagtgctcgaggaaaacatggacgttgagatctggactaaagaaggtgagagaaagaaattgaggcctcggtggctggacgctcgcacgtatagcgatccgctagccctgagagagtttaaggagttcgctgcaggcaggcggtcagtcagtggggacctcatccttgagattggaaaactgccacagcacttaaccttgaaggcccagaatgctctggataacctcgtgatgctgcacaattctgaacagggcggtaaggcctaccgacatgcaatggaggaacttcccgacacaatagagactctgatgctcttggcgctgatcgccgtgttaaccgggggcgtcacactatttttcctgtccggaaaaggcctcgggaagaccagcattggacttctgtgtgttactgcttcaagtgccttgctgtggatggcaagcgtggagcctcactggatcgctgcctccattatcctcgaatttttcctgatggtacttctcatacccgagccagatagacaacgcacacctcaggacaaccagctggcatatgtggtcatcggtttgctgtttatgattttaacggtggccgctaacgaaatgggcctactggagaccactaaaaaggatctcgggatcggacatgttgcggccgagaatcaccaacacgcaacaatgcttgacgtggatctgaggcccgcttctgcctggaccttgtacgccgtcgcaaccacagtaattactccaatgatgcggcatacgatcgaaaacaccacagctaatataagcctgactgccattgcgaaccaggctgccatcctcatgggcctggacaaaggttggcctatttccaagatggatatcggggtgccgcttttagcactgggctgctactcacaggttaatcccctcaccttgacagccgctgtgctgatgctagtcgcacactatgccataatcggaccaggcctgcaggcgaaggctacccgtgaggcccaaaaacgaactgcagccgggattatgaagaaccctacggtggacggaatcgtcgctattgatctcgaccccgtggtttacgacgccaaattcgaaaagcagcttggccagatcatgctgttgatactgtgtacatctcagattctcctgatgaggaccacttgggcattatgcgagagtatcacccttgctacaggtccactgactaccctctgggaagggtcgcctggaaaattttggaatacaacgatcgccgtgagcatggcgaacattttccgcggctcctatctagccggtgcaggcctggctttctctttgatgaagtcactagggggaggccggcgagggaccggagcccaaggcgagactctcggtgagaagtggaaaagacagcttaatcagctgagcaagtccgaatttaacacatacaaaaggagtgggatcatggaggtagatcgctctgaagcaaaggagggattgaaacggggcgaaaccactaagcatgctgtgagcagaggtacagccaagctgcgttggttcgtcgagaggaatctcgttaaacccgagggcaaggtgatagacttagggtgtggacggggcgggtggtcatattactgcgccggactgaaaaaggtcaccgaagtgaaaggctatacgaagggtgggccgggacacgaggaaccaattcctatggcgacctacggctggaaccttgtaaaactgcattccggcaaggatgtgtttttcatgcccccagagaagtgtgacacactactctgcgatatcggggaaagtagccccaatcctactattgaggagggacgcaccctgcgagttttgaaaatggtggaaccgtggctgagaggtaaccagttttgtatcaagatactcaatccctacatgccatctgtcgtggagacacttgaacaaatgcagaggaaacacggcgggatgctggtccggaaccctttatcccgcaattcaactcacgagatgtattgggtgagctgcggaaccggcaacatcgtttcggctgtaaacatgacatctagaatgctgttgaataggttcaccatggcacatcgaaagcccacttttgagcgggacgtggatctcggtgccgggacgcgtcacgtcgctgtggaacctgaggttgccaacctggacattatcggacagagaattgaaaatatcaaaaacgagcataagagtacatggcactacgatgaagacaatccatataagacctgggcataccacggctcctatgaggtgaaacccagcggctcagcctcctctatggtcaacggggtggtacgcctacttactaagccttgggatgtgattccaatggttacccaaatcgctatgacagacacgacccccttcggacagcagagggtctttaaagagaaggtggacactcggacaccgagagcgaaacgcggtaccactcagataatggaagtgacagccaagtggctgtggggcttcctcagcaggaataagaaacctcgaatttgtacccgggaggaatttacaagaaaggtcaggagtaacgcagctatcggggccgttttcgtggatgagaatcaatggaactccgcaaaagaagccgtagaggacgagcgcttttgggatctggtgcatcgtgaacgggagttgcacaagcagggaaaatgcgctacttgcgtctacaatatgatgggcaagagagaaaagaaactgggtgagttcgggaaggccaaaggaagcagggcgatctggtatatgtggctcggcgcacgcttccttgaatttgaggccctgggcttcatgaacgaggaccattggttttctcgagaaaattcattaagtggggtggagggagaaggtctgcacaagttgggctacattctccgggatatatccaaaatcccagggggaaacatgtacgctgacgataccgccggctgggacacgagaattaccgaggatgacctgcagaatgaggcaaagatcacagatattatggaacccgagcatgctctacttgccactagcatcttcaaactgacctatcagaacaaggttgtgagggtccaacgccctgctaagaacggtacagtgatggacgtaatatctagacgggatcagagggggtcgggacaggttggcacttacggcctcaatacctttacgaacatggaagtgcagctgatccgtcaaatggagtcagaagggattttcttgccaagcgagttagagacacccaatctggccgaacgagtcctcgactggcttgagaaacacggaaccgaacgcctgaagagaatggcaatctccggtgacgattgtgtggtgaaaccgattgacgatcggtttgcgactgccctaacagctctgaacgacatgggcaaggtcaggaaagatatccctcagtgggagcccagtaaggggtggaatgactggcagcaggttccattctgctctcaccattttcaccaactcataatgaaggatggacgcgaaattgtggtaccttgtagaaaccaggacgagttggtgggccgggccagggtcagccagggtgcagggtggtccctgcgagagaccgcttgccttggaaaatcatatgcccaaatgtggcagctgatgtacttccatcgtagagatctccgcttagcagccaatgcgatctgtagtgctgtgcccgttgactgggtgccaacttctcggaccacatggagcatccacgcccaccatcagtggatgacgaccgaagatatgctgtccgtctggaacagggtgtggattgaggaaaatccctggatggaggacaagactcacgtatcaagctgggaagaggttccttatttgggcaaaagagaggaccagtggtgcggctctctgatagggctcacagcacgcgccacctgggctactaacatccaagtggccattaatcaggtccggaggcttatcggaaacgaaaattacctggattatatgacatccatgaagcgatttaaaaacgagagtgacccagaaggtgcactatggtga

SEQ ID NO: 13353 - RNA, 9879 nt, synthetic construct
  misc_feature 1..9879: note = derived and/or modified CDS sequence (opt3) from DENV-1__GQ868518__SS-prME
  source 1..9879: mol_type = other RNA
agcgtgaccatgctgctcatgcttctgcccacagccttggctttccacttaactacgagaggcggggagcctcatatgatcgtctccaagcaggaaaggggaaaatctctgctatttaagacctcagcaggtgttaacatgtgcacactcattgccatggacctgggcgagctttgtgaagatactatgacctacaaatgcccacaaataacagaggcggaaccggacgatgtggactgttggtgcaatgctaccgatacttgggtaacatatgggacctgtagtcagacgggagagcaccggcgcgacaagcgaagcgtggccctggcaccccatgtcggcttgggtctcgagactcgtaccgaaacatggatgtcctctgagggggcctggaaacagatccagagagtggaaacttgggctctgaggcaccctggattcaccgttattgcactgtttctcgcccatgctatcggcacatcgattacccaaaagggcatcatattcatcttactgatgcttgtgacgccatcaatggccatgcggtgcgtcgggattggaaaccgcgattttgtggagggtttgagcggcgcgacttgggtagacgttgtgctggagcacgggagttgtgtcacaaccatggcaaagaataaacccactctagatatcgaactcctgaagacagaggtgaccaaccctgccattcttagaaaactgtgcatcgaagctaagatatccaatacgaccacagactctaggtgtccaactcagggagaggccaccttggtggaagagcaggatgcaaacttcgtctgccggcgcacatttgttgaccgaggctggggtaatgggtgtggactcttcggcaaaggcagcctgttaacttgcgctaagtttaagtgcgtgaccaaactggaggggaagattgtacagtacgaaaacctcaaatattccgtgatcgtcacagtgcacaccggagatcaacatcaggttggtaatgagactacggaacacggcacaattgccaccatcactccccaggcgcctacctcagagatccagcttacagactacggggccctgaccttggactgtagtccaagaactggactagatttcaacgaaatggtgctgctcacaatgaaggagaaaagctggctggtccataagcaatggtttcttgacctgccgttgccctggacgtctggcgcatccacctcacaggagacttggaataggcaggatctcctggtgacattcaaaaccgctcacgccaagaagcaagaagtagttgtgttaggtagccaggagggggctatgcacacagccctgactggcgcaaccgaaattcagacgagtggaaccacaactatatttgccggccatctaaaatgccggctcaagatggacaaactgacccttaaggggacatcttatgtcatgtgtactggatccttcaaattggagaaggaagtggctgagacccagcacggtacggtcctggtgcaagttaagtacgagggcacagatgcgccttgcaaaatcccattcagcacccaggacgaaaagggggtgactcagaacggacgtctcattacagcaaatcccatcgtaaccgataaagagaagcctgtcaacatagaaactgagccaccctttggcgagtcgtatattgtggttggtgccggggaaaaagctctgaagctttcttggttcaagaaaggctcctcaatcggaaagatgtttgaggccaccgcacgcggcgccagaaggatggctatcctgggggacacagcctgggatttcggaagtattggtggcgtgtttacgagcgtcgggaaattggtgcatcaggtattcggaaccgcatacggcgtgctcttttccggtgtttcttggactatgaagatcgggattggcatactgttaacatggctgggactaaatagccggtcaaccagtctctccatgacatgtatcgcggtcggcatggtgactctgtaccttggggtgatggtccaagctgacagcggatgcgttattaactggaaaggccgagaattgaagtgtggttctgggatcttcgtgaccaacgaggtgcacacgtggacagaacagtataagtttcaggccgattcaccgaaacgcctgagtgcagccatcggaaaggcttgggaggagggcgtatgcggtattagaagcgccaccaggctcgaaaatataatgtggaaacagatctccaacgagctgaatcatattttactggaaaacgacatgaagttcactgtcgtggttggcgacgcaaatgggatccttgctcaaggaaaaaagatgattcggcctcagcccatggagcacaaatactcttggaagtcgtggggcaaggccaaaatcataggggcggatatccagaacaccacatttattatcgacggaccagatactcctgaatgtcccgacaatcagcgcgcctggaacatttgggaggtggaggattatggcttcggtatctttaccacaaatatatggttgaagctcagagacagctacacgcaaatgtgcgatcacaggctgatgtccgctgcaattaaagactcaaaggccgtccatgctgatatggggtattggatcgaaagtgagaaaaacgaaacctggaagctagcccgtgcatctttcattgaggtgaagacttgtacatggccaaaaagccacaccctgtggtccaatggagttctcgaatcagagatgatcatacccaagatctacggcggtcctattagccagcataactatcggccaggctacttcactcagacagcggggccgtggcacctgggaaaacttgagttggactttgatctgtgcgaaggcaccacggtggtagtcgacgagcactgcgggaatcgaggaccctctttaagaactaccacagtgaccggcaagatcattcatgaatggtgttgcaggtcctgtactctccctccactgcgcttccggggtgaggatgggtgctggtacggaatggagatcagacccgtgaaagaaaaggaggaaaaccttgtcaggagtatggttagcgccggctctggtgaggtggactccttttcactgggcatattgtgtgctagtattatgatcgaagaggtaatgcgcagccgatggtcgcggaagatgctcatgacagggaccctggccgtgttcctactgctcgtcatgggacaactgacatggaatgaccttatccgtttgtgcattatggtgggcgcaaacgcttccgatagaatggggatgggaactacctatctggccttaatggcaacgtttaaaatgaggcctatgttcgccgttggcctcctgtttcgccggcttacatctagagaggtgctgctactcaccatcggtctgagcttggtcgcttcagtggaactgccaaacagtttagaggaactcggggacggactggcgatgggcattatgatgcttaagctgttgactgagttccagccccaccagctctggaccacactgctatccctgacttttataaaaaccacgctttctctcgattacgcctggaagacaaccgcaatggctctgagcatcgtttccttgttcccgctgtgtttatcaactacaagccagaaaaccacttggctccctgtgctgcttggcagttttgggtgcaagccactgacaatgttcttgattaccgaaaataagatctggggaaggaaatcttggcccctcaacgagggtattatggccatcggcatagtctccatcctgctaagctcgctgcttaagaatgacgtacctctcgccgggcccctgattgctggaggcatgttgatcgcatgttatgtgatttcaggttctagtgccgatttatccctggagaaagcggctgaagttagctgggagcaagaagccgagcattctgggccaagccacaacatcctcgtggaagtccaggacgatggaacgatgaagataaaagacgaggagcgagatgacactctgaccattcttctgaaggcaacattgctagccgtgtccggcgtataccctatgtcaatccccgctaccctgtttgtgtggtatttctggcagaaaaagaagcagcgcagtggcgtcctctgggatacaccaagcccgcctgaagttgagcgggcagtgctggacgatgggatctacagaattcttcaaaggggattactgggtcgttctcaggtgggcgtcggggtgttccaggacggagtttttcatactatgtggcacgtaacccgcggcgccgtgctcatgtatcagggtaaacggttggaaccctcctgggcgtcagtcaagaaagacctgataagttacgggggaggctggagattcaggggcagctggaatacgggggaggaggtgcaagttatcgctgtggaaccaggaaagaaccccaaaaatgtccagacaactcctggtacctttaagacaccagagggcgaagtgggggccattgcactcgatttcaagcccggaacctccggctctcctatcgtaaaccgagagggtaaaattgtcgggctgtacggaaatggcgtggttactacctcgggcacatatgtgagcgccatcgctcaggccaaggcatcacaagaagggccgcttccagagatagaggacgaagtctttaaaaagcggaacctgacgatcatggatttgcaccccggatccggtaaaactcgcagatacctacctgctattgtgagggaggccatcaagcggaagctgcgaaccctcattttagcgccaacaagagttgtggccagtgaaatggcagaggctctgaaaggcatgcccatccgctatcagaccactgccgtcaagtctgaacatacagggagggagatagtggaccttatgtgccacgctaccttcacgatgcgtctgctcagccctgtacgggtgccgaattacaacatgattatcatggatgaggcacattttactgaccccgcctccatcgccgctagaggatatatttcaacaagggttggcatgggtgaagcggcagccatcttcatgaccgctaccccacctgggtctgtcgaggcctttccccagagcaatgcagtgatacaggatgaagagcgcgacattccagaacgaagttggaactccggatacgattggatcactgacttccctggcaaaacagtgtggtttgtccccagcattaagtctggcaatgatatcgccaactgtttgagaaaaaacgggaagcgggtaatacaactgtcaaggaagaccttcgacacagagtatcagaaaactaagaataacgactgggattacgtggttacgaccgacatttccgagatgggagctaatttccgcgcggatcgtgtgatcgacccaagacggtgcctcaaaccggtcatcctgaaggatggtcctgaaagggtgattcttgccggccccatgccagttacagtggcaagtgctgcccagcgccgagggagaatcggacggaaccagaataaagagggcgaccaatacgtctatatgggtcagcccctaaacaatgatgaagaccacgcacattggactgaggccaagatgctgttggataacattaatacccctgaggggataatcccagctttatttgaacccgagagggaaaagagcgccgcgattgacggcgagtaccgcctgagaggagaagcaaggaaaacattcgtggagctcatgcggcgtggcgatctgcctgtatggctttcgtataaggtggcctctgaggggtttcagtactccgaccgccgatggtgcttcgatggagaaagaaacaatcaggttctggaggaaaacatggacgtcgagatctggaccaaagaaggtgagaggaagaaactccggccgcgctggttggacgctagaacttatagcgatccactggccctaagggagtttaaggaattcgctgcaggccggcgatcagtgagtggggacctgatcctcgagattggaaaacttccccaacacctgacgtctagagcccagaatgctttagataacttggtgatgctgcacaattccgaacagggcggtaaggcctaccgccatgcaatggaggaactccctgacaccatagagacactgatgcttctggcgctcatcgccgtcttgactgggggcgttaccctgtttttcttaagcggaaagggcctagggaaaacatcaattggactgctctgtgtgaccgctagtagcgcccttctgtggatggcatccgtagagccccactggatcgctgcctctattatcttggaatttttcctgatggtgctcctgataccagagcctgataggcagcggactccccaagacaaccagcttgcatatgtcgtgatcggtctcctgtttatgattttgacagttgccgctaacgaaatgggcctgttagagacgaccaagaaagatctagggatcggacatgtggcggccgagaatcaccagcacgcaactatgctggacgtcgatctccgtccagctagcgcctggacactttacgccgtagcaaccaccgtgattacacctatgatgagacatactatcgaaaacacgaccgctaatatatccctgacagccattgcgaaccaagctgccatcttgatgggcctggacaagggttggccgatttcaaaaatggatatcggggttcccctcctggcacttggctgctactctcaggtgaatccattaactctgaccgccgctgtcctcatgttggtggcacactatgccataatcggacctggcctgcaggcgaaggctacaagggaggcccagaagcgcaccgcagccgggattatgaaaaaccccactgtcgacggaatcgtggctattgatctagacccagttgtgtacgacgccaagttcgaaaaacaactgggccagatcatgctccttatactgtgtacgagtcagattttgctgatgcggacaacctgggcactctgcgagtcgatcactctggctaccggtcctttaacaactctttgggaagggagccccggaaagttttggaataccacaatcgccgtatccatggcgaacattttccgaggctcttatctggccggtgcaggcctcgctttctcactaatgaaaagcctggggggaggcagaagggggacgggagcccagggcgagaccttgggtgagaagtggaagcgccaactgaatcagctctccaaaagtgaatttaacacttacaagcggtctgggatcatggaggtggatagaagcgaagcaaaagagggacttaagcgtggcgaaacaaccaaacatgctgtctcaaggggtactgccaagctgcggtggttcgttgagcgcaatttggtgaagccggagggcaaagtcatagacctggggtgtggacgaggcgggtggtcctattactgcgccggactcaagaaagtgacagaagtaaagggctataccaaaggtgggccaggacacgaggaacctattcccatggcgacgtacggctggaacttagtgaagctgcatagtggcaaagatgtttttttcatgccacccgagaagtgtgacacccttctgtgcgatatcggggaaagctctcctaatccgacaattgaggagggaagaactctaagggtgctcaagatggtcgaaccctggctgcggggtaaccagttttgtatcaaaatattgaatccatacatgccttccgtggtcgagaccctggaacagatgcaacgcaagcacggcgggatgctcgtgagaaaccccctttcaaggaatagcacacacgagatgtattgggtttcgtgcggaactggcaacatcgtatctgctgtgaacatgaccagtcgaatgctgttaaatcggttcacaatggcacatcgtaaacctacctacgagagagacgtcgatctgggtgccgggactcgccacgtggctgttgaaccagaggtggccaacttggacattatcggacagaggattgaaaatatcaagaacgagcataaatccacgtggcactatgatgaagacaatccctacaagacatgggcatatcacggcagctacgaggtcaagccttcaggctccgcctctagcatggtgaacggggtagtgcggctcctgaccaaaccatgggatgttattcccatggtcactcagatcgctatgaccgacacaacgccgtttggacaacagagagtgttcaaggagaaagtggacacccgcactcctagggcgaagcgaggtacaacccagataatggaagtcactgccaaatggctatggggctttcttagtcggaataagaagccaagaatttgtacaagggaggaattcacccgcaaagttcgttccaacgcagctatcggggccgtgtttgtagatgagaatcagtggaacagcgcaaaggaagccgtggaggacgagcggttctgggatctggtccatagagaaagggagctccacaaacaaggaaagtgcgctacatgcgtgtataatatgatgggcaaacgcgaaaagaagctgggtgagtttgggaaagccaagggatctcgagcgatctggtacatgtggttgggcgcacggttcctggaattcgaggccctcggctttatgaacgaggaccattggttctcaagagaaaatagtctttccggggttgagggagaaggtctgcacaaattaggctacattctgagggatataagcaagatccccgggggaaacatgtatgctgacgatactgccggctgggacacccgcattacggaggatgacttgcagaatgaggcaaaaatcaccgaaattatggagcctgaacatgctctcctggccacatctatctttaagctaacttaccagaacaaagtggtcagagtgcagcggccagctaagaacggtaccgtaatggatgttatatcgaggcgtgaccaacgagggtcaggacaggtgggcacatatggccttaatactttcaccaacatggaggtccagctgatccgccagatggaaagcgaggggatttttctcccctccgagctggaaacgccgaatttggccgagagagtgttagattggctggaaaagcacggagcagagcggctcaaaaggatggcgatcagtggtgacgactgtgtggtcaagcctattgatgaccgcttcgccacagctcttaccgccctgaacgatatgggcaaagttagaaaggacatcccccaatgggaaccatctaaagggtggaatgattggcagcaggtgcctttttgcagccaccatttccaccagctaataatgaaggacggacgggagattgtagtgccctgtaggaaccaagatgagctggtcggccgagcacgtgtgtcccagggtgctgggtggtcactcagagaaactgcctgcttgggaaagagttacgcacagatgtggcaactgatgtattttcatcgccgggaccttaggctggccgcgaatgctatctgttctgccgttccagtggattgggtccccacaagcagaaccacttggtccatccacgcacaccatcagtggatgaccacagaggacatgctctcagtgtggaaccgcgtatggattgaagagaatccttggatggaagataaaacgcacgttagctcttgggaggaggtgccatacttaggcaagcgggaagaccagtggtgcggctccctgatagggttgaccgccagggctacttgggccacaaacatccaggtcgcaattaatcaagtgcgaagactgatcggaaacgagaattatctcgactacatgaccagtatgaaacggttcaagaacgaaagcgatccggagggtgctctttggtga

SEQ ID NO: 13354 - RNA, 9879 nt, synthetic construct
  misc_feature 1..9879: note = derived and/or modified CDS sequence (opt3) from DENV-1__GQ868519__SS-prME
  source 1..9879: mol_type = other RNA
agcgtgaccatgctgctcatgcttctgcccactgcattggctttccacttaactacgcgaggcggggaacctcatatgatcgtctccaagcaggaaaggggaaaatctctgctgtttaagacctcagccggtgttaacatgtgcaccctcattgccatggacctgggcgaactttgtgaagatactatgacctacaaatgcccacagataacagaggcggaaccggacgatgtggactgttggtgcaatgctaccgatacttgggtaacatatgggacctgtagtcagacgggagagcaccggcgcgacaagcgaagcgtggccctggcaccccatgtcggcttgggtctcgagactcgtaccgaaacatggatgtcctctgagggggcctggaaacagatccagagagtggaaacttgggctctgaggcaccctggattcaccgttattgcactgtttctcgcccatgctatcggcacatcgattacccaaaagggcatcattttcatcttactgatgcttgtgacgccatcaatggccatgcggtgcgtcgggattggaaaccgcgattttgtggagggtttgagcggcgcgacttgggttgacgttgtgctggagcacgggagttgtgtcacaaccatggcaaagaataaacccactctagatatcgaactcctgaagacagaggtgaccaaccctgccattcttagaaaactgtgcatcgaagctaagatatccaatacgaccacagactctaggtgtccaactcagggagaggccaccttggtggaagaacaggatgcaaacttcgtctgccggcgcacatttgttgaccgaggctggggtaatgggtgtggactcttcggcaaaggcagcctgttaacttgcgctaagtttaagtgcgtgaccaaactggaggggaagattgtacagtacgaaaacctcaaatattccgtgatcgtcacagtgcacaccggagatcaacatcaggttggtaatgagactacggaacacggcacaattgccaccatcactccccaggcgcctacctcagagatccagcttacagactacggggccctgaccttggactgtagtccaagaactggactagatttcaacgaaatggtgctgctcacaatgaaggagaaaagctggctggtccataagcaatggtttcttgacctgccgttgccctggacgtctggcgcatccacctcacaggagacttggaataggcaggatctcctggtgacattcaaaaccgctcacgccaagaagcaagaagtagttgtgttaggtagccaggagggggctatgcacacagccctgactggcgcaaccgaaattcagacgagtggaaccacaactatatttgccggccatctaaaatgccggctcaagatggacaaactgacccttaaggggacatcttatgtcatgtgtactggatccttcaaattggagaaggaagtggctgagacccagcacggtacggtcctggtgcaagttaagtacgagggcacagatgcgccttgcaaaatcccattcctcacccaggacgaaaagggggtgactcagaacggacgtctgattacagcaaatcccatcgtaaccgataaagagaagcctgtcaacatagaaactgagccaccctttggcgagagctatattgtggttggtgccggggaaaaagctcttaagctgtcgtggttcaagaaaggatcttccatcggaaagatgtttgaggccaccgcacgcggcgccagaaggatggctatcttgggggacacagcctgggatttcggatcaattggtggcgtgtttacgagtgtcgggaaactcgtgcatcaggtattcggaaccgcatacggcgtgctgtttagcggtgtttcctggactatgaagatcgggattggcatattactgacatggctaggactcaattctcggagcacctcactgagtatgacatgtatcgcggtcggcatggtgactctttacttgggggtgatggtccaagctgactccggatgcgttattaactggaaaggccgagaactgaagtgtggtagcgggatcttcgtgaccaacgaggtgcacacgtggacagaacagtataagtttcaggccgattctccgaaacgcctctcagcagccatcggaaaggcttgggaggagggcgtatgcggtattagaagtgccaccaggctggaaaatataatgtggaaacagatcagcaacgagttaaatcatattctgcttgaaaacgacatgaagttcactgtcgtggttggcgacgcaaatgggatcttggctcaaggcaaaaagatgattcggcctcagcccatggagcacaaatactcctggaagtcttggggcaaggccaaaatcataggggcggatatccagaacaccacatttattatcgacggaccagatactcctgaatgtcccgacaatcagcgcgcctggaacatttgggaggtggaggattatggcttcggtatctttaccacaaatatatggctcaagctgagagactcgtacacgcaaatgtgcgatcacaggctaatgagcgctgcaattaaagactccaaggccgtccatgctgatatggggtattggatcgaatcagagaaaaacgaaacctggaagctggcccgtgcaagtttcattgaggtgaagacttgtacatggccaaaatctcacaccctctggagcaatggagttctggaatccgagatgatcatacccaagatctacggcggtcctatttcacagcataactatcggccaggctacttcactcagacagcggggccgtggcaccttggaaaattggagctggactttgatttatgcgaaggcaccacggtggtagtcgacgagcactgcgggaatcgaggacccagcctcagaactaccacagtgaccggcaagatcattcatgaatggtgttgcaggtcttgtactctgcctccacttcgcttccggggtgaggatgggtgctggtacggaatggagatcagacccgtgaaagaaaaggaggaaaacctggtcaggtccatggttagtgccggcagcggtgaggtggactctttttccttgggcatactctgtgcttcaattatgatcgaagaggtaatgcgcagtcgatggagccggaagatgctgatgacagggaccctagccgtgttcctgctcctggtcatgggacaacttacatggaatgacttgatccgtctgtgcattatggtgggcgcaaacgcttcggatagaatggggatgggaactacctatttagccctcatggcaacgtttaaaatgaggcctatgttcgccgttggcctgctttttcgccggctgacatccagagaggtgctactcctgaccatcggtttgtctctggtcgctagcgtggaattaccaaactcactcgaggaactgggggacggacttgcgatgggcattatgatgctgaagttgctcactgagttccagccccaccagctgtggataaccctactgagtcttacatttatcaaaactaccctctccctggattacgcctggaagacgacagcaatggctttgtctattgttagcctgttcccgttatgtctctccaccacttcacagaaaacaacctggctgcctgtgcttctgggcagctttgggtgcaagccattgactatgttcctcatcacagaaaataagatttggggaaggaaaagttggcccctgaacgagggtatcatggccataggcatcgtctctattctactgtccagccttctcaagaatgacgtacctctggccgggcccttgatcgctggaggcatgttaattgcatgttatgtgatctcgggttcatctgccgatctgagtctcgagaaagcggctgaagtttcctgggagcaagaagccgagcatagcgggacctctcacaacatactggtggaagtccaggacgatggaacgatgaagattaaagacgaggagcgagatgacactcttaccatcctgttgaaggcaacactactggccgtgagcggcgtatacccaatgtccatccctgctaccctctttgtgtggtatttctggcagaaaaagaagcagcgctcaggcgtcctgtgggatacacccagtccaccggaagttgagcgggcagtgcttgacgatgggatttacagaatattacaaaggggactgctcggtcgtagccaggtgggcgtcggggtgttccaggacggagtttttcatactatgtggcacgtaacccgcggcgccgtgttgatgtatcagggtaaacggctggaaccttcttgggcgtccgtcaagaaagacctcatctcatacgggggaggctggagattccaaggcagttggaatacgggggaggaggtgcaggttattgctgtggaacccggaaagaaccccaaaaatgtccagacaatgcccggtacttttaagacccctgagggcgaagtgggggccatcgcactggatttcaagccaggaacaagcggctcccccattgtaaacagggagggtaaaatcgtcgggctttacggaaatggcgtggttaccacttctggcacctatgtgtcggccatagctcaagccaaggcaagccaggaagggcctctgccggagatcgaggacgaagtctttaaaaagcgaaacttgacaattatggatctacacccaggatcaggtaaaacgcggcgctacctgcccgctatggtgagagaggccatcaagaggaagctccggactttaattctggcgcctacccgagttgtggcctccgaaatggcagaggctcttaaaggcatgccaatcagatatcagacaaccgccgtcaagagtgaacatactgggcgcgagatagtggacctgatgtgccacgctacattcaccatgaggctcttgtctcccgtacgtgtgcctaattacaacatgattatcatggatgaggcacattttacggacccggccagcatcgccgctcggggatatatttccactagagttggcatgggtgaagcggcagccatcttcatgacagctacaccaccagggtcagtcgaggcctttcctcagtctaatgcagtgatacaagatgaagagagggacattcccgaacgcagctggaacagtggatacgattggatcaccgacttcccaggcaaaactgtgtggtttgtcccttccattaagagcggcaatgatatcgccaactgtctgcggaaaaacgggaagagagtaatacagctctctagaaagacattcgacaccgagtatcagaaaacaaagaataacgactgggattacgtggttactacggacatttcagagatgggagctaatttcagggcggatcgcgtgatcgacccccgtagatgcctgaaaccagtcatccttaaggatggtccggaacgggtgattctagccggccctatgcccgttaccgtggcatccgctgcccagaggcgcgggcgaatcggaagaaaccaaaataaagagggcgaccagtacgtctatatgggtcagccactgaacaatgatgaagaccacgcacattggacagaggccaagatgttgttagataacattaatactcccgaggggataatccctgctctgtttgaaccagagcgggaaaagagtgccgcgattgacggcgagtacaggctccgcggagaagcaagaaaaaccttcgtggagctgatgaggcggggcgatcttcccgtatggctgagctataaggtggcctcggaggggtttcagtactctgaccgtcgctggtgcttcgatggagaacgaaacaatcaagttctcgaggaaaacatggacgtcgagatctggacaaaagaaggtgagagaaagaaattgaggcctcggtggctggacgctcgcacctattccgatccgctagccctgagagagtttaaggagttcgctgcaggcaggcggagcgtgtcaggggacctcatccttgagattggaaaactgccacagcacttaactttgcgagcccagaatgctctggataacctcgtgatgctgcacaatagtgaacagggcggtaaggcctacagacatgcaatggaggaacttcccgacacgatagagaccctgatgctcttggcgctgatcgccgtcttaacagggggcgttactctatttttcctgtctggaaagggcctcgggaaaacctccattggacttctgtgtgtgacagctagctcagccttgctgtggatggcaagtgtagagcctcactggatcgctgccagcattatcctcgaatttttcctgatggtgcttctcatacccgagccagatcgccaaaggacccctcaggacaaccagctggcatatgtcgtgatcggtttgctgtttatgattttaactgttgccgctaacgaaatgggcctactggagacaacgaagaaagatctcgggatcggacatgtggcggccgagaatcaccaacacgcaaccatgcttgacgtcgatctgcggcccgcttccgcctggactttgtacgccgtagcaacaaccgtgattaccccaatgatgcgtcatacaatcgaaaacactacggctaatatatctctgaccgccattgcgaaccaggctgccatcctcatgggcctggacaagggttggcctattagcaaaatggatatcggggttccgcttttagcactgggctgctactcccaggtgaatcccctcacattgactgccgctgtcctgatgctagtggcacactatgccataatcggaccaggcctgcaggcgaaggctaccagagaggcccaaaagaggacagcagccgggattatgaaaaaccctaccgtcgacggaatcgtggctattgatctcgaccccgttgtgtacgacgccaagttcgaaaaacagcttggccagatcatgctgttgatactgtgtacttcacagattctcctgatgcgcacgacatgggcattatgcgagtctatcacccttgctactggtccactgaccacactctgggaagggagtcctggaaagttttggaatactaccatcgccgtatcgatggcgaacattttccggggcagctatctagccggtgcaggcctggctttctccttgatgaaatctctagggggaggccgaagagggacaggagcccaaggcgagacgctcggtgagaagtggaagaggcagcttaatcagctgtcaaaaagcgaatttaacacctacaagcgctccgggatcatggaggtggatcggagtgaagcaaaagagggattgaagagaggcgaaactacaaaacatgctgtctctcgtggtaccgccaagctgaggtggttcgttgagcggaatctcgtgaagcccgagggcaaagtcatagacttagggtgtggacgcggcgggtggagctattactgcgccggactgaagaaagtgactgaagtaaagggctatacaaaaggtgggccgggacacgaggaaccaattcctatggcgacctacggctggaaccttgtgaagctgcattcaggcaaagatgtatttttcatgcccccagagaagtgtgacacgctactctgcgatatcggggaatccagtcccaatcctaccattgaggagggacgaacactgagagtgttgaagatggtcgaaccgtggctgaggggtaaccagttttgtatcaaaatactcaatccctacatgccaagcgtggtcgagactcttgaacaaatgcagcggaagcacggcgggatgctggtgcgcaaccctttatctagaaattccacccacgagatgtattgggtttcatgcggaacaggcaacatcgtaagcgctgtgaacatgacttcgaggatgctgttgaatcgattcaccatggcacatcggaaacccacatacgagcgtgacgtcgatctcggtgccgggaccagacacgtggctgttgaacctgaggtggccaacctggacattatcggacagcgcattgaaaatatcaagaacgagcataaatctacttggcactatgatgaagacaatccatacaagacgtgggcatatcacggcagttacgaggtcaagccctccggcagcgcctcatccatggtgaacggggtagtgaggctacttacaaaaccttgggatgttattccaatggtcacccaaatcgctatgactgacaccacaccctttggacagcagcgggtgttcaaggagaaagtggacacgagaaccccgcgcgcgaagaggggtactacacagataatggaagtcaccgccaaatggctgtggggctttctctctcgaaataagaagcctcggatttgtactagagaggagttcacaaggaaagttcgcagcaacgcagctatcggggccgtgtttgtagatgagaatcaatggaacagtgcaaaggaagccgtggaggacgagcgtttctgggatctggtccatcgggaaagagagttgcacaaacagggaaagtgcgctacctgcgtgtataatatgatgggcaaaagggaaaagaagctgggtgagtttgggaaagccaagggatcccgcgcgatctggtacatgtggctcggcgcacgattccttgagttcgaggccctgggctttatgaacgaggaccattggttcagccgggaaaattctttatcaggggttgagggagaaggtctgcacaaattgggctacattctcagagatataagtaagatcccagggggaaacatgtatgctgacgatacagccggctgggacactaggattaccgaggatgacctgcagaatgaggcaaaaatcacggaaattatggagcccgaacatgctctacttgccacctccatctttaagctgacataccagaacaaagtggtccgcgtgcaaagacctgctaagaacggtactgtaatggatgttataagccggagggaccagcgtgggtctggacaggtgggcacctatggcctcaatacattcactaacatggaggtccagctgatccgacaaatggaatcggaggggatatttttgccatcagagttagaaacccccaatctggccgagcgcgtgctcgattggcttgaaaagcacggagcagagagactgaaacggatggcgatcagcggtgacgactgtgtggtcaagccgattgatgacaggttcgccacggctctaacagccctgaacgatatgggcaaagttcgcaaggacatccctcagtgggaaccctccaaagggtggaatgattggcaacaggtgccattttgcagtcaccatttccaccaactcataatgaaggacggaagagagattgtagtgccttgtcggaaccaggatgagttggtcggcagggcacgagtgtctcagggtgctgggtggagcctgcgtgaaaccgcctgccttggaaagtcctacgcacaaatgtggcagctgatgtattttcatagacgcgacctccggttagccgcgaatgctatctgttcagccgttcccgtggattgggtcccaacaagtaggacaacctggtctatccacgcacaccatcagtggatgactaccgaggacatgctgagcgtgtggaacagagtatggattgaagagaatccctggatggaagataaaacacacgtttcctcatgggaggaggtgccttacttgggcaagcgcgaagaccagtggtgcggcagcctgatagggctcacggcccgggctacctgggccactaacatccaagtcgcaattaatcaggtgaggcgacttatcggaaacgagaattatctggactacatgacatctatgaaaagattcaagaacgaatccgatccagagggtgctctatggtga

SEQ ID NO: 13355 - RNA, 9879 nt, synthetic construct
  misc_feature 1..9879: note = derived and/or modified CDS sequence (opt3) from DENV-1__KF955443__SS-prME
  source 1..9879: mol_type = other RNA
agcgtgaccatgctgctcatgcttctgccaacagcattggctttccacttaactacgcgaggaggggagcctcatatgatcgtctccaagcaggaaaggggaaaatctctgctgtttaagacctcagccggtgttaacatgtgcaccctcattgccatggacctgggcgagctttgtgaagatactatgacctacaaatgcccacaaataacagaggcggaaccggacgatgtggactgttggtgcaatgctaccgatacttgggtaacatatgggacctgtagtcagacgggagagcaccggcgcgacaagcgaagcgtggccctggcaccccatgtcggcttgggtctcgagactcgtaccgaaacatggatgtcctctgagggggcctggaaacagatccagagagtggaaacttgggctctgaggcaccctggattcaccgttattgcactgtttctcgcccatgctatcggcacatcgattacccaaaagggcatcatattcatcttactgatgcttgtgacgccatcaatggccatgcggtgcgtcgggattggaaaccgcgattttgtggagggtttgagcggcgcgacttgggtagacgttgtgctggagcacgggagttgtgtcacaaccatggcaaagaataaacccactctagatatcgaactcctgaagacagaggtgaccaaccctgccattcttagaaaactgtgcatcgaagctaagatatccaatacgaccacagactctaggtgtccaactcagggagaggccaccttggtggaagaacaggatgcaaacttcgtctgccggcgcacatttgttgaccgaggctggggtaatgggtgtggactcttcggcaaaggcagcctgttaacttgcgctaagtttaagtgcgtgaccaaactggaggggaagattgtacagtacgaaaacctcaaatattccgtgatcgtcacagtgcacaccggagatcaacatcaggttggtaatgagactacggaacacggcacaattgccaccatcactccccaggcgcctacctcagagatccagcttacagactacggggccctgaccttggactgtagtccaagaactggactagatttcaacgaaatggtgctgctcacaatgaaggagaaaagctggctggtccataagcaatggtttcttgacctgccgttgccctggacgtctggcgcatccacctcacaggagacttggaataggcaggatctcctggtgacattcaaaaccgctcacgccaagaagcaagaagtagttgtgttaggtagccaggagggggctatgcacacagccctgactggcgcaaccgaaattcagatgagtggaacgaccacaatatttgccggccatctaaaatgccggctcaagatggacaaactgactcttaaggggacctcttatgtcatgtgtacaggatccttcaaattggagaaggaagtggctgagactcagcacggtaccgtcctggtgcaagttaagtacgagggcacggatgcgccttgcaaaatcccattcagcacacaggacgaaaagggggtgacccagaacggacgtctcattactgcaaatcccatcgtaacagataaagagaagcctgtcaacatagaaaccgagccaccctttggcgagtcgtatattgtggttggtgccggggaaaaagctctgaaactttcttggttcaagaaaggctcctcaatcggaaagatgtttgaggccactgcacgcggcgccagaaggatggctatcctgggggacaccgcctgggatttcggaagtattggtggcgtgtttacaagcgtcgggaaattggtgcatcaggtattcggaacggcatacggcgtgctcttttccggtgtttcttggaccatgaagatcgggattggcatactgttaacttggctgggactaaatagccggtcaacaagtctctccatgacctgtatcgcggtcggcatggtgacactgtaccttggggtgatggtccaagctgacagcggatgcgttattaactggaaaggccgagaattgaagtgtggttctgggatcttcgtgactaacgaggtgcacacctggacggaacagtataagtttcaggccgattcaccgaaacgcctgagtgcagccatcggaaaggcttgggaggagggcgtatgcggtattagaagcgtcacaaggctcgaaaatataatgtggaaacagatctccaacgagctgaatcatattttactggaaaacgacatgaagttcaccgtggttgtgggcgacgccaatgggatccttgcacaaggcaagaagatgattcggcctcagcccatggagcacaaatactcttggaagtcgtggggcaaggctaaaatcataggggccgatatccagaacactacctttattatcgacggaccagatacacctgaatgtcccgacaatcagcgcgcgtggaacatttgggaggtcgaggattatggcttcggtatctttactaccaatatatggttgaagctcagagacagctacacacaaatgtgcgatcacaggctgatgtccgccgctattaaagactcaaaggcagtgcatgccgatatggggtattggatcgaaagtgagaaaaacgaaacgtggaagctagctcgtgcctctttcattgaggttaagacctgtacttggccaaaaagccacacactgtggtccaatggagtgctcgaatcagagatgatcatacccaagatctacggcggtcctattagccagcataactatcggccaggctacttcacccagactgcagggccgtggcacctgggaaaacttgagttggactttgatctgtgcgaaggcacaaccgtagtcgtggacgagcactgcgggaatcgaggaccctctttaagaacgactaccgtgacaggcaagatcattcatgaatggtgttgcaggtcctgtaccctccctccactgcgcttccggggtgaggatgggtgctggtacggaatggagatcagacccgtcaaagaaaaggaggaaaaccttgttaggagtatggtgagcgcgggctctggtgaggtagactccttttcactgggcatattgtgtgccagtattatgatcgaagaggtgatgcgcagccgatggtcgcggaagatgctcatgactgggacactggctgtcttcctactgctcatcatgggacaactgacctggaatgaccttattcgtttgtgcatcatggtgggcgccaacgcatccgatagaatggggatgggaacaacttatctggctttaatggccacctttaaaatgaggcctatgttcgcagttggcctcctgtttcgccggcttacgtctagagaggtgctgctactcacaattggtctgagcttggtcgcctcagtggaactgccaaacagtttagaggaactcggggacggactggctatgggcataatgatgcttaagctgttgaccgagttccagccccaccagctctggactaccctgctatccctgacatttatcaaaactaccctttctctcgattacgcgtggaagacgacagccatggcactgagcattgtttccttgttcccgctgtgtttatcaaccactagccagaaaacaacctggctccctgtgctgcttggcagttttgggtgcaagccactgactatgttcttgatcacagaaaataagatttggggaaggaaatcttggcccctcaacgagggtatcatggctataggcatcgtctccattctgctaagctcgctgcttaagaatgacgtacctctcgccgggcccctgatcgccggaggcatgttgattgcttgttatgtgatctcaggttctagtgcagatttatccctggagaaagccgcggaagttagctgggagcaagaagctgagcattctgggaccagccacaacatactcgtggaagtccaggacgatggaacgatgaagattaaagacgaggagcgagatgacactctgaccatccttctgaaggccacattgctagcagtgtccggcgtatacccaatgtcaatccctgccaccctgtttctctggtatttctggcagaaaaagaagcagcgcagtggcgtgctgtgggatacacccagcccaccggaagtcgagcgggctgttcttgacgatgggatttacagaatattacaaaggggactgctcggtcgttctcaggtgggcgtgggggtcttccaggacggagtgtttcatactatgtggcacgttacccgcggcgcagtattgatgtatcagggtaaacggctggaaccttcctgggcctcagtgaagaaagacctcatcagttacgggggaggctggagattccaaggcagctggaatacgggggaggaggtccaggtgattgcggttgaacccggaaagaaccccaaaaatgtgcagacaactcccggtacctttaagacacctgagggcgaagtcggggctatcgccctggatttcaagccaggaacctccggctctcccattgtgaacagggagggtaaaatcgtagggctttacggaaatggcgtcgtgactacctcgggcacatatgttagcgcaatagcccaagctaaggcctcacaggaagggcctctgccggagatcgaggacgaagtgtttaaaaagcgaaacttgacgattatggatctacacccaggatccggtaaaactcggcgctacctgcccgcaatcgtcagagaggctattaagaggaagctccggaccttaatcctggcccctacacgagtggttgcgagtgaaatggccgaggcacttaaaggcatgccaataagatatcagaccactgctgtgaagtctgaacatacagggcgcgagattgtcgacctgatgtgccacgccaccttcacgatgaggctcttgagccccgtgcgtgtacctaattacaacatgatcatcatggatgaggctcattttactgacccggcatccattgccgcccggggatatatctcaacaagagtgggcatgggtgaagctgcggcaatattcatgaccgccacacccccagggtctgttgaggcttttcctcagagcaatgccgtcattcaagatgaagagagggacatccccgaacgcagttggaactccggatacgattggattactgacttcccaggcaaaacagtgtggtttgtgcctagcatcaagtctggcaatgatatagcaaactgtctgcggaaaaatgggaagagagtcattcagctctcaagaaagaccttcgacacagagtatcagaaaactaagaataacgactgggattacgtagtgacgaccgacatctccgagatgggagccaatttcagggctgatcgcgttatcgacccccgtagatgcctgaaaccagtgattcttaaggatggtccggaacgggtcatcctagcgggccctatgcccgtgacagttgccagtgcagctcagaggcgcgggcgaattggaagaaaccaaaataaagagggcgaccagtacgtgtatatgggtcagccactgaacaatgatgaagaccacgcccattggactgaggcaaagatgttgttagataacataaatacccccgaggggatcattcctgccctgtttgaaccagagcgggaaaagagcgctgccatcgacggcgagtacaggctccgcggagaagcgagaaaaacattcgtcgagctgatgaggcggggcgatcttcccgtgtggctgtcgtataaggtagcatctgaggggtttcagtactccgaccgtcgctggtgcttcgatggagaacgaaacaatcaagtgctcgaggaaaacatggacgttgagatctggaccaaagaaggtgagagaaagaaattgaggcctcggtggctggacgcccgcacttatagcgatccgctagctctgagagagtttaaggagttcgccgctggcaggcggtcagtcagtggggacctcattcttgagataggaaaactgccacagcacttaacgttgcgagcacagaatgccctggataacctcgtgatgctgcacaattctgaacagggcggtaaggcttacagacatgccatggaggaacttcccgacaccatcgagacactgatgctcttggcactgattgcggtgttaactgggggcgtcaccctatttttcctgtccggaaagggcctcgggaaaacaagcatcggacttctgtgtgttaccgcctcaagtgctttgctgtggatggccagcgtggagcctcactggattgcagcttccatcatactcgaatttttcctgatggtacttctcatccccgagccagatcgccaaaggactcctcaggacaaccagctggcctatgtggtcattggtttgctgtttatgatcttaacagtggcagccaacgaaatgggcctactggagacgaccaagaaagatctcgggattggacatgttgctgcggagaatcaccaacacgccactatgcttgacgtggatctgcggcccgcatctgcttggacattgtacgccgtcgccaccaccgtaatcacaccaatgatgcgtcatactatagaaaacacgaccgcaaatattagcctgacagctatcgccaaccaggcggctattctcatgggcctggacaagggttggcctatctccaaaatggatataggggtgccgcttttagccctgggctgctactcacaggttaatcccctcactttgaccgcagccgtgctgatgctagtcgctcactatgcaatcattggaccaggcctgcaggccaaggcgacaagagaggctcaaaagaggaccgccgcagggatcatgaaaaaccctactgtggacggaattgtcgccatcgatctcgaccccgtggtttacgacgctaagttcgaaaaacagcttggccagataatgctgttgattctgtgtacgtctcagatcctcctgatgcgcacaacctgggccttatgcgagagtatcactcttgcaaccggtccactgacaactctctgggaagggtcgcctggaaagttttggaataccacaattgctgtgagcatggccaacatcttccggggctcctatctagcgggtgccggcctggcattctctttgatgaaatcactagggggaggccgaagagggacgggagctcaaggcgagaccctcggtgagaagtggaagaggcagcttaatcagctgagcaaatccgaatttaacacttacaagcgcagtgggataatggaggtagatcggtctgaagccaaagagggattgaagagaggcgaaacaaccaaacatgcagtgagccgtggtactgctaagctgaggtggttcgtcgagcggaatctcgttaagcccgagggcaaagtgattgacttagggtgtggacgcggcgggtggtcatattactgcgccggactgaagaaagtcacagaagtgaagggctataccaaaggtgggccgggacacgaggaaccaatccctatggccacgtacggctggacccttgtaaagctgcattccggcaaagatgtgtttttcatgcccccagagaagtgtgacacactactctgcgatattggggaaagtagccccaaccctactatcgaggagggacgaaccctgagagttttgaagatggtggaaccgtggctgaggggtaatcagttttgtataaaaatcctcaacccctacatgccatctgtcgtggagacacttgaacaaatgcagcggaagcacggcgggatgctggtccgcaatcctttatccagaaactcaactcacgagatgtattgggtgagctgcggaaccggcaatattgtttcggcggtaaacatgacatctaggatgctgttgaaccgattcaccatggctcatcggaaacccacttttgagcgtgacgtggatctcggtgcagggacgagacacgtcgccgtggaacctgaggttgctaatctggacatcattggacagcgcatcgaaaacattaagaatgagcataaaagtacatggcactacgatgaagacaacccatataagacctgggcctaccacggctcctatgaggtgaagcccagcggctcagcatcctctatggtcaatggggtggtaaggctacttactaaaccttgggatgtgatcccaatggttacccaaatagccatgacagacacgacccccttcggacagcagcgggtctttaaggagaaagtggacactagaacaccgcgcgctaagaggggtaccactcagattatggaagtgacagcgaaatggctgtggggcttcctcagccgaaacaagaagcctcggatctgtaccagagaggaatttacaaggaaagtccgcagtaatgccgcaatcggggctgttttcgtggatgagaaccaatggaactccgccaaggaagcagtagaggacgagcgtttttgggatctggtgcatcgggaaagagagttgcacaaacagggaaagtgcgccacttgcgtctacaacatgatgggcaaaagggaaaagaagctgggtgagttcgggaaagctaagggaagccgcgccatttggtatatgtggctcggcgcgcgattccttgaatttgaggcactgggcttcatgaatgaggaccattggttttctcgggaaaactcattaagtggggtggagggagaaggtctgcacaaattgggctacatactcagagatatctccaagattccagggggaaatatgtacgccgacgataccgctggctgggacacgaggatcaccgaggatgacctgcagaacgaggccaaaattacagatatcatggaacccgagcatgcactacttgctactagcatattcaagctgacctatcagaataaagttgtgcgcgtccaaagacctgccaagaacggtacagtgatggacgtaatctctcggagggatcagcgtgggtcgggacaggttggcacttacggcctcaacacctttacgaatatggaagtgcagctgattcgacaaatggagtcagaagggatcttcttgccaagcgagttagagacacccaacctggctgaacgcgtcctcgactggcttgagaagcacggagccgaaagactgaaacggatggcaatttccggtgacgattgtgtggtgaagccgatcgacgataggtttgcgaccgccctaactgctctgaatgacatgggcaaagtccgcaaggatatacctcagtgggagcccagtaaagggtggaacgactggcagcaggttccattctgctctcaccattttcaccaactcattatgaaggatggaagagaaatcgtggtaccttgtcggaatcaggacgagttggtgggcagggcccgagtcagccagggtgcagggtggtccctgcgtgagacagcttgccttggaaagtcatatgcccaaatgtggcagctgatgtacttccatagacgcgatctccggttagcagccaacgcgatctgtagtgctgtgcccgttgactgggtgccaacctctaggactacctggagcattcacgcccaccatcagtggatgacaacggaagatatgctgtccgtctggaatagagtgtggatagaggaaaacccctggatggaggacaaaacccacgtatcaagctgggaagaggttccttatttgggcaagcgcgaggaccagtggtgcggctctctgatcgggctcactgcacgggccacatgggctaccaatattcaagtggccatcaaccaggtcaggcgacttattggaaatgaaaactacctggattatatgacttccatgaaaagatttaagaatgagagtgacccagaaggtgcactatggtga

SEQ ID NO: 13356 - RNA, 9879 nt, synthetic construct
  misc_feature 1..9879: note = derived and/or modified CDS sequence (opt3) from DENV-1__GQ868520__SS-prME
  source 1..9879: mol_type = other RNA
agcgtgaccatgctgctcatgcttctgccaacagcattggctttccacttaactacgagaggaggggaacctcatatgatcgtctccaagcaggaaaggggaaaatctctgttgtttaagacctcagccggtgttaacatgtgcaccctcattgccatggacctgggcgaactttgtgaagatactatgacctacaaatgcccacagataacagaggcggaaccggacgatgtggactgttggtgcaatgctaccgatacttgggtaacatatgggacctgtagtcagacgggagagcaccggcgcgacaagcgaagcgtggccctggcaccccatgtcggcttgggtctcgagactcgtaccgaaacatggatgtcctctgagggggcctggaaacagatccagagagtggaaacttgggctctgaggcaccctggattcaccgttattgcactgtttctcgcccatgctatcggcacatcgattacccaaaagggcatcatattcatcttactgatgcttgtgacgccatcaatggccatgcggtgcgtcgggattggaaaccgcgattttgtggagggtttgagcggcgcgacttgggttgacgttgtgctggagcacgggagttgtgtcacaaccatggcaaagaataaacccactctagatatcgaactcctgaagacagaggtgaccaaccctgccattcttagaaaactgtgcatcgaagctaagatatccaatacgaccacagactctaggtgtccaactcagggagaggccaccttggtggaagaacaggatgcaaacttcgtctgccggcgcacatttgttgaccgaggctggggtaatgggtgtggactcttcggcaaaggcagcctgttaacttgcgctaagtttaagtgcgtgaccaaactggaggggaagattgtacagtacgaaaacctcaaatattccgtgatcgtcacagtgcacaccggagatcaacatcaggttggtaatgagactacggaacacggcacaattgccaccatcactccccaggcgcctacctcagagatccagcttacagactacggggccctgaccttggactgtagtccaagaactggactagatttcaacgaaatggtgctgctcacaatgaaggagaaaagctggctggtccataagcaatggtttcttgacctgccgttgccctggacgtctggcgcatccacctcacaggagacttggaataggcaggatctcctggtgacattcaaaaccgctcacgccaagaagcaagaagtagttgtgttaggtagccaggagggggctatgcacacagccctgactggcgcaaccgaaattcagacgagtggaaccacaactatatttgccggccatctaaaatgccggctcaagatggacaaactgacccttaaggggacatcttatgtcatgtgtactggatccttcaaattggagaaggaagtggctgagacccagcacggtacggtcctggtgcaagttaagtacgagggcacagatgcgccttgcaaaatcccattcagcacccaggacgaaaagggggtgactcagaacggacgtctcattacagcaaatcccatcgtaaccgataaagagaagcctgtcaacatagaaactgagccaccctttggcgagtcgtatattgtggttggtgccggggaaaaagctctgaaactttcttggttcaagaaaggctcctcaatcggaaagatgtttgaggccaccgcacgcggcgccagaaggatggctatcctgggggacacagcctgggatttcggaagtattggtggcgtgtttacgagcgtcgggaaattggtgcatcaggtattcggaaccgcatacggcgtgctcttttccggtgtttcttggactatgaagatcgggattggcatactgttaacatggctgggactaaatagccggtcaaccagtctctccatgacatgtatcgcggtcggcatggtgactctgtaccttggggtgatggtccaagctgacagcggatgcgttattaactggaaaggccgagaattgaagtgtggttctgggatcttcgtgaccaacgaggtgcacacgtggacagaacagtataagtttcaggccgattcaccgaaacgcctgagtgcagccatcggaaaggcttgggaggagggcgtatgcggtattagaagcgccaccaggctcgaaaatataatgtggaaacagatctccaacgagctgaatcatattttactggaaaacgacatgaagttcactgtcgtggttggcgacgcaaatgggatccttgctcaaggcaagaagatgattcggcctcagcccatggagcacaaatactcttggaagtcgtggggcaaggccaaaatcataggggcggatatccagaacaccacatttattatcgacggaccagatactcctgaatgtcccgacaatcagcgcgcctggaacatttgggaggtggaggattatggcttcggtatctttaccacaaatatatggttgaagctcagagacagctacacgcaaatgtgcgatcacaggctgatgtccgctgcaattaaagactcaaaggccgtccatgctgatatggggtattggatcgaaagtgagaaaaacgaaacctggaagctagcccgtgcatctttcattgaggtgaagacttgtacatggccaaaaagccacaccctgtggtccaatggagttctcgaatcagagatgatcatacccaagatctacggcggtcctattagccagcataactatcggccaggctacttcactcagacagcggggccgtggcacctgggaaaacttgagttggactttgatctgtgcgaaggcaccacggtggtagtcgacgagcactgcgggaatcgaggaccctctttaagaactaccacagtgaccggcaagatcattcatgaatggtgttgcaggtcctgtactctccctccactgcgcttccggggtgaggatgggtgctggtacggaatggagatcagacccgtgaaagaaaaggaggaaaaccttgtcaggagtatggttagcgccggctctggtgaggtggactccttttcactgggcatattgtgtgctagtattatgatcgaagaggtaatgcgcagccgatggtcgcggaagatgctcatgacagggaccctggccgtgttcctactgctcgtcatgggacaactgacatggaatgaccttatccgtttgtgcattatggtgggcgcaaacgcttccgatagaatggggatgggaactacctatctggccttaatggcaacgtttaaaatgaggcctatgttcgccgttggcctcctgtttcgccggcttacatctagagaggtgctgctactcaccatcggtctgagcttggtcgcttcagtggaactgccaaacagtttagaggaactcggggacggactggcgatgggcattatgatgcttaagctgttgactgagttccagccccaccagctctggaccacactgctatccctgacttttataaaaaccacgctttctctcgattacgcctggaagacaaccgcaatggctctgagcatcgtttccttgttcccgctgtgtttatcaactacaagccagaaaaccacttggctccctgtgctgcttggcagttttgggtgcaagccactgacaatgttcttgattaccgaaaataagatctggggaaggaaatcttggcccctcaacgagggtattatggccatcggcatagtctccatcctgctaagctcgctgcttaagaatgacgtacctctcgccgggcccctgattgctggaggcatgttgatcgcatgttatgtgatttcaggttctagtgccgatttatccctggagaaagcggctgaagttagctgggagcaagaagccgagcattctgggacgagccacaacatcctcgtggaagtccaggacgatggaactatgaagataaaagacgaggagcgagatgacaccctgacaattcttctgaaggcaaccttgctagccgtgtccggcgtatacccaatgtcaatccctgctacactgtttgtgtggtatttctggcagaaaaagaagcagcgcagtggcgtcctctgggatactcccagcccaccggaagttgagcgggcagtgctggacgatgggatctacaggattcttcaacgaggattactgggtcgttctcaggtgggcgtcggggtgttccaggacggagtttttcataccatgtggcacgtaacgcgcggcgccgtgctcatgtatcagggtaaacggttggaaccttcctgggcgtcagtcaagaaagacctgataagttacgggggaggctggagattccaaggcagctggaatacaggggaggaggtgcaggttatcgctgtggaacccggaaagaaccccaagaatgtccagactatgcccggtacctttaagacacctgagggcgaagtgggggccattgcactcgatttcaagccaggaacctccggctctcccatcgtaaacagggagggtaaaattgtcgggctgtacggaaatggcgtggttactacctcgggcacatatgtgagcgccatcgctcaagccaaggcatcacaggaagggcctcttccggagatagaggacgaagtctttaaaaagcgaaacctgacgatcatggatttgcacccaggatccggtaaaactcggcgctacctacccgctatggtgagagaggccattaagaggaagctgcggaccctcatcttagcgcctacacgagttgtggccagtgaaatggcagaggctctgaaaggcatgccaattagatatcagaccactgccgtcaagtctgaacatacagggcgcgagatcgtggaccttatgtgccacgctaccttcacgatgaggctgctcagccccgtacgtgtgcctaattacaacatgataattatggatgaggcacattttactgacccggcctccatcgccgctcggggatatatctcaacaagagttggcatgggtgaagcggcagccattttcatgaccgctacacccccagggtctgtcgaggcctttcctcagagcaatgcagtgatccaagatgaagagagggacatacccgaacgcagttggaactccggatacgattggattactgacttcccaggcaaaacagtgtggtttgtccctagcatcaagtctggcaatgatattgccaactgtttgagaaagaacgggaagagagtaatccagctgtcacggaagaccttcgacacagagtatcagaaaactaagaataacgactgggattacgtggttacgaccgacatatccgagatgggagctaatttcagggcggatcgcgtgattgacccccgtagatgcctcaaaccagtcatcctgaaggatggtccggaacgggtgatccttgccggccctatgcccgttacagtggcaagtgctgcccagaggcgcgggcgaattggaagaaaccaaaataaagagggcgaccagtacgtctatatgggtcagccactaaacaatgatgaagaccacgcacattggactgaggccaagatgctgttggataacatcaatacccccgaggggattatacctgctttatttgaaccagagcgggaaaagagcgccgcgatcgacggcgagtacaggctgcgcggagaagcaagaaaaacattcgtggagctcatgaggcggggcgatctgcccgtatggctttcgtataaggtggcctctgaggggtttcagtactccgaccgtcgctggtgcttcgatggagaacgaaacaatcaagttctggaggaaaacatggacgtcgagatttggaccaaagaaggtgagagaaagaaactcaggcctcggtggttggacgctcgcacttatagcgatccgctggccctaagagagtttaaggagttcgctgcaggcaggcggtcagtgagtggggacctgatcctcgagatcggaaaacttccacagcacctgacgttacgagcccagaatgctttggataacctggtgatgctccacaattctgaacagggcggtaaggcctacagacatgcaatggaggaactgcccgacaccattgagacacttatgctgctcgcgttgatagccgtcctgactgggggcgttaccttatttttcctatccggaaagggcctggggaaaacaagcatcggactcctttgtgtgaccgcttcaagtgccctgttgtggatggcaagcgtagagcctcactggattgctgcctccatcattctggaatttttcctcatggtgctgcttatccccgagccagatcgccaaaggactcctcaggacaaccagctcgcatatgtcgtgataggtctgttgtttatgatcctgacagttgccgctaacgaaatgggcttactagagacgaccaagaaagatctggggattggacatgtggcggccgagaatcaccaacacgcaactatgctcgacgtcgatcttcggcccgcttctgcctggacactgtacgccgtagcaaccaccgtgatcacaccaatgatgcgtcatactattgaaaacacgaccgctaatatcagcttgacagccatagcgaaccaggctgccattctgatgggcctcgacaagggttggcctatctccaaaatggatattggggttccgctgcttgcattaggctgctactcacaggtgaatcccctgactctcaccgccgctgtcttgatgctggtggcacactatgccatcataggaccaggcctacaggcgaaggctacaagagaggcccaaaagaggaccgcagccgggatcatgaaaaaccctactgtcgacggaattgtggctatcgatctggaccccgttgtgtacgacgccaagttcgaaaaacagctcggccagattatgcttctgatcttgtgtacgtctcagatactgctcatgcgcacaacctgggcactgtgcgagagtattactttagctaccggtccacttacaactctgtgggaagggtcgcctggaaagttttggaataccacaatcgccgtaagcatggcgaacatcttccggggctcctatctcgccggtgcaggcctagctttctctctgatgaaatcactagggggaggccgaagagggacgggagcccaaggcgagaccctgggtgagaagtggaagaggcagctcaatcagcttagcaaatccgaatttaacacttacaagcgcagtgggattatggaggtggatcggtctgaagcaaaagagggactgaagagaggcgaaacaaccaaacatgctgtcagccgtggtactgccaagttgaggtggttcgttgagcggaatctggtgaagcccgagggcaaagtcatcgacctcgggtgtggacgcggcgggtggtcatattactgcgccggattaaagaaagtgacagaagtaaagggctataccaaaggtgggccgggacacgaggaaccaatacctatggcgacgtacggctggaacctggtgaaacttcattccggcaaagatgtatttttcatgcccccagagaagtgtgacaccctgctatgcgatattggggaaagtagccccaatcctacaatcgaggagggacgaactctcagagtgctgaagatggtcgaaccgtggttgaggggtaaccagttttgtattaaaatcctgaatccctacatgccatctgtggtcgagaccctcgaacaaatgcagcggaagcacggcgggatgcttgtgcgcaaccctctgtccagaaattcaacacacgagatgtattgggttagctgcggaactggcaacatagtatcggctgtgaacatgacctctaggatgttactgaatcgattcacaatggcacatcggaaacccacctacgagcgtgacgtcgatttgggtgccgggactagacacgtggctgttgaacctgaggtggccaacctcgacatcattggacagcgcatcgaaaatattaagaacgagcataaaagtacgtggcactatgatgaagacaatccatacaagacatgggcatatcacggctcctacgaggtcaagcccagcggctcagcctcctctatggtgaacggggtagtgaggctgctaaccaaaccttgggatgttatcccaatggtcactcaaattgctatgaccgacacaacgccctttggacagcagcgggtgttcaaggagaaagtggacaccagaactccgcgcgcgaagaggggtacaacccagatcatggaagtcactgccaaatggctttggggctttctgagccgaaataagaagcctcggatatgtacaagagaggagttcaccaggaaagttcgcagtaacgcagctattggggccgtgtttgtagatgagaatcaatggaactccgcaaaggaagccgtggaggacgagcgtttctgggatctcgtccatcgggaaagagagctgcacaaacagggaaagtgcgctacatgcgtgtataatatgatgggcaaaagggaaaagaagttgggtgagtttgggaaagccaagggaagccgcgcgatctggtacatgtggctgggcgcacgattcctcgagttcgaggcccttggctttatgaacgaggaccattggttctctcgggaaaattcactgagtggggttgagggagaaggtttacacaaactgggctacatcttgagagatatttccaagataccagggggaaacatgtatgctgacgatactgccggctgggacaccaggatcacggaggatgacctccagaatgaggcaaaaattaccgaaatcatggagcccgaacatgctctgctagccacaagcatttttaaacttacttaccagaacaaagtggtccgcgtgcaaagacctgctaagaacggtaccgtaatggatgttatctctcggagggaccagcgtgggtcgggacaggtgggcacatatggcctgaatactttcaccaacatggaggtccagctcatacgacaaatggaatcagaggggatctttctgccaagcgagttggaaacgcccaatttagccgagcgcgtgctggattggctcgaaaagcacggagcagagagacttaaacggatggcgatttccggtgacgactgtgtggtcaagccgatcgatgacaggttcgccacagctctgaccgccctaaacgatatgggcaaagttcgcaaggacattcctcagtgggaacccagtaaagggtggaatgattggcaacaggtgccattttgctctcaccatttccaccaactgatcatgaaggacggaagagagatagtagtgccttgtcggaaccaggatgagctcgtcggcagggcacgagtgagccagggtgctgggtggtccttgcgtgaaactgcctgcctgggaaagtcatacgcacaaatgtggcagcttatgtattttcatagacgcgacctgcggctcgccgcgaatgctatttgtagtgccgttcccgtggattgggtcccaacatctaggaccacttggagcatccacgcacaccatcagtggatgaccacagaggacatgttatccgtgtggaacagagtatggatcgaagagaatccctggatggaagataaaacgcacgtttcaagctgggaggaggtgccttacctgggcaagcgcgaagaccagtggtgcggctctttgattgggctgaccgcccgggctacttgggccacaaacatacaagtcgcaatcaatcaggtgaggcgactcattggaaacgagaattatcttgactacatgacctccatgaaaagattcaagaacgaaagtgatccagagggtgctctgtggtga

SEQ ID NO: 13357 - RNA, 9879 nt, synthetic construct
  misc_feature 1..9879: note = derived and/or modified CDS sequence (opt3) from DENV-1__GQ868522__SS-prME
  source 1..9879: mol_type = other RNA
agcgtgaccatgctgctcatgcttctgcccacagccttggctttccacttaactacgagaggcggggagcctcatatgatcgtctccaagcaggaaaggggaaaatctctgctatttaagacctcagcaggtgttaacatgtgcacactcattgccatggacctgggcgagctttgtgaagatactatgacctacaaatgcccacaaataacagaggcggaaccggacgatgtggactgttggtgcaatgctaccgatacttgggtaacatatgggacctgtagtcagacgggagagcaccggcgcgacaagcgaagcgtggccctggcaccccatgtcggcttgggtctcgagactcgtaccgaaacatggatgtcctctgagggggcctggaaacagatccagagagtggaaacttgggctctgaggcaccctggattcaccgttattgcactgtttctcgcccatgctatcggcacatcgattacccaaaagggcatcatattcatcttactgatgcttgtgacgccatcaatggccatgcggtgcgtcgggattggaaaccgcgattttgtggagggtttgagcggcgcgacttgggtagacgttgtgctggagcacgggagttgtgtcacaaccatggcaaagaataaacccactctagatatcgaactcctgaagacagaggtgaccaaccctgccattcttagaaaactgtgcatcgaagctaagatatccaatacgaccacagactctaggtgtccaactcagggagaggccaccttggtggaagagcaggatgcaaacttcgtctgccggcgcacatttgttgaccgaggctggggtaatgggtgtggactcttcggcaaaggcagcctgttaacttgcgctaagtttaagtgcgtgaccaaactggaggggaagattgtacagtacgaaaacctcaaatattccgtgatcgtcacagtgcacaccggagatcaacatcaggttggtaatgagactacggaacacggcacaattgccaccatcactccccaggcgcctacctcagagatccagcttacagactacggggccctgaccttggactgtagtccaagaactggactagatttcaacgaaatggtgctgctcacaatgaaggagaaaagctggctggtccataagcaatggtttcttgacctgccgttgccctggacgtctggcgcatccacctcacaggagacttggaataggcaggatctcctggtgacattcaaaaccgctcacgccaagaagcaagaagtagttgtgttaggtagccaggagggggctatgcacacagccctgactggcgcaaccgaaattcagacgagtggaaccacaactatatttgccggccatctaaaatgccggctcaagatggacaaactgacccttaaggggacatcttatgtcatgtgtactggatccttcaaattggagaaggaagtggctgagacccagcacggtacggtcctggtgcaagttaagtacgagggcacagatgcgccttgcaaaatcccattcagcacccaggacgaaaagggggtgactcagaacggacgtctcattacagcaaatcccatcgtaaccgataaagagaagcctgtcaacatagaaactgagccaccctttggcgagtcgtatattgtggttggtgccggggaaaaagctctgaagctttcttggttcaagaaaggctcctcaatcggaaagatgtttgaggccaccgcacgcggcgccagaaggatggctatcctgggggacacagcctgggatttcggaagtattggtggcgtgtttacgagcgtcgggaaattggtgcatcaggtattcggaaccgcatacggcgtgctcttttccggtgtttcttggactatgaagatcgggattggcatactgttaacatggctgggactaaatagccggtcaaccagtctctccatgacatgtatcgcggtcggcatggtgactctgtaccttggggtgatggtccaagctgacagcggatgcgttattaactggaaaggccgagaattgaagtgtggttctgggatcttcgtgaccaacgaggtgcacacgtggacagaacagtataagtttcaggccgattcaccgaaacgcctgagtgcagccatcggaaaggcttgggaggagggcgtatgcggtattagaagcgccaccaggctcgaaaatataatgtggaaacagatctccaacgagctgaatcatattttactggaaaacgacatgaagttcactgtcgtggttggcgacgcaaatgggatccttgctcaaggaaaaaagatgattcggcctcagcccatggagcacaaatactcttggaagtcgtggggcaaggccaaaatcataggggcggatatccagaacaccacatttattatcgacggaccagatactcctgaatgtcccgacaatcagcgcgcctggaacatttgggaggtggaggattatggcttcggtatctttaccacaaatatatggttgaagctcagagacagctacacgcaaatgtgcgatcacaggctgatgtccgctgcaattaaagactcaaaggccgtccatgctgatatggggtattggatcgaaagtgagaaaaacgaaacctggaagctagcccgtgcatctttcattgaggtgaagacttgtacatggccaaaaagccacaccctgtggtccaatggagttctcgaatcagagatgatcatacccaagatctacggcggtcctattagccagcataactatcggccaggctacttcactcagacagcggggccgtggcacctgggaaaacttgagttggactttgatctgtgcgaaggcaccacggtggtagtcgacgagcactgcgggaatcgaggaccctctttaagaactaccacagtgaccggcaagatcattcatgaatggtgttgcaggtcctgtactctccctccactgcgcttccggggtgaggatgggtgctggtacggaatggagatcagacccgtgaaagaaaaggaggaaaaccttgtcaggagtatggttagcgccggctctggtgaggtggactccttttcactgggcatattgtgtgctagtattatgatcgaagaggtaatgcgcagccgatggtcgcggaagatgctcatgacagggaccctggccgtgttcctactgctcgtcatgggacaactgacatggaatgaccttatccgtttgtgcattatggtgggcgcaaacgcttccgatagaatggggatgggaactacctatctggccttaatggcaacgtttaaaatgaggcctatgttcgccgttggcctcctgtttcgccggcttacatctagagaggtgctgctactcaccatcggtctgagcttggtcgcttcagtggaactgccaaacagtttagaggaactcggggacggactggcgatgggcattatgatgcttaagctgttgactgagttccagccccaccagctctggataaccctgctatccctgacatttatcaaaactaccctttctctcgattacgcctggaagacgacagcaatggctctgagcattgtttccttgttcccgctgtgtttatcaaccactagccagaaaacaacctggctccctgtgctgcttggcagttttgggtgcaagccactgactatgttcttgatcacagaaaataagatttggggaaggaaatcttggcccctcaacgagggtatcatggccataggcatcgtctccattctgctaagctcgctgcttaagaatgacgtacctctcgccgggcccctgatcgctggaggcatgttgattgcatgttatgtgatctcaggttctagtgccgatttatccctggagaaagcggctgaagttagctgggagcaagaagccgagcattctgggaccagccacaacatactcgtggaagtccaggacgatggaacgatgaagattaaagacgaggagcgagatgacactctgaccatccttctgaaggcaacattgctagccgtgtccggcgtatacccaatgtcaatccctgctaccctgtttgtgtggtatttctggcagaaaaagaagcagcgcagtggcgtcctctgggatacacccagcccaccggaagttgagcgggcagtgctggacgatgggatttacagaatacttcaaaggggattactgggtcgttctcaggtgggcgtcggggtgttccaggacggagtttttcatactatgtggcacgtaacccgcggcgccgtgctcatgtatcagggtaaacggttggaaccttcctgggcgtcagtcaagaaagacctgatcagttacgggggaggctggagattccaaggcagctggaatacgggggaggaggtgcaggttattgctgtggaacccggaaagaacccaaaaaatgtccagacaatgcccggtacttttaagacccctgagggcgaagtgggggccatcgcactcgatttcaagccaggaacatccggctctcccattgtaaacagggagggtaaaatcgtcgggctgtacggaaatggcgtggttaccacttcgggcacctatgtgagcgccatagctcaagccaaggcatcacaggaagggcctcttccggagatcgaggacgaagtctttaaaaagcgaaacctgacaattatggatttgcacccaggatccggtaaaacgcggcgctacctacccgctatggtgagagaggccatcaagaggaagctgcggactctcattttagcgcctacccgagttgtggccagtgaaatggcagaggctctgaaaggcatgccaatcagatatcagacaaccgccgtcaagtctgaacatactgggcgcgagatagtggaccttatgtgccacgctacattcaccatgaggctgctcagccccgtacgtgtgcctaattacaacatgattatcatggatgaggcacattttacggacccggcctccatcgccgctcggggatatatttcaactagagttggcatgggtgaagcggcagccatcttcatgacagctacccccccagggtctgtcgaggcctttcctcagagcaatgcagtgatacaagatgaagagagggacattcccgaacgcagttggaactccggatacgattggatcaccgacttcccaggcaaaactgtgtggtttgtccctagcattaagtctggcaatgatatcgccaactgtttgcgaaaaaacgggaagagagtaatacagctgtcacggaagacattcgacaccgagtatcagaaaacaaagaataacgactgggattacgtggttactacggacatttccgagatgggagctaatttcagggcggatcgcgtgatcgacccccgtagatgcctcaaaccagtcatcctgaaggatggtccggaacgggtgattcttgccggccctatgcccgttaccgtggcaagtgctgcccagaggcgcgggcgaatcggaagaaaccaaaataaagagggcgaccagtacgtctatatgggtcagccactaaacaatgatgaagaccacgcacattggacagaggccaagatgctgttggataacattaatactcccgaggggataatccctgctttatttgaaccagagcgggaaaagagcgccgcgattgacggcgagtacaggctgcgcggagaagcaagaaaaaccttcgtggagctcatgaggcggggcgatctgcccgtatggctttcgtataaggtggcctctgaggggtttcagtactccgaccgtcgctggtgcttcgatggagaacgaaacaatcaagttctggaggaaaacatggacgtcgagatctggacaaaagaaggtgagagaaagaaactcaggcctcggtggttggacgctcgcacctatagcgatccgctggccctaagagagtttaaggaattcgctgcaggcaggcggtcagtgagtggggacctgatcctcgagattggaaaacttccacagcacctgactttacgagcccagaatgctttggataacctggtgatgctccacaattctgaacagggcggtaaggcctacagacatgcaatggaggaactgcccgacacgatagagacccttatgctgctcgcgttgatcgccgtcctgacagggggcgttactttatttttcctatccggaaagggcctggggaaaaccagcattggactcctttgtgtgacagcttcaagtgccctgttgtggatggcaagcgtagagcctcactggatcgctgcctccattatcctggaatttttcctcatggtgctgcttatacccgagccagatcgccaaaggacccctcaggacaaccagctcgcatatgtcgtgatcggtctgttgtttatgattctgactgttgccgctaacgaaatgggcttactagagacaacgaagaaagatctggggatcggacatgtggcggccgagaatcaccaacacgcaaccatgctcgacgtcgatcttcggcccgcttctgcctggactctgtacgccgtagcaacaaccgtgattaccccaatgatgcgtcatacaatcgaaaacactacggctaatataagcttgaccgccattgcgaaccaggctgccatcctgatgggcctcgacaagggttggcctatttccaaaatggatatcggggttccgctgcttgcattaggctgctactcacaggtgaatcccctgacactcactgccgctgtcttgatgctggtggcacactatgccataatcggaccaggcctacaggcgaaggctaccagagaggcccaaaagaggacagcagccgggattatgaaaaaccctaccgtcgacggaatcgtggctattgatctggaccccgttgtgtacgacgccaagttcgaaaaacagctcggccagatcatgcttctgatattgtgtacttctcagattctgctcatgcgcacgacatgggcactgtgcgagagtatcaccttagctactggtccacttaccacactgtgggaagggtcgcctggaaagttttggaatactaccatcgccgtaagcatggcgaacattttccggggctcctatctcgccggtgcaggcctagctttctctctgatgaaatcattggggggaggccgaagagggacaggagcccaaggcgagacgctgggtgagaagtggaagaggcagctcaatcagcttagcaaatccgaatttaacacctacaagcgcagtgggatcatggaggtggatcggtctgaagcaaaagagggactgaagagaggcgaaactacaaaacatgctgtcagccgtggtaccgccaagttgaggtggttcgttgagcggaatctggtgaagcccgagggcaaagtcatagacctcgggtgtggacgcggcgggtggtcatattactgcgccggattaaagaaagtgactgaagtaaagggctatacaaaaggtgggccgggacacgaggaaccaattcctatggcgacctacggctggaacctggtgaagcttcattccggcaaagatgtttttttcatgcccccagagaagtgtgacacgctgctatgcgatatcggggaaagtagccccaatcctaccattgaggagggacgaacactcagagtgctgaagatggtcgaaccgtggttgaggggtaaccagttttgtatcaaaatactgaatccctacatgccatctgtggtcgagactctcgaacaaatgcagcggaagcacggcgggatgcttgtgcgcaaccctctgtccagaaattcaacccacgagatgtattgggttagctgcggaacaggcaacatcgtatcggctgtgaacatgacttctaggatgttactgaatcgattcaccatggcacatcggaaacccacatacgagcgtgacgtcgatttgggtgccgggaccagacacgtggctgttgaacctgaggtggccaacctcgacattatcggacagcgcattgaaaatatcaagaacgagcataaaagtacttggcactatgatgaagacaatccatacaagacgtgggcatatcacggctcctacgaggtcaagcccagcggctcagcctcctctatggtgaacggggtagtgaggctgctaacaaaaccttgggatgttattccaatggtcacccaaatcgctatgactgacaccacaccctttggacagcagcgggtgttcaaggagaaagtggacacgagaaccccgcgcgcgaagaggggtactacacagataatggaagtcaccgccaaatggctttggggctttctgagccgaaataagaagcctcggatttgtactagagaggaattcacaaggaaagttcgcagtaacgcagctatcggggccgtgtttgtagatgagaatcaatggaactccgcaaaggaagccgtggaggacgagcgtttctgggatctcgtccatcgggaaagagagctgcacaaacagggaaagtgcgctacctgcgtgtataatatgatgggcaaaagggaaaagaagttgggtgagtttgggaaagccaagggaagccgcgcgatctggtacatgtggctgggcgcacgattcctcgaattcgaggcccttggctttatgaacgaggaccattggttctctcgggaaaattcactgagtggggttgagggagaaggtttacacaaactgggctacattttgagagatatatccaagatcccagggggaaacatgtatgctgacgatacagccggctgggacactaggattaccgaggatgacctccagaatgaggcaaaaatcacggaaattatggagcccgaacatgctctgctagccaccagcatctttaagcttacataccagaacaaagtggtccgcgtgcaaagacctgctaagaacggtactgtaatggatgttatatctcggagggaccagcgtgggtcgggacaggtgggcacctatggcctgaatacattcactaacatggaggtccagctcatccgacaaatggaatcagaggggatttttctgccaagcgagttggaaacccccaatttagccgagcgcgtgctggattggctcgaaaagcacggagcagagagacttaaacggatggcgatctccggtgacgactgtgtggtcaagccgattgatgacaggttcgccacggctctgacagccctaaacgatatgggcaaagttcgcaaggacatccctcagtgggaacccagtaaagggtggaatgattggcagcaggcaccattttgctctcaccatttccaccaactgataatgaaggacggaagagagattgtggtaccttgtcggaaccaggatgagctcgtgggcagggctcgagtcagccagggtgccgggtggtccttgcgtgaaaccgcatgcctgggaaagtcatacgcccaaatgtggcagcttatgtattttcatagacgcgacctgcggctcgcggctaatgccatctgtagtgcagtgcccgttgattgggtgccaacttctaggacaacctggagcatccacgcccaccatcagtggatgactaccgaggacatgttatccgtctggaacagagtgtggattgaagagaatccctggatggaagataaaacacacgtatcaagctgggaggaggttccttacctgggcaagcgcgaagaccagtggtgcggctctttgatagggctgacggctcgggccacctgggcaactaacatccaagtggctattaatcaggtcaggcgactcatcggaaacgagaattatcttgactacatgacatccatgaaaagattcaagaacgaaagtgatccagagggtgccctgtggtga

SEQ ID NO: 13358 - RNA, 9879 nt, synthetic construct
  misc_feature 1..9879: note = derived and/or modified CDS sequence (opt3) from DENV-1__HQ166036__SS-prME
  source 1..9879: mol_type = other RNA
agcgtgaccatgctgctcatgcttctgcccacagccttggctttccacttaactacgagaggcggggagcctcatatgatcgtctccaagcaggaaaggggaaaatctctgctatttaagacctcagcaggtgttaacatgtgcacactcattgccatggacctgggcgagctttgtgaagatactatgacctacaaatgcccacaaataacagaggcggaaccggacgatgtggactgttggtgcaatgctaccgatacttgggtaacatatgggacctgtagtcagacgggagagcaccggcgcgacaagcgaagcgtggccctggcaccccatgtcggcttgggtctcgagactcgtaccgaaacatggatgtcctctgagggggcctggaaacagatccagagagtggaaacttgggctctgaggcaccctggattcaccgttattgcactgtttctcgcccatgctatcggcacatcgattacccaaaagggcatcatattcatcttactgatgcttgtgacgccatcaatggccatgcggtgcgtcgggattggaaaccgcgattttgtggagggtttgagcggcgcgacttgggtagacgttgtgctggagcacgggagttgtgtcacaaccatggcaaagaataaacccactctagatatcgaactcctgaagacagaggtgaccaaccctgccattcttagaaaactgtgcatcgaagctaagatatccaatacgaccacagactctaggtgtccaactcagggagaggccaccttggtggaagagcaggatgcaaacttcgtctgccggcgcacatttgttgaccgaggctggggtaatgggtgtggactcttcggcaaaggcagcctgttaacttgcgctaagtttaagtgcgtgaccaaactggaggggaagattgtacagtacgaaaacctcaaatattccgtgatcgtcacagtgcacaccggagatcaacatcaggttggtaatgagactacggaacacggcacaattgccaccatcactccccaggcgcctacctcagagatccagcttacagactacggggccctgaccttggactgtagtccaagaactggactagatttcaacgaaatggtgctgctcacaatgaaggagaaaagctggctggtccataagcaatggtttcttgacctgccgttgccctggacgtctggcgcatccacctcacaggagacttggaataggcaggatctcctggtgacattcaaaaccgctcacgccaagaagcaagaagtagttgtgttaggtagccaggagggggctatgcacacagccctgactggcgcaaccgaaattcagacgagtggaaccacaactatatttgccggccatctaaaatgccggctcaagatggacaaactgacccttaaggggacatcttatgtcatgtgtactggatccttcaaattggagaaggaagtggctgagacccagcacggtacggtcctggtgcaagttaagtacgagggcacagatgcgccttgcaaaatcccattcagcacccaggacgaaaagggggtgactcagaacggacgtctcattacagcaaatcccatcgtaaccgataaagagaagcctgtcaacatagaaactgagccaccctttggcgagtcgtatattgtggttggtgccggggaaaaagctctgaagctttcttggttcaagaaaggctcctcaatcggaaagatgtttgaggccaccgcacgcggcgccagaaggatggctatcctgggggacacagcctgggatttcggaagtattggtggcgtgtttacgagcgtcgggaaattggtgcatcaggtattcggaaccgcatacggcgtgctcttttccggtgtttcttggactatgaagatcgggattggcatactgttaacatggctgggactaaatagccggtcaaccagtctctccatgacatgtatcgcggtcggcatggtgactctgtaccttggggtgatggtccaagctgacagcggatgcgttattaactggaaaggccgagaattgaagtgtggttctgggatcttcgtgaccaacgaggtgcacacgtggacagaacagtataagtttcaggccgattcaccgaaacgcctgagtgcagccatcggaaaggcttgggaggagggcgtatgcggtattagaagcgccaccaggctcgaaaatataatgtggaaacagatctccaacgagctgaatcatattttactggaaaacgacatgaagttcactgtcgtggttggcgacgcaaatgggatccttgctcaaggaaaaaagatgattcggcctcagcccatggagcacaaatactcttggaagtcgtggggcaaggccaaaatcataggggcggatatccagaacaccacatttattatcgacggaccagatactcctgaatgtcccgacaatcagcgcgcctggaacatttgggaggtggaggattatggcttcggtatctttaccacaaatatatggttgaagctcagagacagctacacgcaaatgtgcgatcacaggctgatgtccgctgcaattaaagactcaaaggccgtccatgctgatatggggtattggatcgaaagtgagaaaaacgaaacctggaagctagcccgtgcatctttcattgaggtgaagacttgtacatggccaaaaagccacaccctgtggtccaatggagttctcgaatcagagatgatcatacccaagatctacggcggtcctattagccagcataactatcggccaggctacttcactcagacagcggggccgtggcacctgggaaaacttgagttggactttgatctgtgcgaaggcaccacggtggtagtcgacgagcactgcgggaatcgaggaccctctttaagaactaccacagtgaccggcaagatcattcatgaatggtgttgcaggtcctgtactctccctccactgcgcttccggggtgaggatgggtgctggtacggaatggagatcagacccgtgaaagaaaaggaggaaaaccttgtcaggagtatggttagcgccggctctggtgaggtggactccttttcactgggcatattgtgtgctagtattatgatcgaagaggtaatgcgcagccgatggtcgcggaagatgctcatgacagggaccctggccgtgttcctactgctcgtcatgggacaactgacatggaatgaccttatccgtttgtgcattatggtgggcgcaaacgcttccgatagaatggggatgggaactacctatctggccttaatggcaacgtttaaaatgaggcctatgttcgccgttggcctcctgtttcgccggcttacatctagagaggtgctgctactcaccatcggtctgagcttggtcgcttcagtggaactgccaaacagtttagaggaactcggggacggactggcgatgggcattatgatgcttaagctgttgactgagttccagccccaccagctctggaccacactgctatccctgacttttataaaaaccacgctttctctcgattacgcctggaagacaaccgcaatggctctgagcatcgtttccttgttcccgctgtgtttatcaactacaagccagaaaaccacttggctccctgtgctgcttggcagttttgggtgcaagccactgacaatgttcttgattaccgaaaataagatctggggaaggaaatcttggcccctcaacgagggtattatggccatcggcatagtctccatcctgctaagctcgctgcttaagaatgacgtacctctcgccgggcccctgattgctggaggcatgttgatcgcatgttatgtgatttcaggttctagtgccgatttatccctggagaaagcggctgaagttagctgggagcaagaagccgagcattctgggacgagccacaacatcctcgtggaagtccaggacgatggaactatgaagataaaagacgaggagcgagatgacaccctgacaattcttctgaaggcaaccttgctagccgtgtccggcgtatacccaatgtcaatccctgctacactgtttgtgtggtatttctggcagaaaaagaagcagcgcagtggcgtcctctgggatactcccagcccaccggaagttgagcgggcagtgctggacgatgggatctacagaattcttcaaaggggattactgggtcgttctcaggtgggcgtcggggtgttccaggacggagtttttcataccatgtggcacgtaacgcgcggcgccgtgctcatgtatcagggtaaacggttggaaccttcctgggcgtcagtcaagaaagacctgataagttacgggggaggctggagattcaggggcagctggaatacaggggaggaggtgcaagttatcgctgtggaacccggaaagaacccaaaaaatgtccagactacccccggtacatttaagacccctgagggcgaagtgggggccattgcactcgatttcaagccaggaacttccggctctcccatcgtaaaccgagagggtaaaattgtcgggctgtacggaaatggcgtggttaccacatcgggcacgtatgtgagcgccatcgctcaggccaaggcatcacaagaagggcctcttccggagatagaggacgaagtctttaaaaagcggaacctgactatcatggatttgcacccaggatccggtaaaacccgcagatacctacccgctattgtgagggaggccatcaagcggaagctgcgaacactcattttagcgcctaccagagttgtggccagtgaaatggcagaggctctgaaaggcatgccaatccgctatcagactacagccgtcaagtctgaacataccgggagggagatagtggaccttatgtgccacgctacgttcactatgcgtctgctcagccccgtacgggtgcctaattacaacatgattatcatggatgaggcacattttacagacccggcctccatcgccgctagaggatatatttcaaccagggttggcatgggtgaagcggcagccatcttcatgaccgctactcccccagggtctgtcgaggcctttcctcagagcaatgcagtgatacaggatgaagagcgcgacattcccgaacgaagttggaactccggatacgattggatcacagacttcccaggcaaaaccgtgtggtttgtccctagcattaagtctggcaatgatatcgccaactgtttgagaaaaaacgggaagcgggtaatacaactgtcaaggaagacattcgacactgagtatcagaaaacgaagaataacgactgggattacgtggttaccacagacatttccgagatgggagctaatttccgcgcggatcgtgtgatcgaccccagacggtgcctcaaaccagtcatcctgaaggatggtccggaaagggtgattcttgccggccctatgcccgttactgtggcaagtgctgcccagcgccgagggagaatcggacggaaccagaataaagagggcgaccaatacgtctatatgggtcagccactaaacaatgatgaagaccacgcacattggaccgaggccaagatgctgttggataacattaatacacccgaggggataatccctgctttatttgaaccagagagggaaaagagcgccgcgattgacggcgagtaccgcctgagaggagaagcaaggaaaaccttcgtggagctcatgcggcgtggcgatctgcccgtatggctttcgtataaggtggcctctgaggggtttcagtactccgaccgccgatggtgcttcgatggagaaagaaacaatcaggttctggaggaaaacatggacgtcgagatctggactaaagaaggtgagaggaagaaactccggcctcgctggttggacgctagaacgtatagcgatccgctggccctaagggagtttaaggaattcgctgcaggccggcgatcagtgagtggggacctgatcctcgagattggaaaacttccacaacacctgacctctagagcccagaatgctttagataacttggtgatgctgcacaattccgaacagggcggtaaggcctaccgccatgcaatggaggaactccccgacacaatagagactctgatgcttctggcgctcatcgccgtcttgaccgggggcgttacactgtttttcttaagcggaaagggcctagggaaaacctcaattggactgctctgtgtgactgctagtagcgcccttctgtggatggcatccgtagagcctcactggatcgctgcctctattatcttggaatttttcctgatggtgctcctgatacccgagccagataggcagcggacacctcaagacaaccagcttgcatatgtcgtgatcggtctcctgtttatgattttgacggttgccgctaacgaaatgggcctgttagagaccactaagaaagatctagggatcggacatgtggcggccgagaatcaccagcacgcaacaatgctggacgtcgatctccgtcccgctagcgcctggaccctttacgccgtagcaaccacagtgattactccaatgatgagacatacgatcgaaaacaccacagctaatatatccctgactgccattgcgaaccaagctgccatcttgatgggcctggacaagggttggcctatttcaaaaatggatatcggggttccgctcctggcacttggctgctactctcaggtgaatcccttaaccctgacagccgctgtcctcatgttggtggcacactatgccataatcggaccaggcctgcaggcgaaggctaccagggaggcccagaagcgcactgcagccgggattatgaaaaaccctacggtcgacggaatcgtggctattgatctagaccccgttgtgtacgacgccaagttcgaaaaacaactgggccagatcatgctccttatactgtgtacaagtcagattttgctgatgcggaccacttgggcactctgcgagtcgatcaccctggctacaggtccattaactaccctttgggaagggagccctggaaagttttggaatacaacgatcgccgtatccatggcgaacattttccgaggctcttatctggccggtgcaggcctcgctttctcactaatgaaaagcctggggggaggcagaagggggaccggagcccagggcgagactttgggtgagaagtggaagcgccaactgaatcagctctccaaaagtgaatttaacacatacaagcggtctgggatcatggaggtggatagaagcgaagcaaaagagggacttaagcgtggcgaaaccactaaacatgctgtctcaaggggtacagccaagctgcggtggttcgttgagcgcaatttggtgaagcccgagggcaaagtcatagacctggggtgtggacgaggcgggtggtcctattactgcgccggactcaagaaagtgaccgaagtaaagggctatacgaaaggtgggccgggacacgaggaaccaattcctatggcgacctacggctggaacttagtgaagctgcatagtggcaaagatgtttttttcatgcccccagagaagtgtgacacacttctgtgcgatatcggggaaagctctcccaatcctactattgaggagggaagaaccctaagggtgctcaagatggtcgaaccgtggctgcggggtaaccagttttgtatcaaaatattgaatccctacatgccatccgtggtcgagacactggaacagatgcaacgcaagcacggcgggatgctcgtgagaaaccctctttcaaggaatagcactcacgagatgtattgggtttcgtgcggaaccggcaacatcgtatctgctgtgaacatgacaagtcgaatgctgttaaatcggttcaccatggcacatcgtaaacccacttacgagagagacgtcgatctgggtgccgggacgcgccacgtggctgttgaacctgaggtggccaacttggacattatcggacagaggattgaaaatatcaagaacgagcataaatccacatggcactatgatgaagacaatccatacaagacctgggcatatcacggcagctacgaggtcaagccctcaggctccgcctctagcatggtgaacggggtagtgcggctcctgactaaaccttgggatgttattccaatggtcacccagatcgctatgacagacacgaccccctttggacaacagagagtgttcaaggagaaagtggacactcgcacaccgagggcgaagcgaggtaccactcagataatggaagtcacagccaaatggctatggggctttcttagtcggaataagaagcctagaatttgtaccagggaggaattcacacgcaaagttcgttccaacgcagctatcggggccgtgtttgtagatgagaatcagtggaacagcgcaaaggaagccgtggaggacgagcggttctgggatctggtccatagagaaagggagctccacaaacaaggaaagtgcgctacttgcgtgtataatatgatgggcaaacgcgaaaagaagctgggtgagtttgggaaagccaagggatctcgagcgatctggtacatgtggttgggcgcacggttcctggaattcgaggccctcggctttatgaacgaggaccattggttctcaagagaaaatagtctttccggggttgagggagaaggtctgcacaaattaggctacattctgagggatataagcaagatcccagggggaaacatgtatgctgacgataccgccggctgggacacgcgcattaccgaggatgacttgcagaatgaggcaaaaatcacagaaattatggagcccgaacatgctctcctggccacttctatctttaagctaacctaccagaacaaagtggtcagagtgcagcggcctgctaagaacggtacagtaatggatgttatatcgaggcgtgaccaacgagggtcaggacaggtgggcacttatggccttaataccttcacgaacatggaggtccagctgatccgccagatggaaagcgaggggatttttctcccatccgagctggaaacacccaatttggccgagagagtgttagattggctggaaaagcacggagcagagcggctcaaaaggatggcgatcagtggtgacgactgtgtggtcaagccgattgatgaccgcttcgccaccgctcttactgccctgaacgatatgggcaaagttagaaaggacatccctcaatgggaaccctctaaagggtggaatgattggcagcaggtgccattttgcagccaccatttccaccagctaataatgaaggacggacgggagattgtagtgccttgtaggaaccaagatgagctggtcggccgagcacgtgtgtcccagggtgctgggtggtcactcagagaaacagcctgcttgggaaagagttacgcacagatgtggcaactgatgtattttcatcgccgggaccttaggctggccgcgaatgctatctgttctgccgttcccgtggattgggtcccaaccagcagaactacctggtccatccacgcacaccatcagtggatgacaacggaggacatgctctcagtgtggaaccgcgtatggattgaagagaatccctggatggaagataaaacccacgttagctcttgggaggaggtgccttacttaggcaagcgggaagaccagtggtgcggctccctgatagggttgactgccagggctacatgggccaccaacatccaggtcgcaattaatcaagtgcgaagactgatcggaaacgagaattatctcgactacatgactagtatgaaacggttcaagaacgaaagcgatccagagggtgctctttggtga

SEQ ID NO: 13359 - RNA, 9879 nt, synthetic construct
  misc_feature 1..9879: note = derived and/or modified CDS sequence (opt3) from DENV-1__GU131981__SS-prME
  source 1..9879: mol_type = other RNA
agcgtgaccatgctgctcatgcttctgcccacagccttggctttccacttaactacgagaggcggggagcctcatatgatcgtctccaagcaggaaaggggaaaatctctgctatttaagacctcagcaggtgttaacatgtgcacactcattgccatggacctgggcgagctttgtgaagatactatgacctacaaatgcccacaaataacagaggcggaaccggacgatgtggactgttggtgcaatgctaccgatacttgggtaacatatgggacctgtagtcagacgggagagcaccggcgcgacaagcgaagcgtggccctggcaccccatgtcggcttgggtctcgagactcgtaccgaaacatggatgtcctctgagggggcctggaaacagatccagagagtggaaacttgggctctgaggcaccctggattcaccgttattgcactgtttctcgcccatgctatcggcacatcgattacccaaaagggcatcatattcatcttactgatgcttgtgacgccatcaatggccatgcggtgcgtcgggattggaaaccgcgattttgtggagggtttgagcggcgcgacttgggtagacgttgtgctggagcacgggagttgtgtcacaaccatggcaaagaataaacccactctagatatcgaactcctgaagacagaggtgaccaaccctgccattcttagaaaactgtgcatcgaagctaagatatccaatacgaccacagactctaggtgtccaactcagggagaggccaccttggtggaagagcaggatgcaaacttcgtctgccggcgcacatttgttgaccgaggctggggtaatgggtgtggactcttcggcaaaggcagcctgttaacttgcgctaagtttaagtgcgtgaccaaactggaggggaagattgtacagtacgaaaacctcaaatattccgtgatcgtcacagtgcacaccggagatcaacatcaggttggtaatgagactacggaacacggcacaattgccaccatcactccccaggcgcctacctcagagatccagcttacagactacggggccctgaccttggactgtagtccaagaactggactagatttcaacgaaatggtgctgctcacaatgaaggagaaaagctggctggtccataagcaatggtttcttgacctgccgttgccctggacgtctggcgcatccacctcacaggagacttggaataggcaggatctcctggtgacattcaaaaccgctcacgccaagaagcaagaagtagttgtgttaggtagccaggagggggctatgcacacagccctgactggcgcaaccgaaattcagacgagtggaaccacaactatatttgccggccatctaaaatgccggctcaagatggacaaactgacccttaaggggacatcttatgtcatgtgtactggatccttcaaattggagaaggaagtggctgagacccagcacggtacggtcctggtgcaagttaagtacgagggcacagatgcgccttgcaaaatcccattcagcacccaggacgaaaagggggtgactcagaacggacgtctcattacagcaaatcccatcgtaaccgataaagagaagcctgtcaacatagaaactgagccaccctttggcgagtcgtatattatggtgggtgccggggaaaaagctctgaagctttcttggttcaagaaaggctcctcaatcggaaagatgtttgaggccaccgcacgcggcgccagaaggatggctatcctgggggacacagcctgggatttcggaagtattggtggcgtttttacgagcgtggggaaattggtccatcaggtgttcggaaccgcatacggcgtactcttttccggtgtgtcttggactatgaagatcgggattggcatactgttaacatggctgggactaaatagccggtcaaccagtctctccatgacatgtatcgcggttggcatggtcactctgtaccttggggtgatggtgcaagctgacagcggatgcgtcattaactggaaaggccgagaattgaagtgtggttctgggatcttcgttaccaacgaggtgcacacgtggacagaacagtataagtttcaggccgattcaccgaaacgcctgagtgcagccatcggaaaggcttgggaggagggcgtgtgcggtattagaagcgccaccaggctcgaaaatataatgtggaaacagatctccaacgagctgaatcatattttactggaaaacgacatgaagttcactgtagtcgtgggcgacgcaaatgggatccttgctcaaggaaaaaagatgattcggcctcagcccatggagcacaaatactcttggaagtcgtggggcaaggccaaaatcataggggcggatatccagaacaccacatttattatcgacggaccagatactcctgaatgtcccgacaatcagcgcgcctggaacatttgggaggttgaggattatggcttcggtatctttaccacaaatatatggttgaagctcagagacagctacacgcaaatgtgcgatcacaggctgatgtccgctgcaattaaagactcaaaggccgtgcatgctgatatggggtattggatcgaaagtgagaaaaacgaaacctggaagctagcccgtgcatctttcattgaggtcaagacttgtacatggccaaaaagccacaccctgtggtccaatggagtgctcgaatcagagatgatcatacccaagatctacggcggtcctattagccagcataactatcggccaggctacttcactcagacagcggggccgtggcacctgggaaaacttgagttggactttgatctgtgcgaaggcaccacggttgtggtagacgagcactgcgggaatcgaggaccctctttaagaactaccacagtcaccggcaagatcattcatgaatggtgttgcaggtcctgtactctccctccactgcgcttccggggtgaggatgggtgctggtacggaatggagatcagacccgtgaaagaaaaggaggaaaaccttgtgaggagtatggtcagcgccggctctggtgaggttgactccttttcactgggcatattgtgtgctagtattatgatcgaagaggtgatgcgcagccgatggtcgcggaagatgctcatgacagggaccctggccgtattcctactgctcgtgatgggacaactgacatggaatgaccttatccgtttgtgcattatggtcggcgcaaacgcttccgatagaatggggatgggaactacctatctggccttaatggcaacgtttaaaatgaggcctatgttcgccgtgggcctcctgtttcgccggcttacatctagagaggttctgctactcaccatcggtctgagcttggtggcttcagtcgaactgccaaacagtttagaggaactcggggacggactggcgatgggcattatgatgcttaagctgttgactgagttccagccccaccagctctggataaccctgctatccctgacatttatcaaaactaccctttctctcgattacgcctggaagacgacagcaatggctctgagcattgtgtccttgttcccgctgtgtttatcaaccactagccagaaaacaacctggctccctgttctgcttggcagttttgggtgcaagccactgactatgttcttgatcacagaaaataagatttggggaaggaaatcttggcccctcaacgagggtatcatggccataggcatcgtgtccattctgctaagctcgctgcttaagaatgacgtccctctcgccgggcccctgatcgctggaggcatgttgattgcatgttatgtaatctcaggttctagtgccgatttatccctggagaaagcggctgaagtgagctgggagcaagaagccgagcattctgggaccagccacaacatactcgttgaagtgcaggacgatggaacgatgaagattaaagacgaggagcgagatgacactctgaccatccttctgaaggcaacattgctagccgtctccggcgtgtacccaatgtcaatccctgctaccctgtttgtatggtatttctggcagaaaaagaagcagcgcagtggcgtgctctgggatacacccagcccaccggaagtcgagcgggcagttctggacgatgggatttacagaatacttcaaaggggattactgggtcgttctcaggtgggcgtgggggtcttccaggacggagtgtttcatactatgtggcacgttacccgcggcgccgtactcatgtatcagggtaaacggttggaaccttcctgggcgtcagtgaagaaagacctgatcagttacgggggaggctggagattccaaggcagctggaatacgggggaggaggtccaggtgattgctgttgaacccggaaagaacccaaaaaatgtgcagacaatgcccggtacttttaagacccctgagggcgaagtcggggccatcgcactcgatttcaagccaggaacatccggctctcccattgtgaacagggagggtaaaatcgtagggctgtacggaaatggcgtcgtgaccacttcgggcacctatgttagcgccatagctcaagccaaggcatcacaggaagggcctcttccggagatcgaggacgaagtgtttaaaaagcgaaacctgacaattatggatttgcacccaggatccggtaaaacgcggcgctacctacccgctatggtcagagaggccatcaagaggaagctgcggactctcattttagcgcctacccgagtggttgccagtgaaatggcagaggctctgaaaggcatgccaatcagatatcagacaaccgccgtgaagtctgaacatactgggcgcgagatagtcgaccttatgtgccacgctacattcaccatgaggctgctcagccccgtgcgtgtacctaattacaacatgattatcatggatgaggcacattttacggacccggcctccatcgccgctcggggatatatttcaactagagtgggcatgggtgaagcggcagccatcttcatgacagctacccccccagggtctgttgaggcctttcctcagagcaatgcagtcatacaagatgaagagagggacattcccgaacgcagttggaactccggatacgattggatcaccgacttcccaggcaaaactgtgtggtttgtgcctagcattaagtctggcaatgatatcgccaactgtttgcgaaaaaacgggaagagagtcatacagctgtcacggaagacattcgacaccgagtatcagaaaacaaagaataacgactgggattacgtagtgactacggacatttccgagatgggagctaatttcagggcggatcgcgttatcgacccccgtagatgcctcaaaccagtgatcctgaaggatggtccggaacgggtcattcttgccggccctatgcccgtgaccgttgcaagtgctgcccagaggcgcgggcgaatcggaagaaaccaaaataaagagggcgaccagtacgtgtatatgggtcagccactaaacaatgatgaagaccacgcacattggacagaggccaagatgctgttggataacattaatactcccgaggggataatccctgctttatttgaaccagagcgggaaaagagcgccgcgattgacggcgagtacaggctgcgcggagaagcaagaaaaaccttcgtcgagctcatgaggcggggcgatctgcccgtgtggctttcgtataaggtagcctctgaggggtttcagtactccgaccgtcgctggtgcttcgatggagaacgaaacaatcaagtgctggaggaaaacatggacgttgagatctggacaaaagaaggtgagagaaagaaactcaggcctcggtggttggacgctcgcacctatagcgatccgctggccctaagagagtttaaggaattcgctgcaggcaggcggtcagtcagtggggacctgatcctcgagattggaaaacttccacagcacctgactttacgagcccagaatgctttggataacctggtgatgctccacaattctgaacagggcggtaaggcctacagacatgcaatggaggaactgcccgacacgatagagacccttatgctgctcgcgttgatcgccgtgctgacagggggcgtcactttatttttcctatccggaaagggcctggggaaaaccagcattggactcctttgtgttacagcttcaagtgccctgttgtggatggcaagcgtggagcctcactggatcgctgcctccattatcctggaatttttcctcatggtactgcttatacccgagccagatcgccaaaggacccctcaggacaaccagctcgcatatgtggtcatcggtctgttgtttatgattctgactgtggccgctaacgaaatgggcttactagagacaacgaagaaagatctggggatcggacatgttgcggccgagaatcaccaacacgcaaccatgctcgacgtggatcttcggcccgcttctgcctggactctgtacgccgtcgcaacaaccgtaattaccccaatgatgcgtcatacaatcgaaaacactacggctaatataagcttgaccgccattgcgaaccaggctgccatcctgatgggcctcgacaagggttggcctatttccaaaatggatatcggggtgccgctgcttgcattaggctgctactcacaggttaatcccctgacactcactgccgctgtgttgatgctggtcgcacactatgccataatcggaccaggcctacaggcgaaggctaccagagaggcccaaaagaggacagcagccgggattatgaaaaaccctaccgtggacggaatcgtcgctattgatctggaccccgtggtttacgacgccaagttcgaaaaacagctcggccagatcatgcttctgatattgtgtacttctcagattctgctcatgcgcacgacatgggcactgtgcgagagtatcaccttagctactggtccacttaccacactgtgggaagggtcgcctggaaagttttggaatactaccatcgccgtgagcatggcgaacattttccggggctcctatctcgccggtgcaggcctagctttctctctgatgaaatcattggggggaggccgaagagggacaggagcccaaggcgagacgctgggtgagaagtggaagaggcagctcaatcagcttagcaaatccgaatttaacacctacaagcgcagtgggatcatggaggtagatcggtctgaagcaaaagagggactgaagagaggcgaaactacaaaacatgctgtgagccgtggtaccgccaagttgaggtggttcgtcgagcggaatctggttaagcccgagggcaaagtgatagacctcgggtgtggacgcggcgggtggtcatattactgcgccggattaaagaaagtcactgaagtgaagggctatacaaaaggtgggccgggacacgaggaaccaattcctatggcgacctacggctggaacctggtaaagcttcattccggcaaagatgtgtttttcatgcccccagagaagtgtgacacgctgctatgcgatatcggggaaagtagccccaatcctaccattgaggagggacgaacactcagagttctgaagatggtggaaccgtggttgaggggtaaccagttttgtatcaaaatactgaatccctacatgccatctgtcgtggagactctcgaacaaatgcagcggaagcacggcgggatgcttgtccgcaaccctctgtccagaaattcaacccacgagatgtattgggtgagctgcggaacaggcaacatcgtttcggctgtaaacatgacttctaggatgttactgaatcgattcaccatggcacatcggaaacccacatacgagcgtgacgtggatttgggtgccgggaccagacacgtcgctgtggaacctgaggttgccaacctcgacattatcggacagcgcattgaaaatatcaagaacgagcataaaagtacttggcactatgatgaagacaatccatacaagacgtgggcatatcacggctcctacgaggtgaagcccagcggctcagcctcctctatggtcaacggggtggtaaggctgctaacaaaaccttgggatgtgattccaatggttacccaaatcgctatgactgacaccacaccctttggacagcagcgggtcttcaaggagaaagtggacacgagaaccccgcgcgcgaagaggggtactacacagataatggaagtgaccgccaaatggctttggggctttctgagccgaaataagaagcctcggatttgtactagagaggaattcacaaggaaagtccgcagtaacgcagctatcggggccgtttttgtggatgagaatcaatggaactccgcaaaggaagccgtagaggacgagcgtttctgggatctcgtgcatcgggaaagagagctgcacaaacagggaaagtgcgctacctgcgtctataatatgatgggcaaaagggaaaagaagttgggtgagtttgggaaagccaagggaagccgcgcgatctggtacatgtggctgggcgcacgattcctcgaattcgaggcccttggctttatgaacgaggaccattggttctctcgggaaaattcactgagtggggtggagggagaaggtttacacaaactgggctacattttgagagatatatccaagatcccagggggaaacatgtatgctgacgatacagccggctgggacactaggattaccgaggatgacctccagaatgaggcaaaaatcacggaaattatggagcccgaacatgctctgctagccaccagcatctttaagcttacataccagaacaaagttgtgcgcgtccaaagacctgctaagaacggtactgtgatggatgtaatatctcggagggaccagcgtgggtcgggacaggttggcacctatggcctgaatacattcactaacatggaggtgcagctcatccgacaaatggaatcagaggggatttttctgccaagcgagttggaaacccccaatttagccgagcgcgtcctggattggctcgaaaagcacggagcagagagacttaaacggatggcgatctccggtgacgactgtgtggtgaagccgattgatgacaggttcgccacggctctgacagccctaaacgatatgggcaaagtccgcaaggacatccctcagtgggaacccagtaaagggtggaatgattggcagcaggttccattttgctctcaccatttccaccaactgataatgaaggacggaagagagattgtggtaccttgtcggaaccaggatgagctcgtgggcagggcacgagtcagccagggtgctgggtggtccttgcgtgaaaccgcctgcctgggaaagtcatacgcacaaatgtggcagcttatgtattttcatagacgcgacctgcggctcgccgcgaatgctatctgtagtgccgtgcccgttgattgggtgccaacttctaggacaacctggagcatccacgcacaccatcagtggatgactaccgaggacatgttatccgtctggaacagagtgtggattgaagagaatccctggatggaagataaaacacacgtatcaagctgggaggaggttccttacctgggcaagcgcgaagaccagtggtgcggctctttgatagggctgacggcccgggctacctgggccactaacatccaagtggcaattaatcaggtcaggcgactcatcggaaacgagaattatcttgactacatgacatccatgaaaagattcaagaacgaaagtgatccagagggtgctctgtggtga

SEQ ID NO: 13360 - RNA, 9879 nt, synthetic construct
  misc_feature 1..9879: note = derived and/or modified CDS sequence (opt3) from DENV-1__GQ868529__SS-prME
  source 1..9879: mol_type = other RNA
agcgtgaccatgctgctcatgcttctgcccacagcattggctttccacttaactacgagaggaggggaacctcatatgatcgtctccaagcaggaaaggggaaaatctctgctgtttaagacctcagccggtgttaacatgtgcacactcattgccatggacctgggcgagctttgtgaagatactatgacctacaaatgcccacagataacagaggcggaaccggacgatgtggactgttggtgcaatgctaccgatacttgggtaacatatgggacctgtagtcagacgggagagcaccggcgcgacaagcgaagcgtggccctggcaccccatgtcggcttgggtctcgagactcgtaccgaaacatggatgtcctctgagggggcctggaaacagatccagagagtggaaacttgggctctgaggcaccctggattcaccgttattgcatttttcctggcccatgctatcggcacatcgattacccaaaagggcatcatatttatcctcttaatgctggtgacgccatcaatggccatgcggtgcgtcgggattggaaaccgcgatttcgtggagggtcttagcggcgcgacttgggtagacgttgtgttggagcacgggagttgtgtcacaaccatggcaaagaataaacccactctggatatcgaactactcaagacagaggtgaccaaccctgccattctgagaaaactttgcatcgaagctaagatatccaatacgaccacagactctaggtgtccaactcagggagaggccaccctggtggaagaacaggatgcaaactttgtctgccggcgcacattcgttgaccgaggctggggtaatgggtgtggattgtttggcaaaggcagcctcctgacttgcgctaagttcaagtgcgtgaccaaattagaggggaagacagtacagtacgaaaacctgaaatattccgtgattgtcaccgtgcacactggagatcaacatcaggttggtaatgagacgacagaacacggcaccatcgccactattaccccacaggcgcctacatcagagatccagctcaccgactacggggcccttactctggactgtagtccaagaacaggattggattttaacgaaatggtgctactgacgatgaaggagaaaagctggctcgtccataagcaatggttcctggaccttccgctgccctggacctctggcgcatccacttcacaggagacatggaataggcaggatttgctcgtgacctttaaaacagctcacgccaagaagcaagaagtagttgtgctgggtagccaggagggggctatgcacactgccttaaccggcgcaacggaaatccagaccagtggaacaactaccattttcgccggccatctgaaatgccggctaaagatggacaaactcacactgaaggggacttcttatgtcatgtgtaccggatccttcaaacttgagaaggaagtggctgagacgcagcacggtacagtcttggtgcaagttaagtacgagggcaccgatgcgccttgcaaaataccatttagcactcaggacgaaaagggggtgacacagaacggacgtctgatcaccgcaaatcccattgtaactgataaagagaagcctgtcaacatcgaaaccgagccacccttcggcgagtcgtatatagtggttggtgccggggaaaaagctctcaagctgtcttggtttaagaaaggctcctcaattggaaagatgttcgaggccacagcacgcggcgccagaaggatggctatccttggggacacggcctgggattttggaagtatcggtggcgtgttcaccagcgtcgggaaactggtgcatcaggtatttggaactgcatacggcgtgttgttctccggtgtttcttggacaatgaagattgggatcggcattctcctgacctggttaggactgaatagccggtcaacaagtctatccatgacttgtatagcggtcggcatggtgaccctctacctgggggtgatggtccaagctgacagcggatgcgttatcaactggaaaggccgagaacttaagtgtggttctgggatttttgtgacgaacgaggtgcacacatggaccgaacagtataagttccaggccgattcaccgaaacgcttgagtgcagccatcggaaaggcttgggaggagggcgtatgcggtatcagaagcgccactaggctggaaaatattatgtggaaacagatatccaacgagctcaatcatatcctgttagaaaacgacatgaagtttaccgtcgtggttggcgacgcaaatgggattctggctcaaggcaagaagatgatccggcctcagcccatggagcacaaatactcttggaagtcgtggggcaaggccaaaattatcggggcggatatacagaacacaactttcatcattgacggaccagatacccctgaatgtcccgacaatcagcgcgcctggaacatctgggaggtggaggattatggctttggtattttcacaacgaatatctggcttaagttgagagacagctacacccaaatgtgcgatcacaggctcatgtccgctgcaataaaagactcaaaggccgtccatgctgatatggggtattggattgaaagtgagaaaaacgaaacttggaagctggcccgtgcatctttcatcgaggtgaagacatgtacctggccaaaaagccacactctatggtccaatggagttctggaatcagagatgattatccccaagatatacggcggtcctatcagccagcataactatcggccaggctactttacacagattgcggggccgtggcacctcggaaaactggagcttgacttcgatttgtgcgaaggcaccacggtggtagtcgacgagcactgcgggaatcgaggaccctctctgagaactaccacagtgaccggcaagatcattcatgaatggtgttgcaggtcctgtactttacctccactccgctttcggggtgaggatgggtgctggtacggaatggagatcagacccgtgaaagaaaaggaggaaaacctggtcaggagtatggttagcgccggctctggtgaggtggactccttctcacttggcatactgtgtgctagtattatgatcgaagaggtaatgcgcagccgatggtcgcggaagatgttgatgacagggaccctcgccgtgtttctgctactggtcatgggacaactcacatggaatgacctgatccgtctttgcattatggtgggcgcaaacgcttccgatagaatggggatgggaactacctatttggccctgatggcaacgttcaaaatgaggcctatgtttgccgttggcttactcttccgccggctgacatctagagaggtgcttctgctaaccatcggtctcagcctggtcgcttcagtggaattgccaaacagtctggaggaattaggggacggactcgcgatgggcattatgatgctgaaacttctgactgagtttcagccccaccagttgtggaccacactcctgtccctaactttcataaaaaccacgctgtctcttgattacgcctggaagacaaccgcaatggctctcagcatcgtttccctgtttccgttgtgtctgtcaactacaagccagaaaaccacttggttacctgtgctcctgggcagtttcgggtgcaagccacttacaatgtttctgattaccgaaaataagatctggggaaggaaatcttggcccttgaacgagggtattatggccatcggcatagtctccatcctcctgagctcgctactgaagaatgacgtacctcttgccgggcccctcattgctggaggcatgctgatcgcatgttatgtgatttcaggttctagtgccgatttgtccttagagaaagcggctgaagttagctgggagcaagaagccgagcattctgggacgagccacaacatcctggtggaagtccaggacgatggaactatgaagataaaagacgaggagcgagatgacaccctcacaattctgcttaaggcaaccctgttggccgtgtccggcgtatacccaatgtcaatccctgctacactattcgtgtggtatttctggcagaaaaagaagcagcgcagtggcgtcctgtgggatactcccagcccaccggaagttgagcgggcagtgctcgacgatgggatctacaggattctgcaacgaggacttttaggtcgttctcaggtgggcgtcggggtgtttcaggacggagttttccataccatgtggcacgtaacgcgcggcgccgtgctgatgtatcagggtaaacggctcgaaccttcctgggcgtcagtcaagaaagacttgataagttacgggggaggctggagatttcaaggcagctggaatacaggggaggaggtgcaggttatcgctgtggaacccggaaagaaccccaagaatgtccagactacccccggtacattcaagacccctgagggcgaagtgggggccattgcactggattttaagccaggaacttccggctctcccatcgtaaacagggagggtaaaattgtcgggctctacggaaatggcgtggttaccacatcgggcacgtatgtgagcgccatcgctcaagccaaggcatcacaggaagggcctctgccggagatagaggacgaagtcttcaaaaagcgaaaccttactatcatggatctgcacccaggatccggtaaaacccggcgctacttgcccgctatggtgagagaggccattaagaggaagctacggacactgatcctcgcgcctacccgagttgtggccagtgaaatggcagaggctttaaaaggcatgccaattagatatcagactacagccgtcaagtctgaacataccgggcgcgagatcgtggacctgatgtgccacgctacgtttactatgaggcttctgagccccgtacgtgtgcctaattacaacatgataattatggatgaggcacatttcacagacccggcctccatcgccgctcggggatatatctcaaccagagttggcatgggtgaagcggcagccatttttatgaccgctactcccccagggtctgtcgaggccttccctcagagcaatgcagtgatccaagatgaagagagggacatacccgaacgcagttggaactccggatacgattggattacagactttccaggcaaaaccgtgtggttcgtccctagcatcaagtctggcaatgatattgccaactgtctcagaaagaacgggaaaagagtaatccagttgtcacggaagacattcgacactgagtatcagaaaacgaagaataacgactgggattacgtggttaccacagacatatccgagatgggagctaattttagggcggatcgcgtgattgacccccgtagatgcctgaaaccagtcatcctcaaggatggtccggaacgggtgatcctggccggccctatgcccgttactgtggcaagtgctgcccagaggcgcgggcgaattggaagaaaccaaaataaagagggcgaccagtacgtctatatgggtcagccacttaacaatgatgaagaccacgcacattggaccgaggccaagatgctactggataacatcaatacacccgaggggattatacctgctttgttcgaaccagagcgggaaaagagcgccgcgatcgacggcgagtacaggttacgcggagaagcaagaaaaacctttgtggagctgatgaggcggggcgatctccccgtatggctgtcgtataaggtggcctctgaggggttccagtactccgaccgtcgctggtgctttgatggagaacgaaacaatcaagttcttgaggaaaacatggacgtcgagatttggactaaagaaggtgagagaaagaaactgaggcctcggtggctcgacgctcgcacgtatagcgatccgttggccctgagagagttcaaggaatttgctgcaggcaggcggtcagtgagtggggacctaatgctggagatcggaaaactcccacagcaccttaccctgcgagcccagaatgctttagataacttggtgatgctgcacaattctgaacagggcggtaaggcctacagacatgcaatggaggaactccccgacacaatcgagactctgatgcttctggcgctcattgccgtcttgaccgggggcgttacactgttctttttatccggaaagggcctagggaaaaccagcataggactgctctgtgtgactgcttcaagtgcccttctgtggatggcaagcgtagagcctcactggatcgctgcctccattatcttggagttctttctgatggtgctcctgattcccgagccagatcgccaaaggacacctcaggacaaccagcttgcatatgtcgtgatcggtctcctgttcatgatattgacggttgccgctaacgaaatgggcctgttagagaccactaagaaagatctagggatcggacatgtggcggccgagaatcaccaacacgcaacaatgctggacgtcgatctccggcccgcttctgcctggaccctttacgccgtagcaaccacagtgattactccaatgatgcgtcatacgatcgaaaacaccacagctaatattagcctgactgccatcgcgaaccaggctgccatattgatgggcctggacaagggttggcctatttccaaaatggatatcggggttccgctcctggcacttggctgctactcacaggtgaatcccttaaccctgacagccgctgtcctcatgttggtggcacactatgccattatcggaccaggcctgcaggcgaaggctaccagagaggcccaaaagaggactgcagccgggataatgaaaaaccctacggtcgacggaatcgtggctattgatctagaccccgttgtgtacgacgccaagtttgaaaaacagctgggccagatcatgctccttattctgtgtacatctcagatcttgctgatgcgcaccacttgggcactctgcgagagtataaccctggctacaggtccattaactaccctttgggaagggtcgcctggaaagttctggaatacaacgattgccgtaagcatggcgaacatcttccggggctcctatctggccggtgcaggcctcgctttttctctaatgaaatcactagggggaggccgaagagggaccggagcccaaggcgagactttgggtgagaagtggaagaggcagctgaatcagctcagcaaatccgagttcaacacatacaagcgcagtgggatcatggaggtggatcggtctgaagcaaaagagggacttaagagaggcgaaaccactaaacatgctgtcagccgtggtacagccaagctgaggtggtttgttgagcggaatttggtgaagcccgagggcaaagtcattgacctggggtgtggacgcggcgggtggtcatattactgcgccggactcaagaaagtgaccgaagtaaagggctatacgaaaggtgggttaggacacgaggatccgatcccaatggcgacctacggctggaacctggtgaaacttctggctggcaaagacgttttctttatgcctcccgaaaagtgtgatacactactctgcgacataggggagtccagtccaaatcccactattgaagagggacgaaccctgagagtgttgaagatggtcgagccttggctgaggggtaaccagttctgtatcaaaattctcaatccgtacatgcccagcgtggtcgaaacacttgagcaaatgcagcggaagcatggcgggatgctggtgcgcaacccattatctagaaattccactcacgaaatgtattgggtttcatgcggaaccggcaacatcgtaagcgcagtgaacatgacatcgaggatgctgttgaatcgatttaccatggcccaccggaaacctacttacgagcgtgatgtcgacctcggtgctgggacgagacatgtggccgttgagcccgaagtggcaaacctggatataatcggacagcgcattgagaatatcaagaacgaacacaaatctacatggcattatgacgaggataatccttacaagacctgggcctatcacggcagttacgaagtcaagccatccggcagcgcttcatccatggtgaacggggtagtgaggctacttactaaaccctgggacgttattcctatggtcacccaaatcgcgatgacagacacgaccccattcggacagcagcgggtgtttaaggagaaagtggatactagaacaccccgcgccaagaggggtaccactcagattatggaggtcacagcaaaatggctgtggggcttcctctctcgaaataagaagccgcggatctgtaccagagaagagtttacaaggaaagttcgcagcaacgctgccataggggcagtgttcgtagacgaaaatcaatggaacagtgccaaggaggctgtggaagatgagcgtttttgggacctggtccaccgggagagagaattgcataaacagggaaagtgcgccacttgcgtgtataatatgatgggcaaaagggagaagaagctgggtgagttcgggaaagcgaagggatcccgcgcaatttggtacatgtggctcggcgcccgattccttgagtttgaagctctgggcttcatgaacgaggatcactggtttagccgggaaaattctttatcaggggttgaaggagagggtctgcataaattgggctacatcctcagagacatcagtaagattcctgggggaaacatgtatgccgatgacaccgcaggctgggatacgaggataaccgaagacgatctgcagaatgaggctaaaatcacagagattatggaaccagagcacgccctacttgctacttccatcttcaagctgacctaccagaacaaagtggtccgcgtgcaaagacccgccaagaacggtacagtaatggacgttattagccggagggatcagcgtgggtctggacaggtgggcacttatggcctcaatacctttacgaacatggaagtccagctgatccgacaaatggagtcggaagggatattcttgccttcagagttagagacaccaaatctggcagaacgcgtgctcgactggcttgagaagcatggagcggaaagactgaaacggatggccatcagcggtgacgattgtgtggtcaagcccattgacgataggtttgctaccgccctaactgcactgaacgacatgggcaaagttcgcaaggatatcccgcagtgggagccttccaaagggtggaatgactggcaacaggtgcccttctgcagtcaccactttcatcaactcattatgaaggatggaagagaaatcgtagtgccatgtcggaaccaggacgagttggtcggcagggctcgagtgtctcagggtgccgggtggagcctgcgtgagacagcatgccttggaaagtcctacgcccaaatgtggcagctgatgtatttccacagacgcgatctccggttagcggctaatgccatatgttcagcagttcctgtggactgggtccccaccagtaggactacctggtctattcatgcccaccaccagtggatgacaacggaagatatgctgagcgtgtggaacagagtatggatcgaggaaaatccatggatggaggacaaaacccatgtttcctcatgggaagaggtgccctacttgggcaagcgcgaggaccagtggtgcggcagcctgatcgggctcactgctcgggccacatgggcaaccaacattcaagtcgctataaatcaggtgaggcgacttatcggaaacgaaaattatctggattacatgacttctatgaaaagatttaagaacgagtccgaccctgaaggtgccctatggtga

SEQ ID NO: 13361 - RNA, 9879 nt, synthetic construct
  misc_feature 1..9879: note = derived and/or modified CDS sequence (opt3) from DENV-1__GQ868531__SS-prME
  source 1..9879: mol_type = other RNA
agcgtgaccatgctgctcatgcttctgccaacagcattggctttccacttaactacgagaggaggggaacctcatatgatagtctccaagcaggaaaggggaaaatctctgttgtttaagacctcagccggtgttaacatgtgcacactcattgccatggacctgggcgaactttgtgaagatactatgacctacaaatgcccacaaataacagaggcggaaccggacgatgtggactgttggtgcaatgctaccgatacttgggtaacatatgggacctgtagtcagacgggagagcaccggcgcgacaagcgaagcgtggccctggcaccccatgtcggcttgggtctcgagactcgtaccgaaacatggatgtcctctgagggggcctggaaacagatccagagagtggaaacttgggctctgaggcaccctggattcaccgttattgcactgtttctcgcccatgctatcggcacatcgattacccaaaagggcatcatattcatcttactgatgcttgtgacgccatcaatggccatgcggtgcgtcgggattggaaaccgcgattttgtggagggtttgagcggcgcgacttgggtagacgttgtgctggagcacgggagttgtgtcacaaccatggcaaagaataaacccactctagatatcgaactcctgaagacagaggtgaccaaccctgccattcttagaaaactgtgcatcgaagctaagatatccaatacgaccacagactctaggtgtccaactcagggagaggccaccttggtggaagaacaggatgcaaacttcgtctgccggcgcacatttgttgaccgaggctggggtaatgggtgtggactcttcggcaaaggcagcctgttaacttgcgctaagtttaagtgcgtgaccaaactggaggggaagattgtacagtacgaaaacctcaaatattccgtgatcgtcacagtgcacaccggagatcaacatcaggttggtaatgagactacggaacacggcacaattgccaccatcactccccaggcgcctacctcagagatccagcttacagactacggggccctgaccttggactgtagtccaagaactggactagatttcaacgaaatggtgctgctcacaatgaaggagaaaagctggctggtccataagcaatggtttcttgacctgccgttgccctggacgtctggcgcatccacctcacaggagacttggaataggcaggatctcctggtgacattcaaaaccgctcacgccaagaagcaagaagtagttgtgttaggtagccaggagggggctatgcacacagccctgactggcgcaaccgaaattcagacgagtggaaccacaactatatttgccggccatctaaaatgccggctcaagatggacaaactgacccttaaggggacatcttatgtcatgtgtactggatccttcaaattggagaaggaagtggctgagacccagcacggtacggtcctggtgcaagttaagtacgagggcacagatgcgccttgcaaaatcccattcagcacccaggacgaaaagggggtgactcagaacggacgtctcattacagcaaatcccatcgtaaccgataaagagaagcctgtcaacatagaaactgagccaccctttggcgagtcgtatattgtggttggtgccggggaaaaagctctgaaactttcttggttcaagaaaggctcctcaatcggaaagatgtttgaggccaccgcacgcggcgccagaaggatggctatcctgggggacacagcctgggatttcggaagtattggtggcgtgtttacgagcgtcgggaaattggtgcatcaggtattcggaaccgcatacggcgtgctcttttccggtgtttcttggactatgaagatcgggattggcatactgttaacatggctgggactaaatagccggtcaaccagtctctccatgacatgtatcgcggtcggcatggtgactctgtaccttggggtgatggtccaagctgacagcggatgcgttattaactggaaaggccgagaattgaagtgtggttctgggatcttcgtgaccaacgaggtgcacacgtggacagaacagtataagtttcaggccgattcaccgaaacgcctgagtgcagccatcggaaaggcttgggaggagggcgtatgcggtattagaagcgccaccaggctcgaaaatataatgtggaaacagatctccaacgagctgaatcatattttactggaaaacgacatgaagttcactgtcgtggttggcgacgcaaatgggatccttgctcaaggcaagaagatgattcggcctcagcccatggagcacaaatactcttggaagtcgtggggcaaggccaaaatcataggggcggatatccagaacaccacatttattatcgacggaccagatactcctgaatgtcccgacaatcagcgcgcctggaacatttgggaggtggaggattatggcttcggtatctttaccacaaatatatggttgaagctcagagacagctacacgcaaatgtgcgatcacaggctgatgtccgctgcaattaaagactcaaaggccgtccatgctgatatggggtattggatcgaaagtgagaaaaacgaaacctggaagctagcccgtgcatctttcattgaggtgaagacttgtacatggccaaaaagccacaccctgtggtccaatggagttctcgaatcagagatgatcatacccaagatctacggcggtcctattagccagcataactatcggccaggctacttcactcagacagcggggccgtggcacctgggaaaacttgagttggactttgatctgtgcgaaggcaccacggtggtagtcgacgagcactgcgggaatcgaggaccctctttaagaactaccacagtgaccggcaagatcattcatgaatggtgttgcaggtcctgtactctccctccactgcgcttccggggtgaggatgggtgctggtacggaatggagatcagacccgtgaaagaaaaggaggaaaaccttgtcaggagtatggttagcgccggctctggtgaggtggactccttttcactgggcatattgtgtgtaagtattatgatcgaagaggtgatgcgcagccgatggtcgcggaagatgctcatgacagggaccctggctgtcttcctactgctcgtgatgggacaactgacatggaatgaccttatccgtttgtgcattatggttggcgccaacgcatccgatagaatggggatgggaactacctatctggctttaatggccacgtttaaaatgaggcctatgttcgcagtgggcctcctgtttcgccggcttacatctagagaggtcctgctactcaccatcggtctgagcttggtggcctcagttgaactgccaaacagtttagaggaactcggggacggactggctatgggcattatgatgcttaagctgttgactgagttccagccccaccagctctggaccacactgctatccctgacttttataaaaaccacgctttctctcgattacgcgtggaagacaaccgccatggcactgagcatcgtgtccttgttcccgctgtgtttatcaactacaagccagaaaaccacttggctccctgtcctgcttggcagttttgggtgcaagccactgacaatgttcttgattaccgaaaataagatctggggaaggaaatcttggcccctcaacgagggtattatggctatcggcatagtatccatcctgctaagctcgctgcttaagaatgacgtgcctctcgccgggcccctgattgccggaggcatgttgatcgcttgttatgttatttcaggttctagtgcagatttatccctggagaaagccgcggaagtgagctgggagcaagaagctgagcattctgggacgagccacaacatcctcgtcgaagtgcaggacgatggaactatgaagataaaagacgaggagcgagatgacaccctgacaattcttctgaaggccaccttgctagcagtatccggcgtgtacccaatgtcaatccctgccacactgtttgtctggtatttctggcagaaaaagaagcagcgcagtggcgttctctgggatactcccagcccaccggaagtggagcgggctgtgctggacgatgggatctacaggattcttcaacgaggattactgggtcgttctcaggtcggcgtgggggttttccaggacggagtatttcataccatgtggcacgtgacgcgcggcgcagtcctcatgtatcagggtaaacggttggaaccttcctgggcctcagtgaagaaagacctgataagttacgggggaggctggagattccaaggcagctggaatacaggggaggaggttcaggtgatcgcggtcgaacccggaaagaaccccaagaatgtgcagactacccccggtacatttaagacccctgagggcgaagtaggggctattgccctcgatttcaagccaggaacttccggctctcccatcgtcaacagggagggtaaaattgtggggctgtacggaaatggcgttgtgaccacatcgggcacgtatgtcagcgcaatcgcccaagctaaggcctcacaggaagggcctcttccggagatagaggacgaagtgtttaaaaagcgaaacctgactatcatggatttgcacccaggatccggtaaaacccggcgctacctacccgcaattgttagagaggctatcaagaggaagctgcggacactcattttagcccctacccgagtggtcgcgagtgaaatggccgaggcactgaaaggcatgccaatcagatatcagactacagctgtgaagtctgaacataccgggcgcgagatagtagaccttatgtgccacgccacgttcactatgaggctgctcagccccgtgcgtgttcctaattacaacatgattatcatggatgaggctcattttacagacccggcatccatcgccgcccggggatatatttcaaccagagtcggcatgggtgaagctgcggcaatcttcatgaccgccactcccccagggtctgtggaggcttttcctcagagcaatgccgtgatacaagatgaagagagggacattcccgaacgcagttggaactccggatacgattggatcacagacttcccaggcaaaaccgtctggtttgtacctagcattaagtctggcaatgatatcgcaaactgtttgagaaagaacgggaagagagtgatacagctgtcacggaagacattcgacactgagtatcagaaaacgaagaataacgactgggattacgttgtgaccacagacatttccgagatgggagccaatttcagggctgatcgcgtcatcgacccccgtagatgcctcaaaccagtgatcctgaaggatggtccggaacgggttattcttgcgggccctatgcccgtgactgtcgccagtgcagctcagaggcgcgggcgaatcggaagaaaccaaaataaagagggcgaccagtacgtgtatatgggtcagccactaaacaatgatgaagaccacgcccattggaccgaggcaaagatgctgttggataacattaatacacccgaggggataatccctgccttatttgaaccagagcgggaaaagagcgctgccattgacggcgagtacaggctgcgcggagaagcgagaaaaaccttcgtagagctcatgaggcggggcgatctgcccgtgtggctttcgtataaggttgcatctgaggggtttcagtactccgaccgtcgctggtgcttcgatggagaacgaaacaatcaagtcctggaggaaaacatggacgtggagatctggactaaagaaggtgagagaaagaaactcaggcctcggtggttggacgcccgcacgtatagcgatccgctggctctaagagagtttaaggagttcgccgctggcaggcggtcagtgagtggggacctgatcctcgagattggaaaacttccacagcacctgaccttacgagcacagaatgccttggataacctggtcatgctccacaattctgaacagggcggtaaggcttacagacatgccatggaggaactgcccgacacaatagagactcttatgctgctcgcattgatcgcggttctgaccgggggcgtgacattatttttcctatccggaaagggcctggggaaaaccagcattggactcctttgtgtaactgcctcaagtgctctgttgtggatggccagcgtggagcctcactggatcgcagcttccattatcctggaatttttcctcatggtcctgcttatacccgagccagatcgccaaaggacacctcaggacaaccagctcgcctatgtggttatcggtctgttgtttatgattctgacggtggcagccaacgaaatgggcttactagagaccactaagaaagatctggggatcggacatgtcgctgcggagaatcaccaacacgccacaatgctcgacgtagatcttcggcccgcatctgcttggaccctgtacgccgtggccaccacagttattactccaatgatgcgtcatacgatcgaaaacaccacagcaaatatcagcttgactgctattgccaaccaggcggctatcctgatgggcctcgacaagggttggcctatttccaaaatggatatcggggtgccgctgcttgccttaggctgctactcacaggtcaatcccctgaccctcacagcagccgtgttgatgctggtcgctcactatgcaataatcggaccaggcctacaggccaaggcgaccagagaggctcaaaagaggactgccgcagggattatgaaaaaccctacggtggacggaatcgttgccattgatctggaccccgtggtatacgacgctaagttcgaaaaacagctcggccagatcatgcttctgatattgtgtacatctcagattctgctcatgcgcaccacttgggccctgtgcgagagtatcaccttagcaacaggtccacttactaccctgtgggaagggtcgcctggaaagttttggaatacaacgatcgctgtgagcatggccaacattttccggggctcctatctcgcgggtgccggcctagcattctctctgatgaaatcactagggggaggccgaagagggaccggagctcaaggcgagactctgggtgagaagtggaagaggcagctcaatcagcttagcaaatccgaatttaacacatacaagcgcagtgggatcatggaggtcgatcggtctgaagccaaagagggactgaagagaggcgaaaccactaaacatgcagttagccgtggtacagctaagttgaggtggttcgtggagcggaatctggtcaagcccgagggcaaagtgatagacctcgggtgtggacgcggcgggtggtcatattactgcgccggattaaagaaagtaaccgaagtgaagggctatacgaaaggtgggccgggacacgaggaaccaattcctatggccacctacggctggaacctggttaaacttcattccggcaaagatgtgtttttcatgcccccagagaagtgtgacacactgctatgcgatatcggggaaagtagccccaatcctactattgaggagggacgaaccctcagagtcctgaagatggtggaaccgtggttgaggggtaaccagttttgtatcaaaatactgaatccctacatgccatctgtcgtggaggcgctcgaacaaatgcagcggaagcacggcgggatgcttgttcgcaaccctctgtccagaaattcaacacacgagatgtattgggtaagctgcggaactggcaacatcgtgtcggctgtcaacatgacctctaggatgttactgaatcgattcacaatggcacatcggaaacccacctacgagcgtgacgtggatttgggtgccgggactagacacgttgctgtggaacctgaggtcgccaacctcgacattatcggacagcgcattgaaaatatcaagaacgagcataaaagtacgtggcactatgatgaagacaatccatacaagacatgggcatatcacggctcctacgaggtgaagcccagcggctcagcctcctctatggtaaacggggtggttaggctgctaaccaaaccttgggatgtcattccaatggtgactcaaatcgctatgaccgacacaacgccctttggacagcagcgggtgttcaaggagaaagtcgacaccagaactccgcgcgcgaagaggggtacaacccagataatggaagttactgccaaatggctttggggctttctgagccgaaataagaagcctcggatttgtacaagagaggagttcaccaggaaagtgcgcagtaacgcagctatcggggccgtatttgtggatgagaatcaatggaactccgcaaaggaagccgtcgaggacgagcgtttctgggatctcgtgcatcgggaaagagagctgcacaaacagggaaagtgcgctacatgcgtttataatatgatgggcaaaagggaaaagaagttgggtgagtttgggaaagccaagggaagccgcgcgatctggtacatgtggctgggcgcacgattcctcgagttcgaggcccttggctttatgaacgaggaccattggttctctcgggaaaattcactgagtggggtggagggagaaggtttacacaaactgggctacattttgagagatatatccaagatcccagggggaaacatgtatgctgacgatactgccggctgggacaccaggattacggaggatgacctccagaatgaggcaaaaatcaccgaaattatggagcccgaacatgctctgctagccacaagcatctttaaacttacttaccagaacaaagtcgtgcgcgtacaaagacctgctaagaacggtaccgttatggatgtgatatctcggagggaccagcgtgggtcgggacaggtcggcacatatggcctgaatactttcaccaacatggaggtgcagctcatccgacaaatggaatcagaggggatttttctgccaagcgagttggaaacgcccaatttagccgagcgcgtgctggattggctcgaaaagcacggagcagagagacttaaacggatggcgatctccggtgacgactgtgtcgttaagccgattgatgacaggttcgccacagctctgaccgccctaaacgatatgggcaaagtgcgcaaggacatccctcagtgggaacccagtaaagggtggaatgattggcagcaggtaccattttgctctcaccatttccaccaactgataatgaaggacggaagagagattgtggtcccttgtcggaaccaggatgagctcgtgggcagggcacgagttagccagggtgctgggtggtccttgcgtgaaactgcctgcctgggaaagtcatacgcacaaatgtggcagcttatgtattttcatagacgcgacctgcggctcgccgcgaatgctatcagttctgccgtgcccgtcgattgggtgccaacaagcaggaccacttggtccatccacgcacaccatcagtggatgaccacagaggacatgttatcagtatggaacagagtttggattgaagagaatccctggatggaagataaaacgcacgtgagctcttgggaggaggtcccttacctgggcaagcgcgaagaccagtggtgtggctccttgatagggctgaccgcccgggctacttgggccacaaacatccaagtggcaattaatcaggttaggcgactcatcggaaacgagaattatcttgactacatgaccagtatgaaaagattcaagaacgaaagcgatccagagggtgctctgtggtga

SEQ ID NO: 13362 - RNA, 9879 nt, synthetic construct
  misc_feature 1..9879: note = derived and/or modified CDS sequence (opt3) from DENV-1__GU131983__SS-prME
  source 1..9879: mol_type = other RNA
agcgtgaccatgctgctcatgcttctgcccacagccttggctttccacttaactacgagaggcggggagcctcatatgatcgtctccaagcaggaaaggggaaaatctctgctatttaagacctcagcaggtgttaacatgtgcacactcattgccatggacctgggcgagctttgtgaagatactatgacctacaaatgcccacaaataacagaggcggaaccggacgatgtggactgttggtgcaatgctaccgatacttgggtaacatatgggacctgtagtcagacgggagagcaccggcgcgacaagcgaagcgtggccctggcaccccatgtcggcttgggtctcgagactcgtaccgaaacatggatgtcctctgagggggcctggaaacagatccagagagtggaaacttgggctctgaggcaccctggattcaccgttattgcactgtttctcgcccatgctatcggcacatcgattacccaaaagggcatcatattcatcttactgatgcttgtgacgccatcaatggccatgcggtgcgtcgggattggaaaccgcgattttgtggagggtttgagcggcgcgacttgggtagacgttgtgctggagcacgggagttgtgtcacaaccatggcaaagaataaacccactctagatatcgaactcctgaagacagaggtgaccaaccctgccattcttagaaaactgtgcatcgaagctaagatatccaatacgaccacagactctaggtgtccaactcagggagaggccaccttggtggaagagcaggatgcaaacttcgtctgccggcgcacatttgttgaccgaggctggggtaatgggtgtggactcttcggcaaaggcagcctgttaacttgcgctaagtttaagtgcgtgaccaaactggaggggaagattgtacagtacgaaaacctcaaatattccgtgatcgtcacagtgcacaccggagatcaacatcaggttggtaatgagactacggaacacggcacaattgccaccatcactccccaggcgcctacctcagagatccagcttacagactacggggccctgaccttggactgtagtccaagaactggactagatttcaacgaaatggtgctgctcacaatgaaggagaaaagctggctggtccataagcaatggtttcttgacctgccgttgccctggacgtctggcgcatccacctcacaggagacttggaataggcaggatctcctggtgacattcaaaaccgctcacgccaagaagcaagaagtagttgtgttaggtagccaggagggggctatgcacacagccctgactggcgcaaccgaaattcagacgagtggaaccacaactatatttgccggccatctaaaatgccggctcaagatggacaaactgacccttaaggggacatcttatgtcatgtgtactggatccttcaaattggagaaggaagtggctgagacccagcacggtacggtcctggtgcaagttaagtacgagggcacagatgcgccttgcaaaatcccattcagcacccaggacgaaaagggggtgactcagaacggacgtctcattacagcaaatcccatcgtaaccgataaagagaagcctgtcaacatagaaactgagccaccctttggcgagtcgtatattgtggttggtgccggggaaaaagctctgaagctttcttggttcaagaaaggctcctcaatcggaaagatgtttgaggccaccgcacgcggcgccagaaggatggctatcctgggggacacagcctgggatttcggaagtattggtggcgtgtttacgagcgtcgggaaattggtgcatcaggtattcggaaccgcatacggcgtgctcttttccggtgtttcttggactatgaagatcgggattggcatactgttaacatggctgggactaaatagccggtcaaccagtctctccatgacatgtatcgcggtcggcatggtgactctgtaccttggggtgatggtccaagctgacagcggatgcgttattaactggaaaggccgagaattgaagtgtggttctgggatcttcgtgaccaacgaggtgcacacgtggacagaacagtataagtttcaggccgattcaccgaaacgcctgagtgcagccatcggaaaggcttgggaggagggcgtatgcggtattagaagcgccaccaggctcgaaaatataatgtggaaacagatctccaacgagctgaatcatattttactggaaaacgacatgaagttcactgtcgtggttggcgacgcaaatgggatccttgctcaaggaaaaaagatgattcggcctcagcccatggagcacaaatactcttggaagtcgtggggcaaggccaaaatcataggggcggatatccagaacaccacatttattatcgacggaccagatactcctgaatgtcccgacaatcagcgcgcctggaacatttgggaggtggaggattatggcttcggtatctttaccacaaatatatggttgaagctcagagacagctacacgcaaatgtgcgatcacaggctgatgtccgctgcaattaaagactcaaaggccgtccatgctgatatggggtattggatcgaaagtgagaaaaacgaaacctggaagctagcccgtgcatctttcattgaggtgaagacttgtacatggccaaaaagccacaccctgtggtccaatggagttctcgaatcagagatgatcatacccaagatctacggcggtcctattagccagcataactatcggccaggctacttcactcagacagcggggccgtggcacctgggaaaacttgagttggactttgatctgtgcgaaggcaccacggtggtagtcgacgagcactgcgggaatcgaggaccctctttaagaactaccacagtgaccggcaagatcattcatgaatggtgttgcaggtcctgtactctccctccactgcgcttccggggtgaggatgggtgctggtacggaatggagatcagacccgtgaaagaaaaggaggaaaaccttgtcaggagtatggttagcgccggctctggtgaggtggactccttttcactgggcatattgtgtgctagtattatgatcgaagaggtaatgcgcagccgatggtcgcggaagatgctcatgatcgggacactggccgtgttcctactgctcgtcatgggacaactgacctggaatgaccttattcgtttgtgcatcatggtgggcgcaaacgcttccgatagaatggggatgggaacaacttatctggccttaatggcaacctttaaaatgaggcctatgttcgccgttggcctcctgtttcgccggcttacgtctagagaggtgctgctactcacaattggtctgagcttggtcgcttcagtggaactgccaaacagtttagaggaactcggggacggactggcgatgggcataatgatgcttaagctgttgaccgagttccagccccaccagctctggactaccctgctatccctgacatttatcaaaactaccctttctctcgattacgcctggaagacgacagcaatggctctgagcattgtttccttgttcccgctgtgtttatcaaccactagccagaaaacaacctggctccctgtgctgcttggcagttttgggtgcaagccactgactatgttcttgatcacagaaaataagatttggggaaggaaatcttggcccctcaacgagggtatcatggccataggcatcgtctccattctgctaagctcgctgcttaagaatgacgtacctctcgccgggcccctgatcgctggaggcatgttgattgcatgttatgtgatctcaggttctagtgccgatttatccctggagaaagcggctgaagttagctgggagcaagaagccgagcattctgggaccagccacaacatactcgtggaagtccaggacgatggaacgatgaagattaaagacgaggagcgagatgacactctgaccatccttctgaaggcaacattgctagccgtgtccggcgtatacccaatgtcaatccctgctaccctgtttgtgtggtatttctggcagaaaaagaagcagcgcagtggcgtcctctgggatacacccagcccaccggaagttgagcgggcagtgctggacgatgggatttacagaatacttcaaaggggattactgggtcgttctcaggtgggcgtcggggtgttccaggacggagtttttcatactatgtggcacgtaacccgcggcgccgtgctcatgtatcagggtaaacggttggaaccttcctgggcgtcagtcaagaaagacctgatcagttacgggggaggctggagattccaaggcagctggaatacgggggaggaggtgcaggttattgctgtggaacccggaaagaacccaaaaaatgtccagacaactcccggtacctttaagacacctgagggcgaagtgggggccatcgcactcgatttcaagccaggaacctccggctctcccattgtaaacagggagggtaaaatcgtcgggctgtacggaaatggcgtggttactacctcgggcacatatgtgagcgccatagctcaagccaaggcatcacaggaagggcctcttccggagatcgaggacgaagtctttaaaaagcgaaacctgacgattatggatttgcacccaggatccggtaaaactcggcgctacctacccgctatcgtgagagaggccattaagaggaagctgcggaccctcatcttagcgcctacacgagttgtggccagtgaaatggcagaggctctgaaaggcatgccaataagatatcagaccactgccgtcaagtctgaacatacagggcgcgagattgtggaccttatgtgccacgctaccttcacgatgaggctgctcagccccgtacgtgtgcctaattacaacatgatcatcatggatgaggcacattttactgacccggcctccattgccgctcggggatatatctcaacaagagttggcatgggtgaagcggcagccatattcatgaccgctacccccccagggtctgtcgaggcctttcctcagagcaatgcagtgattcaagatgaagagagggacatccccgaacgcagttggaactccggatacgattggattactgacttcccaggcaaaacagtgtggtttgtccctagcatcaagtctggcaatgatatagccaactgtttgcgaaaaaacgggaagagagtaattcagctgtcacggaagaccttcgacacagagtatcagaaaactaagaataacgactgggattacgtggttacgaccgacatctccgagatgggagctaatttcagggcggatcgcgtgatcgacccccgtagatgcctcaaaccagtcattctgaaggatggtccggaacgggtgatccttgccggccctatgcccgttacagtggcaagtgctgcccagaggcgcgggcgaattggaagaaaccaaaataaagagggcgaccagtacgtctatatgggtcagccactaaacaatgatgaagaccacgcacattggactgaggccaagatgctgttggataacataaatacccccgaggggatcattcctgctttatttgaaccagagcgggaaaagagcgccgcgatcgacggcgagtacaggctgcgcggagaagcaagaaaaacattcgtggagctcatgaggcggggcgatctgcccgtatggctttcgtataaggtggcctctgaggggtttcagtactccgaccgtcgctggtgcttcgatggagaacgaaacaatcaagttctggaggaaaacatggacgtcgagatctggaccaaagaaggtgagagaaagaaactcaggcctcggtggttggacgctcgcacttatagcgatccgctggccctaagagagtttaaggaattcgctgcaggcaggcggtcagtgagtggggacctgattctcgagataggaaaacttccacagcacctgacgttacgagcccagaatgctttggataacctggtgatgctccacaattctgaacagggcggtaaggcctacagacatgcaatggaggaactgcccgacaccatcgagacacttatgctgctcgcgttgattgccgtcctgactgggggcgttaccttatttttcctatccggaaagggcctggggaaaacaagcatcggactcctttgtgtgaccgcttcaagtgccctgttgtggatggcaagcgtagagcctcactggattgctgcctccatcatactggaatttttcctcatggtgctgcttatccccgagccagatcgccaaaggactcctcaggacaaccagctcgcatatgtcgtgattggtctgttgtttatgatcctgacagttgccgctaacgaaatgggcttactagagacgaccaagaaagatctggggattggacatgtggcggccgagaatcaccaacacgcaactatgctcgacgtcgatcttcggcccgcttctgcctggacactgtacgccgtagcaaccaccgtgatcacaccaatgatgcgtcatactatagaaaacacgaccgctaatattagcttgacagccatcgcgaaccaggctgccattctgatgggcctcgacaagggttggcctatctccaaaatggatataggggttccgctgcttgcattaggctgctactcacaggtgaatcccctgactctcaccgccgctgtcttgatgctggtggcacactatgccatcattggaccaggcctacaggcgaaggctacaagagaggcccaaaagaggaccgcagccgggatcatgaaaaaccctactgtcgacggaattgtggctatcgatctggaccccgttgtgtacgacgccaagttcgaaaaacagctcggccagataatgcttctgattttgtgtacgtctcagatcctgctcatgcgcacaacctgggcactgtgcgagagtatcactttagctaccggtccacttacaactctgtgggaagggtcgcctggaaagttttggaataccacaattgccgtaagcatggcgaacatcttccggggctcctatctcgccggtgcaggcctagctttctctctgatgaaatcattggggggaggccgaagagggacgggagcccaaggcgagaccctgggtgagaagtggaagaggcagctcaatcagcttagcaaatccgaatttaacacttacaagcgcagtgggataatggaggtggatcggtctgaagcaaaagagggactgaagagaggcgaaacaaccaaacatgctgtcagccgtggtactgccaagttgaggtggttcgttgagcggaatctggtgaagcccgagggcaaagtcattgacctcgggtgtggacgcggcgggtggtcatattactgcgccggattaaagaaagtgacagaagtaaagggctataccaaaggtgggccgggacacgaggaaccaatccctatggcgacgtacggctggaacctggtgaagcttcattccggcaaagatgtttttttcatgcccccagagaagtgtgacaccctgctatgcgatattggggaaagtagccccaatcctacaatcgaggagggacgaactctcagagtgctgaagatggtcgaaccgtggttgaggggtaaccagttttgtataaaaatcctgaatccctacatgccatctgtggtcgagaccctcgaacaaatgcagcggaagcacggcgggatgcttgtgcgcaaccctctgtccagaaattcaacacacgagatgtattgggttagctgcggaactggcaacattgtatcggctgtgaacatgacctctaggatgttactgaatcgattcacaatggcacatcggaaacccacctacgagcgtgacgtcgatttgggtgccgggactagacacgtggctgttgaacctgaggtggccaacctcgacatcattggacagcgcatcgaaaatattaagaacgagcataaaagtacgtggcactatgatgaagacaatccatacaagacatgggcatatcacggctcctacgaggtcaagcccagcggctcagcctcctctatggtgaacggggtagtgaggctgctaaccaaaccttgggatgttatcccaatggtcactcaaatagctatgaccgacacaacgccctttggacagcagcgggtgttcaaggagaaagtggacaccagaactccgcgcgcgaagaggggtacaacccagattatggaagtcactgccaaatggctttggggctttctgagccgaaataagaagcctcggatctgtacaagagaggaattcaccaggaaagttcgcagtaacgcagctatcggggccgtgtttgtagatgagaatcaatggaactccgcaaaggaagccgtggaggacgagcgtttctgggatctcgtccatcgggaaagagagctgcacaaacagggaaagtgcgctacatgcgtgtataatatgatgggcaaaagggaaaagaagttgggtgagtttgggaaagccaagggaagccgcgcgatttggtacatgtggctgggcgcacgattcctcgaattcgaggcccttggctttatgaacgaggaccattggttctctcgggaaaattcactgagtggggttgagggagaaggtttacacaaactgggctacatattgagagatatctccaagattccagggggaaacatgtatgctgacgatactgccggctgggacaccaggatcacggaggatgacctccagaatgaggcaaaaattaccgaaatcatggagcccgaacatgctctgctagccacaagcatatttaagcttacttaccagaacaaagtggtccgcgtgcaaagacctgctaagaacggtaccgtaatggatgttatctctcggagggaccagcgtgggtcgggacaggtgggcacatatggcctgaatactttcaccaacatggaggtccagctcattcgacaaatggaatcagaggagatctttctgccaagcgaattggagacgcccaatttagccgaacgcgtgctggattggctcgagaagcacggggcagaaagacttaaacggatggcgatttccggagacgactgtgtggtcaagccgatcgatgacaggttcgccacagctctgaccgccctaaacgatatgggtaaagttcgcaaggacatacctcagtgggagcccagtaaaggctggaatgattggcagcaggtgccattttgctctcaccatttccaccaactgattatgaaggacgggagagagatcgtagtgccttgtcggaaccaggatgaactcgtcggaagggcacgagtgagccagggcgctggttggtccttgcgtgagactgcctgcctggggaagtcatacgcacaaatgtggcagcttatgtattttcatagacgcgacctgcggctcgccgcgaatgctatctgtagtgccgttcccgtggattgggtcccaacatctaggaccacttggagcattcacgcacaccatcagtggatgaccacagaagacatgttatccgtgtggaacagagtatggatagaggaaaatccctggatggaggataaaacgcacgtttcaagctgggaggaagtgccttacctgggaaagcgcgaggaccagtggtgcggctctttgatcggcctgaccgcccgggctacttgggccacaaacattcaagtcgcaatcaatcaggtgaggcgactcattgggaacgaaaattatcttgactacatgacctccatgaaaagattcaagaacgagagtgatccagagggagctctgtggtga

SEQ ID NO: 13363 - RNA, 9879 nt, synthetic construct
  misc_feature 1..9879: note = derived and/or modified CDS sequence (opt3) from DENV-1__GQ868532__SS-prME
  source 1..9879: mol_type = other RNA
agcgtgaccatgctgctcatgcttctgcccacagccttggctttccacttaactacgcgaggaggggaacctcatatgatcgtctccaagcaggaaaggggaaaatctctgctgtttaagacctcagctggtgttaacatgtgcacactcattgccatggacctgggcgaactttgtgaagatactatgacctacaaatgcccacaaataacagaggcggaaccggacgatgtggactgttggtgcaatgctaccgatacttgggtaacatatgggacctgtagtcagacgggagagcaccggcgcgacaagcgaagcgtggccctggcaccccatgtcggcttgggtctcgagactcgtaccgaaacatggatgtcctctgagggggcctggaaacagatccagagagtggaaacttgggctctgaggcaccctggattcaccgttattgcactgtttctcgcccatgctatcggcacatcgattacccaaaagggcatcatattcatcttactgatgcttgtgacgccatcaatggccatgcggtgcgtcgggattggaaaccgcgattttgtggagggtttgagcggcgcgacttgggttgacgttgtgctggagcacgggagttgtgtcacaaccatggcaaagaataaacccactctagatatcgaactcctgaagacagaggtgaccaaccctgccattcttagaaaactgtgcatcgaagctaagatatccaatacgaccacagactctaggtgtccaactcagggagaggccaccttggtggaagaacaggatgcaaacttcgtctgccggcgcacatttgttgaccgaggctggggtaatgggtgtggactcttcggcaaaggcagcctgttaacttgcgctaagtttaagtgcgtgaccaaactggaggggaagattgtacagtacgaaaacctcaaatattccgtgatcgtcacagtgcacaccggagatcaacatcaggttggtaatgagactacggaacacggcacaattgccaccatcactccccaggcgcctacctcagagatccagcttacagactacggggccctgaccttggactgtagtccaagaactggactagatttcaacgaaatggtgctgctcacaatgaaggagaaaagctggctggtccataagcaatggtttcttgacctgccgttgccctggacgtctggcgcatccacctcacaggagacttggaataggcaggatctcctggtgacattcaaaaccgctcacgccaagaagcaagaagtagttgtgttaggtagccaggagggggctatgcacacagccctgactggcgcaaccgaaattcagacgagtggaaccacaactatatttgccggccatctaaaatgccggctcaagatggacaaactgacccttaaggggacatcttatgtcatgtgtactggatccttcaaattggagaaggaagtggctgagacccagcacggtacggtcctggtgcaagttaagtacgagggcacagatgcgccttgcaaaatcccattcagcacccaggacgaaaagggggtgactcagaacggacgtctcattacagcaaatcccatcgtaaccgataaagagaagcctgtcaacatagaaactgagccaccctttggcgagtcgtatattgtggttggtgccggggaaaaagctctgaaactttcttggttcaagaaaggctcctcaatcggaaagatgtttgaggccaccgcacgcggcgccagaaggatggctatcctgggggacacagcctgggatttcggaagtattggtggcgtgtttacgagcgtcgggaaattggtgcatcaggtattcggaaccgcatacggcgtgctcttttccggtgtttcttggactatgaagatcgggattggcatactgttaacatggctgggactaaatagccggtcaaccagtctctccatgacatgtatcgcggtcggcatggtgactctgtaccttggggtgatggtccaagctgacagcggatgcgttattaactggaaaggccgagaattgaagtgtggttctgggatcttcgtgaccaacgaggtgcacacgtggacagaacagtataagtttcaggccgattcaccgaaacgcctgagtgcagccatcggaaaggcttgggaggagggcgtatgcggtattagaagcgccaccaggctcgaaaatataatgtggaaacagatctccaacgagctgaatcatattttactggaaaacgacatgaagttcactgtcgtggttggcgacgcaaatgggatccttgctcaaggcaagaagatgattcggcctcagcccatggagcacaaatactcttggaagtcgtggggcaaggccaaaatcataggggcggatatccagaacaccacatttattatcgacggaccagatactcctgaatgtcccgacaatcagcgcgcctggaacatttgggaggtggaggattatggcttcggtatctttaccacaaatatatggttgaagctcagagacagctacacgcaaatgtgcgatcacaggctgatgtccgctgcaattaaagactcaaaggccgtccatgctgatatggggtattggatcgaaagtgagaaaaacgaaacctggaagctagcccgtgcatctttcattgaggtgaagacttgtacatggccaaaaagccacaccctgtggtccaatggagttctcgaatcagagatgatcatacccaagatctacggcggtcctattagccagcataactatcggccaggctacttcactcagacagcggggccgtggcacctgggaaaacttgagttggactttgatctgtgcgaaggcaccacggtggtagtcgacgagcactgcgggaatcgaggaccctctttaagaactaccacagtgaccggcaagatcattcatgaatggtgttgcaggtcctgtactctccctccactgcgcttccggggtgaggatgggtgctggtacggaatggagatcagacccgtgaaagaaaaggaggaaaaccttgtcaggagtatggttagcgccggctctggtgaggtggactccttttcactgggcatattgtgtgctagtattatgatcgaagaggtaatgcgcagccgatggtcgcggaagatgctcatgacagggaccctggccgtgttcctactgctcgtcatgggacaactgacatggaatgaccttatccgtttgtgcattatggtgggcgcaaacgcttccgatagaatggggatgggaactacctatctggccttaatggcaacgtttaaaatgaggcctatgttcgccgttggcctcctgtttcgccggcttacatctagagaggtgctgctactcaccatcggtctgagcttggtcgcttcagtggaactgccaaacagtttagaggaactcggggacggactggcgatgggcattatgatgcttaagctgttgactgagttccagccccaccagctctggataaccctgctatccctgacatttatcaaaactaccctttctctcgattacgcctggaagacgacagcaatggctctgagcattgtttccttgttcccgctgtgtttatcaaccactagccagaaaacaacctggctccctgtgctgcttggcagttttgggtgcaagccactgactatgttcttgatcacagaaaataagatttggggaaggaaatcttggcccctcaacgagggtatcatggccataggcatcgtctccattctgctaagctcgctgcttaagaatgacgtacctctcgccgggcccctgatcgctggaggcatgttgattgcatgttatgtgatctcaggtaactctgccgatttaagtctggagaaagcggctgaagtttcctgggagcaagaagccgagcatagcgggacctctcacaatatactcgtggaagtccaggacgatggaacgatgaagattaaagacgaggagcgagatgacactctgaccatccttctgaaggcaacattgctagccgtgagcggcgtatacccaatgtccatccctgctaccctgtttgtgtggtatttctggcagaaaaagaagcagcgctcaggcgtcctctgggatacacccagtccaccggaagttgagcgggcagtgctggacgatgggatttacagaatacttcaaaggggattactgggtcgtagccaggtgggcgtcggggtgttccaggacggagtttttcatactatgtggcacgtaacccgcggcgccgtgctcatgtatcagggtaaacggttggaaccttcttgggcgtccgtcaagaaagacctgatctcatacgggggaggctggagattccaaggcagttggaacacgggggaggaggtgcaggttattgctgtggaacccggaaagaatcccaaaaacgtccagacaatgcccggtacttttaagacccctgagggcgaagtgggggccatcgcactcgatttcaagccaggaacaagcggctcccccattgtaaatagggagggtaaaatcgtcgggctgtacggaaacggcgtggttaccacttctggcacctatgtgtcggccatagctcaagccaaggcaagccaggaagggcctccgccagagatcgaggacgaagtctttaaaaagcgaaatcttacaattatggatctgcaccccggatcaggtaaaacgcggcgctacttgcctgctatggtgagagaggccatcaagaggaagctacggactctgattctcgcgccaacccgagttgtggcctccgaaatggcagaggctttaaaaggcatgcccatcagatatcagacaaccgccgtcaagagtgaacatactgggcgcgagatagtggacctgatgtgccacgctacattcaccatgaggcttctgtctcctgtacgtgtgccgaactacaatatgattatcatggatgaggcacattttacggaccccgccagcatcgccgctcggggatatatttccactagagttggcatgggtgaagcggcagccatcttcatgacagctaccccacctgggtcagtcgaggcctttccccagtctaacgcagtgatacaagatgaagagagggacattccagaacgcagctggaatagtggatacgattggatcaccgacttccctggcaaaactgtgtggtttgtcccctccattaagagcggcaacgatatcgccaactgtctccggaaaaatgggaagagagtaatacagttgtctagaaagacattcgacaccgagtatcagaaaacaaagaacaatgactgggattacgtggttactacggacatttcagagatgggagctaacttcagggcggatcgcgtgatcgacccacgtagatgcctgaaaccggtcatcctcaaggatggtcctgaacgggtgattctggccggccccatgccagttaccgtggcatccgctgcccagaggcgcgggcgaatcggaagaaatcaaaacaaagagggcgaccagtacgtctatatgggtcagccccttaataacgatgaagaccacgcacattggacagaggccaagatgctactggataatattaacactcctgaggggataatcccagctttgtttgaacccgagcgggaaaagagtgccgcgattgacggcgagtacaggttacgcggagaagcaagaaaaaccttcgtggagctgatgaggcggggcgatctccctgtatggctgagctataaggtggcctcggaggggtttcagtactctgaccgtcgctggtgcttcgatggagaacgaaataaccaagttcttgaggaaaatatggacgtcgagatctggacaaaagaaggtgagagaaagaaactgaggccgcggtggctcgacgctcgcacctattccgatccattggccctgagagagtttaaggagttcgctgcaggcaggcggagcgtgtcaggggacctaatcctggagattggaaaactcccccagcaccttactctgcgagcccagaacgctttagataatttggtgatgctgcacaacagtgaacagggcggtaaggcctacagacatgcaatggaggaactccctgacacgatagagaccctgatgcttctgacactcatcgcggtcttgactgggggcgttaccctgtttttcttatctggaaagggcctagggaaaacatccattggactgctctgtgtgaccgccagctcagcacttctgtggatggccagtgtagagccccactggatcgcagctagcattatcttggaatttttcctgatggtgctcctgataccagagcctgatcgccaaaggactccccaggacaaccagcttgcctatgtcgtgatcggtctcctgtttatgattttgacagttgcagccaatgaaatgggcctgttagagacgaccaagaaagatctagggatcggacatgtggctgcggagaaccaccaacacgccactatgctggacgtcgatctccggccagcatccgcttggacactttacgccgtagccaccaccgtgattacacctatgatgcgtcatactatcgaaaatacgaccgcaaacatatctctgacagctattgccaatcaggcggctatcttgatgggcctggacaagggttggccgattagcaaaatggatatcggggttcccctcctggcccttggctgctactcccaggtgaacccattaactctgaccgcagccgtcctcatgttggtggctcactatgcaataatcggacctggcctgcaggccaaggcgacaagagaggctcaaaagaggaccgccgcagggattatgaaaaatcccactgtcgacggaatcgtggccattgatctagacccagttgtgtacgacgctaagttcgaaaaacagctgggccagatcatgctccttatactgtgtacgtcacagattttgctgatgcgcacaacctgggccctctgcgagtctatcactctggcaaccggtcctttaacaactctttgggaagggagtcccggaaagttttggaacaccacaatcgctgtatcgatggccaatattttccggggcagctatctggcgggtgccggcctcgcattctccctaatgaaatctctagggggaggccgaagagggacgggagctcaaggcgagaccttgggtgagaagtggaagaggcagctgaaccagctctcaaaaagcgaatttaatacttacaagcgctccgggatcatggaggtggatcggagtgaagccaaagagggacttaagagaggcgaaacaaccaaacatgcagtctctcgtggtactgctaagctgaggtggttcgttgagcggaacttggtgaagccggagggcaaagtcatagacctggggtgtggacgcggcgggtggagctattactgcgccggactcaagaaagtgacagaagtaaagggctataccaaaggtgggccaggacacgaggaacctattcccatggccacgtacggctggaatttagtgaagctgcattcaggcaaagatgtatttttcatgccacccgagaagtgtgacacccttctgtgcgatatcggggaatccagtcctaacccgacaattgaggagggacgaactctaagagtgctcaagatggtcgaaccctggctgaggggtaatcagttttgtatcaaaatattgaacccatacatgcctaatgtggtcgagaccctggaacaaatgcagcggaagcacggcgggatgctcgtgcgcaacccccttagcagaaactctacacacgagatgtattgggtttcctgcggaactggcaatatcgtatcagcggtgaacatgaccagcaggatgctgttaaatcgattcacaatggctcatcggaaacctacctacgagcgtgacgtcgatctgggtgcagggactagacacgtggccgttgaaccagaggtggctaacttggacattatcggacagcgcattgaaaatatcaagaacgagcataaatcgacgtggcactatgatgaagacaatccctacaagacatgggcctatcacggctcttacgaggtcaagcctagtggctccgcaagctcaatggtgaacggggtagtgaggctcctgaccaaaccatgggatggtattccaatggttactcaaatcgccatgaccgacacaacgccgtttggacagcagcgggtcttcaaggagaaagtggacaccagaactcctcgcgctaagaggggcacaacccagataatggaagtgactgcgaaatggctatgggggtttctttcccgaaataagaagccacggatttgtacaagagaggagttcaccaggaaagtccgctctaacgccgcaatcggagctgtttttgtggatgagaatcaatggaacagcgccaaggaagcagtagaggacgagcgtttctgggatctggtgcatcgggaaagagagctccacaaacagggcaagtgcgccacatgcgtctataatatgatgggtaaaagggaaaagaagctgggggagtttggaaaagctaagggcagtcgcgccatctggtacatgtggttgggcgcgcgattcctggagttcgaggcactcgggtttatgaacgaggaccattggttctcccgggaaaatagcctttctggagtggagggtgaaggcctgcacaaattagggtacattctgagagatatatcaaagatccccggaggcaacatgtatgccgacgatactgctggttgggacaccaggattacggaggatgacttgcagaacgaggccaaaatcaccgaaattatggagcctgaacatgcactcctggctacaagtatctttaagctaacttaccagaataaagttgtgcgcgtccaaagaccagccaagaacgggaccgtgatggatgtaatatcccggagggaccagcgtggaagcggccaggttggcacatatgggcttaatactttcaccaacatggaggtgcagctgatccgacaaatggaatctgagggaatttttctcccctcggagctggaaacgccgaatttggctgagcgcgtcttagattggctggaaaagcacggtgccgagagactcaaacggatggcaatctcaggcgacgactgtgtggtgaagcctattgatgacaggttcgcgacagcccttaccgctctgaacgatatggggaaagtccgcaaggacatcccccagtgggaaccaagcaaaggatggaatgattggcagcaggttcctttttgctcccaccatttccaccaactaataatgaaggacggcagagagattgtggtaccctgtcggaaccaggatgagctggtgggtagggcccgagtcagtcagggggcaggatggtctctccgtgaaactgcttgcttgggcaagagctacgcccaaatgtggcagctgatgtattttcatagacgcgaccttcggctggcagccaatgcgatctgttccgctgtgccagttgattgggtgcccacatcaaggaccacttggagtatccacgcccaccatcagtggatgaccacagaggacatgctctctgtctggaacagagtgtggattgaagagaatccttggatggaagataaaacgcacgtaagctcctgggaggaggttccatacttaggcaagcgcgaagaccagtggtgcgggtcactgataggattgaccgcacgggccacttgggctacaaacatccaagtggccattaatcaggtcaggcgactgatcggtaacgagaattatctcgactacatgaccagcatgaaaagattcaagaacgaatctgatccggagggcgcactttggtga

SEQ ID NO: 13364 - RNA, 9879 nt, synthetic construct
  misc_feature 1..9879: note = derived and/or modified CDS sequence (opt3) from DENV-1__GQ868533__SS-prME
  source 1..9879: mol_type = other RNA
agcgtgaccatgctgctcatgcttctgccaacagcattggctttccacttaactacgcgaggaggggagcctcatatgatcgtctccaagcaggaaaggggaaaatctctgctatttaagacctcagccggtgttaacatgtgcacactcattgccatggacctgggcgagctttgtgaagatactatgacctacaaatgcccacaaataacagaggcggaaccggacgatgtggactgttggtgcaatgctaccgatacttgggtaacatatgggacctgtagtcagacgggagagcaccggcgcgacaagcgaagcgtggccctggcaccccatgtcggcttgggtctcgagactcgtaccgaaacatggatgtcctctgagggggcctggaaacagatccagagagtggaaacttgggctctgaggcaccctggattcaccgttattgcactgtttctcgcccatgctatcggcacatcgattacccaaaagggcatcatattcatcttactgatgcttgtgacgccatcaatggccatgcggtgcgtcgggattggaaaccgcgattttgtggagggtttgagcggcgcgacttgggtagacgttgtgctggagcacgggagttgtgtcacaaccatggcaaagaataaacccactctagatatcgaactcctgaagacagaggtgaccaaccctgccattcttagaaaactgtgcatcgaagctaagatatccaatacgaccacagactctaggtgtccaactcagggagaggccaccttggtggaggaacaggatgcaaacttcgtctgccggcgcacatttgttgaccgaggctggggtaatgggtgtggactcttcggcaaaggcagcctgttaacttgcgctaagtttaagtgcgtgaccaaactggaggggaagattgtacagtacgaaaacctcaaatattccgtgatcgtcacagtgcacaccggagatcaacatcaggttggtaatgagactacggaacacggcacaattgccaccatcactccccaggcgcctacctcagagatccagcttacagactacggggccctgaccttggactgtagtccaagaactggactagatttcaacgaaatggtgctgctcacaatgaaggagaaaagctggctggtccataagcaatggtttcttgacctgccgttgccctggacgtctggcgcatccacctcacaggagacttggaataggcaggatctcctggtgacattcaaaaccgctcacgccaagaagcaagaagtagttgtgttaggtagccaggagggggctatgcacacagccctgactggcgcaaccgaaattcagacgagtggaaccacaactatatttgccggccatctaaaatgccggctcaagatggacaaactgacccttaaggggacatcttatgtcatgtgtactggatccttcaaattggagaaggaagtggctgagacccagcacggtacggtcctggtgcaagttaagtacgagggcacagatgcgccttgcaaaatcccattcagcacccaggacgaaaagggggtgactcagaacggacgtctcattacagcaaatcccatcgtaaccgataaagagaagcctgtcaacatagaaactgagccaccctttggcgagtcgtatattgtggttggtgccggggaaaaagctctgaaactttcttggttcaagaaaggctcctcaatcggaaagatgtttgaggccaccgcacgcggcgccagaaggatggctatcctgggggacacagcctgggatttcggaagtattggtggcgtgtttacgagcgtcgggaaattggtgcatcaggtattcggaaccgcatacggcgtgctcttttccggtgtttcttggactatgaagatcgggattggcatactgttaacatggctgggactaaatagccggtcaaccagtctctccatgacatgtatcgcggtcggcatggtgactctgtaccttggggtgatggtccaagctgacagcggatgcgttattaactggaaaggccgagaattgaagtgtggttctgggatcttcgtgaccaacgaggtgcacacgtggacagaacagtataagtttcaggccgattcaccgaaacgcctgagtgcagccatcggaaaggcttgggaggagggcgtatgcggtattagaagcgccaccaggctcgaaaatataatgtggaaacagatctccaacgagctgaatcatattttactggaaaacgacatgaagttcactgtcgtggttggcgacgcaaatgggatccttgctcaaggcaagaaaatgattcggcctcagcccatggagcacaaatactcttggaagtcgtggggcaaggccaaaatcatagaagcggatatccagaacaccacatttattatcgacgggccagatactcctgagtgtcccgacaatcagcgcgcctggaacatttgggaggtggaagattatggattcggcatctttaccacaaatatatggttgaagctcagagacagctacacgcaaatgtgcgatcacaggctgatgtccgctgcaattaaagactcaaaggccgtccatgctgatatgggttattggatcgagagtgagaagaacgagacctggaagctagcccgtgcatctttcattgaagtgaagacttgtacatggccaaaaagccacaccctgtggtccaatggggttctcgagtcagagatgatcatacccaagatctacggaggccctattagccagcataactatcggccaggttacttcactcagacagcgggcccgtggcacctggggaaacttgaattggactttgatctgtgcgagggaaccacggtggtagtcgacgaacactgcggcaatcgagggccctctttaagaactaccacagtgaccggaaagatcattcatgagtggtgttgcaggtcctgtactctccctccactgcgcttccggggcgaggatggttgctggtacgggatggaaatcagacccgtgaaagagaaggaagagaaccttgtcaggagtatggttagcgccggatctggcgaagtggactccttttcactgggtatattgtgtgctagtattatgatcgaggaggtaatgcgcagccgatggtcgcggaagatgctcatgacaggcaccctggccgtgttcctactgctcgtcatggggcaactgacatggaatgaccttatccgtttgtgcattatggtgggagcaaacgcttccgatagaatgggcatggggactacctatctggccttaatggcaacgtttaaaatgaggcctatgttcgccgttggactcctgtttcgccggcttacatctagagaagtgctgctactcaccatcggcctgagcttggtcgcttcagtggagctgccaaacagtttagaggaactcggtgacgggctggcgatgggaattatgatgcttaagctgttgactgagttccagccccaccagctctggaccacactgctatccctgacttttataaaaaccacgctttctctcgattacgcctggaagacaaccgcaatggctctgagcatcgtttccttgttcccgctgtgtttatcaactacaagccagaaaaccacttggctccctgtgctgcttggcagttttggctgcaagccactgacaatgttcttgattaccgagaataagatctgggggaggaaatcttggcccctcaacgagggaattatggccatcggtatagtctccatcctgctaagctcgctgcttaagaatgacgtacctctcgccggccccctgattgctgggggaatgttgatcgcatgttatgtgatttcaggctctagtgccgatttatccctggaaaaagcggctgaggttagctgggaacaagaggccgaacattctggtacgagccacaacatcctcgtggaggtccaggacgatgggactatgaagataaaagacgaggaacgagatgacaccctgacaattcttctgaaggcaaccttgctagccgtgtccggagtatacccaatgtcaatccctgctacactgtttctctggtatttctggcagaaaaagaagcagcgcagtggcgtgctgtgggatactcccagcccaccggaggtcgaacgggcagttcttgacgatggcatctacagaattttacaaagggggctgctcggacgttctcaggtgggtgtgggcgtcttccaggacggggtgtttcataccatgtggcacgttacgcgcggagccgtattgatgtatcagggcaaacggctggagccttcctgggcgtcagtgaagaaagacctcataagttacggtgggggatggagattccaaggcagctggaatacaggcgaggaagtccaggtgatcgctgttgagcccgggaagaaccccaagaatgtgcagactacccccggaacatttaagacccctgaaggtgaggtcggcgccattgcactggatttcaagccagggacttccggatctcccatcgtgaacagggaaggcaaaattgtaggtctttacgggaatggagtcgtgaccacatcgggcacgtatgttagcgccatcgctcaagccaaggcatcacaggagggccctctgccggagatagaagacgaggtgtttaaaaagcgaaacttgactatcatggatctacacccagggtccggaaaaacccggcgctacctgcccgctattgtcagagaagccatcaagaggaagctccggacattaattctggcgcctacccgagtggttgccagtgagatggcagaagctcttaaaggtatgccaatcagatatcagactacagccgtgaagtctgagcataccggccgcgagatagtcgacctgatgtgccacgctacgttcactatgaggctcttgagccccgtgcgtgtacctaattacaacatgattatcatggatgaagcacattttacagacccggcctccatcgccgctcgggggtatatttcaaccagagtgggaatgggcgaggcggcagccatcttcatgaccgctactcccccaggttctgttgaagcctttcctcagagcaatgcagtcatacaagatgaggaaagggacattcccgagcgcagttggaactccgggtacgattggatcacagacttcccaggaaaaaccgtgtggtttgtgcctagcattaagtctggcaatgatatcgccaactgtctgcggaaaaacggcaagagagtcatacagctctcaagaaagacattcgacactgagtatcagaaaacgaagaataacgactgggattacgtagtgaccacagacatttccgaaatgggggctaatttcagggcggatcgcgttatcgacccccgtagatgcctgaaaccagtgatccttaaggatggaccggagcgggtcattctagccggtcctatgcccgtgactgttgcaagtgctgcccagaggcgcggccgaatcgggagaaaccaaaataaagaaggagaccagtacgtgtatatgggccagccactgaacaatgatgaggaccacgcacattggaccgaggccaagatgttgttagataacattaatacacccgaaggtataatccctgctctgtttgagccagaacgggaaaagagcgccgcgattgacggggaatacaggctccgcggcgaggcaagaaaaaccttcgtcgagctgatgaggcggggagatcttcccgtgtggctgtcgtataaggtagcctctgaaggctttcagtactccgaccgtcgctggtgcttcgatggggagcgaaacaatcaagtgctcgaagagaacatggacgttgaaatctggactaaagagggagagagaaagaaattgaggcctcggtggctggacgctcgcacgtatagcgatccgctagccctgagagaatttaaggagttcgctgcaggtaggcggtcagtcagtggcgacctcatccttgaaattgggaaactgccacagcacttaacctctcgagcccagaatgctttggataacctggtgatgctccacaattccgagcagggaggcaaggcctacagacatgcaatggaggaactgcccgacacaatagagactcttatgctgctcgcgttgatcgccgtgctgaccggtggggtcacattatttttcctaagcggcaagggactgggcaaaacctcaattgggctcctttgtgttactgctagtagcgccctgttgtggatggcatccgtggaacctcactggatcgctgcctctattatcctggagtttttcctcatggtactgcttatacccgaaccagatcgccaaaggacacctcaggacaaccagctcgcatatgtggtcatcggactgttgtttatgattctgacggtggccgctaacgagatgggtttactagagaccactaagaaagatctgggcatcgggcatgttgcggccgaaaatcaccaacacgcaacaatgctcgacgtggatcttcggcccgctagcgcctggaccctgtacgccgtcgcaaccacagtaattactccaatgatgcgtcatacgatcgagaacaccacagctaatatatccttgactgccattgcgaaccaggctgccatcctgatgggactcgacaagggctggcctatttcaaaaatggatatcggtgtgccgctgcttgcattagggtgctactctcaggttaatcccctgaccctcacagccgctgtgttgatgctggtcgcacactatgccataatcggcccaggactacaggcgaaggctaccagagaagcccaaaagaggactgcagccggcattatgaaaaaccctacggtggacgggatcgtcgctattgatctggaccccgtggtttacgacgccaagttcgagaaacagctcggacagatcatgcttctgatattgtgtacaagtcagattctgctcatgcgcaccacttgggcactgtgcgaatcgatcaccttagctacaggcccacttactaccctgtgggagggtagccctgggaagttttggaatacaacgatcgccgtgtccatggcgaacattttccggggatcttatctcgccggcgcaggtctagctttctcactgatgaagtccttgggcgggggacgaagaggcaccggggcccaaggagagactctgggcgaaaagtggaagaggcagctcaatcagcttagcaaaagtgagtttaacacatacaagcgctctggtatcatggaagtagatcggagcgaggcaaaagaagggctgaagagaggagagaccactaaacatgctgtgtcacgtggcacagccaagttgaggtggttcgtcgagcggaatctggttaagcccgaaggtaaagtgatagacctcggctgtgggcgcggaggctggtcctattactgcgccgggttaaagaaagtcaccgaggtgaagggatatacgaaaggcggtccggggcacgaggaaccaattcctatggcgacctacggatggaacctggctaaacttcatagtggcaaagatgtatttttcatgcccccagaaaagtgtgacacactgctatgcgatatcggcgagagctctcccaatcctactattgaggaagggcgaaccctcagagtgctgaagatggttgagccgtggttgaggggaaaccagttttgtatcaaaatactgaatccctacatgccatccgtggtcgaaacactcgagcaaatgcagcggaagcacggtggcatgcttgtgcgcaaccctctgtcaagaaatagcactcacgagatgtattgggtctcgtgcgggaccggaaacatcgtgtctgcagttaacatgacaagtaggatgttactgaatcgattcaccatggcccatcggaaacccacttacgaacgtgacgtagatttgggcgctggtacgagacacgtggccgtcgagcctgaagtggcaaacctcgacattatcgggcagcgcattgagaatatcaagaacgaacataaatccacatggcactatgatgaggacaatccatacaagacctgggcctatcacggaagctacgaggttaagtcatccggctctgctagcagtatggtgaacggcgtcgtgaggctgctaactaaaccctgggatgtaattcctatggtgacccaaatcgcgatgacagacacgaccccatttgggcagcagcgggttttcaaggaaaaagtcgacactagaacaccccgcgccaagaggggaaccactcagataatggaggtgacagcaaaatggctttggggttttctgtcccgaaataagaagccgcggatttgtaccagagaagagttcacaaggaaagtgcgcagcaacgctgccatcggcgcagtctttgttgatgaaaatcaatggaactctgccaaggaggctgtggaggacgaacgtttctgggatctcgtacatcgggagagagaactgcacaaacaggggaagtgcgccacttgcgtgtataatatgatgggaaaaagggagaagaagttgggcgaatttggtaaagcgaaggggtcacgcgcaatctggtacatgtggctgggagcccgattcctcgagttcgaggctcttggctttatgaacgaagaccattggttcagtcgggaaaattccctgagcggcgtcgaaggggagggattacacaaactgggttacattttgagagatatatctaagatccctggcgggaacatgtatgccgacgataccgcaggatgggacacgaggattaccgaggatgacctccagaatgaagctaaaatcacagagattatggaaccagagcatgccctgctagctacttcgatctttaaacttacctaccagaacaaagtggttcgcgtgcaaagacccgccaagaacggcacagtcatggatgtgatatcacggagggaccagcgtggtagcgggcaggtaggaacttatggcctgaataccttcacgaacatggaagttcagctcatccgacaaatggagtccgagggcatttttctgcctagtgaattggagacaccaaatttagcagaacgcgtgctggattggctcgagaagcacggggcggaaagacttaaacggatggccatctctggagacgactgtgtcgtgaagcccattgatgacaggttcgctaccgccctgactgcactaaacgatatgggtaaagtgcgcaaggacatcccgcagtgggagcctagcaaaggctggaatgattggcagcaggtccccttttgctcccaccatttccaccaactgataatgaaggacgggagagagattgttgtgccatgtcggaaccaggatgaactcgtaggaagggctcgagtgtcacagggcgccggttggagtttgcgtgagacagcatgcctggggaagtcttacgcccaaatgtggcagcttatgtattttcatagacgcgacctgcggctcgcggctaatgccatctgtagcgcagtccctgtggattgggttcccacctccaggactacctggtcaatccacgcccaccatcagtggatgacaacggaagacatgttaagcgtgtggaacagagtctggattgaggaaaatccatggatggaggataaaacccacgtgtcttcctgggaggaagtaccctacctgggaaagcgcgaggaccagtggtgcggcagtttgataggcctgactgctcgggccacatgggcaaccaacatccaagttgctattaatcaggtgaggcgactcatcgggaacgaaaattatcttgactacatgactagcatgaaaagattcaagaacgagtcggatcctgagggagccctgtggtga

SEQ ID NO: 13365 - RNA, 9879 nt, synthetic construct
  misc_feature 1..9879: note = derived and/or modified CDS sequence (opt3) from DENV-1__GQ868534__SS-prME
  source 1..9879: mol_type = other RNA
agcgtgaccatgctgctcatgcttctgcccacagcattggctttccacttaactacgagaggaggggaacctcatatgatcgtctccaagcaggaaaggggaaaatctctgttgtttaagacctcagccggtgttaacatgtgcacactcattgccatggacctgggcgaactttgtgaagatactatgacctacaaatgcccacagataacagaggcggaaccggacgatgtggactgttggtgcaatgctaccgatacttgggtaacatatgggacctgtagtcagacgggagagcaccggcgcgacaagcgaagcgtggccctggcaccccatgtcggcttgggtctcgagactcgtaccgaaacatggatgtcctctgagggggcctggaaacagatccagagagtggaaacttgggctctgaggcaccctggattcaccgttattgcactgtttctcgcccatgctatcggcacatcgattacccaaaagggcatcatattcatcttactgatgcttgtgacgccatcaatggccatgcggtgcgtcgggattggaaaccgcgattttgtggagggtttgagcggcgcgacttgggtagacgttgtgctggagcacgggagttgtgtcacaaccatggcaaagaataaacccactctagatatcgaactcctgaagacagaggtgaccaaccctgccattcttagaaaactgtgcatcgaagctaagatatccaatacgaccacagactctaggtgtccaactcagggagaggccaccttggtggaagaacaggatgcaaacttcgtctgccggcgcacatttgttgaccgaggctggggtaatgggtgtggactcttcggcaaaggcagcctgttaacttgcgctaagtttaagtgcgtgaccaaactggaggggaagattgtacagtacgaaaacctcaaatattccgtgatcgtcacagtgcacaccggagatcaacatcaggttggtaatgagactacggaacacggcacaattgccaccatcactccccaggcgcctacctcagagatccagcttacagactacggggccctgaccttggactgtagtccaagaactggactagatttcaacgaaatggtgctgctcacaatgaaggagaaaagctggctggtccataagcaatggtttcttgacctgccgttgccctggacgtctggcgcatccacctcacaggagacttggaataggcaggatctcctggtgacattcaaaaccgctcacgccaagaagcaagaagtagttgtgttaggtagccaggagggggctatgcacacagccctgactggcgcaaccgaaattcagacgagtggaaccacaactatatttgccggccatctaaaatgccggctcaagatggacaaactgacccttaaggggacatcttatgtcatgtgtactggatccttcaaattggagaaggaagtggctgagacccagcacggtacggtcctggtgcaagttaagtacgagggcacagatgcgccttgcaaaatcccattcagcacccaggacgaaaagggggtgactcagaacggacgtctcattacagcaaatcccatcgtaaccgataaagagaagcctgtcaacatagaaactgagccaccctttggcgagtcgtatattgtggttggtgccggggaaaaagctctgaaactttcttggttcaagaaaggctcctcaatcggaaagatgtttgaggccaccgcacgcggcgccagaaggatggctatcctgggggacacagcctgggatttcggaagtattggtggcgtgtttacgagcgtcgggaaattggtgcatcaggtattcggaaccgcatacggcgtgctcttttccggtgtttcttggactatgaagatcgggattggcatactgttaacatggctgggactaaatagccggtcaaccagtctctccatgacatgtatcgcggtcggcatggtgactctgtaccttggggtgatggtccaagctgacagcggatgcgttattaactggaaaggccgagaattgaagtgtggttctgggatcttcgtgaccaacgaggtgcacacgtggacagaacagtataagtttcaggccgattcaccgaaacgcctgagtgcagccatcggaaaggcttgggaggagggcgtatgcggtattagaagcgccaccaggctcgaaaatataatgtggaaacagatctccaacgagctgaatcatattttactggaaaacgacatgaagttcactgtcgtggttggcgacgcaaatgggatccttgctcaaggcaagaagatgattcggcctcagcccatggagcacaaatactcttggaagtcgtggggcaaggccaaaatcataggggcggatatccagaacaccacatttattatcgacggaccagatactcctgaatgtcccgacaatcagcgcgcctggaacatttgggaggtggaggattatggcttcggtatctttaccacaaatatatggttgaagctcagagacagctacacgcaaatgtgcgatcacaggctgatgtccgctgcaattaaagactcaaaggccgtccatgctgatatggggtattggatcgaaagtgagaaaaacgaaacctggaagctagcccgtgcatctttcattgaggtgaagacttgtacatggccaaaaagccacaccctgtggtccaatggagttctcgaatcagagatgatcatacccaagatctacggcggtcctattagccagcataactatcggccaggctacttcactcagacagcggggccgtggcacctgggaaaacttgagttggactttgatctgtgcgaaggcaccacggtggtagtcgacgagcactgcgggaatcgaggaccctctttaagaactaccacagtgaccggcaagatcattcatgaatggtgttgcaggtcctgtactctccctccactgcgcttccggggtgaggatgggtgctggtacggaatggagatcagacccgtgaaagaaaaggaggaaaaccttgtcaggagtatggttagcgccggctctggtgaggtggactccttttcactgggcatattgtgtgtaagtattatgatcgaagaggtgatgcgcagccgatggtcgcggaagatgctcatgacagggaccctggctgtcttcctactgctcgtgatgggacaactgacatggaatgaccttatccgtttgtgcattatggttggcgccaacgcatccgatagaatggggatgggaactacctatctggctttaatggccacgtttaaaatgaggcctatgttcgcagtgggcctcctgtttcgccggcttacatctagagaggtcctgctactcaccatcggtctgagcttggtggcctcagttgaactgccaaacagtttagaggaactcggggacggactggctatgggcattatgatgcttaagctgttgactgagttccagccccaccagctctggaccacactgctatccctgacttttataaaaaccacgctttctctcgattacgcgtggaagacaaccgccatggcactgagcatcgtgtccttgttcccgctgtgtttatcaactacaagccagaaaaccacttggctccctgtcctgcttggcagttttgggtgcaagccactgacaatgttcttgattaccgaaaataagatctggggaaggaaatcttggcccctcaacgagggtattatggctatcggcatagtatccatcctgctaagctcgctgcttaagaatgacgtgcctctcgccgggcccctgattgccggaggcatgttgatcgcttgttatgttatttcaggttctagtgcagatttatccctggagaaagccgcggaagtgagctgggagcaagaagctgagcattctgggacgagccacaacatcctcgtcgaagtgcaggacgatggaactatgaagataaaagacgaggagcgagatgacaccctgacaattcttctgaaggccaccttgctagcagtatccggcgtgtacccaatgtcaatccctgccacactgtttgtctggtatttctggcagaaaaagaagcagcgcagtggcgttctctgggatactcccagcccaccggaagtggagcgggctgtgctggacgatgggatctacaggattcttcaacgaggattactgggtcgttctcaggtcggcgtgggggttttccaggacggagtatttcataccatgtggcacgtgacgcgcggcgcagtcctcatgtatcagggtaaacggttggaaccttcctgggcctcagtgaagaaagacctgataagttacgggggaggctggagattccaaggcagctggaatacaggggaggaggttcaggtgatcgcggtcgaacccggaaagaaccccaagaatgtgcagactacccccggtacatttaagacccctgagggcgaagtaggggctattgccctcgatttcaagccaggaacttccggctctcccatcgtcaacagggagggtaaaattgtggggctgtacggaaatggcgttgtgaccacatcgggcacgtatgtcagcgcaatcgcccaagctaaggcctcacaggaagggcctcttccggagatagaggacgaagtgtttaaaaagcgaaacctgactatcatggatttgcacccaggatccggtaaaacccggcgctacctacccgcaattgttagagaggctatcaagaggaagctgcggacactcattttagcccctacccgagtggtcgcgagtgaaatggccgaggcactgaaaggcatgccaatcagatatcagactacagctgtgaagtctgaacataccgggcgcgagatagtagaccttatgtgccacgccacgttcactatgaggctgctcagccccgtgcgtgttcctaattacaacatgattatcatggatgaggctcattttacagacccggcatccatcgccgcccggggatatatttcaaccagagtcggcatgggtgaagctgcggcaatcttcatgaccgccactcccccagggtctgtggaggcttttcctcagagcaatgccgtgatacaagatgaagagagggacattcccgaacgcagttggaactccggatacgattggatcacagacttcccaggcaaaaccgtctggtttgtacctagcattaagtctggcaatgatatcgcaaactgtttgagaaagaacgggaagagagtgatacagctgtcacggaagacattcgacactgagtatcagaaaacgaagaataacgactgggattacgttgtgaccacagacatttccgagatgggagccaatttcagggctgatcgcgtcatcgacccccgtagatgcctcaaaccagtgatcctgaaggatggtccggaacgggttattcttgcgggccctatgcccgtgactgtcgccagtgcagctcagaggcgcgggcgaatcggaagaaaccaaaataaagagggcgaccagtacgtgtatatgggtcagccactaaacaatgatgaagaccacgcccattggaccgaggcaaagatgctgttggataacattaatacacccgaggggataatccctgccttatttgaaccagagcgggaaaagaacgctgccattgacggcgagtacaggctgcgcggagaagcgagaaaaaccttcgtagagctcatgaggcggggcgatctgcccgtgtggcttagctataaggttgcatcggaggggtttcagtactctgaccgtcgctggtgcttcgatggagaacgaaataaccaagtcctggaggaaaatatggacgtggagatctggactaaagaaggtgagagaaagaaactcaggcctcggtggttggacgcccgcacgtattccgatccgctggctctaagagagtttaaggagttcgccgctggcaggcggagcgtgtcaggggacctgatcctcgagattggaaaacttccacagcacctgaccttacgagcacagaacgccttggataatctggtcatgctccacaacagtgaacagggcggtaaggcttacagacatgccatggaggaactgcccgacacaatagagactcttatgctgctcgcattgatcgcggttctgaccgggggcgtgacattatttttcctatctggaaagggcctggggaaaacctccattggactcctttgtgtaactgccagctcagctctgttgtggatggccagtgtggagcctcactggatcgcagctagcattatcctggaatttttcctcatggtcctgcttatacccgagccagatcgccaaaggacacctcaggacaaccagctcgcctatgtggttatcggtctgttgtttatgattctgacggtggcagccaatgaaatgggcttactagagaccactaagaaagatctggggatcggacatgtcgctgcggagaaccaccaacacgccacaatgctcgacgtagatcttcggcccgcatccgcttggaccctgtacgccgtggccaccacagttattactccaatgatgcgtcatacgatcgaaaataccacagcaaacatatctttgactgctattgccaatcaggcggctatcctgatgggcctcgacaagggttggcctattagcaaaatggatatcggggtgccgctgcttgccttaggctgctactcccaggtcaaccccctgaccctcacagcagccgtgttgatgctggtcgctcactatgcaataatcggaccaggcctacaggccaaggcgaccagagaggctcaaaagaggactgccgcagggattatgaaaaatcctacggtggacggaatcgttgccattgatctggaccccgtggtatacgacgctaagttcgaaaaacagctcggccagatcatgcttctgatattgtgtacatcacagattctgctcatgcgcaccacttgggccctgtgcgagtctatcaccttagcaacaggtccacttactaccctgtgggaagggagtcctggaaagttttggaacacaacgatcgctgtgtcgatggccaatattttccggggcagctatctcgcgggtgccggcctagcattctccctgatgaaatctctagggggaggccgaagagggaccggagctcaaggcgagactctgggtgagaagtggaagaggcagctcaaccagctttcaaaaagcgaatttaatacatacaagcgctccgggatcatggaggtcgatcggagtgaagccaaagagggactgaagagaggcgaaaccactaaacatgcagtttctcgtggtacagctaagttgaggtggttcgtggagcggaacctggtcaagcccgagggcaaagtgatagacctcgggtgtggacgcggcgggtggagctattactgcgccggattaaagaaagtaaccgaagtgaagggctatacgaaaggtgggccgggacacgaggaaccaattcctatggccacctacggctggaatctggttaaacttcattcaggcaaagatgtgtttttcatcccaccagagaagtgtgacacactgctatgcgatattggggaatccagtcccaaccctactatcgaggagggacgaaccctcagagtcctgaagatggtggaaccgtggttgaggggtaatcagttttgtataaaaatcctgaacccctacatgccaagcgtcgtggaggcgctcgaacaaatgcagcggaagcacggcgggatgcttgttcgcaatcctctgtctagaaactccacacacgagatgtattgggtatcatgcggaactggcaacattgtgagcgctgtcaatatgacctcgaggatgttactgaaccgattcacaatggcacatcggaaacccacctacgagcgtgacgtggatttgggtgccgggactagacacgttgctgtggaacctgaggtcgccaatctcgacatcattggacagcgcatcgaaaacattaagaatgagcataaatctacgtggcactatgatgaagacaacccatacaagacatgggcatatcacggcagttacgaggtgaagccctccggcagcgcctcatccatggtaaatggggtggttaggctgctaaccaaaccttgggatgtcatcccaatggtgactcaaatagctatgaccgacacaacgccctttggacagcagcgggtgttcaaggagaaagtcgacaccagaactccgcgcgcgaagaggggtacaacccagattatggaagttactgccaaatggctttggggctttctgtctcgaaacaagaagcctcggatctgtacaagagaggagttcaccaggaaagtgcgcagcaatgcagctatcggggccgtatttgtggatgagaaccaatggaatagtgcaaaggaagccgtcgaggacgagcgtttctgggatctcgtgcatcgggaaagagagctgcacaaacagggaaagtgcgctacatgcgtttataacatgatgggcaaaagggaaaagaagttgggtgagtttgggaaagccaagggatcccgcgcgatttggtacatgtggctgggcgcacgattcctcgagttcgaggcccttggctttatgaatgaggaccattggttcagccgggaaaactctctgtcaggggtggagggagaaggtttacacaaactgggctacatattgagagatatcagtaagattccagggggaaatatgtatgctgacgatactgccggctgggacaccaggatcacggaggatgacctccagaacgaggcaaaaattaccgaaatcatggagcccgaacatgctctgctagccacatccatatttaaacttacttaccagaacaaagtcgtgcgcgtacaaagacctgctaagaatggtaccgttatggatgtgatcagccggagggaccagcgtgggtctggacaggtcggcacatatggcctgaacactttcaccaatatggaggtgcagctcattcgacaaatggaatcggaggggatctttctgccatcagagttggaaacgcccaacttagccgagcgcgcactggattggctcgaaaagcacggagcggagagacttaaacggatggccattagcggtgacgactgtgtggtcaagccgatcgatgacaggttcgctacagccctgaccgcactaaatgatatgggcaaagttcgcaaggacatacctcagtgggaaccctccaaagggtggaacgattggcaacaggtgccattttgcagtcaccatttccaccaactgattatgaaggacggaagagagatcgtagtgccttgtcggaatcaggatgagctcgtcggcagggctcgagtgtctcagggtgccgggtggagcttgcgtgaaactgcatgcctgggaaagtcctacgcccaaatgtggcagcttatgtattttcatagacgcgacctgcggctcgcggctaacgccatctgttcagcagttcccgtggattgggtcccaacaagtaggaccacttggtctattcacgcccaccatcagtggatgaccacagaggacatgttaagcgtgtggaatagagtatggatagaagagaacccctggatggaagataaaacgcacgtttcctcatgggaggaggtgccttacctgggcaagcgcgaagaccagtggtgcggcagcttgatcgggctgaccgctcgggccacttgggcaacaaatattcaagtcgctatcaaccaggtgaggcgactcattggaaatgagaactatcttgactacatgacctctatgaaaagattcaagaatgaatccgatccagagggtgccctgtggtga

SEQ ID NO: 13366 - RNA, 9879 nt, synthetic construct
  misc_feature 1..9879: note = derived and/or modified CDS sequence (opt3) from DENV-1__GQ868535__SS-prME
  source 1..9879: mol_type = other RNA
agcgtgaccatgctgctcatgcttctgcccacagccttggctttccacttaactacgagaggcggggagcctcatatgatcgtctccaagcaggaaaggggaaaatctctgctatttaagacctcagcaggtgttaacatgtgcacactcattgccatggacctgggcgagctttgtgaagatactatgacctacaaatgcccacaaataacagaggcggaaccggacgatgtggactgttggtgcaatgctaccgatacttgggtaacatatgggacctgtagtcagacgggagagcaccggcgcgacaagcgaagcgtggccctggcaccccatgtcggcttgggtctcgagactcgtaccgaaacatggatgtcctctgagggggcctggaaacagatccagagagtggaaacttgggctctgaggcaccctggattcaccgttattgcactgtttctcgcccatgctatcggcacatcgattacccaaaagggcatcatattcatcttactgatgcttgtgacgccatcaatggccatgcggtgcgtcgggattggaaaccgcgattttgtggagggtttgagcggcgcgacttgggtagacgttgtgctggagcacgggagttgtgtcacaaccatggcaaagaataaacccactctagatatcgaactcctgaagacagaggtggccaaccctgctattcttagaaaactgtgcatcgaagccaagatatccaataccacgaccgactctaggtgtccaacacagggagaggcaactttggtggaagagcaggatgctaacttcgtctgccggcgcacctttgttgaccgaggctggggtaatgggtgtggactcttcggcaaaggcagcctgttaacatgcgccaagtttaagtgcgtgactaaactggaggggaagattgtacagtacgaaaacctcaaatattccgtgatcgtcaccgtgcacacaggagatcaacatcaggttggtaatgagaccactgaacacggcacgattgcgacaatcaccccccaggcccctacttcagagatccagcttaccgactacggggcactgacattggactgtagtccaagaaccggactagatttcaacgaaatggtgctgctcactatgaaggagaaaagctggctggtccataagcaatggtttcttgacctgccgttgccctggacatctggcgcttccacgtcacaggagacctggaataggcaggatctcctggtgactttcaaaacagcccacgctaagaagcaagaagtagttgtgttaggtagccaggagggggccatgcacaccgcactgacaggcgccactgaaattcagaccagtggaacgaccacaatatttgctggccatctaaaatgccggctcaagatggacaaactgactcttaaggggacctcttatgtcatgtgtacaggatccttcaaattggagaaggaagtggcggagactcagcacggtaccgtcctggtgcaagttaagtacgagggcacggatgcaccttgcaaaatcccattcagcacacaggacgaaaagggggtgacccagaacggacgtctcattactgccaatcccatcgtaacagataaagagaagcctgtcaacatagaaaccgagccaccctttggcgagtcgtatattgtggttggtgctggggaaaaagccctgaagctttcttggttcaagaaaggctcctcaatcggaaagatgtttgaggcaactgcccgcggcgctagaaggatggccatcctgggggacaccgcatgggatttcggaagtattggtggcgtgtttacaagcgtcgggaaattggtgcatcaggtattcggaacggcgtacggcgtgctcttttccggtgtttcttggaccatgaagatcgggattggcatactgttaacttggctgggactaaatagccggtcaacaagtctctccatgacctgtatcgctgtcggcatggtgacactgtaccttggggtgatggtccaagccgacagcggatgcgttattaactggaaaggccgagaattgaagtgtggttctgggatcttcgtgactaacgaggtgcacacctggacggaacagtataagtttcaggcagattcaccgaaacgcctgagtgccgctatcggaaaggcctgggaggagggcgtatgcggtattagaagcgcaacaaggctcgaaaatataatgtggaaacagatctccaacgagctgaatcatattttactggaaaacgacatgaagttcaccgtcgtggttggcgacgctaatgggatccttgcccaaggaaaaaagatgattcggcctcagcccatggagcacaaatactcttggaagtcgtggggcaaggcgaaaatcataggggccgatatccagaacactacctttattatcgacggaccagatacacctgaatgtcccgacaatcagcgcgcttggaacatttgggaggtggaggattatggcttcggtatctttactaccaatatatggttgaagctcagagacagctacacacaaatgtgcgatcacaggctgatgtccgcagccattaaagactcaaaggctgtccatgccgatatggggtattggatcgaaagtgagaaaaacgaaacgtggaagctagcacgtgcgtctttcattgaggtgaagacctgtacttggccaaaaagccacacactgtggtccaatggagttctcgaatcagagatgatcatacccaagatctacggcggtcctattagccagcataactatcggccaggctacttcacccagactgccgggccgtggcacctgggaaaacttgagttggactttgatctgtgcgaaggcacaaccgtggtagtcgacgagcactgcgggaatcgaggaccctctttaagaacgactaccgtgacaggcaagatcattcatgaatggtgttgcaggtcctgtaccctccctccactgcgcttccggggtgaggatgggtgctggtacggaatggagatcagacccgtgaaagaaaaggaggaaaaccttgtcaggagtatggttagcgctggctctggtgaggtggactccttttcactgggcatattgtgtgccagtattatgatcgaagaggtaatgcgcagccgatggtcgcggaagatgctcatgactgggacactggcagtgttcctactgctcatcatgggacaactgacctggaatgaccttattcgtttgtgcatcatggtcggcgctaacgcctccgatagaatggggatgggaacaacttatctggcattaatggccacctttaaaatgaggcctatgttcgctgtgggcctcctgtttcgccggcttacgtctagagaggttctgctactcacaattggtctgagcttggtggcgtcagtcgaactgccaaacagtttagaggaactcggggacggactggccatgggcataatgatgcttaagctgttgaccgagttccagccccaccagctctggactaccctgctatccctgacatttatcaaaactaccctttctctcgattacgcatggaagacgacagctatggccctgagcattgtgtccttgttcccgctgtgtttatcaaccactagccagaaaacaacctggctccctgttctgcttggcagttttgggtgcaagccactgactatgttcttgatcacagaaaataagatttggggaaggaaatcttggcccctcaacgagggtatcatggccataggcatcgtgtccattctgctaagctcgctgcttaagaatgacgtccctctcgctgggcccctgatcgcaggaggcatgttgattgcctgttatgtaatctcaggttctagtgcggatttatccctggagaaagctgccgaagtgagctgggagcaagaagcagagcattctgggaccagccacaacatactcgttgaagtgcaggacgatggaacgatgaagattaaagacgaggagcgagatgacactctgaccatccttctgaaggccacattgctagctgtctccggcgtgtacccaatgtcaatccctgcaaccctgtttgtatggtatttctggcagaaaaagaagcagcgcagtggcgtgctctgggatacacccagcccaccggaagtcgagcgggccgttctggacgatgggatttacagaatacttcaaaggggattactgggtcgttctcaggtgggcgtgggggtcttccaggacggagtgtttcatactatgtggcacgttacccgcggcgcggtactcatgtatcagggtaaacggttggaaccttcctgggcttcagtgaagaaagacctgatcagttacgggggaggctggagattccaaggcagctggaatatgggggaggaggtccaggtgattgccgttgaacccggaaagaacccaaaaaatgtgcagacgacacccggtacttttaagacccctgagggcgaagtcggggcaatcgccctcgatttcaagccaggaacatccggctctcccattgtgaacagggagggtaaaatcgtagggctgtacggaaatggcgtcgtgaccacttcgggcacctatgttagcgctatagcccaagcaaaggcttcacaggaagggcctcttccggagatcgaggacgaagtgtttaaaaagcgaaacctgacaattatggatttgcacccaggatccggtaaaacgcggcgctacctacccgccatcgtcagagaggcgattaagaggaagctgcggactctcatcttagcccctacccgagtggttgcaagtgaaatggctgaggccctgaaaggcatgccaataagatatcagacaaccgctgtgaagtctgaacatactgggcgcgagattgtcgaccttatgtgccacgcaacattcaccatgaggctgctcagccccgtgcgtgtacctaattacaacatgatcatcatggatgaggcccattttacggacccggcctccattgctgcgcggggatatatctcaactagagtgggcatgggtgaagcagccgctatattcatgacagccacccccccagggtctgttgaggcatttcctcagagcaatgccgtcattcaagatgaagagagggacatccccgaacgcagttggaactccggatacgattggattaccgacttcccaggcaaaactgtgtggtttgtgcctagcatcaagtctggcaatgatatagctaactgtttgcgaaaaaacgggaagagagtcattcagctgtcacggaagacattcgacaccgagtatcagaaaacaaagaataacgactgggattacgtagtgactacggacatctccgagatgggagcgaatttcagggccgatcgcgttatcgacccccgtagatgcctcaaaccagtgattctgaaggatggtccggaacgggtcatccttgcaggccctatgcccgtgaccgttgctagtgccgcacagaggcgcgggcgaattggaagaaaccaaaataaagagggcgaccagtacgtgtatatgggtcagccactaaacaatgatgaagaccacgcccattggacagaggctaagatgctgttggataacataaatactcccgaggggatcattcctgccttatttgaaccagagcgggaaaagagcgcggcaatcgacggcgagtacaggctgcgcggagaagccagaaaaaccttcgtcgagctcatgaggcggggcgatctgcccgtgtggctttcgtataaggtagcttctgaggggtttcagtactccgaccgtcgctggtgcttcgatggagaacgaaacaatcaagtgctggaggaaaacatggacgttgagatctggacaaaagaaggtgagagaaagaaactcaggcctcggtggttggacgcccgcacctatagcgatccgctggctctaagagagtttaaggaattcgcagccggcaggcggtcagtcagtggggacctgattctcgagataggaaaacttccacagcacctgactttacgagctcagaatgccttggataacctggtgatgctccacaattctgaacagggcggtaaggcatacagacatgcgatggaggaactgcccgacacgatcgagacccttatgctgctcgccttgattgctgtgctgacagggggcgtcactttatttttcctatccggaaagggcctggggaaaaccagcatcggactcctttgtgttacagcctcaagtgcactgttgtggatggctagcgtggagcctcactggattgccgcatccatcatactggaatttttcctcatggtactgcttatccccgagccagatcgccaaaggacccctcaggacaaccagctcgcctatgtggtcattggtctgttgtttatgatcctgactgtggctgcgaacgaaatgggcttactagagacaacgaagaaagatctggggattggacatgttgccgcagagaatcaccaacacgctaccatgctcgacgtggatcttcggcccgcctctgcctggactctgtacgcagtcgctacaaccgtaatcaccccaatgatgcgtcatacaatagaaaacactacggccaatattagcttgaccgcgatcgctaaccaggccgcaattctgatgggcctcgacaagggttggcctatctccaaaatggatataggggtgccgctgcttgccttaggctgctactcacaggttaatcccctgacactcactgctgcagtgttgatgctggtcgcccactatgcgatcattggaccaggcctacaggctaaggccaccagagaggcacaaaagaggacagccgctgggatcatgaaaaaccctaccgtggacggaattgtcgccatcgatctggaccccgtggtttacgacgcaaagttcgaaaaacagctcggccagataatgcttctgattttgtgtacttctcagatcctgctcatgcgcacgacatgggctctgtgcgagagtatcaccttagccactggtccacttaccacactgtgggaagggtcgcctggaaagttttggaatactaccattgcggtgagcatggccaacatcttccggggctcctatctcgcaggtgctggcctagccttctctctgatgaaatcattggggggaggccgaagagggacaggagcacaaggcgagacgctgggtgagaagtggaagaggcagctcaatcagcttagcaaatccgaatttaacacctacaagcgcagtgggataatggaggtagatcggtctgaagctaaagagggactgaagagaggcgaaactacaaaacatgccgtgagccgtggtaccgccaagttgaggtggttcgtcgagcggaatctggttaagcccgagggcaaagtgattgacctcgggtgtggacgcggcgggtggtcatattactgcgcgggattaaagaaagtcactgaagtgaagggctatacaaaaggtgggccgggacacgaggaaccaatccctatggctacctacggctggaacctggtaaagcttcattccggcaaagatgtgtttttcatgcccccagagaagtgtgacacgctgctatgcgatattggggaaagtagccccaatcctaccatcgaggagggacgaacactcagagttctgaagatggtggaaccgtggttgaggggtaaccagttttgtataaaaatcctgaatccctacatgccatctgtcgtggagactctcgaacaaatgcagcggaagcacggcgggatgcttgtccgcaaccctctgtccagaaattcaacccacgagatgtattgggtgagctgcggaacaggcaacattgtttcggcagtaaacatgacttctaggatgttactgaatcgattcaccatggcccatcggaaacccacatttgagcgtgacgtggatttgggtgctgggaccagacacgtcgccgtggaacctgaggttgcaaacctcgacatcattggacagcgcatcgaaaatattaagaacgagcataaaagtacttggcactacgatgaagacaatccatataagacgtgggcctaccacggctcctatgaggtgaagcccagcggctcagcttcctctatggtcaacggggtggtaaggctgctaacaaaaccttgggatgtgatcccaatggttacccaaatagcgatgactgacaccacacccttcggacagcagcgggtctttaaggagaaagtggacacgagaaccccgcgcgccaagaggggtactacacagattatggaagtgaccgcaaaatggctttggggcttcctgagccgaaataagaagcctcggatctgtactagagaggaatttacaaggaaagtccgcagtaacgctgccatcggggcagttttcgtggatgagaatcaatggaactccgccaaggaagctgtagaggacgagcgtttttgggatctcgtgcatcgggaaagagagctgcacaaacagggaaagtgcgccacctgcgtctacaatatgatgggcaaaagggaaaagaagttgggtgagttcgggaaagcgaagggaagccgcgcaatttggtatatgtggctgggcgcccgattcctcgaatttgaggctcttggcttcatgaacgaggaccattggttttctcgggaaaattcactgagtggggtggagggagaaggtttacacaaactgggctacatattgagagatatctccaagattccagggggaaacatgtacgccgacgatacagcaggctgggacactaggatcaccgaggatgacctccagaatgaggctaaaattacggatatcatggaacccgagcatgccctgctagctaccagcatattcaagcttacatatcagaacaaagttgtgcgcgtccaaagacctgccaagaacggtactgtgatggacgtaatctctcggagggatcagcgtgggtcgggacaggttggcacctacggcctgaatacatttactaacatggaagtgcagctcattcgacaaatggagtcagaagggatcttcctgccaagcgagttggagacccccaatttagcagaacgcgtcctggactggctcgagaagcacggagcggaaagacttaaacggatggccatttccggtgacgattgtgtggtgaagccgatcgacgataggtttgctacggccctgacagcactaaacgacatgggcaaagtccgcaaggatatacctcagtgggagcccagtaaagggtggaatgactggcagcaggttccattctgctctcaccattttcaccaactgattatgaaggatggaagagaaatcgtggtaccttgtcggaaccaggacgagctcgtgggcagggctcgagtcagccagggtgccgggtggtccttgcgtgagaccgcatgcctgggaaagtcatatgcccaaatgtggcagcttatgtacttccatagacgcgatctgcggctcgcggctaatgccatctgtagtgcagtgcccgttgactgggtgccaacttctaggacaacctggagcattcacgcccaccatcagtggatgactaccgaagatatgttatccgtctggaacagagtgtggatagaggaaaatccctggatggaggacaaaacacacgtatcaagctgggaagaggttccttatctgggcaagcgcgaggaccagtggtgcggctctttgatcgggctgacggctcgggccacctgggcaactaacattcaagtggctatcaatcaggtcaggcgactcattggaaacgaaaattaccttgattatatgacatccatgaaaagatttaagaacgagagtgacccagaaggtgccctgtggtga

SEQ ID NO: 13367 - RNA, 9879 nt, synthetic construct
  misc_feature 1..9879: note = derived and/or modified CDS sequence (opt3) from DENV-1__KJ189306__SS-prME
  source 1..9879: mol_type = other RNA
agcgtgaccatgctgctcatgcttctgcccactgccttggctttccacttaactacgagaggaggggaacctcatatgatcgtctccaagcaggaaaggggaaaatctctgctgtttaagacctcagccggtgttaacatgtgcacactcattgccatggacctgggagaactttgtgaagatactatgacctacaaatgcccacaaataacagaggcggaaccggacgatgtggactgttggtgcaatgctaccgatacttgggtaacatatgggacctgtagtcagacgggagagcaccggcgcgacaagcgaagcgtggccctggcaccccatgtcggcttgggtctcgagactcgtaccgaaacatggatgtcctctgagggggcctggaaacagatccagagagtggaaacttgggctctgaggcaccctggattcaccgttattgcactgtttctcgcccatgctatcggcacatcgattacccaaaagggcatcattttcatcttactgatgcttgtgacgccatcaatggccatgcggtgcgtcgggattggaaaccgcgattttgtggagggtttgagcggcgcgacttgggtagacgttgtgctggagcacgggagttgtgtcacaaccatggcaaagaataaacccactctagatatcgaactcctgaagacagaggtgaccaaccctgccattcttagaaaactgtgcatcgaagctaagatatccaatacgaccacagactctaggtgtccaactcagggagaggccaccttggtggaagaacaggatgcaaacttcgtctgccggcgcacatttgttgaccgaggctggggtaatgggtgtggactcttcggcaaaggcagcctgttaacttgcgctaagtttaagtgcgtgaccaaactggaggggaagattgtacagtacgaaaacctcaaatattccgtgatcgtcacagtgcacaccggagatcaacatcaggttggtaatgagactacggaacacggcacaattgccaccatcactccccaggcgcctacctcagagatccagcttacagactacggggccctgaccttggactgtagtccaagaactggactagatttcaacgaaatggtgctgctcacaatgaaggagaaaagctggctggtccataagcaatggtttcttgacctgccgttgccctggacgtctggcgcatccacctcacaggagacttggaataggcaggatctcctggtgacattcaaaaccgctcacgccaagaagcaagaagtagttgtgttaggtagccaggagggggctatgcacacagccctgactggcgcaaccgaaattcagacgagtggaaccacaactatatttgccggccatctaaaatgccggctcaagatggacaaactgacccttaaggggacatcttatgtcatgtgtactggacctttcaaattggagaaggaagtggctgagacccagcacggtacggtcctggtgcaagttaagtacgagggcacagatgcgccatgcaaaatccccttcctcacccaggacgaaaagggggtgactcagaacggacgtctgattacagcaaatcctatcgtaaccgataaagagaagccagtcaacatagaaactgagcccccgtttggcgagtcctatattgtggttggtgccggggaaaaagctcttaagctgagctggttcaagaaaggctcgtctatcggaaagatgtttgaggccaccgcacgcggcgccagaaggatggctatcttgggggacacagcctgggatttcggatccattggtggcgtgtttacgtcagtcgggaaactcgtgcatcaggtattcggaaccgcatacggcgtgctgtttagtggtgttagctggactatgaagatcgggattggcatattactgacatggctaggactcaattcccggtctaccagcctgtcaatgacatgtatcgcggtcggcatggtgactctttacttgggggtgatggtccaagctgacagtggatgcgttattaactggaaaggccgagaactgaagtgtggttccgggatcttcgtgaccaacgaggtgcacacgtggacagaacagtataagtttcaggccgatagccctaaacgcctctctgcagccatcggaaaggcttgggaggagggcgtatgcggtattagatcagccaccaggctggaaaatataatgtggaaacagatcagtaacgagttaaatcatattctgcttgaaaacgacatgaagttcactgtcgtggttggcgacgcaaatgggatcttggctcaaggcaagaaaatgattcggccccagccaatggagcacaaatacagctggaaatcctggggcaaggccaaaatcataggggcggatatccagaacaccacatttattatcgacggacctgatactcccgaatgtccagacaatcagcgcgcctggaacatttgggaggtggaggattatggcttcggtatctttaccacaaatatatggctcaagctgagagactcttacacgcaaatgtgcgatcacaggctaatgtcggctgcaattaaagacagcaaggccgtccatgctgatatggggtattggatcgaatccgagaaaaacgaaacctggaagctggcccgtgcatcattcattgaggtgaagacttgtacatggcccaaaagtcacaccctctggtctaatggagttctggaaagcgagatgatcatacctaagatctacggcggtccaatttcccagcataactatcggccgggctacttcactcagacagcggggccctggcaccttggaaaattggagctggactttgatttatgcgaaggcaccacggtggtagtcgacgagcactgcgggaatcgaggaccttcactcagaactaccacagtgaccggcaagatcattcatgaatggtgttgcaggagctgtactctgccaccccttcgcttccggggtgaggatgggtgctggtacggaatggagatcagacctgtgaaagaaaaggaggaaaacctggtcaggtctatggtttccgccggcagtggtgaggtggacagcttttctttgggcatactctgtgtatccattatgatcgaagaggtgatgcgctcacgatggagtcggaagatgctgatgacagggaccctagctgtcttcctgctcctggtgatgggacaacttacatggaatgacttgatccgtctgtgcattatggttggcgccaacgcaagcgatagaatggggatgggaactacctatttagctctcatggccacgtttaaaatgaggccaatgttcgcagtgggcctgctttttcgccggctgacatcgagagaggtcctactcctgaccatcggtttgtccctggtggcctctgttgaattacccaacagcctcgaggaactgggggacggacttgctatgggcattatgatgctgaagttgctcactgagttccagccgcaccagctgtggaccacactactgtcacttacttttataaaaaccacgctcagtctggattacgcgtggaagacaaccgccatggcattgtccatcgtgtctctgttccctttatgtctcagcactacatcccagaaaaccacttggctgccagtccttctgggctcatttgggtgcaagcccttgacaatgttcctcattaccgaaaataagatctggggaaggaaaagctggcctctgaacgagggtattatggctatcggcatagtaagtatcctactgtcttcccttctcaagaatgacgtgcccctggccgggccattgattgccggaggcatgttaatcgcttgttatgttattagcggttcgtcagcagatctgtctctcgagcgagccgcggaagtgagttgggagcaagaagctgagcattccgggacgagccacaacatcctggtcgaagtgcaggacgatggaactatgaaaataaaggacgaggagcgcgatgacacccttacaattctgttgaaagccaccctactggcagtatctggcgtgtaccctatgagcatccccgccacactctttgtctggtatttctggcagaagaaaaagcagcggtccggcgttctgtgggatactccatcaccgcctgaagtggagagagctgtgcttgacgatgggatctacaggattttacaacgtggactgctcggtcgcagtcaggtcggcgtgggggttttccaggacggagtatttcataccatgtggcacgtgacgcggggcgcagtcttgatgtatcagggtaagagactggaacccagctgggcctctgtgaaaaaggacctcatatcctacgggggaggctggaggttccaaggctcatggaatacaggggaggaggttcaggtgatcgcggtcgaaccaggcaaaaaccccaagaatgtgcagactacccctggtacatttaaaaccccagagggcgaagtaggggctattgccctggatttcaagcccggaacaagtggcagccctatcgtcaaccgagagggtaagattgtggggctttacggaaatggcgttgtgaccacatccggcacgtatgtctctgcaatcgcccaagctaaagcctcgcaggaagggccgctgccagagatagaggacgaagtgtttaagaaacggaacttgactatcatggatctacaccccggaagcggtaagacccgcagatacctgcctgcaattgttagggaggctatcaaacggaagctccgaacattaattctggccccaaccagagtggtcgcgtcagaaatggccgaggcacttaagggcatgcccatccgctatcagactacagctgtgaaatccgaacataccgggagggagatagtagacctgatgtgccacgccacgttcactatgcgtctcttgagtcctgtgcgggttccgaattacaacatgattatcatggatgaggctcattttacagaccccgcatctatcgccgccagaggatatattagcaccagggtcggcatgggtgaagctgcggcaatcttcatgaccgccactccacctgggtccgtggaggcttttccccagtcaaatgccgtgatacaagatgaagaacgcgacattccagaacgatcttggaacagcggatacgattggatcacagacttccctggcaagaccgtctggtttgtacccagtattaaatccggcaatgatatcgcaaactgtctgagaaagaacgggaaacgggtgatacagctcagcaggaagacattcgacactgagtatcagaagacgaaaaataacgactgggattacgttgtgaccacagacatttctgagatgggagccaatttccgcgctgatcgtgtcatcgacccaagacggtgcctgaagccggtgatccttaaagatggtcctgaaagggttattctagcgggccccatgccagtgactgtcgcctcagcagctcagcgccgagggagaatcggacggaaccaaaataaggagggcgaccagtacgtgtatatgggtcagcccctgaacaatgatgaagaccacgcccattggaccgaggcaaaaatgttgttagataacattaatacacctgaggggataatcccagccctgtttgaacccgagagggaaaagtccgctgccattgacggcgagtaccgcctcagaggagaagcgaggaagaccttcgtagagctgatgcggcgtggcgatcttcctgtgtggctgagttataaagttgcaagcgaggggtttcagtactcggaccgccgatggtgcttcgatggagaaagaaacaatcaagtcctcgaggaaaacatggacgtggagatctggactaaggaaggtgagaggaaaaagttgcggccgcgctggctggacgccagaacgtattctgatccactagctctgagggagtttaaagagttcgccgctggccggcgatccgtgagcggggacctcatccttgagattggaaagctgccccagcacttaaccttgagagcacagaatgccctggataacctcgtcatgctgcacaattcagaacagggcggtaaggcttaccgccatgccatggaggaacttcctgacacaatagagactctgatgctcttggcactgatcgcggttttaaccgggggcgtgacactatttttcctgagtggaaagggcctcgggaagacctctattggacttctgtgtgtaactgcctccagcgctttgctgtggatggcctcagtggagccccactggatcgcagctagtattatcctcgaatttttcctgatggtccttctcataccagagcctgataggcaacggacaccccaggacaaccagctggcctatgtggttatcggtttgctgtttatgattttaacggtggcagccaacgaaatgggcctactggagaccactaaaaaggatctcgggatcggacatgtcgctgcggagaatcaccaacacgccacaatgcttgacgtagatctgcgtccagcaagcgcttggaccttgtacgccgtggccaccacagttattactcctatgatgagacatacgatcgaaaacaccacagcaaatatatccctgactgctattgccaaccaggcggctatcctcatgggcctggacaaaggttggccgatttctaagatggatatcggggtgccccttttagccctgggctgctacagccaggtcaatccactcaccttgacagcagccgtgctgatgctagtcgctcactatgcaataatcggacctggcctgcaggccaaagcgaccagggaggctcaaaagcgcactgccgcagggattatgaagaaccccacggtggacggaatcgttgccattgatctcgacccagtggtatacgacgctaaattcgaaaagcagcttggccagatcatgctgttgatactgtgtacatcccagattctcctgatgcggaccacttgggccttatgcgagtcaatcacccttgcaacaggtcctctgactaccctctgggaagggtctcccggaaaattttggaatacaacgatcgctgtgagtatggccaacattttccgaggctcgtatctagcgggtgccggcctggcattcagcttgatgaagtccctagggggaggcagaagggggaccggagctcaaggcgagactctcggtgagaaatggaagcgccagcttaatcagctgtctaagtcagaatttcatatctacaaacggagcgggataatggaggtcgatagatccgaagccaaggagggattgaaacgtggcgaaacaaccaagcacgcagttagtaggggtactgctaaactgcggtggttcgtggagcgcaacctcgtcaagccggagggcaaggtgattgacttagggtgtggacgaggcgggtggtcttattactgcgccggactgaaaaaggtaacagaagtgaaaggctataccaagggtgggccaggacatgaggaacctatccccatggccacgtacggctggaatcttgttaaactgcacagcggcaaggatgtgtttttcatgccacccgagaaatgtgacaccctactctgcgatattggggaatcatcccctaacccgacaatcgaggagggaagaactctgagggtcttgaagatggtggaaccctggctgcggggtaatcagttttgtataaagatcctcaacccatacatgcctagtgtcgtggagacccttgaacaaatgcagcgcaaacacggcgggatgctggttagaaatcccttaagcaggaactctacacatgagatgtattgggtatcctgcggaactggcaatattgtgtcagcggtcaacatgaccagccgaatgctgttgaaccggttcacaatggctcaccgtaagcctacctacgagagagacgtggatctcggtgcagggactcgccatgttgccgtggaaccagaggtcgctaatctggacatcattggacagaggatcgaaaacattaaaaatgagcacaagtcgacgtggcactatgatgaagacaacccctacaaaacatgggcctatcatggctcttacgaggtgaagcctagtggctccgcaagctcaatggtaaatggggtggttcggctacttaccaagccatgggatgtcatccccatggtgactcaaatagccatgaccgacacaacgccgtttggacagcagagagtgttcaaagagaaggtcgacacccgcactcctagggctaaacgaggtacaacccagattatggaagttactgcgaagtggctgtggggctttctctcccggaacaaaaagccaagaatctgtacaagggaggagttcatccgcaaggtgcgttctaatgccgcaattggggctgtatttgtggatgagaaccaatggaatagcgccaaagaagcagtcgaggacgagcggttctgggatctggtgcacagagaaagggagttgcataagcagggaaaatgcgcaacctgcgtttataacatgatgggcaagcgcgagaaaaagctgggtgagtttgggaaggctaaaggaagtcgagccatatggtacatgtggctcggcgcgcggttccttgagttcgaggcactgggctttatgaatgaggaccactggttctccagagaaaacagcttatctggggtggagggagaaggtctgcataagttgggctacatcctcagggatatttcaaaaatccccgggggaaatatgtatgccgacgatacagctggctgggacactcgcattaccgaggatgacctgcagaacgaggccaagatcacggaaataatggagcctgaacacgcactacttgctaccagtatctttaaactgacataccagaataaggtcgtgagagtacaacggccagccaaaaacggtactgttatggatgtgatttccaggcgtgaccagcgagggagcggacaggtcggcacctatggcctcaacacattcactaatatggaggtgcagctgatccgccaaatggaatctgaggggatatttttgccctcggagttagaaaccccgaacctggctgagagagtgctcgattggcttgaaaagcacggagccgagcggctgaagaggatggcaatctcaggtgacgactgtgtcgttaaacctatagatgaccgcttcgcgacggccctaacagctctgaatgatatgggcaaggtgagaaaagacattccccagtgggaaccaagcaaggggtggaacgattggcagcaggtacctttttgctcccatcacttccatcaactcatcatgaaagacggacgggagatcgtggtcccctgtaggaatcaggatgagttggtgggccgagcccgtgttagtcagggtgcagggtggtctctgagagaaaccgcttgccttggaaagagctacgcccaaatgtggcagctgatgtattttcaccgccgggacctcaggttagcagccaacgcgatttgttccgctgtgccagtcgattgggtgcccacttcaagaacaacctggagtatacacgcccatcaccagtggatgactaccgaggacatgctgtctgtatggaatcgcgtttggatcgaagagaacccttggatggaagataagacacatgtgagctcctgggaggaggtcccatacttgggcaaacgggaagaccagtggtgcggctcactgattgggctcacggcaagggccacctgggctactaatatccaagtggccattaaccaggttcgaagacttatcggaaatgagaactatctggactacatgacaagcatgaagcggttcaaaaatgaatctgatccggagggtgcactatggtga

SEQ ID NO: 13368 - RNA, 9879 nt, synthetic construct
  misc_feature 1..9879: note = derived and/or modified CDS sequence (opt3) from DENV-1__KJ189307__SS-prME
  source 1..9879: mol_type = other RNA
agcgtgaccatgctgctcatgcttctgcccacagcattggctttccacttaactacgagaggaggggaacctcatatgatcgtctccaagcaggaaaggggaaaatctctgctatttaagacctcagccggtgttaacatgtgcacactcattgccatggacctgggcgagctttgtgaagatactatgacctacaaatgcccacaaataacagaggcggaaccggacgatgtggactgttggtgcaatgctaccgatacttgggtaacatatgggacctgtagtcagacgggagagcaccggcgcgacaagcgaagcgtggccctggcaccccatgtcggcttgggtctcgagactcgtaccgaaacatggatgtcctctgagggggcctggaaacagatccagagagtggaaacttgggctctgaggcaccctggattcaccgttattgcatttttcctggcccatgctatcggcacatcgattacccaaaagggcatcatatttatcctcttaatgctggtgacgccatcaatggccatgcggtgcgtcgggattggaaaccgcgatttcgtggagggtcttagcggcgcgacttgggtagacgttgtgttggagcacgggagttgtgtcacaaccatggcaaagaataaacccactctggatatcgaactactcaagacagaggtgaccaaccctgccattctgagaaaactttgcatcgaagctaagatatccaatacgaccacagactctaggtgtccaactcagggagaggccaccctggtggaagaacaggatgcaaactttgtctgccggcgcacattcgttgaccgaggctggggtaatgggtgtggattgtttggcaaaggcagcctcctgacttgcgctaagttcaagtgcgtgaccaaattagaggggaagattgtacagtacgaaaacctgaaatattccgtgatcgtcacagtgcacaccggagatcaacatcaggttggtaatgagactacggaacacggcacaattgccaccatcactccccaggcgcctacctcagagatccagctcacagactacggggcccttaccctggactgtagtccaagaactggattggattttaacgaaatggtgctactgacaatgaaggagaaaagctggctcgtccataagcaatggttcctggaccttccgctgccctggacgtctggcgcatccacctcacaggagacttggaataggcaggatttgctcgtgacatttaaaaccgctcacgccaagaagcaagaagtagttgtgctgggtagccaggagggggctatgcacacagccttaactggcgcaaccgaaattcagacgagtggaaccacaactatattcgccggccatctgaaatgccggctaaagatggacaaactcaccctgaaggggacatcttatgtcatgtgtactggatccttcaaacttgagaaggaagtggctgagacccagcacggtacggtcttggtgcaagttaagtacgagggcacagatgcgccttgcaaaatcccatttagcacccaggacgaaaagggggtgactcagaacggacgtctgattacagcaaatcccatcgtaaccgataaagagaagcctgtcaacatagaaactgagccacccttcggcgagtcgtatattgtggttggtgccggggaaaaagctctcaagctgtcttggtttaagaaaggctcctcaatcggaaagatgttcgaggccaccgcacgcggcgccagaaggatggctatccttggggacacagcctgggattttggaagtattggtggcgtgttcacgagcgtcgggaaactggtgcatcaggtatttggaaccgcatacggcgtgttgttctccggtgtttcttggactatgaagatcgggattggcatactcctgacatggttaggactgaatagccggtcaaccagtctatccatgacatgtatcgcggtcggcatggtgactctctacctgggggtgatggtccaagctgacagcggatgcgttattaactggaaaggccgagaacttaagtgtggttctgggatctttgtgaccaacgaggtgcacacgtggacagaacagtataagttccaggccgattcaccgaaacgcttgagtgcagccatcggaaaggcttgggaggagggcgtatgcggtattagaagcgccaccaggctggaaaatataatgtggaaacagatctccaacgagctcaatcatattctgttagaaaacgacatgaagtttactgtcgtggttggcgacgcaaatgggatcctggctcaaggcaagaagatgattcggcctcagcccatggagcacaaatactcttggaagtcgtggggcaaggccaaaatcataggggcggatatccagaacaccacattcattatcgacggaccagatactcctgaatgtcccgacaatcagcgcgcctggaacatttgggaggtggaggattatggctttggtatcttcaccacaaatatatggcttaagttgagagacagctacacgcaaatgtgcgatcacaggctcatgtccgctgcaattaaagactcaaaggccgtccatgctgatatggggtattggatcgaaagtgagaaaaacgaaacctggaagctggcccgtgcatctttcattgaggtgaagacttgtacatggccaaaaagccacaccctatggtccaatggagttctggaatcagagatgatcatacccaagatctacggcggtcctattagccagcataactatcggccaggctactttactcagacagcggggccgtggcacctcggaaaactggagcttgacttcgatttgtgcgaaggcaccacggtggtagtcgacgagcactgcgggaatcgaggaccctctctgagaactaccacagtgaccggcaagatcattcatgaatggtgttgcaggtcctgtactttacctccactccgctttcggggtgaggatgggtgctggtacggaatggagatcagacccgtgaaagaaaaggaggaaaacctggtcaggagtatggttagcgccggctctggtgaggtggactccttctcacttggcatactgtgtgtaagtattatgatcgaagaggtgatgcgcagccgatggtcgcggaagatgttgatgacagggaccctcgctgtctttctgctactggtgatgggacaactcacatggaatgacctgatccgtctttgcattatggttggcgccaacgcatccgatagaatggggatgggaactacctatttggctctgatggccacgttcaaaatgaggcctatgtttgcagtgggcttactcttccgccggctgacatctagagaggtccttctgctaaccatcggtctcagcctggtggcctcagttgaattgccaaacagtctggaggaattaggggacggactcgctatgggcattatgatgctgaaacttctgactgagtttcagccccaccagttgtggaccacactcctgtccctaactttcataaaaaccacgctgtctcttgattacgcgtggaagacaaccgccatggcactcagcatcgtgtccctgtttccgttgtgtctgtcaactacaagccagaaaaccacttggttacctgtcctcctgggcagtttcgggtgcaagccacttacaatgtttctgattaccgaaaataagatctggggaaggaaatcttggcccttgaacgagggtattatggctatcggcatagtatccatcctcctgagctcgctactgaagaatgacgtgcctcttgccgggcccctcattgccggaggcatgctgatcgcttgttatgttatttcaggttctagtgcagatttgtccttagagaaagccgcggaagtgagctgggagcaagaagctgagcattctgggacgagccacaacatcccagtcgaagtgcaggacgatggaactatgaagataaaagacgaggagcgagatgacaccctgacaattctcctgaaggccacccttctggcagtatccggcgtgtaccctatgtcaatccccgccacattgttcgtctggtatttctggcagaaaaagaagcagcgcagtggcgttctatgggatactccaagcccgcctgaagtggagcgggctgtgctggacgatgggatctacaggattctccaacgaggactgcttggtcgttctcaggtcggcgtgggggtttttcaggacggagtattccataccatgtggcacgtgacgcgcggcgcagtcttaatgtatcagggtaaacggctggaaccctcctgggcctcagtgaagaaagacctcataagttacgggggaggctggagatttcaaggcagctggaatacaggggaggaggttcaggtgatcgcggtcgaaccaggaaagaaccccaaaaatgtgcagactacccctggtacattcaagaccccagagggcgaagtaggggctattgccttggattttaagcccggaacttccggctctcctatcgtcaacagggagggtaaaattgtggggctgtacggaaatggcgttgtgaccacatcgggcacgtatgtcagcgcaatcgcccaagctaaggcctcacaggaagggccgctcccagagatagaggacgaagtgttcaaaaagcgaaacctgactatcatggatcttcaccccggatccggtaaaacccggcgctacctgcctgcaattgttagagaggctatcaagaggaagttgcggacactaattctggccccaacccgagtggtcgcgagtgaaatggccgaggcactcaaaggcatgcccatcagatatcagactacagctgtgaagtctgaacataccgggcgcgagatagtagacttaatgtgccacgccacgtttactatgaggctgcttagccctgtgcgtgttccgaattacaacatgattatcatggatgaggctcatttcacagaccccgcatccatcgccgcccggggatatatttcaaccagagtcggcatgggtgaagctgcggcaatctttatgaccgccactccacctgggtctgtggaggctttcccccagagcaatgccgtgatacaagatgaagagagggacattccagaacgcagttggaactccggatacgattggatcacagactttcctggcaaaaccgtctggttcgtacccagcattaagtctggcaatgatatcgcaaactgtctgagaaagaacgggaagagagtgatacagctctcacggaagacattcgacactgagtatcagaaaacgaagaataacgactgggattacgttgtgaccacagacatttccgagatgggagccaattttagggctgatcgcgtcatcgacccacgtagatgcttgaaaccggtgatcctgaaggatggtcctgaacgggttattctcgcgggccccatgccagtgactgtcgccagtgcagctcagaggcgcgggcgaatcggaagaaaccaaaataaagagggcgaccagtacgtgtatatgggtcagcccctgaacaatgatgaagaccacgcccattggaccgaggcaaagatgcttctagataacattaatacacctgaggggataatcccagccctgttcgaacccgagcgggaaaagaacgctgccattgacggcgagtacaggttgcgcggagaagcgagaaaaacctttgtagagttaatgaggcggggcgatctgcctgtgtggctcagctataaggttgcatcggaggggttccagtactctgaccgtcgctggtgctttgatggagaacgaaataaccaagtcctggaggaaaatatggacgtggagatctggactaaagaaggtgagagaaagaaacttaggccgcggtggctggacgcccgcacgtattccgatccactcgctttgagagagttcaaggaatttgccgctggcaggcggagcgtgtcaggggacctgatcctagagattggaaaactgccccagcacctcacccttcgagcacagaacgccctggataatttagtcatgttgcacaacagtgaacagggcggtaaggcttacagacatgccatggaggaactgcctgacacaatagagactctcatgctgcttgcactgatcgcggttctcaccgggggcgtgacattgttctttctgtctggaaagggcttagggaaaacctccattggactactgtgtgtaactgccagctcagctctcctttggatggccagtgtggagccccactggatcgcagctagcattatcctggagttctttttgatggtcctgctcataccagagcctgatcgccaaaggacaccccaggacaaccagctggcctatgtggttatcggtcttctcttcatgattctgacggtggcagccaatgaaatgggcttgctggagaccactaagaaagatttagggatcggacatgtcgctgcggagaaccaccaacacgccacaatgctagacgtagatctgcggccagcatccgcttggaccctctacgccgtggccaccacagttattactcctatgatgcgtcatacgatcgaaaataccacagcaaacatatctcttactgctattgccaatcaggcggctatcctgatgggcttggacaagggttggccgattagcaaaatggatatcggggtgcccctgctcgccctgggctgctactcccaggtcaacccacttaccttaacagcagccgtgctgatgctcgtcgctcactatgcaataatcggacctggcttgcaggccaaggcgaccagagaggctcaaaagaggactgccgcagggattatgaaaaatcccacggtggacggaatcgttgccattgatctggacccagtggtatacgacgctaagtttgaaaaacagctaggccagatcatgctgctcatactttgtacatcacagattctgttgatgcgcaccacttgggccctgtgcgagtctatcaccctcgcaacaggtcctctgactaccttatgggaagggagtcccggaaagttctggaacacaacgatcgctgtgtcgatggccaatattttccggggcagctatcttgcgggtgccggcctggcattttccctcatgaaatctctagggggaggccgaagagggaccggagctcaaggcgagactctgggtgagaagtggaagaggcagttgaaccagctgtcaaaaagcgagttcaatacatacaagcgctccgggatcatggaggtcgatcggagtgaagccaaagagggactcaagagaggcgaaaccactaaacatgcagtttctcgtggtacagctaaacttaggtggtttgtggagcggaacctggtcaagccggagggcaaagtgatagacttggggtgtggacgcggcgggtggagctattactgcgccggactgaagaaagtaaccgaagtgaagggctatacgaaaggtgggccaggacacgaggaacctattcccatggccacctacggctggaatctcgttaagttacattcaggcaaagatgtgttctttatgccacccgagaagtgtgacacactgctttgcgatatcggggaatccagtcctaacccgactattgaggagggacgaaccctgagagtcctaaagatggtggaaccctggctcaggggtaatcagttctgtatcaaaatactgaacccatacatgcctagcgtcgtggagacattggaacaaatgcagcggaagcacggcgggatgctggttcgcaatcccctctctagaaactccactcacgagatgtattgggtatcatgcggaaccggcaacatcgtgagcgcggtcaatatgacatcgaggatgcttctgaaccgatttaccatggctcatcggaaacctacttacgagcgtgacgtggatttaggtgcagggacgagacacgttgccgtggaaccagaggtcgctaatctggacattatcggacagcgcattgaaaacatcaagaatgagcataaatctacatggcactatgatgaagacaacccctacaagacctgggcctatcacggcagttacgaggtgaagccttccggcagcgcatcatccatggtaaatggggtggttaggttgctcactaaaccatgggatgtcattcccatggtgacccaaatcgccatgacagacacgaccccgttcggacagcagcgggtgtttaaggagaaagtcgacactagaacacctcgcgctaagaggggtaccactcagataatggaagttacagcgaaatggctgtggggcttcctatctcgaaacaagaagccacggatttgtaccagagaggaatttacaaggaaagtgcgcagcaatgccgcaatcggggctgtattcgtggatgagaaccaatggaatagtgccaaggaagcagtcgaggacgagcgtttttgggatcttgtgcatcgggaaagagagctgcacaaacagggaaagtgcgccacttgcgtttataacatgatgggcaaaagggaaaagaagctcggtgagttcgggaaagctaagggatcccgcgccatctggtacatgtggctgggcgcgcgattcttggaatttgaggcactgggcttcatgaatgaggaccattggtttagccgggaaaactctctctcaggggtggagggagaaggtcttcacaaactgggctacattttaagagatataagtaagatccccgggggaaatatgtatgccgacgataccgctggctgggacacgaggattaccgaggatgacctgcagaacgaggccaaaatcacagaaattatggagcctgaacatgcattgctcgctacttccatcttcaagctgacctaccagaacaaagtcgtgcgcgtacaaagaccagccaagaatggtacagttatggatgtgataagccggagggaccagcgtgggtctggacaggtcggcacttatggcctaaacacctttacgaatatggaggtgcagcttatccgacaaatggaatcggaggggattttcctgccctcagagctcgaaacaccgaacctggctgagcgcgtgttggattggttagaaaagcacggagccgagagactgaaacggatggcaatcagcggtgacgactgtgtcgttaagcctattgatgacaggtttgcgaccgccctcactgctcttaatgatatgggcaaagtgcgcaaggacatcccccagtgggaaccatccaaagggtggaacgattggcagcaggtacctttctgcagtcaccattttcaccaactgataatgaaggacggaagagagattgtggtcccctgtcggaatcaggatgagctagtgggcagggcccgagtttctcagggtgcagggtggagcctgcgtgaaacagcttgcctcggaaagtcctacgcccaaatgtggcagttgatgtatttccatagacgcgacctgcggcttgcagccaacgcgatctgttcagctgtgccagtcgattgggtgcccaccagtaggactacctggtctatccacgcccaccatcagtggatgacaacggaggacatgctgagcgtatggaatagagtttggattgaagagaacccttggatggaagataaaacccacgtgtcctcatgggaggaggtcccatacctcggcaagcgcgaagaccagtggtgcggcagcttaatagggctgactgcacgggccacatgggctaccaatatccaagtggccattaaccaggttaggcgattgatcggaaatgagaactatctggactacatgacttctatgaaaagatttaagaatgaatccgatccggagggtgcactctggtga

SEQ ID NO: 13369 - RNA, 9879 nt, synthetic construct
  misc_feature 1..9879: note = derived and/or modified CDS sequence (opt3) from DENV-1__KJ189318__SS-prME
  source 1..9879: mol_type = other RNA
agcgtgaccatgctgctcatgcttctgcccacagccttggctttccacttaactacgagaggcggggagcctcatatgatcgtctccaagcaggaaaggggaaaatctctgctatttaagacctcagcaggtgttaacatgtgcacactcattgccatggacctgggcgagctttgtgaagatactatgacctacaaatgcccacaaataacagaggcggaaccggacgatgtggactgttggtgcaatgctaccgatacttgggtaacatatgggacctgtagtcagacgggagagcaccggcgcgacaagcgaagcgtggccctggcaccccatgtcggcttgggtctcgagactcgtaccgaaacatggatgtcctctgagggggcctggaaacagatccagagagtggaaacttgggctctgaggcaccctggattcaccgttattgcactgtttctcgcccatgctatcggcacatcgattacccaaaagggcatcatattcatcttactgatgcttgtgacgccatcaatggccatgcggtgcgtcgggattggaaaccgcgattttgtggagggtttgagcggcgcgacttgggtagacgttgtgctggagcacgggagttgtgtcacaaccatggcaaagaataaacccactctagatatcgaactcctgaagacagaggtgaccaaccctgccattcttagaaaactgtgcatcgaagctaagatatccaatacgaccacagactctaggtgtccaactcagggagaggccaccttggtggaagagcaggatgcaaacttcgtctgccggcgcacatttgttgaccgaggctggggtaatgggtgtggactcttcggcaaaggcagcctgttaacttgcgctaagtttaagtgcgtgaccaaactggaggggaagattgtacagtacgaaaacctcaaatattccgtgatcgtcacagtgcacaccggagatcaacatcaggttggtaatgagactacggaacacggcacaattgccaccatcactccccaggcgcctacctcagagatccagcttacagactacggggccctgaccttggactgtagtccaagaactggactagatttcaacgaaatggtgctgctcacaatgaaggagaaaagctggctggtccataagcaatggtttcttgacctgccgttgccctggacgtctggcgcatccacctcacaggagacttggaataggcaggatctcctggtgacattcaaaaccgctcacgccaagaagcaagaagtagttgtgttaggtagccaggagggggctatgcacacagccctgactggcgcaaccgaaattcagacgagtggaaccacaactatatttgccggccatctaaaatgccggctcaagatggacaaactgacccttaaggggacatcttatgtcatgtgtactggatccttcaaattggagaaggaagtggctgagacccagcacggtacggtcctggtgcaagttaagtacgagggcacagatgcgccttgcaaaatcccattcagcacccaggacgaaaagggggtgactcagaacggacgtctcattacagcaaatcccatcgtaaccgataaagagaagcctgtcaacatagaaactgagccaccctttggcgagtcgtatattgtggttggtgccggggaaaaagctctgaagctttcttggttcaagaaaggctcctcaatcggaaagatgtttgaggccaccgcacgcggcgccagaaggatggctatcctgggggacacagcctgggatttcggaagtattggtggcgtgtttacgagcgtcgggaaattggtgcatcaggtattcggaaccgcatacggcgtgctcttttccggtgtttcttggactatgaagatcgggattggcatactgttaacatggctgggactaaatagccggtcaaccagtctctccatgacatgtatcgcggtcggcatggtgactctgtaccttggggtgatggtccaagctgacagcggatgcgttattaactggaaaggccgagaattgaagtgtggttctgggatcttcgtgaccaacgaggtgcacacgtggacagaacagtataagtttcaggccgattcaccgaaacgcctgagtgcagccatcggaaaggcttgggaggagggcgtatgcggtattagaagcgccaccaggctcgaaaatataatgtggaaacagatctccaacgagctgaatcatattttactggaaaacgacatgaagttcactgtcgtggttggcgacgcaaatgggatccttgctcaaggaaaaaagatgattcggcctcagcccatggagcacaaatactcttggaagtcgtggggcaaggccaaaatcataggggcggatatccagaacaccacatttattatcgacggaccagatactcctgaatgtcccgacaatcagcgcgcctggaacatttgggaggtggaggattatggcttcggtatctttaccacaaatatatggttgaagctcagagacagctacacgcaaatgtgcgatcacaggctgatgtccgctgcaattaaagactcaaaggccgtccatgctgatatggggtattggatcgaaagtgagaaaaacgaaacctggaagctagcccgtgcatctttcattgaggtgaagacttgtacatggccaaaaagccacaccctgtggtccaatggagttctcgaatcagagatgatcatacccaagatctacggcggtcctattagccagcataactatcggccaggctacttcactcagacagcggggccgtggcacctgggaaaacttgagttggactttgatctgtgcgaaggcaccacggtggtagtcgacgagcactgcgggaatcgaggaccctctttaagaactaccacagtgaccggcaagatcattcatgaatggtgttgcaggtcctgtactctccctccactgcgcttccggggtgaggatgggtgctggtacggaatggagatcagacccgtgaaagaaaaggaggaaaaccttgtcaggagtatggttagcgccggctctggtgaggtggactccttttcactgggcatattgtgtgctagtattatgatcgaagaggtaatgcgcagccgatggtcgcggaagatgctcatgacagggaccctggccgtgttcctactgctcatcatgggacaactgacatggaatgaccttattcgtttgtgcatcatggtcggcgcaaacgcttccgatagaatggggatgggaactacctatctggccttaatggcaacgtttaaaatgaggcctatgttcgccgtgggcctcctgtttcgccggcttacatctagagaggttctgctactcaccattggtctgagcttggtggcttcagtcgaactgccaaacagtttagaggaactcggggacggactggcgatgggcataatgatgcttaagctgttgactgagttccagccccaccagctctggaccacactgctatccctgacttttatcaaaaccacgctttctctcgattacgcctggaagacaaccgcaatggctctgagcattgtgtccttgttcccgctgtgtttatcaactacaagccagaaaaccacttggctccctgttctgcttggcagttttgggtgcaagccactgacaatgttcttgatcaccgaaaataagatttggggaaggaaatcttggcccctcaacgagggtatcatggccataggcatcgtgtccattctgctaagctcgctgcttaagaatgacgtccctctcgccgggcccctgatcgctggaggcatgttgattgcatgttatgtaatctcaggttctagtgccgatttatccctggagaaaacggcggaagtgagctgggagcaagaagctgagcattctgggactagccacaacatactcgttgaagtgcaggacgatggaaccatgaagattaaagacgaggagcgagatgacacactgaccatccttctgaaggccacattgctagcagtctccggcgtgtacccaatgtcaatccctgccactctgtttgtatggtatttctggcagaaaaagaagcagcgcagtggcgtgctctgggatacccccagcccaccggaagtcgagcgggctgttctggacgatgggatttacagaatacttcaaaggggattactgggtcgttctcaggtgggcgtgggggtcttccaggacggagtgtttcatacgatgtggcacgttacacgcggcgcagtactcatgtatcagggtaaacggttggaaccttcctgggcctcagtgaagaaagacctgatcagttacgggggaggctggagattccaaggcagctggaatactggggaggaggtccaggtgattgcggttgaacccggaaagaacccaaaaaatgtgcagaccacacccggtacctttaagactcctgagggcgaagtcggggctatcgccctcgatttcaagccaggaacctccggctctcccattgtgaacagggagggtaaaatcgtagggctgtacggaaatggcgtcgtgacaacgtcgggcacttatgttagcgcaatagcccaagctaaggcctcacaggaagggcctcttccggagatcgaggacgaagtgtttaaaaagcgaaacctgaccattatggatttgcacccaggatccggtaaaacacggcgctacctacccgcaatcgtcagagaggctattaagaggaagctgcggaccctcatcttagcccctactcgagtggttgcgagtgaaatggccgaggcactgaaaggcatgccaataagatatcagacaaccgctgtgaagtctgaacatacggggcgcgagattgtcgaccttatgtgccacgccactttcacaatgaggctgctcagccccgtgcgtgtacctaattacaacatgatcatcatggatgaggctcattttaccgacccggcatccattgccgcccggggatatatctcaaccagagtgggcatgggtgaagctgcggcaatattcatgactgccacacccccagggtctgttgaggcttttcctcagagcaatgccgtcattcaagatgaagagagggacatccccgaacgcagttggaactccggatacgattggattaccgacttcccaggcaaaacagtgtggtttgtgcctagcatcaagtctggcaatgatatagcaaactgtttgcgaaaaaacgggaagagagtcattcagctgtcacggaagactttcgacacggagtatcagaaaaccaagaataacgactgggattacgtagtgacaactgacatctccgagatgggagccaatttcagggctgatcgcgttatcgacccccgtagatgcctcaaaccagtgattctgaaggatggtccggaacgggtcatccttgcgggccctatgcccgtgaccgttgccagtgcagctcagaggcgcgggcgaattggaagaaaccaaaataaagagggcgaccagtacgtgtatatgggtcagccactaaacaatgatgaagaccacgcccattggacagaggcaaagatgctgttggataacataaatacccccgaggggatcattcctgccttatttgaaccagagcgggaaaagagcgctgccatcgacggcgagtacaggctgcgcggagaagcgagaaaaactttcgtcgagctcatgaggcggggcgatctgcccgtgtggctttcgtataaggtagcatctgaggggtttcagtactccgaccgtcgctggtgcttcgatggagaacgaaacaatcaagtgctggaggaaaacatggacgttgagatctggacgaaagaaggtgagagaaagaaactcaggcctcggtggttggacgcccgcacctatagcgatccgctggctctaagagagtttaaggaattcgccgctggcaggcggtcagtcagtggggacctgattctcgagataggaaaacttccacagcacctgacattacgagcacagaatgccttggataacctggtgatgctccacaattctgaacagggcggtaaggcttacagacatgccatggaggaactgcccgacactatcgagacccttatgctgctcgcattgattgcggtgctgacagggggcgtcaccttatttttcctatccggaaagggcctggggaaaactagcatcggactcctttgtgttacagcctcaagtgctctgttgtggatggccagcgtggagcctcactggattgcagcttccatcatactggaatttttcctcatggtactgcttatccccgagccagatcgccaaaggacgcctcaggacaaccagctcgcctatgtggtcattggtctgttgtttatgatcctgaccgtggcagccaacgaaatgggcttactagagactacaaagaaagatctggggattggacatgttgctgcggagaatcaccaacacgccaccatgctcgacgtggatcttcggcccgcatctgcttggaccctgtacgccgtcgccacaactgtaatcacgccaatgatgcgtcataccatagaaaacacaactgcaaatattagcttgaccgctatcgccaaccaggcggctattctgatgggcctcgacaagggttggcctatctccaaaatggatataggggtgccgctgcttgccttaggctgctactcacaggttaatcccctgacactcaccgcagccgtgttgatgctggtcgctcactatgcaatcattggaccaggcctacaggccaaggcgactagagaggctcaaaagaggacggccgcagggatcatgaaaaaccctacagtggacggaattgtcgccatcgatctggaccccgtggtttacgacgctaagttcgaaaaacagctcggccagataatgcttctgattttgtgtacctctcagatcctgctcatgcgcactacctgggccctgtgcgagagtatcacattagcaactggtccacttaccacactgtgggaagggtcgcctggaaagttttggaatacgaccattgctgtgagcatggccaacatcttccggggctcctatctcgcgggtgccggcctagcattctctctgatgaaatcattggggggaggccgaagagggactggagctcaaggcgagacactgggtgagaagtggaagaggcagctcaatcagcttagcaaatccgaatttaacacctacaagcgcagtgggataatggaggtagatcggtctgaagccaaagagggactgaagagaggcgaaactacaaaacatgcagtgagccgtggtaccgctaagttgaggtggttcgtcgagcggaatctggttaagcccgagggcaaagtgattgacctcgggtgtggacgcggcgggtggtcatattactgcgccggattaaagaaagtcacggaagtgaagggctataccaaaggtgggccgggacacgaggaaccaatccctatggccacatacggctggaacctggtaaagcttcattccggcaaagatgtgtttttcatgcccccagagaagtgtgacactctgctatgcgatattggggaaagtagccccaatcctaccatcgaggagggacgaacactcagagttctgaagatggtggaaccgtggttgaggggtaaccagttttgtataaaaatcctgaatccctacatgccatctgtcgtggagactctcgaacaaatgcagcggaagcacggcgggatgcttgtccgcaaccctctgtccagaaattcaacccacgagatgtattgggtgagctgcggaacaggcaacattgtttcggcggtaaacatgacctctaggatgttactgaatcgattcactatggctcatcggaaacccacgtttgagcgtgacgtggatttgggtgcagggacaagacacgtcgccgtggaacctgaggttgctaacctcgacatcattggacagcgcatcgaaaatattaagaacgagcataaaagtacctggcactacgatgaagacaatccatataagacttgggcctaccacggctcctatgaggtgaagcccagcggctcagcatcctctatggtcaacggggtggtaaggctgctaaccaaaccttgggatgtgatcccaatggttacacaaatagccatgacggacaccactcccttcggacagcagcgggtctttaaggagaaagtggacacaagaaccccgcgcgctaagaggggtactacacagattatggaagtgaccgcgaaatggctttggggcttcctgagccgaaataagaagcctcggatctgtacaagagaggaatttactaggaaagtccgcagtaacgccgcaatcggggctgttttcgtggatgagaatcaatggaactccgccaaggaagcagtagaggacgagcgtttttgggatctcgtgcatcgggaaagagagctgcacaaacagggaaagtgcgccacctgcgtctacaatatgatgggcaaaagggaaaagaagttgggtgagttcgggaaagctaagggaagccgcgccatttggtatatgtggctgggcgcgcgattcctcgaatttgaggcacttggcttcatgaacgaggaccattggttttctcgggaaaattcactgagtggggtggagggagaaggtttacacaaactgggctacatattgagagatatctccaagattccagggggaaacatgtacgccgacgatacggctggctgggacaccaggatcacagaggatgacctccagaatgaggccaaaattactgatatcatggaacccgagcatgcactgctagctaccagcatattcaagcttacatatcagaacaaagttgtgcgcgtccaaagacctgccaagaacggtactgtgatggacgtaatctctcggagggatcagcgtgggtcgggacaggttggcacctacggcctgaatacgtttacaaacatggaagtgcagctcattcgacaaatggagtcagaagggatcttcctgccaagcgagttggagacccccaatttagctgaacgcgtcctggactggctcgagaagcacggagccgaaagacttaaacggatggcaatttccggtgacgattgtgtggtgaagccgatcgacgataggtttgcgactgccctgacagctctaaacgacatgggcaaagtccgcaaggatatacctcagtgggagcccagtaaagggtggaatgactggcagcaggttccattctgctctcaccattttcaccaactgattatgaaggatggaagagaaatcgtggtaccttgtcggaaccaggacgagctcgtgggcagggcccgagtcagccagggtgcagggtggtccttgcgtgagaccgcttgcctgggaaagtcatatgcccaaatgtggcagcttatgtacttccatagacgcgatctgcggctcgcagccaatgcgatctgtagtgctgtgcccgttgactgggtgccaacttctaggaccacatggagcattcacgcccaccatcagtggatgacgaccgaagatatgttatccgtctggaacagagtgtggatagaggaaaatccctggatggaggacaaaactcacgtatcaagctgggaagaggttccttatctgggcaagcgcgaggaccagtggtgcggctctttgatcgggctgacagcacgggccacctgggctactaacattcaagtggccatcaatcaggtcaggcgactcattggaaacgaaaattaccttgattatatgacatccatgaaaagatttaagaacgagagtgacccagaaggtgcactgtggtga

SEQ ID NO: 13370 - RNA, 9879 nt, synthetic construct
  misc_feature 1..9879: note = derived and/or modified CDS sequence (opt3) from DENV-1__KJ189319__SS-prME
  source 1..9879: mol_type = other RNA
agcgtgaccatgctgctcatgcttctgccaacagcattggctttccacttaactacgcgaggaggggaacctcatatgatcgtctccaagcaggaaaggggaaaatctctgctgtttaagacctcagccggtgttaacatgtgcacactcattgccatggacctgggcgaactttgtgaagatactatgacctacaaatgcccacaaataacagaagcggaaccggacgatgtggactgttggtgcaatgctaccgatacttgggtaacatatgggacctgtagtcagacgggagagcaccggcgcgacaagcgaagcgtggccctggcaccccatgtcggcttgggtctcgagactcgtaccgaaacatggatgtcctctgagggggcctggaaacagatccagagagtggaaacttgggctctgaggcaccctggattcaccgttattgcactgtttctcgcccatgctatcggcacatcgattacccaaaagggcatcatattcatcttactgatgcttgtgacgccatcaatggccatgcggtgcgtcgggattggaaaccgcgattttgtggagggtttgagcggcgcgacttgggtagacgttgtgctggagcacgggagttgtgtcacaaccatggcaaagaataaacccactctagatatcgaactcctgaagacagaggtgaccaaccctgccattcttagaaaactgtgcatcgaagctaagatatccaatacgaccacagactctaggtgtccaactcagggagaggccaccttggtggaagaacaggatgcaaacttcgtctgccggcgcacatttgttgaccgaggctggggtaatgggtgtggactcttcggcaaaggcagcctgttaacttgcgctaagtttaagtgcgtgaccaaactggaggggaagattgtacagtacgaaaacctcaaatattccgtgatcgtcacagtgcacaccggagatcaacatcaggttggtaatgagactacggaacacggcacaattgccaccatcactccccaggcgcctacctcagagatccagcttacagactacggggccctgaccttggactgtagtccaagaactggactagatttcaacgaaatggtgctgctcacaatgaaggagaaaagctggctggtccataagcaatggtttcttgacctgccgttgccctggacgtctggcgcatccacctcacaggagacttggaataggcaggatctcctggtgacattcaaaaccgctcacgccaagaagcaagaagtagttgtgttaggtagccaggagggggctatgcacacagccctgactggcgcaaccgaaattcagacgagtggaaccacaactatatttgccggccatctaaaatgccggctcaagatggacaaactgacccttaaggggacatcttatgtcatgtgtactggatccttcaaattggagaaggaagtggctgagacccagcacggtacggtcctggtgcaagttaagtacgagggcacagatgcgccttgcaaaatcccattcagcacccaggacgaaaagggggtgactcagaacggacgtctcattacagcaaatcccatcgtaaccgataaagagaagcctgtcaacatagaaactgagccaccctttggcgagtcgtatattgtggttggtgccggggaaaaagctctgaaactttcttggttcaagaaaggctcctcaatcggaaagatgtttgaggccaccgcacgcggcgccagaaggatggctatcctgggggacacagcctgggatttcggaagtattggtggcgtgtttacgagcgtcgggaaattggtgcatcaggtattcggaaccgcatacggcgtgctcttttccggtgtttcttggactatgaagatcgggattggcatactgttaacatggctgggactaaatagccggtcaaccagtctctccatgacatgtatcgcggtcggcatggtgactctgtaccttggggtgatggtccaagctgacagcggatgcgttattaactggaaaggccgagaattgaagtgtggttctgggatcttcgtgaccaacgaggtgcacacgtggacagaacagtataagtttcaggccgattcaccgaaacgcctgagtgcagccatcggaaaggcttgggaggagggcgtatgcggtattagaagcgccaccaggctcgaaaatataatgtggaaacagatctccaacgagctgaatcatattttactggaaaacgacatgaagttcactgtcgtggttggcgacgcaaatgggatccttgctcaaggcaagaagatgattcggcctcagcccatggagcacaaatactcttggaagtcgtggggcaaggccaaaatcataggggcggatatccagaacaccacatttattatcgacggaccagatactcctgaatgtcccgacaatcagcgcgcctggaacatttgggaggtggaggattatggcttcggtatctttaccacaaatatatggttgaagctcagagacagctacacgcaaatgtgcgatcacaggctgatgtccgctgcaattaaagactcaaaggccgtccatgctgatatggggtattggatcgaaagtgagaaaaacgaaacctggaagctagcccgtgcatctttcattgaggtgaagacttgtacatggccaaaaagccacaccctgtggtccaatggagttctcgaatcagagatgatcatacccaagatctacggcggtcctattagccagcataactatcggccaggctacttcactcagacagcggggccgtggcacctgggaaaacttgagttggactttgatctgtgcgaaggcaccacggtggtagtcgacgagcactgcgggaatcgaggaccctctttaagaactaccacagtgaccggcaagatcattcatgaatggtgttgcaggtcctgtactctccctccactgcgcttccggggtgaggatgggtgctggtacggaatggagatcagacccgtgaaagaaaaggaggaaaaccttgtcaggagtatggttagcgccggctctggtgaggtggactccttttcactgggcatattgtgtgctagtattatgatcgaagaggtaatgcgcagccgatggtcgcggaagatgctcatgacagggaccctggccgtgttcctactgctcatcatgggacaactgacatggaatgaccttattcgtttgtgcatcatggtcggcgcaaacgcttccgatagaatggggatgggaactacctatctggccttaatggcaacgtttaaaatgaggcctatgttcgccgtgggcctcctgtttcgccggcttacatctagagaggttctgctactcaccattggtctgagcttggtggcttcagtcgaactgccaaacagtttagaggaactcggggacggactggcgatgggcataatgatgcttaagctgttgactgagttccagccccaccagctctggaccacactgctatccctgacttttatcaaaaccacgctttctctcgattacgcctggaagacaaccgcaatggctctgagcattgtgtccttgttcccgctgtgtttatcaactacaagccagaaaaccacttggctccctgttctgcttggcagtctggggtgcaagccattgacaatgtttctcatcaccgaaaataagatttggggaaggaaatcttggcccctgaacgagggtatcatggccataggcatcgtgtccattctactgagctcgcttctcaagaatgacgtccctctggccgggcccttgatcgctggaggcatgttaattgcatgttatgtaatctcaggttctagtgccgatctgtccctcgagaaagcggctgaagtgagctgggagcaagaagccgagcattctgggacgagccacaacatactggttgaagtgcaggacgatggaactatgaagattaaagacgaggagcgagatgacacccttacaatcctgttgaaggcaaccctactggccgtctccggcgtgtacccaatgtcaatccctgctacactcttcgtatggtatttttggcagaaaaagaagcagcgcagtggcgtgctgtgggatactcccagcccaccggaagtcgagcgggcagttcttgacgatgggatttacagaatattacaaaggggactgctcggtcgttctcaggtgggcgtgggggtcttccaggacggagtgttccataccatgtggcacgttacgcgcggcgccgtattgatgtatcagggtaaacggctggaaccttcctgggcgtcagtgaagaaagacctcatcagttacgggggaggctggagatttcaaggcagctggaatacaggggaggaggtccaggtgattgctgttgaacccggaaagaaccccaaaaatgtgcagactacccccggtacattcaagacccctgagggcgaagtcggggccatcgcactggattttaagccaggaacttccggctctcccattgtgaacagggagggtaaaatcgtagggctttacggaaatggcgtcgtgaccacatcgggcacgtatgttagcgccatagctcaagccaaggcatcacaggaagggcctctgccggagatcgaggacgaagtgttcaaaaagcgaaacttgactattatggatctacacccaggatccggtaaaacccggcgctacctgcccgctatcgtcagagaggccattaagaggaagctccggacattaatcctggcgcctacccgagtggttgccagtgaaatggcagaggctcttaaaggcatgccaataagatatcagactacagccgtgaagtctgaacataccgggcgcgagattgtcgacctgatgtgccacgctacgtttactatgaggctcttgagccccgtgcgtgtacctaattacaacatgatcatcatggatgaggcacatttcacagacccggcctccattgccgctcggggatatatctcaaccagagtgggcatgggtgaagcggcagccatatttatgaccgctactcccccagggtctgttgaggccttccctcagagcaatgcagtcattcaagatgaagagagggacatccccgaacgcagttggaactccggatacgattggattacagactttccaggcaaaaccgtgtggttcgtgcctagcatcaagtctggcaatgatatagccaactgtctgcggaaaaacgggaagagagtcattcagctctcaagaaagacatttgacactgagtatcagaaaacgaagaataacgactgggattacgtagtgaccacagacatctccgagatgggagctaatttcagggcggatcgcgttatcgacccccgtagatgcctgaaaccagtgattcttaaggatggtccggaacgggtcatcctagccggccctatgcccgtgactgttgcaagtgctgcccagaggcgcgggcgaattggaagaaaccaaaataaagagggcgaccagtacgtgtatatgggtcagccactgaacaatgatgaagaccacgcacattggaccgaggccaagatgttgttagataacataaatacacccgaggggatcattcctgctctgttcgaaccagagcgggaaaagagcgccgcgatcgacggcgagtacaggctccgcggagaagcaagaaaaacctttgtcgagctgatgaggcggggcgatcttcccgtgtggctgtcgtataaggtagcctctgaggggttccagtactccgaccgtcgctggtgctttgatggagaacgaaacaatcaagtgctcgaggaaaacatggacgttgagatctggactaaagaaggtgagagaaagaaattgaggcctcggtggctggacgctcgcacgtatagcgatccgctagccctgagagagttcaaggaatttgctgcaggcaggcggtcagtcagtggggacctcattcttgagataggaaaactgccacagcacttaaccttgcgagcccagaatgctctggataacctcgtgatgctgcacaattctgaacagggcggtaaggcctacagacatgcaatggaggaacttcccgacacaatcgagactctgatgctcttggcgctgattgccgtgttaaccgggggcgtcacactattctttctgtccggaaagggcctcgggaaaaccagcatcggacttctgtgtgttactgcttcaagtgccttgctgtggatggcaagcgtggagcctcactggattgctgcctccatcatactcgagttctttctgatggtacttctcatccccgagccagatcgccaaaggacacctcaggacaaccagctggcatatgtggtcattggtttgctgttcatgatcttaacggtggccgctaacgaaatgggcctactggagaccactaagaaagatctcgggattggacatgttgcggccgagaatcaccaacacgcaacaatgcttgacgtggatctgcggcccgcttctgcctggaccttgtacgccgtcgcaaccacagtaatcactccaatgatgcgtcatacgatagaaaacaccacagctaatattagcctgactgccatcgcgaaccaggctgccattctcatgggcctggacaagggttggcctatctccaaaatggatataggggtgccgcttttagcactgggctgctactcacaggttaatcccctcaccttgacagccgctgtgctgatgctagtcgcacactatgccatcattggaccaggcctgcaggcgaaggctaccagagaggcccaaaagaggactgcagccgggatcatgaaaaaccctacggtggacggaattgtcgctatcgatctcgaccccgtggtttacgacgccaagtttgaaaaacagcttggccagataatgctgttgattctgtgtacatctcagatcctcctgatgcgcaccacttgggcattatgcgagagtatcacccttgctacaggtccactgactaccctctgggaagggtcgcctggaaagttctggaatacaacgattgccgtgagcatggcgaacatctttcggggctcctatctagccggtgcaggcctggctttctctttgatgaaatcactagggggaggccgaagagggaccggagcccaaggcgagactctcggtgagaagtggaagaggcagcttaatcagctgagcaaatccgagttcaacacatacaagcgcagtgggataatggaggtagatcggtctgaagcaaaagagggattgaagagaggcgaaaccactaaacatgctgtgagccgtggtacagccaagctgaggtggtttgtcgagcggaatctcgttaagcccgagggcaaagtgattgacttagggtgtggacgcggcgggtggtcatattactgcgccggactgaagaaagtcaccgaagtgaagggctatacgaaaggtgggccgggacacgaggaaccaatccctatggcgacctacggctggaaccttgtaaagctgcattccggcaaagatgtgttctttatgcccccagagaagtgtgacacactactctgcgatattggggaaagtagccccaatcctactatcgaggagggacgaaccctgagagttttgaagatggtggaaccgtggctgaggggtaaccagttctgtataaaaatcctcaatccctacatgccatctgtcgtggagacacttgaacaaatgcagcggaagcacggcgggatgctggtccgcaaccctttatccagaaattcaactcacgagatgtattgggtgagctgcggaaccggcaacattgtttcggctgtaaacatgacatctaggatgctgttgaatcgatttaccatggcacatcggaaacccactttcgagcgtgacgtggatctcggtgccgggacgagacacgtcgctgtggaacctgaggttgccaacctggacatcattggacagcgcatcgaaaatattaagaacgagcataaaagtacatggcactacgatgaagacaatccatataagacctgggcataccacggctcctatgaggtgaagcccagcggctcagcctcctctatggtcaacggggtggtaaggctacttactaaaccttgggatgtgatcccaatggttacccaaatagctatgacagacacgaccccctttggacagcagcgggtcttcaaggagaaagtggacactagaacaccgcgcgcgaagaggggtaccactcagattatggaagtgacagccaaatggctgtggggctttctcagccgaaataagaagcctcggatctgtaccagagaggagttcacaaggaaagtccgcagtaacgcagctatcggggccgtttttgtggatgagaatcaatggaactccgcaaaggaagccgtagaggacgagcgtttctgggatctggtgcatcgggaaagagagttgcacaaacagggaaagtgcgctacttgcgtctacaatatgatgggcaaaagggaaaagaagctgggtgagtttgggaaagccaagggaagccgcgcgatttggtatatgtggctcggcgcacgattccttgagttcgaggccctgggctttatgaacgaggaccattggttctctcgggaaaattcattaagtggggtggagggagaaggtctgcacaaattgggctacatactcagagatatctccaagattccagggggaaacatgtacgctgacgataccgccggctgggacacgaggatcaccgaggatgacctgcagaatgaggcaaaaattacagatatcatggaacccgagcatgctctacttgccactagcatatttaagctgacctatcagaacaaagttgtgcgcgtccaaagacctgctaagaacggtacagtgatggacgtaatctctcggagggatcagcgtgggtcgggacaggttggcacttacggcctcaataccttcacgaacatggaagtgcagctgattcgacaaatggagtcagaagggatctttttgccaagcgagttagagacacccaatctggccgaacgcgtcctcgactggcttgagaagcacggagcagaaagactgaaacggatggcgatttccggtgacgattgtgtggtgaagccgatcgacgataggttcgccaccgctctaactgccctgaacgacatgggcaaagtccgcaaggatatacctcagtgggagcccagtaaagggtggaatgactggcagcaggttccattttgctctcaccatttccaccaactcattatgaaggatggaagagaaatcgtggtaccttgtcggaaccaggacgagttggtgggcagggcacgagtcagccagggtgctgggtggtccctgcgtgagacagcctgccttggaaagtcatatgcacaaatgtggcagctgatgtactttcatagacgcgatctccggttagccgcgaatgctatctgtagtgccgtgcccgttgactgggtgccaacctctaggactacctggagcattcacgcacaccatcagtggatgacaacggaagatatgctgtccgtctggaacagagtgtggatagaggaaaatccctggatggaggacaaaacccacgtatcaagctgggaagaggttccttatttgggcaagcgcgaggaccagtggtgcggctctctgatcgggctcactgcccgggctacatgggccaccaacattcaagtggcaatcaatcaggtcaggcgacttattggaaacgaaaattacctggattatatgacttccatgaaaagattcaagaacgagagtgacccagaaggtgctctatggtga

SEQ ID NO: 13371 - RNA, 9879 nt, synthetic construct
  misc_feature 1..9879: note = derived and/or modified CDS sequence (opt3) from DENV-1__KJ189320__SS-prME
  source 1..9879: mol_type = other RNA
agcgtgaccatgctgctcatgcttctgcccacagccttggctttccacttaactacgagaggcggggagcctcatatgatcgtctccaagcaggaaaggggaaaatctctgctatttaagacctcagcaggtgttaacatgtgcacactcattgccatggacctgggcgagctttgtgaagatactatgacctacaaatgcccacaaataacagaggcggaaccggacgatgtggactgttggtgcaatgctaccgatacttgggtaacatatgggacctgtagtcagacgggagagcaccggcgcgacaagcgaagcgtggccctggcaccccatgtcggcttgggtctcgagactcgtaccgaaacatggatgtcctctgagggggcctggaaacagatccagagagtggaaacttgggctctgaggcaccctggattcaccgttattgcactgtttctcgcccatgctatcggcacatcgattacccaaaagggcatcatattcatcttactgatgcttgtgacgccatcaatggccatgcggtgcgtcgggattggaaaccgcgattttgtggagggtttgagcggcgcgacttgggtagacgttgtgctggagcacgggagttgtgtcacaaccatggcaaagaataaacccactctagatatcgaactcctgaagacagaggtgaccaaccctgccattcttagaaaactgtgcatcgaagctaagatatccaatacgaccacagactctaggtgtccaactcagggagaggccaccttggtggaagagcaggatgcaaacttcgtctgccggcgcacatttgttgaccgaggctggggtaatgggtgtggactcttcggcaaaggcagcctgttaacttgcgctaagtttaagtgcgtgaccaaactggaggggaagattgtacagtacgaaaacctcaaatattccgtgatcgtcacagtgcacaccggagatcaacatcaggttggtaatgagactacggaacacggcacaattgccaccatcactccccaggcgcctacctcagagatccagcttacagactacggggccctgaccttggactgtagtccaagaactggactagatttcaacgaaatggtgctgctcacaatgaaggagaaaagctggctggtccataagcaatggtttcttgacctgccgttgccctggacgtctggcgcatccacctcacaggagacttggaataggcaggatctcctggtgacattcaaaaccgctcacgccaagaagcaagaagtagttgtgttaggtagccaggagggggctatgcacacagccctgactggcgcaaccgaaattcagacgagtggaaccacaactatatttgccggccatctaaaatgccggctcaagatggacaaactgacccttaaggggacatcttatgtcatgtgtactggatccttcaaattggagaaggaagtggctgagacccagcacggtacggtcctggtgcaagttaagtacgagggcacagatgcgccttgcaaaatcccattcagcacccaggacgaaaagggggtgactcagaacggacgtctcattacagcaaatcccatcgtaaccgataaagagaagcctgtcaacatagaaactgagccaccctttggcgagtcgtatattgtggttggtgccggggaaaaagctctgaagctttcttggttcaagaaaggctcctcaatcggaaagatgtttgaggccaccgcacgcggcgccagaaggatggctatcctgggggacacagcctgggatttcggaagtattggtggcgtgtttacgagcgtcgggaaattggtgcatcaggtattcggaaccgcatacggcgtgctcttttccggtgtttcttggactatgaagatcgggattggcatactgttaacatggctgggactaaatagccggtcaaccagtctctccatgacatgtatcgcggtcggcatggtgactctgtaccttggggtgatggtccaagctgacagcggatgcgttattaactggaaaggccgagaattgaagtgtggttctgggatcttcgtgaccaacgaggtgcacacgtggacagaacagtataagtttcaggccgattcaccgaaacgcctgagtgcagccatcggaaaggcttgggaggagggcgtatgcggtattagaagcgccaccaggctcgaaaatataatgtggaaacagatctccaacgagctgaatcatattttactggaaaacgacatgaagttcactgtcgtggttggcgacgcaaatgggatccttgctcaaggaaaaaagatgattcggcctcagcccatggagcacaaatactcttggaagtcgtggggcaaggccaaaatcataggggcggatatccagaacaccacatttattatcgacggaccagatactcctgaatgtcccgacaatcagcgcgcctggaacatttgggaggtggaggattatggcttcggtatctttaccacaaatatatggttgaagctcagagacagctacacgcaaatgtgcgatcacaggctgatgtccgctgcaattaaagactcaaaggccgtccatgctgatatggggtattggatcgaaagtgagaaaaacgaaacctggaagctagcccgtgcatctttcattgaggtgaagacttgtacatggccaaaaagccacaccctgtggtccaatggagttctcgaatcagagatgatcatacccaagatctacggcggtcctattagccagcataactatcggccaggctacttcactcagacagcggggccgtggcacctgggaaaacttgagttggactttgatctgtgcgaaggcaccacggtggtagtcgacgagcactgcgggaatcgaggaccctctttaagaactaccacagtgaccggcaagatcattcatgaatggtgttgcaggtcctgtactctccctccactgcgcttccggggtgaggatgggtgctggtacggaatggagatcagacccgtgaaagaaaaggaggaaaaccttgtcaggagtatggttagcgccggctctggtgaggtggactccttttcactgggcatattgtgtgctagtattatgatcgaagaggtaatgcgcagccgatggtcgcggaagatgctcatgacagggaccctggccgtgttcctactgctcatcatgggacaactgacatggaatgaccttattcgtttgtgcatcatggtcggcgcaaacgcttccgatagaatggggatgggaactacctatctggccttaatggcaacgtttaaaatgaggcctatgttcgccgtgggcctcctgtttcgccggcttacatctagagaggttctgctactcaccattggtctgagcttggtggcttcagtcgaactgccaaacagtttagaggaactcggggacggactggcgatgggcataatgatgcttaagctgttgactgagttccagccccaccagctctggaccacactgctatccctgacttttatcaaaaccacgctttctctcgattacgcctggaagacaaccgcaatggctctgagcattgtgtccttgttcccgctgtgtttatcaactacaagccagaaaaccacttggctccctgttctgcttggcagttttgggtgcaagccactgacaatgttcttgatcaccgaaaataagatttggggaaggaaatcttggcccctcaacgagggtatcatggccataggcatcgtgtccattctgctaagctcgctgcttaagaatgacgtccctctcgccgggcccctgatcgctggaggcatgttgattgcatgttatgtaatctcaggttctagtgccgatttatccctggagaaagcggctgaagtgagctgggagcaagaagccgagcattctgggacgagccacaacatactcgttgaagtgcaggacgatggaactatgaagattaaagacgaggagcgagatgacaccctgacaatccttctgaaggcaaccttgctagccgtctccggcgtgtacccaatgtcaatccctgctacactgtttgtatggtatttctggcagaaaaagaagcagcgcagtggcgtgctctgggatactcccagcccaccggaagtcgagcgggcagttctggacgatgggatttacagaatacttcaaaggggattactgggtcgttctcaggtgggcgtgggggtcttccaggacggagtgtttcataccatgtggcacgttacgcgcggcgccgtactcatgtatcagggtaaacggttggaaccttcctgggcgtcagtgaagaaagacctgatcagttacgggggaggctggagattccaaggcagctggaatacaggggaggaggtccaggtgattgctgttgaacccggaaagaacccaaaaaatgtgcagactacccccggtacatttaagacccctgagggcgaagtcggggccatcgcactcgatttcaagccaggaacttccggctctcccattgtgaacagggagggtaaaatcgtagggctgtacggaaatggcgtcgtgaccacatcgggcacgtatgttagcgccatagctcaagccaaggcatcacaggaagggcctcttccggagatcgaggacgaagtgtttaaaaagcgaaacctgactattatggatttgcacccaggatccggtaaaacccggcgctacctacccgctatcgtcagagaggccattaagaggaagctgcggacactcatcttagcgcctacccgagtggttgccagtgaaatggcagaggctctgaaaggcatgccaataagatatcagactacagccgtgaagtctgaacataccgggcgcgagattgtcgaccttatgtgccacgctacgttcactatgaggctgctcagccccgtgcgtgtacctaattacaacatgatcatcatggatgaggcacattttacagacccggcctccattgccgctcggggatatatctcaaccagagtgggcatgggtgaagcggcagccatattcatgaccgctactcccccagggtctgttgaggcctttcctcagagcaatgcagtcattcaagatgaagagagggacatccccgaacgcagttggaactccggatacgattggattacagacttcccaggcaaaaccgtgtggtttgtgcctagcatcaagtctggcaatgatatagccaactgtttgcgaaaaaacgggaagagagtcattcagctgtcacggaagacattcgacactgagtatcagaaaacgaagaataacgactgggattacgtagtgaccacagacatctccgagatgggagctaatttcagggcggatcgcgttatcgacccccgtagatgcctcaaaccagtgattctgaaggatggtccggaacgggtcatccttgccggccctatgcccgtgactgttgcaagtgctgcccagaggcgcgggcgaattggaagaaaccaaaataaagagggcgaccagtacgtgtatatgggtcagccactaaacaatgatgaagaccacgcacattggaccgaggccaagatgctgttggataacataaatacacccgaggggatcattcctgctttatttgaaccagagcgggaaaagagcgccgcgatcgacggcgagtacaggctgcgcggagaagcaagaaaaaccttcgtcgagctcatgaggcggggcgatctgcccgtgtggctttcgtataaggtagcctctgaggggtttcagtactccgaccgtcgctggtgcttcgatggagaacgaaacaatcaagtgctggaggaaaacatggacgttgagatctggactaaagaaggtgagagaaagaaactcaggcctcggtggttggacgctcgcacgtatagcgatccgctggccctaagagagtttaaggaattcgctgcaggcaggcggtcagtcagtggggacctgattctcgagataggaaaacttccacagcacctgaccttacgagcccagaatgctttggataacctggtgatgctccacaattctgaacagggcggtaaggcctacagacatgcaatggaggaactgcccgacacaatcgagactcttatgctgctcgcgttgattgccgtgctgaccgggggcgtcacattatttttcctatccggaaagggcctggggaaaaccagcatcggactcctttgtgttactgcttcaagtgccctgttgtggatggcaagcgtggagcctcactggattgctgcctccatcatactggaatttttcctcatggtactgcttatccccgagccagatcgccaaaggacacctcaggacaaccagctcgcatatgtggtcattggtctgttgtttatgatcctgacggtggccgctaacgaaatgggcttactagagaccactaagaaagatctggggattggacatgttgcggccgagaatcaccaacacgcaacaatgctcgacgtggatcttcggcccgcttctgcctggaccctgtacgccgtcgcaaccacagtaatcactccaatgatgcgtcatacgatagaaaacaccacagctaatattagcttgactgccatcgcgaaccaggctgccattctgatgggcctcgacaagggttggcctatctccaaaatggatataggggtgccgctgcttgcattaggctgctactcacaggttaatcccctgaccctcacagccgctgtgttgatgctggtcgcacactatgccatcattggaccaggcctacaggcgaaggctaccagagaggcccaaaagaggactgcagccgggatcatgaaaaaccctacggtggacggaattgtcgctatcgatctggaccccgtggtttacgacgccaagttcgaaaaacagctcggccagataatgcttctgattttgtgtacatctcagatcctgctcatgcgcaccacttgggcactgtgcgagagtatcaccttagctacaggtccacttactaccctgtgggaagggtcgcctggaaagttttggaatacaacgattgccgtgagcatggcgaacatcttccggggctcctatctcgccggtgcaggcctagctttctctctgatgaaatcattggggggaggccgaagagggaccggagcccaaggcgagactctgggtgagaagtggaagaggcagctcaatcagcttagcaaatccgaatttaacacatacaagcgcagtgggataaccgaggtagatcggtctgaagcaaaagagggactgaagagaggcgaaactacaaaacatgctgtgagccgtggtaccgccaagttgaggtggttcgtcgagcggaatctggttaagcccgagggcaaagtgattgacctcgggtgtggacgcggcgggtggtcatattactgcgccggattaaagaaagtcacggaagtgaagggctataccaaaggtgggccgggacacgaggaaccaatccctatggcgacatacggctggaacctggtaaagcttcattccggcaaagatgtgtttttcatgcccccagagaagtgtgacactctgctatgcgatattggggaaagtagccccaatcctaccatcgaggagggacgaacactcagagttctgaagatggtggaaccgtggttgaggggtaaccagttttgtataaaaatcctgaatccctacatgccatctgtcgtggagactctcgaacaaatgcagcggaagcacggcgggatgcttgtccgcaaccctctgtccagaaattcaacccacgagatgtattgggtgagctgcggaacaggcaacattgtttcggctgtaaacatgacctctaggatgttactgaatcgattcactatggcacatcggaaacccacgtttgagcgtgacgtggatttgggtgccgggacaagacacgtcgctgtggaacctgaggttgccaacctcgacatcattggacagcgcatcgaaaatattaagaacgagcataaaagtacctggcactacgatgaagacaatccatataagacttgggcataccacggctcctatgaggtgaagcccagcggctcagcctcctctatggtcaacggggtggtaaggctgctaaccaaaccttgggatgtgatcccaatggttacacaaatagctatgacggacaccactcccttcggacagcagcgggtctttaaggagaaagtggacacaagaaccccgcgcgcgaagaggggtactacacagattatggaagtgaccgccaaatggctttggggcttcctgagccgaaataagaagcctcggatctgtacaagagaggaatttactaggaaagtccgcagtaacgcagctatcggggccgttttcgtggatgagaatcaatggaactccgcaaaggaagccgtagaggacgagcgtttttgggatctcgtgcatcgggaaagagagctgcacaaacagggaaagtgcgctacctgcgtctacaatatgatgggcaaaagggaaaagaagttgggtgagttcgggaaagccaagggaagccgcgcgatttggtatatgtggctgggcgcacgattcctcgaatttgaggcccttggcttcatgaacgaggaccattggttttctcgggaaaattcactgagtggggtggagggagaaggtttacacaaactgggctacatattgagagatatctccaagattccagggggaaacatgtacgctgacgatacggccggctgggacaccaggatcacagaggatgacctccagaatgaggcaaaaattactgatatcatggaacccgagcatgctctgctagccaccagcatattcaagcttacatatcagaacaaagttgtgcgcgtccaaagacctgctaagaacggtactgtgatggacgtaatctctcggagggatcagcgtgggtcgggacaggttggcacctacggcctgaatacgtttacaaacatggaagtgcagctcattcgacaaatggagtcagaagggatcttcctgccaagcgagttggagacccccaatttagccgaacgcgtcctggactggctcgagaagcacggagcagaaagacttaaacggatggcgatttccggtgacgattgtgtggtgaagccgatcgacgataggtttgccactgctctgacagccctaaacgacatgggcaaagtccgcaaggatatacctcagtgggagcccagtaaagggtggaatgactggcagcaggttccattctgctctcaccattttcaccaactgattatgaaggatggaagagaaatcgtggtaccttgtcggaaccaggacgagctcgtgggcagggcacgagtcagccagggtgctgggtggtccttgcgtgagaccgcctgcctgggaaagtcatatgcacaaatgtggcagcttatgtacttccatagacgcgatctgcggctcgccgcgaatgctatctgtagtgccgtgcccgttgactgggtgccaacttctaggaccacatggagcattcacgcacaccatcagtggatgacgaccgaagatatgttatccgtctggaacagagtgtggatagaggaaaatccctggatggaggacaaaactcacgtatcaagctgggaagaggttccttatctgggcaagcgcgaggaccagtggtgcggctctttgatcgggctgacagcccgggctacctgggccactaacattcaagtggcaatcaatcaggtcaggcgactcattggaaacgaaaattaccttgattatatgacatccatgaaaagatttaagaacgagagtgacccagaaggtgctctgtggtga

SEQ ID NO: 13372 - RNA, 9879 nt, synthetic construct
  misc_feature 1..9879: note = derived and/or modified CDS sequence (opt3) from DENV-1__KJ189323__SS-prME
  source 1..9879: mol_type = other RNA
agcgtgaccatgctgctcatgcttctgcccacagcattggctttccacttaactacgcggggcggggaacctcatatgatcgtctccaagcaggaaaggggaaaatctctgctatttaagacctcagccggtgttaacatgtgcacactcattgccatggacctgggcgaactttgtgaagatactatgacctacaaatgcccacaaataacagaagcggaaccggacgatgtggactgttggtgcaatgctaccgatacttgggtaacatatgggacctgtagtcagacgggagagcaccggcgcgacaagcgaagcgtggccctggcaccccatgtcggcttgggtctcgagactcgtaccgaaacatggatgtcctctgagggggcctggaaacagatccagagagtggaaacttgggctctgaggcaccctggattcaccgttattgcactgtttctcgcccatgctatcggcacatcgattacccaaaagggcatcatattcatcttactgatgcttgtgacgccatcaatggccatgcggtgcgtcgggattggaaaccgcgattttgtggagggtttgagcggcgcgacttgggtagacgttgtgctggagcacgggagttgtgtcacaaccatggcaaagaataaacccactctagatatcgaactcctgaagacagaggtgaccaaccctgccattcttagaaaactgtgcatcgaagctaagatatccaatacgaccacagactctaggtgtccaactcagggagaggccaccttggtggaagaacaggatgcaaacttcgtctgccggcgcacatttgttgaccgaggctggggtaatgggtgtggactcttcggcaaaggcagcctgttaacttgcgctaagtttaagtgcgtgaccaaactggaggggaagattgtacagtacgaaaacctcaaatattccgtgatcgtcacagtgcacaccggagatcaacatcaggttggtaatgagactacggaacacggcacaattgccaccatcactccccaggcgcctacctcagagatccagcttacagactacggggccctgaccttggactgtagtccaagaactggactagatttcaacgaaatggtgctgctcacaatgaaggagaaaagctggctggtccataagcaatggtttcttgacctgccgttgccctggacgtctggcgcatccacctcacaggagacttggaataggcaggatctcctggtgacattcaaaaccgctcacgccaagaagcaagaagtagttgtgttaggtagccaggagggggctatgcacacagccctgactggcgcaaccgaaattcagacgagtggaaccacaactatatttgccggccatctaaaatgccggctcaagatggacaaactgacccttaaggggacatcttatgtcatgtgtactggacctttcaaattggagaaggaagtggctgagacccagcacggtacggtcctggtgcaagttaagtacgagggcacagatgcgccatgcaaaatccccttctccacccaggacgaaaagggggtgactcagaacggacgtctcattacagcaaatcctatcgtaaccgataaagagaagccagtcaacatagaaactgagcccccgtttggcgagagctatattgtggttggtgccggggaaaaagctctgaaactttcgtggttcaagaaaggatcttccatcggaaagatgtttgaggccaccgcacgcggcgccagaaggatggctatcctgggggacacagcctgggatttcggatcaattggtggcgtgtttacgagtgtcgggaaattggtgcatcaggtattcggaaccgcatacggcgtgctctttagcggtgtttcctggactatgaagatcgggattggcatactgttaacatggctgggactaaattctcggagcacctcactcagtatgacatgtatcgcggtcggcatggtgactctgtaccttggggtgatggtccaagctgactccggatgcgttattaactggaaaggccgagaattgaagtgtggtagcgggatcttcgtgaccaacgaggtgcacacgtggacagaacagtataagtttcaggccgattctcctaaacgcctgtcagcagccatcggaaaggcttgggaggagggcgtatgcggtattagaagtgccaccaggctcgaaaatataatgtggaaacagatcagcaacgagctgaatcatattttactggaaaacgacatgaagttcactgtcgtggttggcgacgcaaatgggatccttgctcaaggcaagaagatgattcggccccagccaatggagcacaaatactcctggaagtcttggggcaaggccaaaatcataggggcggatatccagaacaccacatttattatcgacggacctgatactcccgaatgtccagacaatcagcgcgcctggaacatttgggaggtggaggattatggcttcggtatctttaccacaaatatatggttgaagctcagagactcgtacacgcaaatgtgcgatcacaggctgatgagcgctgcaattaaagactccaaggccgtccatgctgatatggggtattggatcgaatcagagaaaaacgaaacctggaagctagcccgtgcaagtttcattgaggtgaagacttgtacatggcccaaatctcacaccctgtggagcaatggagttctcgaatccgagatgatcatacctaagatctacggcggtccaatttcacagcataactatcggccgggctacttcactcagacagcggggccctggcacctgggaaaacttgagttggactttgatctgtgcgaaggcaccacggtggtagtcgacgagcactgcgggaatcgaggacctagcttaagaactaccacagtgaccggcaagatcattcatgaatggtgttgcaggtcttgtactctcccacccctgcgcttccggggtgaggatgggtgctggtacggaatggagatcagacctgtgaaagaaaaggaggaaaaccttgtcaggtccatggttagtgccggcagcggtgaggtggactctttttccctgggcatattgtgtgtatcaattatgatcgaagaggtgatgcgcagtcgatggagccggaagatgctcatgacagggaccctggctgtcttcctactgctcgtgatgggacaactgacatggaatgaccttatccgtttgtgcattatggttggcgccaacgcatcggatagaatggggatgggaactacctatctggctttaatggccacgtttaaaatgaggccaatgttcgcagtgggcctcctgtttcgccggcttacatccagagaggtcctgctactcaccatcggtctgtctttggtggccagcgttgaactgcccaactcattagaggaactcggggacggactggctatgggcattatgatgcttaagctgttgactgagttccagccgcaccagctctggaccacactgctaagtctgacttttataaaaaccacgctttccctcgattacgcgtggaagacaaccgccatggcactgtctatcgtgagcttgttccctctgtgtttatccactacatcacagaaaaccacttggctcccagtcctgcttggcagctttgggtgcaagcccctgacaatgttcttgattaccgaaaataagatctggggaaggaaaagttggcctctcaacgagggtattatggctatcggcatagtatctatcctgctatccagcctgcttaagaatgacgtgcccctcgccgggccactgattgccggaggcatgttgatcgcttgttatgttatttcgggttcatctgcagatttaagtctggagaaagccgcggaagtgtcctgggagcaagaagctgagcatagcgggacgtctcacaacatcctcgtcgaagtgcaggacgatggaactatgaagataaaagacgaggagcgagatgacaccctgacaattcttctgaaggccaccttgctagcagtaagcggcgtgtaccctatgtccatccccgccacactgtttgtctggtatttctggcagaaaaagaagcagcgctcaggcgttctctgggatactccaagtccgcctgaagtggagcgggctgtgctggacgatgggatctacaggattcttcaacgaggattactgggtcgtagccaggtcggcgtgggggttttccagggaggcgtatttcataccatgtggcacgtgacgcgcggtgcagtcctcatgtatcaggggaaacggttggaaccctcttgggcctccgtgaagaaagacctgatatcatacggaggcggctggagattccaagggagttggaatacaggagaggaggttcaggtgatcgcggtcgaaccaggtaagaaccccaaaaatgtgcagactacccctggcacatttaagaccccagagggggaagtaggagctattgccctcgacttcaagcccggcactagcggttcccctatcgtcaacagggaggggaaaattgtgggactgtacggcaatggcgttgtgaccacatctgggacgtatgtctcggcaatcgcccaagctaaggccagccaggaaggaccgcttccagagatagaggatgaagtgtttaaaaagcgaaacctgactatcatggacttgcaccccggttcaggcaaaacccggcgctacctacctgcaattgttagagaggctatcaagaggaagctgcggacactcattttagccccaacccgagtggtcgcgtccgaaatggccgaggcactgaaagggatgcccatcagatatcagactacagctgtgaagagtgaacataccggacgcgagatagtagatcttatgtgccacgccacgttcactatgaggctgctctctcctgtgcgtgttccgaattacaacatgattatcatggacgaggctcattttacagatcccgcaagcatcgccgcccggggctatatttccaccagagtcggtatgggggaagctgcggcaatcttcatgaccgccactccacctggatcagtggaggcttttccccagtctaatgccgtgatacaagacgaagagagggatattccagaacgcagctggaacagtggctacgactggatcacagatttccctggcaaaaccgtctggtttgtaccctccattaagagcgggaatgacatcgcaaactgtttgagaaagaacggaaagagagtgatacagctgtctcggaagacattcgatactgagtatcagaaaacgaagaataacgactgggactacgttgtgaccacagatatttcagagatgggtgccaatttcagggctgaccgcgtcatcgatccacgtagatgcctcaaaccggtgatcctgaaggacggccctgaacgggttattcttgcggggcccatgccagtgactgtcgcctccgcagctcagaggcgcggacgaatcggcagaaaccaaaataaagagggtgatcagtacgtgtatatggggcagcccctaaacaatgacgaagatcacgcccattggaccgaggcaaagatgctgttggacaacattaatacacctgagggcataatcccagccttatttgaacccgagcgggaaaagagtgctgccattgatggagagtacaggctgcgcggcgaagcgagaaaaaccttcgtagagctcatgaggagaggggacctgcctgtgtggcttagctataaggttgcatcggagggatttcagtactctgatcgtcgctggtgcttcgacggtgaacgaaacaatcaagtcctggaggaaaacatggatgtggagatctggactaaagaaggcgagagaaagaaactcaggccgcggtggttggacgcccgcacgtattccgacccactggctctaagagagtttaaggagttcgccgctgggaggcggagcgtgtcaggagatctgatcctcgagattggcaaacttccccagcacctgaccttacgagcacagaatgccttggacaacctggtcatgctccacaatagtgaacagggtgggaaggcttacagacatgccatggaggaactgcctgatacaatagagactcttatgctgctcgcattgatcgcggttctgaccggcggagtgacattatttttcctatctggcaaggggctgggaaaaacctccattggtctcctttgtgtaactgccagctcagctctgttgtggatggccagtgtggagccccactggatcgcagctagcattatcctggaatttttcctcatggtcctgcttataccagagcctgaccgccaaaggacaccccaggataaccagctcgcctatgtggttatcggcctgttgtttatgattctgacggtggcagccaacgaaatggggttactagagaccactaagaaagacctgggaatcggccatgtcgctgcggagaatcaccaacacgccacaatgctcgatgtagaccttcggccagcatccgcttggaccctgtacgccgtggccaccacagttattactcctatgatgcgtcatacgatcgaaaacaccacagcaaatatatctttgactgctattgccaaccaggcggctatcctgatgggtctcgataaggggtggccgattagcaaaatggacatcggcgtgcccctgcttgccttaggatgctactcccaggtcaatccactgaccctcacagcagccgtgttgatgctggtcgctcactatgcaataatcggccctgggctacaggccaaggcgaccagagaggctcaaaagaggactgccgcaggaattatgaaaaaccccacggtggatggcatcgttgccattgacctggatccagtggtatacgacgctaagttcgaaaaacagctcggtcagatcatgcttctgatattgtgtacatcacagattctgctcatgcgcaccacttgggccctgtgcgagtctatcaccttagcaacagggcctcttactaccctgtgggaaggaagtcccggcaagttttggaatacaacgatcgctgtgtcgatggccaacattttccggggtagctatctcgcgggcgccgggctagcattctccctgatgaaatctttgggaggcgggcgaagaggaaccggcgctcaaggtgagactctgggggagaagtggaagaggcagctcaatcagctttcaaaaagcgaatttaacacatacaagcgctccggaatcatggaggtcgaccggagtgaagccaaagagggcctgaagagaggtgaaaccactaaacatgcagtttctcgtggcacagctaagttgaggtggttcgtggagcggaatctggtcaagccggaggggaaagtgatagatctcggatgtggccgcgggggatggagctattactgcgccggcttaaagaaagtaaccgaagtgaagggttatacgaaagggggaccaggccacgaggaacctattcccatggccacctacggctggaacctggttaaacttcattcagggaaagacgtgtttttcatgccacccgagaagtgtgatacactgctatgcgacatcggagaatccagtcctaatccgactattgaggagggtcgaaccctcagagtcctgaagatggtggaaccctggttgaggggcaaccagttttgtatcaaaatactgaatccatacatgcctagcgtcgtggagacactcgaacaaatgcagcggaagcacgggggaatgcttgttcgcaaccccctgtctagaaattccactcacgagatgtattgggtatcatgcggcaccggtaacatcgtgagcgcggtcaacatgacatcgaggatgttactgaatcgattcaccatggctcatcggaaacctacttacgagcgtgatgtggacttgggggcaggaacgagacacgttgccgtggaaccagaggtcgctaacctcgatattatcggccagcgcattgaaaatatcaagaacgagcataaatctacatggcactatgacgaagataatccctacaagacctgggcctatcacggcagttacgaggtgaggccttccgggagcgcatcatccatggtaaacggagtggttcggctgctaactaagccatgggacgtcattcccatggtgacccaaatcgccatgacagatacgaccccgtttggtcagcagagagtgttcaaagagaaggtcgacactcgcacacctagggctaaacgaggcaccactcagataatggaagttacagcgaagtggctttgggggtttctgtctcggaataaaaagccaagaatttgtaccagggaggagttcacacgcaaggtgcgtagcaacgccgcaatcggagctgtatttgtggacgagaatcaatggaacagtgccaaagaagcagtcgaggatgagcggttctgggacctcgtgcatagagaaagggagctgcacaagcagggcaaatgcgccacttgcgtttataatatgatgggtaagcgcgagaaaaagttgggggagtttggaaaggctaaaggctcccgagccatctggtacatgtggctgggcgcgcggttcctcgagttcgaggcacttgggtttatgaacgaggatcattggttcagcagagaaaattctctgtcaggagtggagggtgaaggcttacacaagctggggtacattttgagggacataagtaaaatccccggaggcaacatgtatgccgatgacaccgctggttgggatacgcgcattaccgaggacgatctccagaatgaggccaagatcacagaaattatggagcctgaacatgcactgctagctacttccatctttaaacttacctaccagaacaaggtcgtgagagtacaacggccagccaaaaacgggacagttatggacgtgataagcaggcgtgatcagcgaggatctggccaggtcggcacttatgggctgaataccttcacgaacatggaggtgcagctcatccgccaaatggaatcggagggaatttttctgccctcagagttggaaacaccgaatttagctgagagagtgctggactggctcgaaaagcacggtgccgagcggcttaagaggatggcaatcagcggcgatgactgtgtcgttaaacctattgacgatcgcttcgcgaccgccctgactgctctaaacgacatggggaaggtgagaaaagatatcccccagtgggaaccatccaagggatggaatgactggcagcaggtacctttttgcagtcaccatttccaccaactgataatgaaagatggccgggagattgtggtcccctgtaggaaccaggacgagctcgtgggtcgagcccgtgtttctcagggggcaggatggagcttgagagaaacagcttgcctgggcaagtcctacgcccaaatgtggcagcttatgtattttcatcgccgggatctgaggctcgcagccaatgcgatctgttcagctgtgccagtcgactgggtgcccaccagtagaactacctggtctatccacgcccaccatcagtggatgacaacggaggatatgttaagcgtatggaaccgcgtttggattgaagagaatccttggatggaagacaagacccacgtgtcctcatgggaggaggtcccatacctgggcaaacgggaagatcagtggtgcgggagcttgataggactgactgcaagggccacatgggctaccaacatccaagtggccattaatcaggttcgaagactcatcggtaacgagaattatcttgactacatgacttctatgaagcggttcaaaaacgaatccgacccggagggcgcactgtggtga

SEQ ID NO: 13373 - RNA, 9879 nt, synthetic construct
  misc_feature 1..9879: note = derived and/or modified CDS sequence (opt3) from DENV-1__KJ189324__SS-prME
  source 1..9879: mol_type = other RNA
agcgtgaccatgctgctcatgcttctgcccacagccttggctttccacttaactacgagaggcggggagcctcatatgatcgtctccaagcaggaaaggggaaaatctctgctatttaagacctcagcaggtgttaacatgtgcacactcattgccatggacctgggcgagctttgtgaagatactatgacctacaaatgcccacaaataacagaggcggaaccggacgatgtggactgttggtgcaatgctaccgatacttgggtaacatatgggacctgtagtcagacgggagagcaccggcgcgacaagcgaagcgtggccctggcaccccatgtcggcttgggtctcgagactcgtaccgaaacatggatgtcctctgagggggcctggaaacagatccagagagtggaaacttgggctctgaggcaccctggattcaccgttattgcactgtttctcgcccatgctatcggcacatcgattacccaaaagggcatcatattcatcttactgatgcttgtgacgccatcaatggccatgcggtgcgtcgggattggaaaccgcgattttgtggagggtttgagcggcgcgacttgggtagacgttgtgctggagcacgggagttgtgtcacaaccatggcaaagaataaacccactctagatatcgaactcctgaagacagaggtgaccaaccctgccattcttagaaaactgtgcatcgaagctaagatatccaatacgaccacagactctaggtgtccaactcagggagaggccaccttggtggaagagcaggatgcaaacttcgtctgccggcgcacatttgttgaccgaggctggggtaatgggtgtggactcttcggcaaaggcagcctgttaacttgcgctaagtttaagtgcgtgaccaaactggaggggaagattgtacagtacgaaaacctcaaatattccgtgatcgtcacagtgcacaccggagatcaacatcaggttggtaatgagactacggaacacggcacaattgccaccatcactccccaggcgcctacctcagagatccagcttacagactacggggccctgaccttggactgtagtccaagaactggactagatttcaacgaaatggtgctgctcacaatgaaggagaaaagctggctggtccataagcaatggtttcttgacctgccgttgccctggacgtctggcgcatccacctcacaggagacttggaataggcaggatctcctggtgacattcaaaaccgctcacgccaagaagcaagaagtagttgtgttaggtagccaggagggggctatgcacacagccctgactggcgcaaccgaaattcagacgagtggaaccacaactatatttgccggccatctaaaatgccggctcaagatggacaaactgacccttaaggggacatcttatgtcatgtgtactggatccttcaaattggagaaggaagtggctgagacccagcacggtacggtcctggtgcaagttaagtacgagggcacagatgcgccttgcaaaatcccattcagcacccaggacgaaaagggggtgactcagaacggacgtctcattacagcaaatcccatcgtaaccgataaagagaagcctgtcaacatagaaactgagccaccctttggcgagtcgtatattgtggttggtgccggggaaaaagctctgaagctttcttggttcaagaaaggctcctcaatcggaaagatgtttgaggccaccgcacgcggcgccagaaggatggctatcctgggggacacagcctgggatttcggaagtattggtggcgtgtttacgagcgtcgggaaattggtgcatcaggtattcggaaccgcatacggcgtgctcttttccggtgtttcttggactatgaagatcgggattggcatactgttaacatggctgggactaaatagccggtcaaccagtctctccatgacatgtatcgcggtcggcatggtgactctgtaccttggggtgatggtccaagctgacagcggatgcgttattaactggaaaggccgagaattgaagtgtggttctgggatcttcgtgaccaacgaggtgcacacgtggacagaacagtataagtttcaggccgattcaccgaaacgcctgagtgcagccatcggaaaggcttgggaggagggcgtatgcggtattagaagcgccaccaggctcgaaaatataatgtggaaacagatctccaacgagctgaatcatattttactggaaaacgacatgaagttcactgtcgtggttggcgacgcaaatgggatccttgctcaaggaaaaaagatgattcggcctcagcccatggagcacaaatactcttggaagtcgtggggcaaggccaaaatcataggggcggatatccagaacaccacatttattatcgacggaccagatactcctgaatgtcccgacaatcagcgcgcctggaacatttgggaggtggaggattatggcttcggtatctttaccacaaatatatggttgaagctcagagacagctacacgcaaatgtgcgatcacaggctgatgtccgctgcaattaaagactcaaaggccgtccatgctgatatggggtattggatcgaaagtgagaaaaacgaaacctggaagctagcccgtgcatctttcattgaggtgaagacttgtacatggccacggagccacaccctgtggtccaatggagttctcgaatcagagatgatcatacccaaaatctacggcggtcctattagccagcataactatcgaccaggctacttcactcagacagcggggccgtggcacctgggaaagcttgagttggactttgatctgtgcgaaggcaccacggtggtagtcgacgagcactgcgggaatagaggaccctctttaaggactaccacagtgaccggcaaaatcattcatgaatggtgttgccgctcctgtactctccctccactgcggttcagaggtgaggatgggtgctggtacggaatggagatcaggcccgtgaaggaaaaagaggaaaaccttgtccgcagtatggttagcgccggctctggtgaggtggactccttttcactgggcatattgtgtgctagtattatgatcgaagaggtaatgcgaagccggtggtcgcgtaagatgctcatgacagggaccctggccgtgttcctactgctcgtcatgggacaactgacatggaatgaccttatcagattgtgcattatggtgggcgcaaacgcttccgataggatggggatgggaactacctatctggccttaatggcaacgtttaagatgcgccctatgttcgccgttggcctcctgtttcggagacttacatctagggaggtgctgctactcaccatcggtctgagcttggtcgcttcagtggaactgccaaacagtttagaggaactcggggacggactggcgatgggcattatgatgcttaaactgttgactgagttccagccccaccagctctggaccacactgctatccctgacttttataaagaccacgctttctctcgattacgcctggaaaacaaccgcaatggctctgagcatcgtttccttgttcccgctgtgtttatcaactacaagccagaagaccacttggctccctgtgctgcttggcagttttgggtgcaaaccactgacaatgttcttgattaccgaaaataagatctggggacgaaagtcttggcccctcaacgagggtattatggccatcggcatagtctccatcctgctaagctcgctgcttaaaaatgacgtacctctcgccgggcccctgattgctggaggcatgttgatcgcatgttatgtgatttcaggttctagtgccgatttatccctggagaaggcggctgaagttagctgggagcaagaagccgagcattctgggacgagccacaacatcctcgtggaagtccaggacgatggaactatgaaaataaaggacgaggagcgcgatgacaccctgacaattcttctgaaagcaaccttgctagccgtgtccggcgtatacccaatgtcaatccctgctacactgtttgtgtggtatttctggcagaagaaaaagcagcggagtggcgtcctctgggatactcccagcccaccggaagttgagagagcagtgctggacgatgggatctacaggattcttcaacgtggattactgggtcgctctcaggtgggcgtcggggtgttccaggacggagtttttcataccatgtggcacgtaacgcggggcgccgtgctcatgtatcagggtaagagattggaaccttcctgggcgtcagtcaaaaaggacctgataagttacgggggaggctggaggttccaaggcagctggaatacaggggaggaggtgcaggttatcgctgtggaacccggaaaaaacccaaagaatgtccagactacccccggtacatttaaaacccctgagggcgaagtgggggccattgcactcgatttcaagccaggaacttccggctctcccatcgtaaaccgagagggtaagattgtcgggctgtacggaaatggcgtggttaccacatcgggcacgtatgtgagcgccatcgctcaagccaaagcatcacaggaagggcctcttccggagatagaggacgaagtctttaagaaacggaacctgactatcatggatttgcacccaggatccggtaagacccgcagatacctacccgctattgtgagggaggccatcaaacggaagctgcgaacactcattttagcgcctaccagagttgtggccagtgaaatggcagaggctctgaagggcatgccaatccgctatcagactacagccgtcaaatctgaacataccgggagggagatagtggaccttatgtgccacgctacgttcactatgcgtctgctcagccccgtacgggtgcctaattacaacatgattatcatggatgaggcacattttacagacccggcctccatcgccgctagaggatatatttcaaccagggttggcatgggtgaagcggcagccatcttcatgaccgctactcccccagggtctgtcgaggcctttcctcagagcaatgcagtgatacaagatgaagagcgcgacattcccgaacgaagttggaactccggatacgattggatcacagacttcccaggcaagaccgtgtggtttgtccctagcattaaatctggcaatgatatcgccaactgtttgagaaagaacgggaaacgggtaatacagctgtcaaggaagacattcgacactgagtatcagaagacgaaaaataacgactgggattacgtggttaccacagacatttccgagatgggagctaatttccgcgcggatcgtgtgatcgaccccagacggtgcctcaagccagtcatcctgaaagatggtccggaaagggtgattcttgccggccctatgcccgttactgtggcaagtgctgcccagcgccgagggagaatcggacggaaccaaaataaggagggcgaccagtacgtctatatgggtcagccactaaacaatgatgaagaccacgcacattggaccgaggccaaaatgctgttggataacattaatacacccgaggggataatccctgctttatttgaaccagagagggaaaagagcgccgcgattgacggcgagtaccgcctgagaggagaagcaaggaagaccttcgtggagctcatgcggcgtggcgatctgcccgtatggctttcgtataaagtggcctctgaggggtttcagtactccgaccgccgatggtgcttcgatggagaaagaaacaatcaagttctggaggaaaacatggacgtcgagatctggactaaggaaggtgagaggaaaaagctccggcctcgctggttggacgctagaacgtatagcgatccgctggccctaagggagtttaaagaattcgctgcaggccggcgatcagtgagtggggacctgatcctcgagattggaaagcttccacagcacctgaccttaagagcccagaatgctttggataacctggtgatgctccacaattctgaacagggcggtaaagcctaccgccatgcaatggaggaactgcccgacacaatagagactcttatgctgctcgcgttgatcgccgtcctgaccgggggcgttacattatttttcctatccggaaagggcctggggaagaccagcattggactcctttgtgtgactgcttcaagtgccctgttgtggatggcaagcgtagagcctcactggatcgctgcctccattatcctggaatttttcctcatggtgctgcttatacccgagccagataggcaacggacacctcaggacaaccagctcgcatatgtcgtgatcggtctgttgtttatgattctgacggttgccgctaacgaaatgggcttactagagaccactaaaaaggatctggggatcggacatgtggcggccgagaatcaccaacacgcaacaatgctcgacgtcgatcttcgtcccgcttctgcctggaccctgtacgccgtagcaaccacagtgattactccaatgatgagacatacgatcgaaaacaccacagctaatataagcttgactgccattgcgaaccaggctgccatcctgatgggcctcgacaaaggttggcctatttccaagatggatatcggggttccgctgcttgcattaggctgctactcacaggtgaatcccctgaccctcacagccgctgtcttgatgctggtggcacactatgccataatcggaccaggcctacaggcgaaagctaccagggaggcccaaaagcgcactgcagccgggattatgaagaaccctacggtcgacggaatcgtggctattgatctggaccccgttgtgtacgacgccaaattcgaaaagcagctcggccagatcatgcttctgatattgtgtacatctcagattctgctcatgcggaccacttgggcactgtgcgagagtatcaccttagctacaggtccacttactaccctgtgggaagggtcgcctggaaaattttggaatacaacgatcgccgtaagcatggcgaacattttccgaggctcctatctcgccggtgcaggcctagctttctctctgatgaagtcattggggggaggcagaagggggaccggagcccaaggcgagactctgggtgagaaatggaagcgccagctcaatcagcttagcaagtccgaatttaacacatacaaacggagtgggatcatggaggtggatagatctgaagcaaaggagggactgaaacgtggcgaaaccactaagcatgctgtcagcaggggtacagccaaattgcggtggttcgttgagcgcaatctggtgaagcccgagggcaaggtcatagacctcgggtgtggacgaggcgggtggtcatattactgcgccggattaaaaaaggtgaccgaagtaaaaggctatacgaagggtgggccgggacacgaggaaccaattcctatggcgacctacggctggaacctggtgaaacttcattccggcaaggatgtttttttcatgcccccagagaaatgtgacacactgctatgcgatatcggggaaagtagccccaatcctactattgaggagggaagaaccctcagggtgctgaagatggtcgaaccgtggttgcggggtaaccagttttgtatcaagatactgaatccctacatgccatctgtggtcgagacactcgaacaaatgcagcgcaaacacggcgggatgcttgtgagaaaccctctgtccaggaattcaactcacgagatgtattgggttagctgcggaaccggcaacatcgtatcggctgtgaacatgacatctcgaatgttactgaatcggttcaccatggcacatcgtaagcccacttacgagagagacgtcgatttgggtgccgggacgcgccacgtggctgttgaacctgaggtggccaacctcgacattatcggacagaggattgaaaatatcaaaaacgagcataagagtacatggcactatgatgaagacaatccatacaaaacctgggcatatcacggctcctacgaggtcaagcccagcggctcagcctcctctatggtgaacggggtagtgcggctgctaactaagccttgggatgttattccaatggtcacccaaatcgctatgacagacacgaccccctttggacagcagagagtgttcaaagagaaggtggacactcgcacaccgagggcgaaacgaggtaccactcagataatggaagtcacagccaagtggctttggggctttctgagccggaataaaaagcctagaatttgtaccagggaggaattcacacgcaaggttcgtagtaacgcagctatcggggccgtgtttgtagatgagaatcaatggaactccgcaaaagaagccgtggaggacgagcggttctgggatctcgtccatagagaaagggagctgcacaagcagggaaaatgcgctacttgcgtgtataatatgatgggcaagcgcgaaaaaaagttgggtgagtttgggaaggccaaaggaagccgagcgatctggtacatgtggctgggcgcacggttcctcgaattcgaggcccttggctttatgaacgaggaccattggttctctagagaaaattcactgagtggggttgagggagaaggtttacacaagctgggctacattttgagggatatatccaaaatcccagggggaaacatgtatgctgacgataccgccggctgggacacgcgcattaccgaggatgacctccagaatgaggcaaagatcacagaaattatggagcccgaacatgctctgctagccactagcatctttaaacttacctaccagaacaaggtggtcagagtgcaacggcctgctaaaaacggtacagtaatggatgttatatctaggcgtgaccagcgagggtcgggacaggtgggcacttatggcctgaataccttcacgaacatggaggtccagctcatccgccaaatggaatcagaggagatttttctgccaagcgaattggagacacccaatttagccgaaagagtgctggattggctcgagaagcacggggcagaacggcttaagaggatggcgatctccggagacgactgtgtggtcaaaccgattgatgaccgcttcgccaccgctctgactgccctaaacgatatgggtaaggttagaaaagacatccctcagtgggagcccagtaagggctggaatgattggcagcaggtgccattttgctctcaccatttccaccaactgataatgaaagacgggcgggagattgtagtgccttgtaggaaccaggatgaactcgtcggacgagcacgtgtgagccagggcgctggttggtccttgagagagacagcctgcctggggaagtcatacgcacaaatgtggcagcttatgtattttcatcgccgggacctgaggctcgccgcgaatgctatctgtagtgccgttcccgtggattgggtcccaacctctagaactacctggagcatccacgcacaccatcagtggatgacaacggaagacatgttatccgtgtggaaccgcgtatggattgaggaaaatccctggatggaggataagacccacgtttcaagctgggaggaagtgccttacctgggaaaacgggaggaccagtggtgcggctctttgataggcctgactgccagggctacatgggccaccaacatccaagtcgcaattaatcaggtgcgaagactcatcgggaacgaaaattatcttgactacatgacttccatgaagcggttcaaaaacgagagtgatccagagggagctctgtggtga

SEQ ID NO: 13374 - RNA, 9879 nt, synthetic construct
  misc_feature 1..9879: note = derived and/or modified CDS sequence (opt3) from DENV-1__KJ189325__SS-prME
  source 1..9879: mol_type = other RNA
agcgtgaccatgctgctcatgcttctgcccacagcattggctttccacttaactacgagaggaggggaacctcatatgatcgtctccaagcaggaaaggggaaaatctctgttgtttaagacctcagccggtgttaacatgtgcaccctcattgccatggacctgggcgaactttgtgaagatactatgacctacaaatgcccacagataacagaggcggaaccggacgatgtggactgttggtgcaatgctaccgatacttgggtaacatatgggacctgtagtcagacgggagagcaccggcgcgacaagcgaagcgtggccctggcaccccatgtcggcttgggtctcgagactcgtaccgaaacatggatgtcctctgagggggcctggaaacagatccagagagtggaaacttgggctctgaggcaccctggattcaccgttattgcactgtttctcgcccatgctatcggcacatcgattacccaaaagggcacgatcttcatattactgatgcttgtgactccatcaatggccatgcggtgcgtcgggatcggaaaccgcgattttgtggagggtttgagcggcgcgacatgggttgacgttgtgctggagcacgggagttgtgtcaccactatggcaaagaataaacccacactagatattgaactcctgaagaccgaggtgacgaaccctgccatccttagaaaactgtgcattgaagctaagatctccaataccacaactgactctaggtgtccaacccagggagaggccacattggtggaagaacaggatgcaaacttcgtctgccggcgcacttttgttgaccgaggctggggtaatgggtgtggactcttcggcaaaggcagcctgttaacctgcgctaagtttaagtgcgtgacaaaactggaggggaagatagtacagtacgaaaacctcaaatattccgtgattgtcaccgtgcacactggagatcaacatcaggttggtaatgagacgacagaacacggcaccatcgccactattaccccacaggcgcctacatcagagatccagcttaccgactacggggccctgactttggactgtagtccaagaacaggactagatttcaacgaaatggtgctgctcacgatgaaggagaaaagctggctggtccataagcaatggtttcttgacctgccgttgccctggacctctggcgcatccacttcacaggagacatggaataggcaggatctcctggtgaccttcaaaacagctcacgccaagaagcaagaagtagttgtgttaggtagccaggagggggctatgcacactgccctgaccggcgcaacggaaatccagaccagtggaacaactaccatttttgccggccatctaaaatgccggctcaagatggacaaactgacacttaaggggacttcttatgtcatgtgtaccggatccttcaaattggagaaggaagtggctgagacgcagcacggtacagtcctggtgcaagttaagtacgagggcaccgatgcgccttgcaaaataccattcagcactcaggacgaaaagggggtgacacagaacggacgtctcatcaccgcaaatcccattgtaactgataaagagaagcctgtcaacatcgaaaccgagccaccctttggcgagtcgtatatagtggttggtgccggggaaaaagctctgaaactttcttggttcaagaaaggctcctcaattggaaagatgtttgaggccacagcacgcggcgccagaaggatggctatcctgggggacacggcctgggatttcggaagtatcggtggcgtgtttaccagcgtcgggaaattggtgcatcaggtattcggaactgcatacggcgtgctcttttccggtgtttcttggacaatgaagattgggatcggcattctgttaacctggctgggactaaatagccggtcaacaagtctctccatgacttgtatagcggtcggcatggtgaccctgtaccttggggtgatggtccaagctgacagcggatgcgttatcaactggaaaggccgagaattgaagtgtggttctgggattttcgtgacgaacgaggtgcacacatggaccgaacagtataagtttcaggccgattcaccgaaacgcctgagtgcagccatcggaaaggcttgggaggagggcgtatgcggtatcagaagcgccactaggctcgaaaatattatgtggaaacagatatccaacgagctgaatcatatcttactggaaaacgacatgaagttcaccgtcgtggttggcgacgcaaatgggattcttgctcaaggcaagaagatgatccggcctcagcccatggagcacaaatactcttggaagtcgtggggcaaggccaaaattatcggggcggatatacagaacacaacttttatcattgacggaccagatacccctgaatgtcccgacaatcagcgcgcctggaacatctgggaggtggaggattatggcttcggtatttttacaacgaatatctggttgaagctcagagacagctacacccaaatgtgcgatcacaggctgatgtccgctgcaataaaagactcaaaggccgtccatgctgatatggggtattggattgaaagtgagaaaaacgaaacttggaagctagcccgtgcatctttcatcgaggtgaagacatgtacctggccaaaaagccacactctgtggtccaatggagttctcgaatcagagatgattatccccaagatatacggcggtcctatcagccagcataactatcggccaggctacttcacacagaccgcggggccgtggcacctgggaaaacttgagttggactttgatctgtgcgaaggcacgactgtggtagtcgacgagcactgcgggaatcgaggaccctctttaagaaccacaaccgtgactggcaagattatccatgaatggtgttgcaggtcctgtacactccctccactgcgcttccggggtgaggatgggtgctggtacggaatggagattagacccgtgaaagaaaaggaggaaaaccttgtcaggagtatggttagcgccggctctggtgaggtggactccttttcactgggcatcttgtgtgctagtataatgattgaagaggtaatgcgcagccgatggtcgcggaagatgctcatgaccgggacactggccgtgttcctactgctcgtcatgggacaactgacttggaatgaccttatccgtttgtgcatcatggtgggcgcaaacgcttccgatagaatggggatgggaaccacgtatctggccttaatggcaacatttaaaatgaggcctatgttcgccgttggcctcctgtttcgccggcttacctctagagaggtgctgctactcactattggtctgagcttggtcgcttcagtggaactgccaaacagtttagaggaactcggggacggactggcgatgggcatcatgatgcttaagctgttgaccgagttccagccccaccagctctggattacactgctatccctgacttttataaaaaccacgctttctctcgattacgcctggaagacaaccgcaatggctctgagcatcgtttccttgttcccgctgtgtttatcaactacaagccagaaaaccacttggctccctgtgctgcttggcagttttgggtgcaagccactgacaatgttcttgattaccgaaaataagatctggggaaggaaatcttggcccctcaacgagggtattatggccatcggcatagtctccatcctgctaagctcgctgcttaagaatgacgtacctctcgccgggcccctgattgctggaggcatgttgatcgcatgttatgtgatttcaggttctagtgccgatttatccctggagaaagcggctgaagttagctgggagcaagaagccgagcattctgggacgagccacaacatcctcgtggaagtccaggacgatggaactatgaagataaaagacgaggagcgagatgacaccctgacaattcttctgaaggcaaccttgctagccgtgtccggcgtatacccaatgtcaatccctgctacactgtttgtgtggtatttctggcagaaaaagaagcagcgcagtggcgtcctctgggatactcccagcccaccggaagttgagcgggcagtgctggacgatgggatctacaggattcttcaacgaggattactgggtcgttctcaggtgggcgtcggggtgttccaggacggagtttttcataccatgtggcacgtaacgcgcggcgccgtgctcatgtatcagggtaaacggttggaaccttcctgggcgtcagtcaagaaagacctgataagttacgggggaggctggagattccaaggcagctggaatacaggggaggaggtgcaggttatcgctgtggaacccggaaagaaccccaagaatgtccagactatgcccggtacctttaagacacctgagggcgaagtgggggccattgcactcgatttcaagccaggaacctccggctctcccatcgtaaacagggagggtaaaattgtcgggctgtacggaaatggcgtggttactacctcgggcacatatgtgagcgccatcgctcaagccaaggcatcacaggaagggcctcttccggagatagaggacgaagtctttaaaaagcgaaacctgacgatcatggatttgcacccaggatccggtaaaactcggcgctacctacccgctatggtgagagaggccattaagaggaagctgcggaccctcatcttagcgcctacacgagttgtggccagtgaaatggcagaggctctgaaaggcatgccaattagatatcagaccactgccgtcaagtctgaacatacagggcgcgagatcgtggaccttatgtgccacgctaccttcacgatgaggctgctcagccccgtacgtgtgcctaattacaacatgataattatggatgaggcacattttactgacccggcctccatcgccgctcggggatatatctcaacaagagttggcatgggtgaagcggcagccattttcatgaccgctacacccccagggtctgtcgaggcctttcctcagagcaatgcagtgatccaagatgaagagagggacatacccgaacgcagttggaactccggatacgattggattactgacttcccaggcaaaacagtgtggtttgtccctagcatcaagtctggcaatgatattgccaactgtttgagaaagaacgggaagagagtaatccagctgtcacggaagaccttcgacacagagtatcagaaaactaagaataacgactgggattacgtggttacgaccgacatatccgagatgggagctaatttcagggcggatcgcgtgattgacccccgtagatgcctcaaaccagtcatcctgaaggatggtccggaacgggtgatccttgccggccctatgcccgttacagtggcaagtgctgcccagaggcgcgggcgaattggaagaaaccaaaataaagagggcgaccagtacgtctatatgggtcagccactaaacaatgatgaagaccacgcacattggactgaggccaagatgctgttggataacatcaatacccccgaggggattatacctgctttatttgaaccagagcgggaaaagagcgccgcgatcgacggcgagtacaggctgcgcggagaagcaagaaaaacattcgtggagctcatgaggcggggcgatctgcccgtatggctttcgtataaggtggcctctgaggggtttcagtactccgaccgtcgctggtgcttcgatggagaacgaaacaatcaagttctggaggaaaacatggacgtcgagatttggaccaaagaaggtgagagaaagaaactcaggcctcggtggttggacgctcgcacttatagcgatccgctggccctaagagagtttaaggagttcgctgcaggcaggcggtcagtgagtggggacctgatcctcgagatcggaaaacttccacagcacctgacgttacgagcccagaatgctttggataacctggtgatgctccacaattctgaacagggcggtaaggcctacagacatgcaatggaggaactgcccgacaccattgagacacttatgctgctcgcgttgatagccgtcctgactgggggcgttaccttatttttcctatccggaaagggcctggggaaaacaagcatcggactcctttgtgtgaccgcttcaagtgccctgttgtggatggcaagcgtagagcctcactggattgctgcctccatcattctggaatttttcctcatggtgctgcttatccccgagccagatcgccaaaggactcctcaggacaaccagctcgcatatgtcgtgataggtctgttgtttatgatcctgacagttgccgctaacgaaatgggcttactagagacgaccaagaaagatctggggattggacatgtggcggccgagaatcaccaacacgcaactatgctcgacgtcgatcttcggcccgcttctgcctggacactgtacgccgtagcaaccaccgtgatcacaccaatgatgcgtcatactattgaaaacacgaccgctaatatcagcttgacagccatagcgaaccaggctgccattctgatgggcctcgacaagggttggcctatctccaaaatggatattggggttccgctgcttgcattaggctgctactcacaggtgaatcccctgactctcaccgccgctgtcttgatgctggtggcacactatgccatcataggaccaggcctacaggcgaaggctacaagagaggcccaaaagaggaccgcagccgggatcatgaaaaaccctactgtcgacggaattgtggctatcgatctggaccccgttgtgtacgacgccaagttcgaaaaacagctcggccagattatgcttctgatcttgtgtacgtctcagatactgctcatgcgcacaacctgggcactgtgcgagagtattactttagctaccggtccacttacaactctgtgggaagggtcgcctggaaagttttggaataccacaatcgccgtaagcatggcgaacatcttccggggctcctatctcgccggtgcaggcctagctttctctctgatgaaatcactagggggaggccgaagagggacgggagcccaaggcgagaccctgggtgagaagtggaagaggcagctcaatcagcttagcaaatccgaatttaacacttacaagcgcagtgggattatggaggtggatcggtctgaagcaaaagagggactgaagagaggcgaaacaaccaaacatgctgtcagccgtggtactgccaagttgaggtggttcgttgagcggaatctggtgaagcccgagggcaaagtcatcgacctcgggtgtggacgcggcgggtggtcatattactgcgccggattaaagaaagtgacagaagtaaagggctataccaaaggtgggccgggacacgaggaaccaatacctatggcgacgtacggctggaacctggtgaaacttcattccggcaaagatgtatttttcatgcccccagagaagtgtgacaccctgctatgcgatattggggaaagtagccccaatcctacaatcgaggagggacgaactctcagagtgctgaagatggtcgaaccgtggttgaggggtaaccagttttgtattaaaatcctgaatccctacatgccatctgtggtcgagaccctcgaacaaatgcagcggaagcacggcgggatgcttgtgcgcaaccctctgtccagaaattcaacacacgagatgtattgggttagctgcggaactggcaacatagtatcggctgtgaacatgacctctaggatgttactgaatcgattcacaatggcacatcggaaacccacctacgagcgtgacgtcgatttgggtgccgggactagacacgtggctgttgaacctgaggtggccaacctcgacatcattggacagcgcatcgaaaatattaagaacgagcataaaagtacgtggcactatgatgaagacaatccatacaagacatgggcatatcacggctcctacgaggtcaagcccagcggctcagcctcctctatggtgaacggggtagtgaggctgctaaccaaaccttgggatgttatcccaatggtcactcaaattgctatgaccgacacaacgccctttggacagcagcgggtgttcaaggagaaagtggacaccagaactccgcgcgcgaagaggggtacaacccagatcatggaagtcactgccaaatggctttggggctttctgagccgaaataagaagcctcggatatgtacaagagaggagttcaccaggaaagttcgcagtaacgcagctattggggccgtgtttgtagatgagaatcaatggaactccgcaaaggaagccgtggaggacgagcgtttctgggatctcgtccatcgggaaagagagctgcacaaacagggaaagtgcgctacatgcgtgtataatatgatgggcaaaagggaaaagaagttgggtgagtttgggaaagccaagggaagccgcgcgatctggtacatgtggctgggcgcacgattcctcgagttcgaggcccttggctttatgaacgaggaccattggttctctcgggaaaattcactgagtggggttgagggagaaggtttacacaaactgggctacatcttgagagatatttccaagataccagggggaaacatgtatgctgacgatactgccggctgggacaccaggatcacggaggatgacctccagaatgaggcaaaaattaccgaaatcatggagcccgaacatgctctgctagccacaagcatttttaaacttacttaccagaacaaagtggtccgcgtgcaaagacctgctaagaacggtaccgtaatggatgttatctctcggagggaccagcgtgggtcgggacaggtgggcacatatggcctgaatactttcaccaacatggaggtccagctcatacgacaaatggaatcagaggggatctttctgccaagcgagttggaaacgcccaatttagccgagcgcgtgctggattggctcgaaaagcacggagcagagagacttaaacggatggcgatttccggtgacgactgtgtggtcaagccgatcgatgacaggttcgccacagctctgaccgccctaaacgatatgggcaaagttcgcaaggacattcctcagtgggaacccagtaaagggtggaatgattggcaacaggtgccattttgctctcaccatttccaccaactgatcatgaaggacggaagagagatagtagtgccttgtcggaaccaggatgagctcgtcggcagggcacgagtgagccagggtgctgggtggtccttgcgtgaaactgcctgcctgggaaagtcatacgcacaaatgtggcagcttatgtattttcatagacgcgacctgcggctcgccgcgaatgctatttgtagtgccgttcccgtggattgggtcccaacatctaggaccacttggagcatccacgcacaccatcagtggatgaccacagaggacatgttatccgtgtggaacagagtatggatcgaagagaatccctggatggaagataaaacgcacgtttcaagctgggaggaggtgccttacctgggcaagcgcgaagaccagtggtgcggctctttgattgggctgaccgcccgggctacttgggccacaaacatacaagtcgcaatcaatcaggtgaggcgactcattggaaacgagaattatcttgactacatgacctccatgaaaagattcaagaacgaaagtgatccagagggtgctctgtggtga

SEQ ID NO: 13375 - RNA, 9879 nt, synthetic construct
  misc_feature 1..9879: note = derived and/or modified CDS sequence (opt3) from DENV-1__KJ189326__SS-prME
  source 1..9879: mol_type = other RNA
agcgtgaccatgctgctcatgcttctgcccactgcattggctttccacttaactacgcgaggaggggaacctcatatgatcgtctccaagcaggaaaggggaaaatctctgctgtttaagacctcagccggtgttaacatgtgcacactcattgccatggacctgggcgaactttgtgaagatactatgacctacaaatgcccacagataacagaggcggaaccggacgatgtggactgttggtgcaatgctaccgatacttgggtaacatatgggacctgtagtcagacgggagagcaccggcgcgacaagcgaagcgtggccctggcaccccatgtcggcttgggtctcgagactcgtaccgaaacatggatgtcctctgagggggcctggaaacagatccagagagtggaaacttgggctctgaggcaccctggattcaccgttattgcactgtttctcgcccatgctatcggcacatcgattacccaaaagggcacgatcttcatattactgatgcttgtgactccatcaatggccatgcggtgcgtcgggatcggaaaccgcgattttgtggagggtttgagcggcgcgacatgggttgacgttgtgctggagcacgggagttgtgtcaccactatggcaaagaataaacccacactagatattgaactcctgaagaccgaggtgacgaaccctgccatccttagaaaactgtgcattgaagctaagatctccaataccacaactgactctaggtgtccaacccagggagaggccacattggtggaagaacaggatgcaaacttcgtctgccggcgcacttttgttgaccgaggctggggtaatgggtgtggactcttcggcaaaggcagcctgttaacctgcgctaagtttaagtgcgtgacaaaactggaggggaagatagtacagtacgaaaacctcaaatattccgtgattgtcaccgtgcacactggagatcaacatcaggttggtaatgagacgacagaacacggcaccatcgccactattaccccacaggcgcctacatcagagatccagcttaccgactacggggccctgactttggactgtagtccaagaacaggactagatttcaacgaaatggtgctgctcacgatgaaggagaaaagctggctggtccataagcaatggtttcttgacctgccgttgccctggacctctggcgcatccacttcacaggagacatggaataggcaggatctcctggtgaccttcaaaacagctcacgccaagaagcaagaagtagttgtgttaggtagccaggagggggctatgcacactgccctgaccggcgcaacggaaatccagaccagtggaacaactaccatttttgccggccatctaaaatgccggctcaagatggacaaactgacacttaaggggacttcttatgtcatgtgtaccggatccttcaaattggagaaggaagtggctgagacgcagcacggtacagtcctggtgcaagttaagtacgagggcaccgatgcgccttgcaaaataccattcagcactcaggacgaaaagggggtgacacagaacggacgtctcatcaccgcaaatcccattgtaactgataaagagaagcctgtcaacatcgaaaccgagccaccctttggcgagtcgtatatagtggttggtgccggggaaaaagctctgaaactttcttggttcaagaaaggctcctcaattggaaagatgtttgaggccacagcacgcggcgccagaaggatggctatcctgggggacacggcctgggatttcggaagtatcggtggcgtgtttaccagcgtcgggaaattggtgcatcaggtattcggaactgcatacggcgtgctcttttccggtgtttcttggacaatgaagattgggatcggcattctgttaacctggctgggactaaatagccggtcaacaagtctctccatgacttgtatagcggtcggcatggtgaccctgtaccttggggtgatggtccaagctgacagcggatgcgttatcaactggaaaggccgagaattgaagtgtggttctgggattttcgtgacgaacgaggtgcacacatggaccgaacagtataagtttcaggccgattcaccgaaacgcctgagtgcagccatcggaaaggcttgggaggagggcgtatgcggtatcagaagcgccactaggctcgaaaatattatgtggaaacagatatccaacgagctgaatcatatcttactggaaaacgacatgaagttcaccgtcgtggttggcgacgcaaatgggattcttgctcaaggcaagaagatgatccggcctcagcccatggagcacaaatactcttggaagtcgtggggcaaggccaaaattatcggggcggatatacagaacacaacttttatcattgacggaccagatacccctgaatgtcccgacaatcagcgcgcctggaacatctgggaggtggaggattatggcttcggtatttttacaacgaatatctggttgaagctcagagacagctacacccaaatgtgcgatcacaggctgatgtccgctgcaataaaagactcaaaggccgtccatgctgatatggggtattggattgaaagtgagaaaaacgaaacttggaagctagcccgtgcatctttcatcgaggtgaagacatgtacctggccaaaaagccacactctgtggtccaatggagttctcgaatcagagatgattatccccaagatatacggcggtcctatcagccagcataactatcggccaggctacttcacacagaccgcggggccgtggcacctgggaaaacttgagttggactttgatctgtgcgaaggcacgactgtggtagtcgacgagcactgcgggaatcgaggaccctctttaagaaccacaaccgtgactggcaagattatccatgaatggtgttgcaggtcctgtacactccctccactgcgcttccggggtgaggatgggtgctggtacggaatggagattagacccgtgaaagaaaaggaggaaaaccttgtcaggagtatggttagcgccggctctggtgaggtggactccttttcactgggcatcttgtgtgctagtataatgattgaagaggtaatgcgcagccgatggtcgcggaagatgctcatgaccgggacactggccgtgttcctactgctcgtcatgggacaactgacttggaatgaccttatccgtttgtgcatcatggtgggcgcaaacgcttccgatagaatggggatgggaaccacgtatctggccttaatggcaacatttaaaatgaggcctatgttcgccgttggcctcctgtttcgccggcttacctctagagaggtgctgctactcactattggtctgagcttggtcgcttcagtggaactgccaaacagtttagaggaactcggggacggactggcgatgggcatcatgatgcttaagctgttgaccgagttccagccccaccagctctggacaactctgctatccctgacctttattaaaacgacactttctctcgattacgcctggaagaccactgcaatggctctgagcatagtttccttgttcccgctgtgtttatcaacaaccagccagaaaactacatggctccctgtgctgcttggcagttttgggtgcaagccactgaccatgttcttgatcacggaaaataagatttggggaaggaaatcttggcccctcaacgagggtatcatggccattggcatcgtctccatactgctaagctcgctgcttaagaatgacgtacctctcgccgggcccctgatcgctggaggcatgttgattgcatgttatgtgatctcaggttctagtgccgatttatccctggagaaagcggctgaagttagctgggagcaagaagccgagcattctgggactagccacaacattctcgtggaagtccaggacgatggaaccatgaagatcaaagacgaggagcgagatgacacactgaccatacttctgaaggcaacattgctagccgtgtccggcgtatacccaatgtcaattcctgctactctgtttgtgtggtatttctggcagaaaaagaagcagcgcagtggcgtcctctgggatacccccagcccaccggaagttgagcgggcagtgctggacgatgggatctacagaatccttcaaaggggattactgggtcgttctcaggtgggcgtcggggtgttccaggacggagtttttcatacgatgtggcacgtaacacgcggcgccgtgctcatgtatcagggtaaacggttggaaccttcctgggcgtcagtcaagaaagacctgattagttacgggggaggctggagattccaaggcctctggaatactggggaggaggtgcaggttatagctgtggaacccggaaagaaccccaaaaatgtccagaccacacccggtacctttaagactcctgagggcgaagtgggggccatcgcactggatttcaagccaggaaccagcggctcccccattgtaaacagggagggtaaaatcgtcgggctttacggaaatggcgtggttacaacgtctggcacttatgtgtcggccattgctcaagccaaggcaagccaggaagggcctctgccggagatcgaggacgaagtctttaaaaagcgaaacttgaccataatggatctacacccaggatcaggtaaaacacggcgctacctgcccgctatggtgagagaggccatcaagaggaagctccggaccttaattctggcgcctactcgagttgtggcctccgaaatggcagaggctcttaaaggcatgccaatcagatatcagacaaccgccgtcaagagtgaacatacggggcgcgagattgtggacctgatgtgccacgctactttcacaatgaggctcttgtctcccgtacgtgtgcctaattacaacatgatcataatggatgaggcacattttaccgacccggccagcattgccgctcggggatatatctccaccagagttggcatgggtgaagcggcagccatcttcatgactgctacacccccagggtcagtcgaggcctttcctcagtctaatgcagtgattcaagatgaagagagggacatccccgaacgcagctggaacagtggatacgattggataaccgacttcccaggcaaaacagtgtggtttgtcccttccattaagagcggcaatgatatcgccaactgtctgcggaaaaacgggaagagagtaattcagctctctagaaagactttcgacacggagtatcagaaaaccaagaataacgactgggattacgtggttacaactgacatctcagagatgggagctaatttcagggcggatcgcgtgatagacccccgtagatgcctgaaaccagtcattcttaaggatggtccggaacgggtgatcctagccggccctatgcccgttaccgtggcatccgctgcccagaggcgcgggcgaatcggaagaaaccaaaataaagagggcgaccagtacgtctatatgggtcagccactgaacaatgatgaagaccacgcacattggacagaggccaagatgttgttagataacattaatacccccgaggggatcattcctgctctgtttgaaccagagcgggaaaagagtgccgcgatagacggcgagtacaggctccgcggagaagcaagaaaaactttcgtggagctgatgaggcggggcgatcttcccgtatggctgagctataaggtggcctcggaggggtttcagtactctgaccgtcgctggtgcttcgatggagaacgaaacaatcaagttctcgaggaaaacatggacgtcgagatctggacgaaagaaggtgagagaaagaaattgaggcctcggtggctggacgctcgcacctattccgatccgctagccctgagagagtttaaggagttcgctgcaggcaggcggagcgtgtcaggggacctcattcttgagatcggaaaactgccacagcacttaacattgcgagcccagaatgctctggataacctcgtgatgctgcacaatagtgaacagggcggtaaggcctacagacatgcaatggaggaacttcccgacactatcgagaccctgatgctcttggcgctgattgccgtcttaacagggggcgttaccctatttttcctgtctggaaagggcctcgggaaaacttccataggacttctgtgtgtgacagctagctcagccttgctgtggatggcaagtgtagagcctcactggatcgctgccagcattatcctcgaatttttcctgatggtgcttctcattcccgagccagatcgccaaaggacgcctcaggacaaccagctggcatatgtcgtgatcggtttgctgtttatgatattaaccgttgccgctaacgaaatgggcctactggagactacaaagaaagatctcgggatcggacatgtggcggccgagaatcaccaacacgcaaccatgcttgacgtcgatctgcggcccgcttccgcctggaccttgtacgccgtagcaacaactgtgattacgccaatgatgcgtcataccatcgaaaacacaactgctaatatttctctgaccgccatcgcgaaccaggctgccatactcatgggcctggacaagggttggcctattagcaaaatggatatcggggttccgcttttagcactgggctgctactcccaggtgaatcccctcacattgaccgccgctgtcctgatgctagtggcacactatgccattatcggaccaggcctgcaggcgaaggctactagagaggcccaaaagaggacggcagccgggataatgaaaaaccctacagtcgacggaatcgtggctattgatctcgaccccgttgtgtacgacgccaagttcgaaaaacagcttggccagatcatgctgttgattctgtgtacctcacagatcctcctgatgcgcactacctgggcattatgcgagtctataacacttgctactggtccactgaccacactctgggaagggagtcctggaaagttttggaatacgaccattgccgtatcgatggcgaacatcttccggggcagctatctagccggtgcaggcctggctttctccttgatgaaatctctagggggaggccgaagagggactggagcccaaggcgagacactcggtgagaagtggaagaggcagcttaatcagctgtcaaaaagcgaatttaacacctacaagcgctccgggatcatggaggtggatcggagtgaagcaaaagagggattgaagagaggcgaaactacaaaacatgctgtctctcgtggtaccgccaagctgaggtggttcgttgagcggaatctcgtgaagcccgagggcaaagtcattgacttagggtgtggacgcggcgggtggagctattactgcgccggactgaagaaagtgacggaagtaaagggctataccaaaggtgggccgggacacgaggaaccaatccctatggcgacatacggctggaaccttgtgaagctgcattcaggcaaagatgtatttttcatgcccccagagaagtgtgacactctactctgcgatataggggaatccagtcccaatcctaccattgaggagggacgaacactgagagtgttgaagatggtcgaaccgtggctgaggggtaaccagttttgtatcaaaattctcaatccctacatgccaagcgtggtcgagactcttgaacaaatgcagcggaagcacggcgggatgctggtgcgcaaccctttatctagaaattccacccacgagatgtattgggtttcatgcggaacaggcaacatcgtaagcgctgtgaacatgacctcgaggatgctgttgaatcgattcactatggcacatcggaaacccacgtacgagcgtgacgtcgatctcggtgccgggacaagacacgtggctgttgaacctgaggtggccaacctggacataatcggacagcgcattgaaaatatcaagaacgagcataaatctacctggcactatgatgaagacaatccatacaagacttgggcatatcacggcagttacgaggtcaagccctccggcagcgcctcatccatggtgaacggggtagtgaggctacttaccaaaccttgggatgttattccaatggtcacacaaatcgctatgacggacaccactccctttggacagcagcgggtgttcaaggagaaagtggacacaagaaccccgcgcgcgaagaggggtactacacagattatggaagtcaccgccaaatggctgtggggctttctctctcgaaataagaagcctcggatctgtacaagagaggagttcactaggaaagttcgcagcaacgcagctataggggccgtgtttgtagatgagaatcaatggaacagtgcaaaggaagccgtggaggacgagcgtttctgggatctggtccatcgggaaagagagttgcacaaacagggaaagtgcgctacctgcgtgtataatatgatgggcaaaagggaaaagaagctgggtgagtttgggaaagccaagggatcccgcgcgatttggtacatgtggctcggcgcacgattccttgagttcgaggccctgggctttatgaacgaggaccattggttcagccgggaaaattctttatcaggggttgagggagaaggtctgcacaaattgggctacatcctcagagatatcagtaagattccagggggaaacatgtatgctgacgatacggccggctgggacaccaggataacagaggatgacctgcagaatgaggcaaaaatcactgaaattatggagcccgaacatgctctacttgccacctccatctttaagctgacataccagaacaaagtggtccgcgtgcaaagacctgctaagaacggtactgtaatggatgttattagccggagggaccagcgtgggtctggacaggtgggcacctatggcctcaatacgttcacaaacatggaggtccagctgatccgacaaatggaatcggaggggatatttttgccatcagagttagaaacccccaatctggccgagcgcgtgctcgattggcttgaaaagcacggagcagagagactgaaacggatggcgatcagcggtgacgactgtgtggtcaagccgattgatgacaggttcgccactgctctaacagccctgaacgatatgggcaaagttcgcaaggacatccctcagtgggaaccctccaaagggtggaatgattggcaacaggtgccattttgcagtcaccatttccaccaactcattatgaaggacggaagagagatcgtagtgccttgtcggaaccaggatgagttggtcggcagggcacgagtgtctcagggtgctgggtggagcctgcgtgaaaccgcctgccttggaaagtcctacgcacaaatgtggcagctgatgtattttcatagacgcgacctccggttagccgcgaatgctatatgttcagccgttcccgtggattgggtcccaacaagtaggaccacatggtctattcacgcacaccatcagtggatgacgaccgaggacatgctgagcgtgtggaacagagtatggatcgaagagaatccctggatggaagataaaactcacgtttcctcatgggaggaggtgccttacttgggcaagcgcgaagaccagtggtgcggcagcctgatcgggctcacagcccgggctacctgggccactaacattcaagtcgcaataaatcaggtgaggcgacttatcggaaacgagaattatctggactacatgacatctatgaaaagattcaagaacgaatccgatccagagggtgctctatggtga

SEQ ID NO: 13376 - RNA, 9879 nt, synthetic construct
  misc_feature 1..9879: note = derived and/or modified CDS sequence (opt3) from DENV-1__KJ189327__SS-prME
  source 1..9879: mol_type = other RNA
agcgtgaccatgctgctcatgcttctgccaacagcattggctttccacttaactacgagaggaggggagcctcatatgatagtctccaagcaggaaaggggaaaatctctgttgtttaagacctcagccggtgttaacatgtgcacactcattgccatggacctgggcgagctttgtgaagatactatgacctacaaatgcccacaaataacagaggcggaaccggacgatgtggactgttggtgcaatgctaccgatacttgggtaacatatgggacctgtagtcagacgggagagcaccggcgcgagaagcgaagcgtggccctggcaccccatgtcggcttgggtctcgaaactcgtaccgagacatggatgtcctctgaaggggcctggaaacagatccagagagtggagacttgggctctgaggcaccctggattcaccgttattgcactgtttctcgcccatgctatcggcacatcgattacccaaaagggcatcatattcatcttactgatgcttgtgacgccatcaatggccatgcggtgcgtcgggattggaaaccgcgactttgtggagggtttgagcggcgcgacttgggtagatgttgtgctggaacacgggagttgtgtcacaaccatggcaaagaataaacccactctagacatcgagctcctgaagacagaagtgaccaaccctgccattcttagaaaactgtgcatcgaggctaagatatccaatacgaccacagattctaggtgtccaactcagggagaagccaccttggtggaggagcaggacgcaaacttcgtctgccggcgcacatttgttgatcgaggctggggtaatgggtgtggactcttcggcaaaggcagcctgttaacttgcgctaagtttaagtgcgtgaccaaactggaagggaagattgtacagtacgagaacctcaaatattccgtgatcgtcacagtgcacaccggagaccaacatcaggttggtaatgaaactacggagcacggcacaattgccaccatcactccccaggcgcctacctcagaaatccagcttacagattacggggccctgaccttggactgtagtccaagaactggactagacttcaacgagatggtgctgctcacaatgaaggagaaaagctggctggtccataagcaatggtttcttgatctgccgttgccctggacgtctggcgcatccacctcacaggaaacttggaataggcaggacctcctggtgacattcaaaaccgctcacgccaagaagcaagaggtagttgtgttaggtagccaggaaggggctatgcacacagccctgactggcgcaaccgagattcagacgagtggaaccacaactatatttgccggccatctaaaatgccggctcaagatggataaactgacccttaaggggacatcttatgtcatgtgtactggatccttcaaattggaaaaggaggtggctgagacccagcacggtacggtcctggtgcaagttaagtacgaaggcacagacgcgccttgcaaaatcccattcagcacccaggatgagaagggggtgactcagaacggacgtctcattacagcaaatcccatcgtaaccgacaaagaaaagcctgtcaacatagagactgagccaccctttggcgaatcgtatattgtggttggtgccggggagaaagctctgaaactttcttggttcaagaaaggctcctcaatcggaaagatgtttgaagccaccgcacgcggcgccagaaggatggctatcctgggggatacagcctgggacttcggaagtattggtggcgtgtttacgagcgtcgggaaattggtgcatcaggtattcggaaccgcatacggcgtgctcttttccggtgtttcttggactatgaagatcgggattggcatactgttaacatggctgggactaaatagccggtcaaccagtctctccatgacatgtatcgcggtcggcatggtgactctgtaccttggggtgatggtccaagctgatagcggatgcgttattaactggaaaggccgagagttgaagtgtggttctgggatcttcgtgaccaacgaagtgcacacgtggacagagcagtataagtttcaggccgactcaccgaaacgcctgagtgcagccatcggaaaggcttgggaggaaggcgtatgcggtattagaagcgccaccaggctcgagaatataatgtggaaacagatctccaacgaactgaatcatattttactggagaacgatatgaagttcactgtcgtggttggcgacgcaaatgggatccttgctcaaggcaagaagatgattcggcctcagcccatggaacacaaatactcttggaagtcgtggggcaaggccaaaatcataggggcggacacccagaacacaacttttatcattgatggaccagacacccctgagtgtcccgataatcagcgcgcctggaacatctgggaggtggaagactatggcttcggtatttttacaacgaatatctggttgaagctcagagatagctacacccaaatgtgcgaccacaggctgatgtccgctgcaataaaagattcaaaggccgtccatgctgacatggggtattggattgagagtgagaagaacgagacttggaagctagcccgtgcatctttcatcgaagtgaagacatgtacctggccaaaaagccacactctgtggtccaatggagttctcgagtcagagatgattatccccaagatatacggcggtcctatcagccagcataactatcggccaggctacttcacacagaccgcggggccgtggcacctgggaaaacttgaattggattttgacctgtgcgagggcacgactgtggtagtcgatgaacactgcgggaatcgaggaccctctttaagaaccacaaccgtgactggcaagattatccatgagtggtgttgcaggtcctgtacactccctccactgcgcttccggggtgaggacgggtgctggtacggaatggaaattagacccgtgaaagagaaggaagagaaccttgtcaggagtatggttagcgccggctctggtgaagtggattccttttcactgggcatcttgtgtgctagtataatgattgaggaggtaatgcgcagccgatggtcgcggaagatgctcatgaccgggacactggccgtgttcctactgctcatcatgggacaactgacttggaatgaccttatccgtttgtgcattatggtcggcgcaaacgcttccgacagaatggggatgggaaccacgtatctggccttaatggcaacatttaaaatgaggcctatgttcgccgtgggcctcctgtttcgccggcttacctctagagaagttctgctactcactatcggtctgagcttggtggcttcagtcgagctgccaaacagtttagaggaactcggggatggactggcgatgggcattatgatgcttaagctgttgaccgagttccagccccaccagctctggacaactctgctatccctgacctttataaaaacgacactttctctcgactacgcctggaagaccactgcaatggctctgagcatcgtgtccttgttcccgctgtgtttatcaacaaccagccagaaaactacatggctccctgttctgcttggcagttttgggtgcaagccactgaccatgttcttgattacggagaataagatctggggaaggaaatcttggcccctcaacgagggtattatggccatcggcatagtgtccatcctgctaagctcgctgcttaagaatgatgtccctctcgccgggcccctgattgctggaggcatgttgatcgcatgttatgtaatttcaggttctagtgccgacttatccctggaaaaagcggctgaggtgagctgggaacaagaggccgaacattctgggactagccacaacatcctcgttgaggtgcaggatgacggaaccatgaagataaaagatgaggaacgagacgatacactgaccattcttctgaaggcaacattgctagccgtctccggcgtgtacccaatgtcaatccctgctactctgtttgtatggtatttctggcagaaaaagaagcagcgcagtggcgtgctctgggacacccccagcccaccggaggtcgaacgggcagttctggatgacgggatctacaggattcttcaacgaggattactgggtcgttctcaggtgggcgtgggggtcttccaggatggagtgtttcatacgatgtggcacgttacacgcggcgccgtactcatgtatcagggtaaacggttggagccttcctgggcgtcagtgaagaaagacctgataagttacgggggaggctggagattccaaggcagctggaatactggggaggaagtccaggtgatcgctgttgagcccggaaagaaccccaagaatgtgcagaccacacccggtacctttaagactcctgaaggcgaggtcggggccattgcactcgacttcaagccaggaacctccggctctcccatcgtgaacagggaaggtaaaattgtagggctgtacggaaatggcgtcgtgacaacgtcgggcacttatgttagcgccatcgctcaagccaaggcatcacaggaggggcctcttccggagatagaagatgaggtgtttaaaaagcgaaacctgaccatcatggacttgcacccaggatccggtaaaacacggcgctacctacccgctattgtcagagaagccatcaagaggaagctgcggaccctcattttagcgcctactcgagtggttgccagtgagatggcagaagctctgaaaggcatgccaatcagatatcagacaaccgccgtgaagtctgagcatacggggcgcgagatagtcgatcttatgtgccacgctactttcacaatgaggctgctcagccccgtgcgtgtacctaattacaacatgattatcatggacgaagcacattttaccgatccggcctccatcgccgctcggggatatatttcaaccagagtgggcatgggtgaggcggcagccatcttcatgactgctacacccccagggtctgttgaagcctttcctcagagcaatgcagtcatacaagacgaggaaagggatattcccgagcgcagttggaactccggatacgactggatcaccgatttcccaggcaaaacagtgtggtttgtgcctagcattaagtctggcaatgacatcgccaactgtttgagaaagaacgggaaaagagtcatacagctgtcacggaagactttcgatacggagtatcagaaaaccaagaataacgactgggactacgtagtgacaactgatatttccgaaatgggagctaatttcagggcggaccgcgttatcgatccccgtagatgcctcaaaccagtgatcctgaaggacggtccggagcgggtcattcttgccggccctatgcccgtgaccgttgcaagtgctgcccagaggcgcgggcgaatcggaagaaaccaaaataaagaaggcgatcagtacgtgtatatgggtcagccactaaacaatgacgaggatcacgcacattggacagaggccaagatgctgttggacaacattaatacccccgaagggataatccctgctttatttgagccagaacgggaaaagagcgccgcgattgatggcgaatacaggctgcgcggagaggcaagaaaaactttcgtcgagctcatgaggcggggcgacctgcccgtgtggctttcgtataaggtagcctctgaagggtttcagtactccgatcgtcgctggtgcttcgacggagagcgaaacaatcaagtgctggaagagaacatggatgttgaaatctggacgaaagagggtgagagaaagaaactcaggcctcggtggttggacgctcgcacctatagcgacccgctggccctaagagaatttaaggagttcgctgcaggcaggcggtcagtcagtggggatctgatcctcgaaattggaaaacttccacagcacctgacattacgagcccagaatgctttggacaacctggtgatgctccacaattctgagcagggcggtaaggcctacagacatgcaatggaagaactgcccgatactatagagacccttatgctgctcgcgttgatcgccgtgctgacagggggcgtcaccttatttttcctatccggaaagggcctggggaaaactagcattggactcctttgtgttacagcttcaagtgccctgttgtggatggcaagcgtggaacctcactggatcgctgcctccattatcctggagtttttcctcatggtactgcttatacccgaaccagaccgccaaaggacgcctcaggataaccagctcgcatatgtggtcatcggtctgttgtttatgattctgaccgtggccgctaacgagatgggcttactagagactacaaagaaagacctggggatcggacatgttgcggccgaaaatcaccaacacgcaaccatgctcgatgtggaccttcggcccgcttctgcctggaccctgtacgccgtcgcaacaactgtaattacgccaatgatgcgtcataccatcgagaacacaactgctaatatcagcttgaccgccattgcgaaccaggctgccatcctgatgggcctcgataagggttggcctatttccaaaatggacatcggggtgccgctgcttgcattaggctgctactcacaggttaatcccctgacactcaccgccgctgtgttgatgctggtcgcacactatgccataatcggaccaggcctacaggcgaaggctactagagaagcccaaaagaggacggcagccgggattatgaaaaaccctacagtggatggaatcgtcgctattgacctggatcccgtggtttacgacgccaagttcgagaaacagctcggccagatcatgcttctgatattgtgtacctctcagattctgctcatgcgcactacctgggcactgtgcgaaagtatcacattagctactggtccacttaccacactgtgggaggggtcgcctggaaagttttggaatacgaccatcgccgtgagcatggcgaacattttccggggctcctatctcgccggtgcaggcctagctttctctctgatgaaatcactagggggaggccgaagagggactggagcccaaggcgagacactgggtgaaaagtggaagaggcagctcaatcagcttagcaaatccgagtttaacacctacaagcgcagtgggatcatggaagtagaccggtctgaggcaaaagaaggactgaagagaggcgagactacaaaacatgctgtgagccgtggtaccgccaagttgaggtggttcgtcgagcggaatctggttaagcccgaaggcaaagtgatagatctcgggtgtggacgcggcgggtggtcatattactgcgccggattaaagaaagtcacggaggtgaagggctataccaaaggtgggccgggacacgaggaaccaattcctatggcgacatacggctggaacctggtaaaacttcattccggcaaagacgtgtttttcatgcccccagaaaagtgtgatactctgctatgcgacatcggggagagtagccccaatcctaccattgaggaaggacgaacactcagagttctgaagatggtggagccgtggttgaggggtaaccagttttgtatcaaaatactgaatccctacatgccatctgtcgtggaaactctcgagcaaatgcagcggaagcacggcgggatgcttgtccgcaaccctctgtccagaaattcaacccacgagatgtattgggtgagctgcggaacaggcaacatcgtttcggctgtaaacatgacctctaggatgttactgaatcgattcactatggcacatcggaaacccacgtttgaacgtgatgtggacttgggtgccgggacaagacacgtcgctgtggagcctgaagttgccaacctcgatattatcggacagcgcattgagaatatcaagaacgaacataaaagtacctggcactacgacgaggataatccatataagacttgggcataccacggctcctatgaggtgaagcccagcggctcagcctcctctatggtcaacggggtggtaaggctgctaaccaaaccttgggacgtgattccaatggttacacaaatcgctatgacggataccactcccttcggacagcagcgggtctttaaggaaaaagtggacacaagaaccccgcgcgcgaagaggggtactacacagataatggaggtgaccgccaaatggctttggggcttcctgagccgaaataagaagcctcggatttgtacaagagaagagtttactaggaaagtccgcagtaacgcagctatcggggccgttttcgtggacgaaaatcaatggaactccgcaaaggaggccgtagaggatgaacgtttttgggacctcgtgcatcgggagagagaactgcacaaacagggaaagtgcgctacctgcgtctacaatatgatgggcaaaagggagaagaagttgggtgagttcgggaaagccaagggaagccgcgcgatctggtatatgtggctgggcgcacgattcctcgagtttgaggcccttggcttcatgaacgaagatcattggttttctcgggaaaattcactgagtggggtggaaggagagggtttacacaaactgggctacattttgagagacatatccaagatcccagggggaaacatgtacgctgatgacacggccggctgggataccaggattacagaggacgatctccagaatgaagcaaaaatcactgacattatggagcccgaacatgctctgctagccaccagcatcttcaaacttacatatcagaacaaagttgtgcgcgtccaaagacctgctaagaacggtactgtgatggatgtaatatctcggagggaccagcgtgggtcgggacaggttggcacctacggcctgaatacgtttacaaacatggaggtgcagctcatccgacaaatggaatcagaggggattttcctgccaagcgagttggaaacccccaatttagccgagcgcgtcctggattggctcgaaaagcacggagcagagagacttaaacggatggcgatctccggtgacgactgtgtggtgaagccgattgatgacaggtttgccactgctctgacagccctaaacgatatgggcaaagtccgcaaggacatccctcagtgggaacccagtaaagggtggaatgattggcagcaggttccattctgctctcaccattttcaccaactgataatgaaggacggaagagagattgtggtaccttgtcggaaccaggatgagctcgtgggcagggcacgagtcagccagggtgctgggtggtccttgcgtgaaaccgcctgcctgggaaagtcatatgcacaaatgtggcagcttatgtacttccatagacgcgacctgcggctcgccgcgaatgctatctgtagtgccgtgcccgttgattgggtgccaacttctaggaccacatggagcatccacgcacaccatcagtggatgacgaccgaggacatgttatccgtctggaacagagtgtggattgaagagaatccctggatggaagataaaactcacgtatcaagctgggaggaggttccttatctgggcaagcgcgaagaccagtggtgcggctctttgatagggctgacagcccgggctacctgggccactaacatccaagtggcaattaatcaggtcaggcgactcatcggaaacgagaattaccttgactatatgacatccatgaaaagatttaagaacgaaagtgatccagagggtgctctgtggtga

SEQ ID NO: 13377 - RNA, 9879 nt, synthetic construct
  misc_feature 1..9879: note = derived and/or modified CDS sequence (opt3) from DENV-1__KJ189328__SS-prME
  source 1..9879: mol_type = other RNA
agcgtgaccatgctgctcatgcttctgcccacagcattggctttccacttaactacgagaggaggggagcctcatatgatcgtctccaagcaggaaagaggaaaatctctgttatttaagacctcagccggtgttaatatgtgcacactcattgccatggacctgggagagctttgtgaagatactatgacctacaaatgcccacagataacagaggcggaaccggacgatgtggactgttggtgcaatgctaccgatacttgggtaacatatgggacctgtagtcagacgggagagcaccggcgcgagaagcgaagcgtggccctggcaccccatgtcggcttgggtctcgaaactcgtaccgagacatggatgtcctctgaaggggcctggaaacagatccagagagtggagacttgggctctgaggcaccctggattcaccgttattgcactgtttctcgcccatgctatcggcacatcgattacccaaaagggcatcatattcatcttactgatgcttgtgacgccatcaatggccatgcggtgcgtcgggattggaaaccgcgactttgtggagggtttgagcggcgcgacttgggttgatgttgtgctggaacacgggagttgtgtcacaaccatggcaaagaataaacccactttggacatcgagctcctgaagacagaagtgaccaaccctgccattcttagaaaactgtgcatcgaggctaagatatccaatacgaccacagattctaggtgtccaactcagggagaagccaccttggtggaggagcaggacgcaaacttcgtctgccggcgcacatttgttgatcgaggctggggtaatgggtgtggactcttcggcaaaggcagcctgttaacttgcgctaagtttaagtgcgtgaccaaactggaagggaagattgtacagtacgagaacctcaaatattccgtgatcgtcacagtgcacaccggagaccaacatcaggttggtaatgaaactacggagcacggcacaattgccaccatcactccccaggcgcctacctcagaaatccagcttacagattacggggccctgaccttggactgtagtccaagaactggactagacttcaacgagatggtgctgctcacaatgaaggagaaaagctggctggtccataagcaatggtttcttgatctgccgttgccctggacgtctggcgcatccacctcacaggaaacttggaataggcaggacctcctggtgacattcaaaaccgctcacgccaagaagcaagaggtagttgtgttaggtagccaggaaggggctatgcacacagccctgactggcgcaaccgagattcagacgagtggaaccacaactatatttgccggccatctaaaatgccggctcaagatggataaactgacccttaaggggacatcttatgtcatgtgtactggatccttcaaattggaaaaggaggtggctgagacccagcacggtacggtcctggtgcaagttaagtacgaaggcacagacgcgccttgcaaaatcccattcagcacccaggatgagaagggggtgactcagaacggacgtctcattacagcaaatcccatcgtaaccgacaaagaaaagcctgtcaacatagagactgagccaccctttggcgaatcgtatattgtggttggtgccggggagaaagctctgaaactttcttggttcaagaaaggctcctcaatcggaaagatgtttgaagccaccgcacgcggcgccagaaggatggctatcctgggggatacagcctgggacttcggaagtattggtggcgtgtttacgagcgtcgggaaattggtgcatcaggtattcggaaccgcatacggcgtgctcttttccggtgtttcttggactatgaagatcgggattggcatactgttaacatggctgggactaaatagccggtcaaccagtctctccatgacatgtatcgcggtcggcatggtgactctgtaccttggggtgatggtccaagctgatagcggatgcgttattaactggaaaggccgagagttgaagtgtggttctgggatcttcgtgaccaacgaagtgcacacgtggacagagcagtataagtttcaggccgactcaccgaaacgcctgagtgcagccatcggaaaggcttgggaggaaggcgtatgcggtattagaagcgccaccaggctcgagaatataatgtggaaacagatctccaacgaactgaatcatattttactggagaacgatatgaagttcactgtcgtggttggcgacgcaaatgggatccttgctcaaggcaagaagatgattcggcctcagcccatggaacacaaatactcttggaagtcgtggggcaaggccaaaatcataggggcggacatccagaacaccacatttattatcgatggaccagacactcctgagtgtcccgataatcagcgcgcctggaacatttgggaggtggaagactatggcttcggtatctttaccacaaatatatggttgaagctcagagatagctacacgcaaatgtgcgaccacaggctgatgtccgctgcaattaaagattcaaaggccgtccatgctgacatggggtattggatcgagagtgagaagaatgagacctggaagctagcccgtgcatctttcattgaagtgaagacttgtacatggccaaaaagccacaccctgtggtccaatggagttctcgagtcagagatgatcatacccaagatctacggcggtcctattagccagcataactatcggccaggctacttcactcagacagcggggccgtggcacctgggaaaacttgaattggattttgacctgtgcgagggcaccacggtggtagtcgatgaacactgcgggaatcgaggaccctctttaagaactaccacagtgaccggcaagatcattcatgagtggtgttgcaggtcctgtactctccctccactgcgcttccggggtgaggacgggtgctggtacggaatggaaatcagacccgtgaaagagaaggaagagaaccttgtcaggagtatggttagcgccggctctggtgaagtggattccttttcactgggcatattgtgtgtaagtattatgatcgaggaggtgatgcgcagccgatggtcgcggaagatgctcatgacagggaccctggctgtcttcctactgctcatcatgggacaactgacatggaaagaccttattcgtttgtgcatcatggtgggcgccaatgcatccgacagaatggggatgggaactacctatctggctttaatggccacgtttaagatgaggcctatgttcgcagttggcctcctgtttcgccggcttacatctagagaagtgctgctactcaccattggtctgagcttggtcgcctcagtggagctgccaaacagtttagaagaactcggggatggactggctatgggcataatgatgcttaaactgttgactgagttccacccccatcagctctggaccacactgctatccctgacttttatcaagaccacgctttctctcgactacgcgtggaaaacaaccgccatggcactgagcattgtttccttgttcccgctgtgtttatcaactacaagccagaagaccacttggctccctgtgctgcttggcagttttgggtgcaagccactgacaatgttcttgatcaccgagaacaaaatttggggaaggaagtcttggcccctcaatgagggtatcatggctataggcatcgtctccattctgctaagctcgctgcttaaaaacgatgtacctctcgccgggcccctgatcgccggaggcatgttgattgcttgttatgtgatctcaggttctagtgcagacttatccctggaaaaggccgcggaggttagctgggaacaggaggctgaacactctgggacgagccataatatactcgtggaggtccaagatgacggaactatgaaaattaaggatgaggaacgagacgataccctgacaatccttctgaaagccaccttgctagcagtgtccggcgtatacccaatgtcaatccctgccacactgtttgtgtggtatttctggcagaagaagaaacagcgcagtggcgtcctctgggacactcccagcccaccggaggttgaacgggctgtgctggatgacgggatttacagaatacttcagaggggattactgggtcgttctcaagtgggcgtcggggtgttccaggatggagtttttcacaccatgtggcacgtaacgcgcggcgcagtgctcatgtatcagggtaagcggttggagccttcctgggcctcagtcaaaaaggacctgatcagttacgggggaggctggagattccagggcagctggaacacaggggaggaagtgcaagttattgcggtggagcccggcaaaaatccaaagaacgtccagactacccccggtacatttaagacccctgaaggcgaggtgggggctatcgccctcgacttcaaaccaggaacttccggctctcccattgtaaatagggaaggtaagatcgtcgggctgtacggaaacggcgtggttaccacatcgggcacgtatgtgagcgcaatagcccaggctaaagcctcacaagaggggcctcttccggagatcgaagatgaggtctttaagaaacgaaatctgactattatggacttgcatccaggatccggtaagacccggcgctacctacccgcaatcgtgagagaagctattaagaggaaactgcggacactcatcttagcccctacccgagttgtggcgagtgagatggccgaagcactgaagggcatgccaataagatatcagactacagctgtcaaatctgagcacaccgggcgcgagattgtggatcttatgtgccatgccacgttcactatgaggctgctcagccccgtacgtgtgcctaactacaatatgatcatcatggacgaagctcactttacagatccggcatccattgccgcccggggatatatctcaaccagagttggcatgggtgaggctgcggcaatattcatgaccgccactcccccagggtctgtcgaggcttttcctcagagcaacgccgtgattcaggacgaagaaagggatatccccgagcgcagttggaactccggatacgactggattacagatttcccaggcaagaccgtgtggtttgtccctagcatcaaatctggcaacgacatagcaaattgtttgcgaaagaacgggaagagagtaattcaactgtcacggaaaacattcgatactgagtatcagaagacgaaaaacaatgactgggactacgtggttaccacagatatctccgaaatgggagccaacttcagggctgaccgcgtgatcgatccccgtagatgcctcaagccagtcattctgaaagacggtccggagcgggtgatccttgcgggccctatgcccgttactgtggccagtgcagctcagaggcgcgggcgaattggaagaaatcagaacaaggaaggcgatcaatacgtctatatgggtcagccactaaataacgacgaggatcatgcccactggaccgaggcaaagatgctgttggacaatataaacacacccgaagggatcattcctgccttatttgagccagaacgggagaaaagcgctgccatcgatggcgaatacaggctgcgcggagaggcgagaaagaccttcgtggagctcatgaggcggggcgacctgcccgtatggctttcgtataaagtggcatctgaagggtttcagtactccgatcgtcgctggtgcttcgacggagagcgaaataaccaggttctggaagagaatatggatgtcgaaatctggactaaggagggtgagaggaaaaagctcaggcctcggtggttggacgcccgcacgtatagcgacccgctggctctaagagaatttaaagagttcgccgctggcaggcggtcagtgagtggggatctgattctcgaaataggaaaacttccacaacacctgaccttacgagcacagaacgccttggacaatctggtgatgctccataactctgagcagggcggtaaggcttacagacacgccatcgaagaactgcccgatacaattgagactcttatgctgctcgcattgatcgcggtcctgaccgggggcgttacattatttttcctatccggaaaaggcctggggaagaccagcattggactcctttgtgtgactgcctcaagtgctctgttgtggatggccagcgtagaacctcattggatcgcagcttccataatcctggagtttttcctcatggtgctgcttattcccgaaccagaccgccagaggacacctcaagataatcagctcgcctatgtcgtgatcggtctgttgtttatgattctgacggttgcagccaacgagatgggcttactagagaccactaaaaaggacctggggatcggacacgtggctgcggaaaaccaccagcatgccacaatgctcgatgtcgaccttcggcccgcatctgcttggaccctgtacgccgtagccaccacagtgataactccaatgatgcgtcacacgattgagaataccacagcaaacatcagcttgactgctattgccaatcaagcggctatcctgatgggcctcgataaaggttggcctatatccaagatggacatcggggttccgctgcttgccttaggctgctactcacaggtgaaccccctgaccctcacagcagccgtcttgatgctggtggctcattatgcaattatcggaccaggcctacaggccaaggcgaccagagaagctcagaaaaggactgccgcagggattatgaagaatcctacggtcgatggaatcgtggccatagacctggatcccgttgtgtacgacgctaaattcgagaagcaactcggccagattatgcttctgatcttgtgtacatctcagatcctgctcatgcgcaccacttgggccctgtgcgaaagtattaccttagcaacaggtccacttactaccctgtgggaggggtcgcctggaaaattttggaacacaacgatcgctgtaagcatggccaatatattccggggctcctatctcgcgggtgccggcctagcattctctctgatgaagtcactagggggaggccgaagagggaccggagctcagggcgagactctgggtgaaaagtggaaaaggcaactcaaccagcttagcaagtccgagtttaatacatacaaacgcagtgggattatggaagtggaccggtctgaggccaaggaaggactgaaaagaggcgagaccactaagcacgcagtcagccgtggtacagctaagttgaggtggttcgttgagcggaacctggtgaaacccgaaggcaaggtcatcgatctcgggtgtggacgcggcgggtggtcatattactgcgccggactgaaaaaggtgaccgaggtaaaaggctatacgaagggtgggccgggacatgaggaaccaattcctatggccacctacggctggaatctagtgaaacttcactccggcaaggacgtatttttcatgcccccagaaaagtgtgatacactgctatgcgacatcggggagagtagccccaaccctactatagaggaaggacgaaccctcagagtgctgaaaatggtcgagccgtggttgaggggtaatcagttttgtatcaagattctgaacccctacatgccatctgtggtcgaaacactcgagcagatgcaacggaaacacggcgggatgcttgtgcgcaatcctctgtccagaaactcaactcatgagatgtattgggttagctgcggaaccggcaatatcgtatcggcggtgaacatgacatctaggatgttactgaaccgattcaccatggctcaccggaagcccacttacgaacgtgatgtcgacttgggtgcagggacgagacatgtggccgttgagcctgaagtggctaatctcgatattatcggacagcgcattgagaacatcaaaaatgaacacaagagtacatggcactatgacgaggataacccatacaagacctgggcctatcatggctcctacgaggtcaaacccagcggctcagcatcctctatggtgaatggggtagtgaggctgctaactaagccttgggacgttataccaatggtcacccagattgccatgacagatacgaccccctttggacaacagcgggtgttcaaagaaaaggtggacactagaacaccgcgcgctaaaaggggtaccactcagatcatggaggtcacagcgaagtggctttggggctttctgagccgaaacaagaaacctcggatctgtaccagagaagagttcacaaggaaggttcgcagtaatgccgcaattggggctgtgtttgtagacgaaaaccagtggaactccgccaaagaggcagtggaggatgaacgtttctgggacctcgtccaccgggagagagaactgcataagcaaggaaaatgcgccacttgcgtgtataacatgatgggcaagagggagaagaaattgggtgaatttgggaaggctaaaggaagccgcgccatatggtacatgtggctgggcgcgcgattcctcgagttcgaggcacttggctttatgaatgaagatcactggttctctcgggagaactcactgagtggggttgaaggagagggtttacataagctgggctacatcttgagagacatttccaaaatcccagggggaaatatgtatgccgatgacaccgctggctgggatacgaggattaccgaggacgatctccagaacgaagccaagatcacagacataatggagcccgaacacgcactgctagctactagcatctttaaacttacctaccagaataaggtggtccgcgtgcagagacctgccaagaacggtacagtaatggatgttatttctcggagggaccaacgtgggtcgggacaggtgggcacttatggcctgaacaccttcacgaatatggaggtccagctcatccgacagatggaatcagaggggatttttctgccaagcgagttggaaacacccaacttagctgagcgcgtgctggattggctcgaaaaacacggagccgagagacttaagcggatggcaatctccggtgacgactgtgtggtcaaaccgatagatgacaggttcgcgaccgccctgactgctctaaatgatatgggcaaggttcgcaaagacattcctcaatgggaacccagtaaggggtggaacgattggcaacaggtgccattttgctctcatcacttccatcagctgatcatgaaggacggaagagagatcgtagtgccttgtcggaatcaagatgagctcgtcggcagggcccgagtgagccagggtgcagggtggtccttgaaagaaacagcttgcctgggaaagtcatacgcccagatgtggcaacttatgtattttcaccgtagagacctgcgcctcgcagccaacgcgatttgtagtgctgttcccgtggattgggtcccaacctctcggactacctggagcatacacgcccatcaccagtggatgacaacggaggacatgttatccgtgtggaatagggtatggatcgaagagaacccctggatggaagataaaacccatgtttcaagctgggaggaggtgccttacctgggcaagagagaagaccagtggtgcggctctttgattgggctgactgcacgcgccacatgggctaccaatatccaggtcgccattaaccaagtgcggaggctcatcggaaatgagaactatcttgactacatgacttccatgaaacgattcaagaatgaaagtgatccagagggtgcactgtggtga

SEQ ID NO: 13378 - RNA, 9879 nt, synthetic construct
  misc_feature 1..9879: note = derived and/or modified CDS sequence (opt3) from DENV-1__KJ189329__SS-prME
  source 1..9879: mol_type = other RNA
agcgtgaccatgctgctcatgcttctgcccactgcattggctttccacttaactacgagaggaggggaacctcatatgatcgtctccaagcaggaaaggggaaaatctctgctatttaagacctcagccggtgttaacatgtgcaccctcattgccatggacctgggcgaactttgtgaagatactatgacctacaaatgcccacagataacagaggcggaaccggacgatgtggactgttggtgcaatgctaccgatgcctgggtaacttatgggacatgtagtcagaccggagagcaccggcgcgacaagcgaagcgtggcactggcaccccatgtcggcttgggtctcgagacgcgtactgaaacctggatgtcctctgagggggcttggaaacagatccagagagtggaaacatgggcactgaggcaccctggattcactgttattgcctttttcctggctcatgccatcggcacctcgattacacaaaagggcatcatatttatcctcttaatgctggtgaccccatcaatggcgatgcggtgcgtcgggattggaaaccgcgatttcgtggagggtcttagcggcgcaacgtgggtagacgttgtgttggagcacgggagttgtgtcactacaatggccaagaataaacccaccctggatatcgaactactcaagactgaggtgacaaaccctgctattctgagaaaactttgcatcgaagccaagatatccaataccacgaccgactctaggtgtccaacacagggagaggcaactctggtggaagaacaggatgctaactttgtctgccggcgcaccttcgttgaccgaggctggggtaatgggtgtggattgtttggcaaaggcagcctcctgacatgcgccaagttcaagtgcgtgactaaattagaggggaagattgtacagtacgaaaacctgaaatattccgtgatcgtcaccgtgcacacaggagatcaacatcaggttggtaatgagaccactgaacacggcacgattgcgacaatcacaccccaggcccctacttcagagatccagctcaccgactacggggcacttacactggactgtagtccaagaaccggattggattttaacgaaatggtgctactgactatgaaggagaaaagctggctcgtccataagcaatggttcctggaccttccgctgccctggacatctggcgcttccacgtcacaggagacctggaataggcaggatttgctcgtgacttttaaaacagcccacgctaagaagcaagaagtagttgtgctgggtagccaggagggggccatgcacaccgcattaacaggcgccactgaaattcagaccagtggaacgaccacaatattcgctggccatctgaaatgccggctaaagatggacaaactcactctgaaggggacctcttatgtcatgtgtacaggatccttcaaacttgagaaggaagtggcggagactcagcacggtaccgtcttggtgcaagttaagtacgagggcacggatgcaccttgcaaaatcccatttagcacacaggacgaaaagggggtgacccagaacggacgtctgattactgccaatcccatcgtaacagataaagagaagcctgtcaacatagaaaccgagccacccttcggcgagtcgtatattgtggttggtgctggggaaaaagccctcaagctgtcttggtttaagaaaggctcctcaatcggaaagatgttcgaggcaactgcccgcggcgctagaaggatggccatccttggggacaccgcatgggattttggaagtattggtggcgtgttcacaagcgtcgggaaactggtgcatcaggtatttggaacggcgtacggcgtgttgttctccggtgtttcttggaccatgaagatcgggattggcatactcctgacttggttaggactgaatagccggtcaacaagtctatccatgacctgtatcgctgtcggcatggtgacactctacctgggggtgatggtccaagccgacagcggatgcgttattaactggaaaggccgagaacttaagtgtggttctgggatctttgtgactaacgaggtgcacacctggacggaacagtataagttccaggcagattcaccgaaacgcttgagtgccgctatcggaaaggcctgggaggagggcgtatgcggtattagaagcgcaacaaggctggaaaatataatgtggaaacagatctccaacgagctcaatcatattctgttagaaaacgacatgaagtttaccgtcgtggttggcgacgctaatgggatcctggcccaaggcaagaagatgattcggcctcagcccatggagcacaaatactcttggaagtcgtggggcaaggcgaaaatcataggggccgatatccagaacactaccttcattatcgacggaccagatacacctgaatgtcccgacaatcagcgcgcttggaacatttgggaggtggaggattatggctttggtatcttcactaccaatatatggcttaagttgagagacagctacacacaaatgtgcgatcacaggctcatgtccgcagccattaaagactcaaaggctgtccatgccgatatggggtattggatcgaaagtgagaaaaacgaaacgtggaagctggcacgtgcgtctttcattgaggtgaagacctgtacttggccaaaaagccacacactatggtccaatggagttctggaatcagagatgatcatacccaagatctacggcggtcctattagccagcataactatcggtctggctactttacccagactgccgggccatggcacctcggaaaactggagcttgacttcgatttgtgcgaaggcacaaccgtggtagtcgacgagcactgcgggaatcgaggaccgtccctgagaacgactaccgtgacaggcaagatcattcatgaatggtgttgcaggagttgtaccttaccccctctccgctttcggggtgaggatgggtgctggtacggaatggagatcagaccagtgaaagaaaaggaggaaaacctggtcaggagcatggtttctgctggctccggtgaggtggactcattcagtcttggcatactgtgtgccagcattatgatcgaagaggtaatgcgctcgcgatggtcccggaagatgttgatgactgggacactcgcagtgtttctgctactggtcatgggacaactcacctggaatgacctgatccgtctttgcattatggtgggcgctaacgcctctgatagaatggggatgggaacaacttatttggcactgatggccaccttcaaaatgaggcccatgtttgctgttggcttactcttccgccggctgacgagcagagaggtgcttctgctaacaatcggtctctcactggtcgcgagtgtggaattgcctaactccctggaggaattaggggacggactcgccatgggcattatgatgctgaaacttctgaccgagtttcagccacaccagttgtggactaccctcctgtctctaacattcataaaaactaccctgagccttgattacgcatggaagacgacagctatggccctctccatcgtttcactgtttcccttgtgtctgagcaccacaagtcagaaaacaacctggttaccggtgctcctgggctctttcgggtgcaagcctcttactatgtttctgattacagaaaataagatctggggaaggaaatcctggccattgaacgagggtattatggccatcggcatagtcagcatcctcctgtcgtcactactgaagaatgacgtaccccttgctgggcctctcattgcaggaggcatgctgatcgcctgttatgtgatttctggtagttccgcggatttgagcttagagaaagctgccgaagtttcttgggagcaagaagcagagcatagcgggacctcccacaacatcctggtggaagtccaggacgatggaacgatgaagataaaagacgaggagcgagatgacactctcaccattctgcttaaggccacactgttggctgtgtcaggcgtataccccatgagtatcccagcaaccctattcgtgtggtatttctggcagaaaaagaagcagcgcagcggcgtcctgtgggatacaccttctcccccagaagttgagcgggccgtgctcgacgatgggatctacaggattctgcaacgaggacttttaggtcgttcccaggtgggcgtcggggtgtttcaggacggagttttccatactatgtggcacgtaacccgcggcgcggtgctgatgtatcagggtaaacggctcgaaccgtcatgggctagtgtcaagaaagacttgataagctacgggggaggctggagatttcaaggctcctggaatacgggggaggaggtgcaggttatcgccgtggaacctggaaagaaccccaaaaatgtccagacaactccaggtaccttcaagacacccgagggcgaagtgggggcaattgccctggattttaagcctggaacctctggctcgccaatcgtaaacagggagggtaaaattgtcgggctctacggaaatggcgtggttactaccagcggcacatatgtgtcagctatcgcccaagcaaaggcttcccaggaagggcccctgcctgagatagaggacgaagtcttcaaaaagcgaaaccttacgatcatggatctgcacccgggaagtggtaaaactcggcgctacttgccagccattgtgagagaggcgatcaagaggaagctacggaccctgattctcgcccccacacgagttgtggcatctgaaatggctgaggccttaaaaggcatgcctatcagatatcagaccactgctgtcaagagcgaacatacagggcgcgagatagtggacctgatgtgccacgcaacctttacgatgaggcttctgtccccagtacgtgtgcccaattacaacatgattatcatggatgaggcccatttcactgaccctgcctcaatcgctgcgcggggatatatttctacaagagttggcatgggtgaagcagccgctatctttatgaccgccaccccgcccgggagcgtcgaggcattcccacagagtaatgccgtgatacaagatgaagagagggacattcctgaacgctcctggaacagcggatacgattggatcactgactttcccggcaaaacagtgtggttcgtcccatctattaagtcaggcaatgatatcgctaactgtctcagaaagaacgggaagagagtaatacagttgtcccggaagaccttcgacacagagtatcagaaaactaagaataacgactgggattacgtggttacgaccgacattagtgagatgggagcgaattttagggccgatcgcgtgatcgaccctcgtagatgcctgaaacccgtcatcctcaaggatggtccagaacgggtgattctggcaggcccgatgcctgttacagtggctagcgccgcacagaggcgcgggcgaatcggaagaaaccaaaataaagagggcgaccagtacgtctatatgggtcagccccttaacaatgatgaagaccacgcccattggactgaggctaagatgctactggataacattaataccccagaggggataatccccgccttgttcgaacctgagcgggaaaagtcggcggcaattgacggcgagtacaggttacgcggagaagccagaaaaacatttgtggagctgatgaggcggggcgatctcccagtatggctgtcttataaggtggcttccgaggggttccagtacagcgaccgtcgctggtgctttgatggagaacgaaacaatcaagttcttgaggaaaacatggacgtcgagatctggaccaaagaaggtgagagaaagaaactgaggccccggtggctcgacgcccgcacttattcagatcctttggctctgagagagttcaaggaatttgcagccggcaggcggagtgtgtctggggacctaatcctggagattggaaaactcccgcagcaccttacgtcccgagctcagaatgccctggataacttagtgatgttgcacaatagcgaacagggcggtaaggcatacagacatgcgatggaggaactgccagacaccatagagacactcatgctgcttgccctgatcgctgtcctcactgggggcgttaccttgttctttctgtcaggaaagggcttagggaaaacaagtattggactactgtgtgtgaccgccagctccgcactcctttggatggcttctgtagagccccactggatcgccgcaagcattatcctggagttctttttgatggtgctgctcatacctgagcccgatcgccaaaggactccacaggacaaccagctggcctatgtcgtgatcggtcttctcttcatgattctgacagttgctgcgaacgaaatgggcttgctggagacgaccaagaaagatttagggatcggacatgtggccgcagagaatcaccaacacgctactatgctagacgtcgatctgcggcctgcctccgcctggacactctacgcagtagctaccaccgtgattacacccatgatgcgtcatactatcgaaaacacgaccgccaatatatcacttacagcgattgctaaccaggccgcaatcctgatgggcttggacaagggttggccaatttctaaaatggatatcggggttcctctgctcgccctgggctgctacagtcaggtgaatccgcttactttaaccgctgcagtcctgatgctcgtggcccactatgcgataatcggacccggcttgcaggctaaggccacaagagaggcacaaaagaggaccgccgctgggattatgaaaaacccaactgtcgacggaatcgtggccattgatctggaccctgttgtgtacgacgcaaagtttgaaaaacagctaggccagatcatgctgctcatactttgtacgtcgcagattctgttgatgcgcacaacctgggctctgtgcgagagcatcactctcgccaccggtcccctgacaactttatgggaagggtccccaggaaagttctggaataccacaatcgcggtatctatggccaacattttccggggctcatatcttgccggtgctggcctggcctttagcctcatgaaatccctagggggaggccgaagagggacgggagcacaaggcgagaccctgggtgagaagtggaagaggcagttgaatcagctgagtaaatctgagttcaacacttacaagcgcagcgggatcatggaggtggatcggtcagaagctaaagagggactcaagagaggcgaaacaaccaaacatgccgtctcccgtggtactgccaaacttaggtggtttgttgagcggaatctggtgaagcctgagggcaaagtcatagacttggggtgtggacgcggcgggtggagttattactgcgcgggactgaagaaagtgacagaagtaaagggctataccaaaggtgggcccggacacgaggaaccgattccaatggctacgtacggctggaacctcgtgaagttacatagcggcaaagatgttttctttatgcctcccgagaagtgtgacaccctgctttgcgatatcggggaatcttccccaaatcccacaattgaggagggacgaactctgagagtgctaaagatggtcgaaccttggctcaggggtaaccagttctgtatcaaaatactgaatccgtacatgccctcagtggtcgagaccttggaacaaatgcagcggaagcacggcgggatgctggtgcgcaacccactcagcagaaattcgacacacgagatgtattgggtttcttgcggaactggcaacatcgtaagtgcagtgaacatgacctccaggatgcttctgaatcgatttacaatggcccatcggaaacctacctacgagcgtgacgtcgatttaggtgctgggactagacacgtggccgttgaacccgaggtggcaaacctggacattatcggacagcgcattgaaaatatcaagaacgagcataaaagcacgtggcactatgatgaagacaatccttacaggacatgggcctatcacggctcatacgaggtcaagccatccggctctgctagcagtatggtgaacggggtagtgcggttgctcaccaagccctgggatgttattcctatggtcactcaaatcgcgatgaccgacacaacgccattcggacagcagagagtgtttaaagagaaggtggacacccgcactcccagggccaaacgaggtacaacccagataatggaagtcactgcaaagtggctgtggggcttcctatcccggaataaaaagccgagaatttgtacaagggaggaatttacccgcaaggttcgtagcaacgctgccatcggggcagtgttcgtagatgagaatcaatggaactctgccaaagaagctgtggaggacgagcggttttgggatcttgtccatagagaaagggagctgcacaagcagggaaaatgcgccacatgcgtgtataatatgatgggcaagcgcgagaaaaagctcggtgagttcgggaaggcgaaaggatcacgagcaatctggtacatgtggctgggcgcccggttcttggaatttgaggctctgggcttcatgaacgaggaccattggtttagtagagaaaattccctcagcggggttgagggagaaggtcttcacaagctgggctacattttaagggatatatctaaaatccctgggggaaacatgtatgccgacgatactgcaggctgggacacccgcattacggaggatgacctgcagaatgaggctaagatcaccgaaattatggagccagaacatgccttgctcgctacatcgatcttcaaactgacttaccagaacaaggtggtcagagtgcaacggcccgccaaaaacggtaccgtaatggatgttatatcaaggcgtgaccagcgagggagcggacaggtgggcacatatggcctaaatacttttaccaacatggaggtccagcttatccgccaaatggaatccgaggggattttcctgcctagtgagctcgaaacgccaaatctggcagagagagtgttggattggttagaaaagcacggagcggagcggctgaagaggatggccatctctggtgacgactgtgtggtcaaacccattgatgaccgctttgctacagccctcaccgcacttaacgatatgggcaaggttagaaaagacatcccgcagtgggaacctagcaaggggtggaatgattggcaacaggtgcccttctgctcccaccattttcaccaactgataatgaaagacggacgggagattgtagtgccatgtaggaaccaggatgagctagtcggccgagctcgtgtgtcacagggtgccgggtggagtctgagagaaactgcatgcctcggaaagtcttacgcccaaatgtggcagttgatgtatttccatcgccgggacctgaggcttgcggctaatgccatctgtagcgcagttcctgtggattgggtccccacatccagaaccacttggtcaatccacgcccaccatcagtggatgaccacagaggacatgctgagcgtgtggaaccgcgtatggattgaagagaatccatggatggaagataagacgcacgtttcttcctgggaggaggtgccctacctcggcaaacgggaagaccagtggtgcggcagtttaatagggctgaccgctagggccacttgggcaacaaacatccaagtcgctattaatcaggtgcgaagattgatcggaaacgagaattatctggactacatgaccagcatgaagcggtttaaaaacgaatcggatcctgagggtgccctctggtga

SEQ ID NO: 13379 - RNA, 9879 nt, synthetic construct
  misc_feature 1..9879: note = derived and/or modified CDS sequence (opt3) from DENV-1__KJ189331__SS-prME
  source 1..9879: mol_type = other RNA
agcgtgaccatgctgctcatgcttctgcccacagccttggctttccacttaactacgagaggcggggagcctcatatgatcgtctccaagcaggaaaggggaaaatctctgctatttaagacctcagcaggtgttaacatgtgcacactcattgccatggacctgggcgagctttgtgaagatactatgacctacaaatgcccacaaataacagaggcggaaccggacgatgtggactgttggtgcaatgctaccgatacttgggtaacatatgggacctgtagtcagacgggagagcaccggcgcgacaagcgaagcgtggccctggcaccccatgtcggcttgggtctcgagactcgtaccgaaacatggatgtcctctgagggggcctggaaacagatccagagagtggaaacttgggctctgaggcaccctggattcaccgttattgcactgtttctcgcccatgctatcggcacatcgattacccaaaagggcatcatattcatcttactgatgcttgtgacgccatcaatggccatgcggtgcgtcgggattggaaaccgcgattttgtggagggtttgagcggcgcgacttgggtagacgttgtgctggagcacgggagttgtgtcacaaccatggcaaagaataaacccactctagatatcgaactcctgaagacagaggtgaccaaccctgccattcttagaaaactgtgcatcgaagctaagatatccaatacgaccacagactctaggtgtccaactcagggagaggccaccttggtggaagagcaggatgcaaacttcgtctgccggcgcacatttgttgaccgaggctggggtaatgggtgtggactcttcggcaaaggcagcctgttaacttgcgctaagtttaagtgcgtgaccaaactggaggggaagattgtacagtacgaaaacctcaaatattccgtgatcgtcacagtgcacaccggagatcaacatcaggttggtaatgagactacggaacacggcacaattgccaccatcactccccaggcgcctacctcagagatccagcttacagactacggggccctgaccttggactgtagtccaagaactggactagatttcaacgaaatggtgctgctcacaatgaaggagaaaagctggctggtccataagcaatggtttcttgacctgccgttgccctggacgtctggcgcatccacctcacaggagacttggaataggcaggatctcctggtgacattcaaaaccgctcacgccaagaagcaagaagtagttgtgttaggtagccaggagggggctatgcacacagccctgactggcgcaaccgaaattcagacgagtggaaccacaactatatttgccggccatctaaaatgccggctcaagatggacaaactgacccttaaggggacatcttatgtcatgtgtactggatccttcaaattggagaaggaagtggctgagacccagcacggtacggtcctggtgcaagttaagtacgagggcacagatgcgccttgcaaaatcccattcagcacccaggacgaaaagggggtgactcagaacggacgtctcattacagcaaatcccatcgtaaccgataaagagaagcctgtcaacatagaaactgagccaccctttggcgagtcgtatattgtggttggtgccggggaaaaagctctgaagctttcttggttcaagaaaggctcctcaatcggaaagatgtttgaggccaccgcacgcggcgccagaaggatggctatcctgggggacacagcctgggatttcggaagtattggtggcgtgtttacgagcgtcgggaaattggtgcatcaggtattcggaaccgcatacggcgtgctcttttccggtgtttcttggactatgaagatcgggattggcatactgttaacatggctgggactaaatagccggtcaaccagtctctccatgacatgtatcgcggtcggcatggtgactctgtaccttggggtgatggtccaagctgacagcggatgcgttattaactggaaaggccgagaattgaagtgtggttctgggatcttcgtgaccaacgaggtgcacacgtggacagaacagtataagtttcaggccgattcaccgaaacgcctgagtgcagccatcggaaaggcttgggaggagggcgtatgcggtattagaagcgccaccaggctcgaaaatataatgtggaaacagatctccaacgagctgaatcatattttactggaaaacgacatgaagttcactgtcgtggttggcgacgcaaatgggatccttgctcaaggaaaaaagatgattcggcctcagcccatggagcacaaatactcttggaagtcgtggggcaaggccaaaatcataggggcggatatccagaacaccacatttattatcgacggaccagatactcctgaatgtcccgacaatcagcgcgcctggaacatttgggaggtggaggattatggcttcggtatctttaccacaaatatatggttgaagctcagagacagctacacgcaaatgtgcgatcacaggctgatgtccgctgcaattaaagactcaaaggccgtccatgctgatatggggtattggatcgaaagtgagaaaaacgaaacctggaagctagcccgtgcatctttcattgaggtgaagacttgtacatggccaaaaagccacaccctgtggtccaatggagttctcgaatcagagatgatcatacccaagatctacggcggtcctattagccagcataactatcggccaggctacttcactcagacagcggggccgtggcacctgggaaaacttgagttggactttgatctgtgcgaaggcaccacggtggtagtcgacgagcactgcgggaatcgaggaccctctttaagaactaccacagtgaccggcaagatcattcatgaatggtgttgcaggtcctgtactctccctccactgcgcttccggggtgaggatgggtgctggtacggaatggagatcagacccgtgaaagaaaaggaggaaaaccttgtcaggagtatggttagcgccggctctggtgaggtggactccttttcactgggcatattgtgtgctagtattatgatcgaagaggtaatgcgcagccgatggtcgcggaagatgctcatgatcgggacactggccgtgttcctactgctcattatgggacaactgacctggaatgaccttatccgtttgtgcattatggtcggcgcaaacgcttccgatagaatggggatgggaacaacttatctggccttaatggcaacctttaaaatgaggcctatgttcgccgtgggcctcctgtttcgccggcttacgtctagagaggttctgctactcacaataggtctgagcttggtggcttcagtcgaactgccaaacagtttagaggaactcggggacggactggcgatgggcatcatgatgcttaagctgttgaccgagttccagccccaccagctctggactaccctgctatccctgacatttattaaaactaccctttctctcgattacgcctggaagacgacagcaatggctctgagcatcgtgtccttgttcccgctgtgtttatcaaccactagccagaaaacaacctggctccctgttctgcttggcagttttgggtgcaagccactgactatgttcttgattacagaaaataagatctggggaaggaaatcttggcccctcaacgagggtataatggccatcggcattgtgtccatcctgctaagctcgctgcttaagaatgacgtccctctcgccgggcccctgattgctggaggcatgttgatcgcatgttatgtaatatcaggttctagtgccgatttatccctggagaaaaccgcggaagtgagctgggagcaagaagctgagcattctgggacgagccacaacattctcgttgaagtgcaggacgatggaactatgaagatcaaagacgaggagcgagatgacaccctgacaatccttctgaaggccaccttgctagcagtctccggcgtgtacccaatgtcaattcctgccacactgtttgtatggtatttctggcagaaaaagaagcagcgcagtggcgtgctctgggatactcccagcccaccggaagtcgagcgggctgttctggacgatgggatatacagaatccttcaaaggggattactgggtcgttctcaggtgggcgtgggggtcttccaggacggagtgtttcataccatgtggcacgttacgcgcggcgcagtactcatgtatcagggtaaacggttggaaccttcctgggcctcagtgaagaaagacctgattagttacgggggaggctggagattccaaggcagctggaatacaggggaggaggtccaggtgatcgcggttgaacccggaaagaacccaaaaaatgtgcagactacccccggtacatttaagacccctgagggcgaagtcggggctattgccctcgatttcaagccaggaacttccggctctcccatcgtgaacagggagggtaaaatagtagggctgtacggaaatggcgtcgtgaccacatcgggcacgtatgttagcgcaatcgcccaagctaaggcctcacaggaagggcctcttccggagattgaggacgaagtgtttaaaaagcgaaacctgactatcatggatttgcacccaggatccggtaaaacccggcgctacctacccgcaattgtcagagaggctatcaagaggaagctgcggacactcatattagcccctacccgagtggttgcgagtgaaatggccgaggcactgaaaggcatgccaattagatatcagactacagctgtgaagtctgaacataccgggcgcgagatcgtcgaccttatgtgccacgccacgttcactatgaggctgctcagccccgtgcgtgtacctaattacaacatgatcattatggatgaggctcattttacagacccggcatccatcgccgcccggggatatatatcaaccagagtgggcatgggtgaagctgcggcaattttcatgaccgccactcccccagggtctgttgaggcttttcctcagagcaatgccgtcatccaagatgaagagagggacattcccgaacgcagttggaactccggatacgattggatcacagacttcccaggcaaaaccgtgtggtttgtgcctagcataaagtctggcaatgatattgcaaactgtttgcgaaaaaacgggaagagagtcatccagctgtcacggaagacattcgacactgagtatcagaaaacgaagaataacgactgggattacgtagtgaccacagacatctccgagatgggagccaatttcagggctgatcgcgttattgacccccgtagatgcctcaaaccagtgatcctgaaggatggtccggaacgggtcattcttgcgggccctatgcccgtgactgttgccagtgcagctcagaggcgcgggcgaataggaagaaaccaaaataaagagggcgaccagtacgtgtatatgggtcagccactaaacaatgatgaagaccacgcccattggaccgaggcaaagatgctgttggataacatcaatacacccgaggggattatccctgccttatttgaaccagagcgggaaaagagcgctgccatcgacggcgagtacaggctgcgcggagaagcgagaaaaaccttcgtcgagctcatgaggcggggcgatctgcccgtgtggctttcgtataaggtagcatctgaggggtttcagtactccgaccgtcgctggtgcttcgatggagaacgaaacaatcaagtgctggaggaaaacatggacgttgagatttggactaaagaaggtgagagaaagaaactcaggcctcggtggttggacgcccgcacgtatagcgatccgctggctctaagagagtttaaggaattcgccgctggcaggcggtcagtcagtggggacctgatactcgagatcggaaaacttccacagcacctgaccttacgagcacagaatgccttggataacctggctatgctccacaattctgaacagggcggtaaggcctacagacatgcaatggaggaactgcccgacacaattgagactcttatgctgctcgcgttgatcgccgtgctgaccgggggcgtgacattatttttcctatccggaaagggcctggggaaaaccagcattggactcctttgtgtcactgcttcaagtgccctgttgtggatggcaagcgttgagcctcactggatcgctgcctccataatcctggaatttttcctcatggtgctgcttattcccgagccagatcgccaaaggacacctcaggacaaccagctcgcatatgtagtgatcggtctgttgtttatgattctgacggtcgccgctaacgaaatgggcttactagagaccactaagaaagatctggggatcggacatgtggcggccgagaatcaccaacacgcaacaatgctcgacgttgatcttcggcccgcttctgcctggaccctgtacgccgtggcaaccacagtcataactccaatgatgcgtcatacgattgaaaacaccacagctaatatcagcttgactgccattgcgaaccaggctgccatcctgatgggcctcgacaagggttggcctatatccaaaatggatatcggggtaccgctgcttgcattaggctgctactcacaggtgaatcccctgaccctcacagccgctgttttgatgctggtggcacactatgccattatcggaccaggcctacaggcgaaggctaccagagaggcccaaaagaggactgcagccgggattatgaaaaaccctacggtcgacggaatcgtggctatagatctggaccccgtcgtgtacgacgccaagttcgaaaaacagctcggccagattatgcttctgatcttgtgtacatctcagatcctgctcatgcgcaccacttgggcactgtgcgagagtattaccttagctacaggtccacttactaccctgtgggaagggtcgcctggaaagttttggaatacaacgatcgccgttagcatggcgaacatattccggggctcctatctcgccggtgcaggcctagctttctctctgatgaaatcattggggggaggccgaagagggaccggagcccaaggcgagactctgggtgagaagtggaagaggcagctcaatcagcttagcaaatccgaatttaacacatacaagcgcagtgggattatggaggtggatcggtctgaagcaaaagagggactgaagagaggcgaaaccactaaacatgctgtaagccgtggtacagccaagttgaggtggttcgtggagcggaatctggtcaagcccgagggcaaagttatcgacctcgggtgtggacgcggcgggtggtcatattactgcgccggattaaagaaagtgaccgaagtcaagggctatacgaaaggtgggccgggacacgaggaaccaattcctatggcgacctacggctggaacctggtgaagcttcattccggcaaagatgtatttttcatgcccccagagaagtgtgacacactgctatgcgatatcggggaaagtagccccaatcctactatagaggagggacgaaccctcagagtgctgaagatggttgaaccgtggttgaggggtaaccagttttgtatcaaaattctgaatccctacatgccatctgtggtcgagacactcgaacaaatgcagcggaagcacggcgggatgcttgtgcgcaaccctctgtccagaaattcaactcacgagatgtattgggtcagctgcggaaccggcaacatcgtgtcggctgttaacatgacatctaggatgttactgaatcgattcaccatggcacatcggaaacccacttttgagcgtgacgtagatttgggtgccgggacgagacacgtggctgtcgaacctgaggtggccaacctcgacattatcggacagcgcattgaaaatatcaagaacgagcataaaagtacatggcactacgatgaagacaatccatataagacctgggcataccacggctcctatgaggttaagcccagcggctcagcctcctctatggtgaacggggtcgtgaggctgctaactaaaccttgggatgtaataccaatggtgacccaaattgctatgacagacacgacccccttcggacagcagcgggtttttaaggagaaagtcgacactagaacaccgcgcgcgaagaggggtaccactcagatcatggaagtgacagccaaatggctttggggcttcctgagccgaaataagaagcctcggatctgtaccagagaggaatttacaaggaaagtgcgcagtaacgcagctattggggccgtcttcgttgatgagaatcaatggaactccgcaaaggaagccgtggaggacgagcgtttttgggatctcgtacatcgggaaagagagctgcacaaacagggaaagtgcgctacttgcgtgtacaatatgatgggcaaaagggaaaagaagttgggtgagttcgggaaagccaagggaagccgcgcgatatggtatatgtggctgggcgcacgattcctcgaatttgaggcccttggcttcatgaacgaggaccattggttttctcgggaaaattcactgagtggggtcgagggagaaggtttacacaaactgggctacatcttgagagatatttccaagatcccagggggaaacatgtacgctgacgataccgccggctgggacacgaggattaccgaggatgacctccagaatgaggcaaaaatcacagatataatggaacccgagcatgctctgctagccactagcatcttcaagcttacctatcagaacaaagtggttcgcgtgcaaagacctgctaagaacggtacagtcatggacgtgatttctcggagggatcagcgtgggtcgggacaggtaggcacttacggcctgaatacctttacgaacatggaagttcagctcatccgacaaatggagtcagaagggattttcctgccaagcgagttggagacacccaatttagccgaacgcgtgctggactggctcgagaagcacggagcagaaagacttaaacggatggcgatctccggtgacgattgtgtcgtgaagccgatagacgataggtttgccaccgctctgactgccctaaacgacatgggcaaagtgcgcaaggatattcctcagtgggagcccagtaaagggtggaatgactggcagcaggtcccattctgctctcaccattttcaccaactgatcatgaaggatggaagagaaatcgttgtgccttgtcggaaccaggacgagctcgtaggcagggcacgagtgagccagggtgctgggtggtccttgcgtgagacagcctgcctgggaaagtcatatgcacaaatgtggcagcttatgtacttccatagacgcgatctgcggctcgccgcgaatgctatttgtagtgccgtccccgtggactgggttccaacctctaggactacctggagcatacacgcacaccatcagtggatgacaacggaagatatgttatccgtgtggaacagagtctggatcgaggaaaatccctggatggaggacaaaacccacgtgtcaagctgggaagaggtaccttatctgggcaagcgcgaggaccagtggtgcggctctttgattgggctgactgcccgggctacatgggccaccaacatccaagttgcaattaatcaggtgaggcgactcatcggaaacgaaaattaccttgattatatgacttccatgaaaagatttaagaacgagagtgacccagaaggtgctctgtggtga

SEQ ID NO: 13380 - RNA, 9879 nt, synthetic construct
  misc_feature 1..9879: note = derived and/or modified CDS sequence (opt3) from DENV-1__KJ189332__SS-prME
  source 1..9879: mol_type = other RNA
agcgtgaccatgctgctcatgcttctgcccacagcattggctttccacttaactacgagaggaggggagcctcatatgatagtctccaagcaggaaaggggaaaatctctgttgtttaagacctcagccggtgttaacatgtgcaccctcattgccatggacctgggcgagctttgtgaagatactatgacctacaaatgcccacaaataacagaggcggaaccggacgatgtggactgttggtgcaatgctaccgatacttgggtaacatatgggacctgtagtcagacgggagagcaccggcgcgacaagcgaagcgtggccctggcaccccatgtcggcttgggtctcgagactcgtaccgaaacatggatgtcctctgagggggcctggaaacagatccagagagtggaaacttgggctctgaggcaccctggattcaccgttattgcactgtttctcgcccatgctatcggcacatcgattacccaaaagggcacgatcttcatattactgatgcttgtgactccatcaatggccatgcggtgcgtcgggatcggaaaccgcgattttgtggagggtttgagcggcgcgacatgggtagacgttgtgctggagcacgggagttgtgtcaccactatggcaaagaataaacccacactagatattgaactcctgaagaccgaggtgacgaaccctgccatccttagaaaactgtgcattgaagctaagatctccaataccacaactgactctaggtgtccaacccagggagaggccacattggtggaagaacaggatgcaaacttcgtctgccggcgcacttttgttgaccgaggctggggtaatgggtgtggactcttcggcaaaggcagcctgttaacctgcgctaagtttaagtgcgtgacaaaactggaggggaagatagtacagtacgaaaacctcaaatattccgtgattgtcaccgtgcacactggagatcaacatcaggttggtaatgagacgacagaacacggcaccatcgccactattaccccacaggcgcctacatcagagatccagcttaccgactacggggccctgactttggactgtagtccaagaacaggactagatttcaacgaaatggtgctgctcacgatgaaggagaaaagctggctggtccataagcaatggtttcttgacctgccgttgccctggacctctggcgcatccacttcacaggagacatggaataggcaggatctcctggtgaccttcaaaacagctcacgccaagaagcaagaagtagttgtgttaggtagccaggagggggctatgcacactgccctgaccggcgcaacggaaatccagaccagtggaacaactaccatttttgccggccatctaaaatgccggctcaagatggacaaactgacacttaaggggacttcttatgtcatgtgtaccggatccttcaaattggagaaggaagtggctgagacgcagcacggtacagtcctggtgcaagttaagtacgagggcaccgatgcgccttgcaaaataccattcagcactcaggacgaaaagggggtgacacagaacggacgtctcatcaccgcaaatcccattgtaactgataaagagaagcctgtcaacatcgaaaccgagccaccctttggcgagtcgtatatagtggttggtgccggggaaaaagctctgaaactttcttggttcaagaaaggctcctcaattggaaagatgtttgaggccacagcacgcggcgccagaaggatggctatcctgggggacacggcctgggatttcggaagtatcggtggcgtgtttaccagcgtcgggaaattggtgcatcaggtattcggaactgcatacggcgtgctcttttccggtgtttcttggacaatgaagattgggatcggcattctgttaacctggctgggactaaatagccggtcaacaagtctctccatgacttgtatagcggtcggcatggtgaccctgtaccttggggtgatggtccaagctgacagcggatgcgttatcaactggaaaggccgagaattgaagtgtggttctgggattttcgtgacgaacgaggtgcacacatggaccgaacagtataagtttcaggccgattcaccgaaacgcctgagtgcagccatcggaaaggcttgggaggagggcgtatgcggtatcagaagcgccactaggctcgaaaatattatgtggaaacagatatccaacgagctgaatcatatcttactggaaaacgacatgaagttcaccgtcgtggttggcgacgcaaatgggattcttgctcaaggcaagaagatgatccggcctcagcccatggagcacaaatactcttggaagtcgtggggcaaggccaaaattatcggggcggatatacagaacacaacttttatcattgacggaccagatacccctgaatgtcccgacaatcagcgcgcctggaacatctgggaggtggaggattatggcttcggtatttttacaacgaatatctggttgaagctcagagacagctacacccaaatgtgcgatcacaggctgatgtccgctgcaataaaagactcaaaggccgtccatgctgatatggggtattggattgaaagtgagaaaaacgaaacttggaagctagcccgtgcatctttcatcgaggtgaagacatgtacctggccaaaaagccacactctgtggtccaatggagttctcgaatcagagatgattatccccaagatatacggcggtcctatcagccagcataactatcggccaggctacttcacacagaccgcggggccgtggcacctgggaaaacttgagttggactttgatctgtgcgaaggcacgactgtggtagtcgacgagcactgcgggaatcgaggaccctctttaagaaccacaaccgtgactggcaagattatccatgaatggtgttgcaggtcctgtacactccctccactgcgcttccggggtgaggatgggtgctggtacggaatggagattagacccgtgaaagaaaaggaggaaaaccttgtcaggagtatggttagcgccggctctggtgaggtggactccttttcactgggcatcttgtgtgctagtataatgattgaagaggtaatgcgcagccgatggtcgcggaagatgctcatgaccgggacactggccgtgttcctactgctcatcatgggacaactgacttggaatgaccttatccgtttgtgcattatggtcggcgcaaacgcttccgatagaatggggatgggaaccacgtatctggccttaatggcaacatttaaaatgaggcctatgttcgccgtgggcctcctgtttcgccggcttacctctagagaggttctgctactcactatcggtctgagcttggtggcttcagtcgaactgccaaacagtttagaggaactcggggacggactggcgatgggcattatgatgcttaagctgttgaccgagttccagccccaccagctctggacaactctgctatccctgacctttataaaaacgacactttctctcgattacgcctggaagaccactgcaatggctctgagcatcgtgtccttgttcccgctgtgtttatcaacaaccagccagaaaactacatggctccctgttctgcttggcagttttgggtgcaagccactgaccatgttcttgattacggaaaataagatctggggaaggaaatcttggcccctcaacgagggtattatggccatcggcatagtgtccatcctgctaagctcgctgcttaagaatgacgtccctctcgccgggcccctgattgctggaggcatgttgatcgcatgttatgtaatttcaggttctagtgccgatttatccctggagaaaactgcggaagtgagctgggagcaagaagctgagcattctgggaccagccacaacatcctcgttgaagtgcaggacgatggaacaatgaagataaaagacgaggagcgagatgacaccctgacaattcttctgaaggccactttgctagcagtctccggcgtgtacccaatgtcaatccctgccaccctgtttgtatggtatttctggcagaaaaagaagcagcgcagtggcgtgctctgggatacgcccagcccaccggaagtcgagcgggctgttctggacgatgggatctacaggattcttcaacgaggattactgggtcgttctcaggtgggcgtgggggtcttccaggacggagtgtttcatacaatgtggcacgttactcgcggcgcagtactcatgtatcagggtaaacggttggaaccttcctgggcctcagtgaagaaagacctgataagttacgggggaggctggagattccaaggcagctggaataccggggaggaggtccaggtgatcgcggttgaacccggaaagaaccccaagaatgtgcagacaacccccggtacttttaagacccctgagggcgaagtcggggctattgccctcgatttcaagccaggaacatccggctctcccatcgtgaacagggagggtaaaattgtagggctgtacggaaatggcgtcgtgacgacttcgggcacctatgttagcgcaatcgcccaagctaaggcctcacaggaagggcctcttccggagatagaggacgaagtgtttaaaaagcgaaacctgacaatcatggatttgcacccaggatccggtaaaacccggcgctacctacccgcaattgtcagagaggctatcaagaggaagctgcggactctcattttagcccctacacgagtggttgcgagtgaaatggccgaggcactgaaaggcatgccaatcagatatcagaccacggctgtgaagtctgaacatactgggcgcgagatagtcgaccttatgtgccacgccacattcaccatgaggctgctcagccccgtgcgtgtacctaattacaacatgattatcatggatgaggctcattttaccgacccggcatccatcgccgcccggggatatatttcaactagagtgggcatgggtgaagctgcggcaatcttcatgacagccacacccccagggtctgttgaggcttttcctcagagcaatgccgtcatacaagatgaagagagggacattcccgaacgcagttggaactccggatacgattggatcacagacttcccaggcaaaactgtgtggtttgtgcctagcattaagtctggcaatgatatcgcaaactgtttgagaaagaacgggaagagagtcatacagctgtcacggaagacgttcgacaccgagtatcagaaaacaaagaataacgactgggattacgtagtgactaccgacatttccgagatgggagccaatttcagggctgatcgcgttatcgacccccgtagatgcctcaaaccagtgatcctgaaggatggtccggaacgggtcattcttgcgggccctatgcccgtgacagttgccagtgcagctcagaggcgcgggcgaatcggaagaaaccaaaataaagagggcgaccagtacgtgtatatgggtcagccactaaacaatgatgaagaccacgcccattggaccgaggcaaagatgctgttggataacattaatactcccgaggggataatccctgccttatttgaaccagagcgggaaaagagcgctgccattgacggcgagtacaggctgcgcggagaagcgagaaaaacgttcgtcgagctcatgaggcggggcgatctgcccgtgtggctttcgtataaggtagcatctgaggggtttcagtactccgaccgtcgctggtgcttcgatggagaacgaaacaatcaagtgctggaggaaaacatggacgttgagatctggaccaaagaaggtgagagaaagaaactcaggcctcggtggttggacgcccgcacatatagcgatccgctggctctaagagagtttaaggagttcgccgctggcaggcggtcagtcagtggggacctgatcctcgagattggaaaacttccacagcacctgactttacgagcacagaatgccttggataacctggctatgctccacaattctgaacagggcggtaaggcctacagacatgcaatggaggaactgcccgacaccatagagacacttatgctgctcgcgttgatcgccgtgctgaccgggggcgtgactttatttttcctatccggaaagggcctggggaaaacaagcattggactcctttgtgtcacggcttcaagtgccctgttgtggatggcaagcgttgagcctcactggatcgctgcctccattatcctggaatttttcctcatggtgctgcttatacccgagccagatcgccaaaggacccctcaggacaaccagctcgcatatgtagtgatcggtctgttgtttatgattctgactgtcgccgctaacgaaatgggcttactagagacaaccaagaaagatctggggatcggacatgtggcggccgagaatcaccaacacgcaaccatgctcgacgttgatcttcggcccgcttctgcctggacactgtacgccgtggcaactacggtcattaccccaatgatgcgtcatacaatcgaaaacactaccgctaatatcagcttgacagccattgcgaaccaggctgccatcctgatgggcctcgacaagggttggcctatttccaaaatggatatcggggtaccgctgcttgcattaggctgctactcacaggtgaatcccctgaccctcactgccgctgttttgatgctggtggcacactatgccataatcggaccaggcctacaggcgaaggctacgagagaggcccaaaagaggacagcagccgggattatgaaaaaccctaccgtcgacggaatcgtggctattgatctggaccccgtcgtgtacgacgccaagttcgaaaaacagctcggccagatcatgcttctgatattgtgtacttctcagattctgctcatgcgcaccacatgggcactgtgcgagagtatcactttagctaccggtccacttacaacgctgtgggaagggtcgcctggaaagttttggaataccactatcgccgttagcatggcgaacattttccggggctcctatctcgccggtgcaggcctagctttctctctgatgaaatcactagggggaggccgaagagggacaggagcccaaggcgagaccctgggtgagaagtggaagaggcagctcaatcagcttagcaaatccgaatttaacacttacaagcgcagtgggatcatggaggtggatcggtctgaagcaaaagagggactgaagagaggcgaaacaaccaaacatgctgtaagccgtggtacggccaagttgaggtggttcgtggagcggaatctggtcaagcccgagggcaaagttatagacctcgggtgtggacgcggcgggtggtcatattactgcgccggattaaagaaagtgaccgaagtcaagggctatacaaaaggtgggccgggacacgaggaaccaattcctatggcgacttacggctggaacctggtgaaacttcattccggcaaagatgtatttttcatgcccccagagaagtgtgacaccctgctatgcgatatcggggaaagtagccccaatcctacaattgaggagggacgaactctcagagtgctgaagatggttgaaccgtggttgaggggtaaccagttttgtatcaaaatactgaatccctacatgccatctgtggtcgagaccctcgaacaaatgcagcggaagcacggcgggatgcttgtgcgcaaccctctgtccagaaattcaacacacgagatgtattgggtcagctgcggaaccggcaacatcgtgtcggctgttaacatgacttctaggatgttactgaatcgattcacgatggcacatcggaaacccacatttgagcgtgacgtagatttgggtgccgggaccagacacgtggctgtcgaacctgaggtggccaacctcgacattatcggacagcgcattgaaaatatcaagaacgagcataaaagtacttggcactacgatgaagacaatccatataagacctgggcataccacggctcctatgaggttaagcccagcggctcagcctcctctatggtgaacggggtcgtgaggctgctaacaaaaccttgggatgtaattccaatggtgacgcaaatcgctatgaccgacactacacccttcggacagcagcgggtttttaaggagaaagtcgacaccagaactccgcgcgcgaagaggggtacaacccagataatggaagtgacagccaaatggctttggggcttcctgagccgaaataagaagcctcggatttgtactagagaggaatttaccaggaaagtgcgcagtaacgcagctatcggggccgtcttcgttgatgagaatcaatggaactccgcaaaggaagccgtggaggacgagcgtttttgggatctcgtacatcgggaaagagagctgcacaaacagggaaagtgcgctacgtgcgtgtacaatatgatgggcaaaagggaaaagaagttgggtgagttcgggaaagccaagggaagccgcgcgatctggtatatgtggctgggcgcacgattcctcgaatttgaggcccttggcttcatgaacgaggaccattggttttctcgggaaaattcactgagtggggtcgagggagaaggtttacacaaactgggctacattttgagagatatatccaagatcccagggggaaacatgtacgctgacgataccgccggctgggacacaaggattactgaggatgacctccagaatgaggcaaaaatcaccgatattatggaacccgagcatgctctgctagccacaagcatcttcaaacttacttatcagaacaaagtggttcgcgtgcaaagacctgctaagaacggtaccgtcatggacgtgatatctcggagggatcagcgtgggtcgggacaggtaggcacgtacggcctgaatacatttaccaacatggaagttcagctcatccgacaaatggagtcagaagggattttcctgccaagcgagttggagactcccaatttagccgaacgcgtgctggactggctcgagaagcacggagcagaaagacttaaacggatggcgatctccggtgacgattgtgtcgtgaagccgattgacgataggtttgccacagctctgaccgccctaaacgacatgggcaaagtgcgcaaggatatccctcagtgggagcccagtaaagggtggaatgactggcagcaggtcccattctgctctcaccattttcaccaactgataatgaaggatggaagagaaattgttgtgccttgtcggaaccaggacgagctcgtaggcagggcacgagtgagccagggtgctgggtggtccttgcgtgagactgcctgcctgggaaagtcatatgcacaaatgtggcagcttatgtacttccatagacgcgatctgcggctcgccgcgaatgctatctgtagtgccgtccccgtggactgggttccaacctctaggacaacgtggagcatccacgcacaccatcagtggatgaccactgaagatatgttatccgtgtggaacagagtctggattgaggaaaatccctggatggaggacaaaacacacgtgtcaagctgggaagaggtaccttatctgggcaagcgcgaggaccagtggtgcggctctttgatagggctgaccgcccgggctacttgggccacaaacatccaagttgcaattaatcaggtgaggcgactcatcggaaacgaaaattaccttgattatatgacctccatgaaaagatttaagaacgagagtgacccagaaggtgctctgtggtga

SEQ ID NO: 13381 - RNA, 9879 nt, synthetic construct
  misc_feature 1..9879: note = derived and/or modified CDS sequence (opt3) from DENV-1__KJ189334__SS-prME
  source 1..9879: mol_type = other RNA
agcgtgaccatgctgctcatgcttctgcccactgccttggctttccacttaactacgagaggaggggaacctcatatgatcgtctccaagcaggaaaggggaaaatctctgctgtttaaggtttcagctggtgtgaacatgtgcaccctcattgccatggacctgggcgagctttgtgaagatacaatgacttacaaatgcccacagatcaccgaggcggaaccggacgatgtagactgttggtgcaatgctaccgatacctgggtgacttatgggacatgtagtcagaccggagagcaccggcgcgacaagcgaagcgtcgccctggcaccccatgtgggcttgggtctcgagacgcgtactgaaacctggatgtcctctgagggggcctggaaacagatccagagagttgaaacatgggctctgaggcaccctggattcactgtgattgcatttttcctggcccatgctatcggcacctcgattacacaaaagggcatcatatttatcctcttaatgctggtcaccccatcaatggccatgcggtgcgtggggattggaaaccgcgatttcgtagagggtcttagcggcgcgacgtgggttgacgtggtcttggagcacgggagttgtgtgactacaatggcaaagaataaacccaccctggatatcgaactactcaagactgaggtgacaaaccctgccattctgagaaaactttgcatcgaagctaagatatccaataccacgaccgactctaggtgtccaacacagggagaggccactctggtcgaagaacaggatgcaaactttgtttgccggcgcaccttcgtggaccgaggctggggtaatgggtgtggattgtttggcaaaggcagcctcctgacatgcgctaagttcaagtgcgtaactaaattagaggggaagattgtgcagtacgaaaacctgaaatattccgtcatcgtgaccgttcacacaggagatcaacatcaggtgggtaatgagaccactgaacacggcacgattgccacaatcaccccacaggcgcctacttcagagatccagctcaccgactacggggcccttacactggactgtagtccaagaaccggattggattttaacgaaatggtcctactgactatgaaggagaaaagctggctcgtgcataagcaatggttcctggaccttccgctgccctggacatctggcgcatccacgtcacaggagacctggaataggcaggatttgctcgtaacttttaaaacagctcacgccaagaagcaagaagttgtggtcctgggtagccaggagggggctatgcacaccgccttaacaggcgcaactgaaattcagaccagtggaacgaccacaatattcgccggccatctgaaatgccggctaaagatggacaaactcactctgaaggggacctcttatgtgatgtgtacaggatccttcaaacttgagaaggaagtcgctgagactcagcacggtaccgtgttggttcaagtgaagtacgagggcacggatgcgccttgcaaaatcccatttagcacacaggacgaaaagggggtaacccagaacggacgtctgattactgcaaatcccatcgtcacagataaagagaagcctgtgaacatagaaaccgagccacccttcggcgagtcgtatattgttgtgggtgccggggaaaaagctctcaagctgtcttggtttaagaaaggctcctcaatcggaaagatgttcgaggccactgcacgcggcgccagaaggatggctatccttggggacaccgcctgggattttggaagtattggtggcgtcttcacaagcgtggggaaactggtacatcaggtgtttggaacggcatacggcgttttgttctccggtgtctcttggaccatgaagatcgggattggcatactcctgacttggttaggactgaatagccggtcaacaagtctatccatgacctgtatcgcggtgggcatggtgacactctacctgggggtcatggttcaagctgacagcggatgcgtgattaactggaaaggccgagaacttaagtgtggttctgggatctttgtgactaacgaggtacacacctggacggaacagtataagttccaggccgattcaccgaaacgcttgagtgcagccatcggaaaggcttgggaggagggcgtctgcggtattagaagcgccacaaggctggaaaatataatgtggaaacagatctccaacgagctcaatcatattctgttagaaaacgacatgaagtttaccgtggttgtgggcgacgcaaatgggatcctggctcaaggcaagaagatgattcggcctcagcccatggagcacaaatactcttggaagtcgtggggcaaggccaaaatcataggggcggatatccagaacactaccttcattatcgacggaccagatacacctgaatgtcccgacaatcagcgcgcctggaacatttgggaggtcgaggattatggctttggtatcttcactaccaatatatggcttaagttgagagacagctacacacaaatgtgcgatcacaggctcatgtccgctgcaattaaagactcaaaggccgtgcatgctgatatggggtattggatcgaaagtgagaaaaacgaaacgtggaagctggcccgtgcatctttcattgaggttaagacctgtacttggccaaaaagccacacactatggtccaatggagtgctggaatcagagatgatcatacccaagatctacggcggtcctattagccagcataactatcggccaggctactttacccagactgcggggccgtggcacctcggaaaactggagcttgacttcgatttgtgcgaaggcacaaccgtagtcgtggacgagcactgcgggaatcgaggaccctctctgagaacgactaccgtgacaggcaagatcattcatgaatggtgttgcaggtcctgtaccttacctccactccgctttcggggtgaggatgggtgctggtacggaatggagatcagacccgtcaaagaaaaggaggaaaacctggttaggagtatggtgagcgccggctctggtgaggtagactccttctcacttggcatactgtgtgtgagtattatgatcgaagaggtcatgcgcagccgatggtcgcggaagatgttgatgactgggacactcgctgtgtttctgctactggttatgggacaactcacctggaatgacctgatccgtctttgcattatggtgggcgccaacgcatccgatagaatggggatgggaacaacttatttggctctgatggccaccttcaaaatgaggcctatgtttgcagtcggcttactcttccgccggctgacgtctagagaggtgcttctgctaacaatcggtctcagcctggttgcctcagtggaattgccaaacagtctggaggaattaggggacggactcgctatgggcattatgatgctgaaacttctgaccgagtttcagccccaccagttgtggactaccctcctgtccctaacattcataaaaactaccctgtctcttgattacgcgtggaagacgacagccatggcactcagcatcgtctccctgtttccgttgtgtctgtcaaccactagccagaaaacaacctggttacctgtactcctgggcagtttcgggtgcaagccacttactatgtttctgattacagaaaataagatctggggaaggaaatcttggcccttgaacgagggtattatggctatcggcatagtgtccatcctcctgagctcgctactgaagaatgacgttcctcttgccgggcccctcattgccggaggcatgctgatcgcttgttatgtgatttcaggttctagtgcagatttgtccttagagaaagccgcggaagtcagctgggagcaagaagctgagcattctgggaccagccacaacatcctggtggaagtacaggacgatggaacgatgaagataaaagacgaggagcgagatgacactctcaccattctgcttaaggccacactgttggcagtgtccggcgtctacccaatgtcaatccctgccaccctattcgtttggtatttctggcagaaaaagaagcagcgcagtggcgtgctgtgggatacacccagcccaccggaagtggagcgggctgtcctcgacgatgggatctacaggattctgcaacgaggacttttaggtcgttctcaggtgggcgttggggtatttcaggacggagtgttccatactatgtggcacgtcacccgcggcgcagtgctgatgtatcagggtaaacggctcgaaccttcctgggcctcagttaagaaagacttgataagttacgggggaggctggagatttcaaggcagctggaatacgggggaggaggtgcaggtcatcgcggtggaacccggaaagaaccccaaaaatgtacagacaactcccggtaccttcaagacacctgagggcgaagtcggggctattgccctggattttaagccaggaacctccggctctcccatcgtgaacagggagggtaaaattgttgggctctacggaaatggcgtggtcactacctcgggcacatatgtgagcgcaatcgcccaagctaaggcctcacaggaagggcctctgccggagatagaggacgaagttttcaaaaagcgaaaccttacgatcatggatctgcacccaggatccggtaaaactcggcgctacttgcccgcaattgtgagagaggctatcaagaggaagctacggaccctgattctcgcccctacacgagtcgtggcgagtgaaatggccgaggcattaaaaggcatgccaatcagatatcagaccactgctgtaaagtctgaacatacagggcgcgagatagtggacctgatgtgccacgccacctttacgatgaggcttctgagccccgttcgtgtccctaattacaacatgattatcatggatgaggctcatttcactgacccggcatccatcgccgcccggggatatatttcaacaagagtgggcatgggtgaagctgcggcaatctttatgaccgccacacccccagggtctgtggaggctttccctcagagcaatgccgtcatacaagatgaagagagggacattcccgaacgcagttggaactccggatacgattggatcactgactttccaggcaaaacagtatggttcgtgcctagcattaagtctggcaatgatatcgcaaactgtctcagaaagaacgggaaaagagttatacagttgtcacggaagaccttcgacacagagtatcagaaaactaagaataacgactgggattacgtggtcacgaccgacatttccgagatgggagccaattttagggctgatcgcgtgatcgacccccgtagatgcctgaaaccagttatcctcaaggatggtccggaacgggtgattctggcgggccctatgcccgtcacagtggccagtgcagctcagaggcgcgggcgaatcggaagaaaccaaaataaagagggcgaccagtacgtatatatgggtcagccacttaacaatgatgaagaccacgcccattggactgaggcaaagatgctactggataacattaatacccccgaggggataatccctgccttgttcgaaccagagcgggaaaagaacgctgccattgacggcgagtacaggttacgcggagaagcgagaaaaacatttgtggagctgatgaggcggggcgatctccccgtttggctgagctataaggtcgcatcggaggggttccagtactctgaccgtcgctggtgctttgatggagaacgaaataaccaagtgcttgaggaaaatatggacgtggagatctggaccaaagaaggtgagagaaagaaactgaggcctcggtggctcgacgcccgcacttattccgatccgttggctctgagagagttcaaggaatttgccgctggcaggcggagcgtctcaggggacctaatcctggagattggaaaactcccacagcaccttacgctgcgagcacagaacgccttagataatttggttatgctgcacaacagtgaacagggcggtaaggcttacagacatgccatggaggaactccccgacaccatagagacactgatgcttctggcactcatcgcggtgttgactgggggcgtaaccctgttctttttatctggaaagggcctagggaaaacatccattggactgctctgtgtgaccgccagctcagcacttctgtggatggccagtgtcgagcctcactggatcgcagctagcattatcttggagttctttctgatggtgctcctgatacccgagccagatcgccaaaggactcctcaggacaaccagcttgcctatgttgtgatcggtctcctgttcatgattttgacagtcgcagccaatgaaatgggcctgttagagacgaccaagaaagatctagggatcggacatgtagctgcggagaaccaccaacacgccactatgctggacgtggatctccggcccgcatccgcttggacactttacgccgttgccaccaccgtgattacaccaatgatgcgtcatactatcgaaaatacgaccgcaaacatatctctgacagctattgccaatcaggcggctatcttgatgggcctggacaagggttggcctattagcaaaatggatatcggggtcccgctcctggcccttggctgctactcccaggtgaaccccttaactctgaccgcagccgtcctcatgttggtggctcactatgcaataatcggaccaggcctgcaggccaaggcgacaagagaggctcaaaagaggaccgccgcagggattatgaaaaatcctactgttgacggaatcgtggccattgatctagaccccgtagtgtacgacgctaagtttgaaaaacagctgggccagatcatgctccttatactgtgtacgtcacagattttgctgatgcgcacaacctgggccctctgcgagtctatcactctggcaaccggtccattaacaactctttgggaagggagtcctggaaagttctggaacaccacaatcgctgtctcgatggccaatattttccggggcagctatctggcgggtgccggcctcgcattttccctaatgaaatctctagggggaggccgaagagggacgggagctcaaggcgagaccttgggtgagaagtggaagaggcagctgaaccagctctcaaaaagcgagttcaatacttacaagcgctccgggatcatggaggttgatcggagtgaagccaaagagggacttaagagaggcgaaacaaccaaacatgcagtgtctcgtggtactgctaagctgaggtggtttgtcgagcggaacttggtgaagcccgagggcaaagtaatagacctggggtgtggacgcggcgggtggagctattactgcgccggactcaagaaagtgacagaagttaagggctataccaaaggtgggccgggacacgaggaaccaattcctatggccacgtacggctggaatttagtgaagctgcattcaggcaaagatgtcttctttatacccccagagaagtgtgacacccttctgtgcgatattggggaatccagtcccaaccctacaatcgaggagggacgaactctaagagtgctcaagatggtcgaaccgtggctgaggggtaatcagttctgtataaaaatcttgaacccctacatgccaagcgtggttgaggcgctggaacaaatgcagcggaagcacggcgggatgctcgtacgcaatcctctttctagaaactccacccacgagatgtattgggtgtcatgcggaacaggcaacattgtcagcgctgtgaatatgacttcgaggatgctgttaaaccgatttaccatggcacatcggaaacccacatacgagcgtgacgttgatctgggtgccgggaccagacacgtggctgtcgaacctgaggtggccaatttggacatcattggacagcgcatcgaaaacattaagaatgagcataaatctacttggcactatgatgaagacaacccatacaagacgtgggcatatcacggcagttacgaggtaaagccctccggcagcgcctcatccatggtgaatggggttgtcaggctcctgacaaaaccttgggatgtgatcccaatggtgacccaaatagctatgactgacaccacacccttcggacagcagcgggtctttaaggagaaagttgacacgagaaccccgcgcgcgaagaggggtactacacagattatggaagtgaccgccaaatggctatggggcttcctttctcgaaacaagaagcctcggatctgtactagagaggaatttacaaggaaagtacgcagcaatgcagctatcggggccgtgttcgtcgatgagaaccaatggaatagtgcaaaggaagccgtggaggacgagcgtttttgggatctggttcatcgggaaagagagctccacaaacagggaaagtgcgctacctgcgtgtataacatgatgggcaaaagggaaaagaagctgggtgagttcgggaaagccaagggatcccgcgcgatttggtacatgtggttgggcgcacgattcctggaatttgaggccctcggcttcatgaatgaggaccattggtttagccgggaaaactctctttcaggggtcgagggagaaggtctgcacaaattaggctacatactgagagatatcagtaagattccagggggaaatatgtatgctgacgatacagccggctgggacactaggatcaccgaggatgacttgcagaacgaggcaaaaattacggaaatcatggagcccgaacatgctctcctggccacctccatattcaagctaacataccagaacaaagtggtacgcgttcaaagacctgctaagaatggtactgtgatggatgtcatcagccggagggaccagcgtgggtctggacaggtgggcacctatggccttaacacatttactaatatggaggtgcagctgattcgacaaatggaatcggaggggatcttcctcccatcagagctggaaacccccaacttggccgagcgcgtcttagattggctggaaaagcacggagcagagagactcaaacggatggcgattagcggtgacgactgtgttgtgaagccgatcgatgacaggtttgccacggctcttacagccctgaatgatatgggcaaagtacgcaaggacatacctcagtgggaaccctccaaagggtggaacgattggcaacaggtgccattctgcagtcaccattttcaccaactaattatgaaggacggaagagagatcgtcgtgccttgtcggaatcaggatgagctggttggcagggcacgagtgtctcagggtgctgggtggagcctccgtgaaaccgcctgcttgggaaagtcctacgcacaaatgtggcagctgatgtatttccatagacgcgaccttcggctggccgcgaacgctatctgttcagccgtccccgtggattgggtaccaacaagtaggacaacctggtctattcacgcacaccatcagtggatgactaccgaggacatgctcagcgtttggaatagagtgtggatagaagagaacccctggatggaagataaaacacacgtctcctcatgggaggaggtgccttacttaggcaagcgcgaagaccagtggtgcggcagcctgatcgggttgacggcccgggctacctgggccactaatattcaagttgcaatcaaccaggtgaggcgactgattggaaatgagaactatctcgactacatgacatctatgaaaagatttaagaatgaatccgatccagagggtgctctttggtga

SEQ ID NO: 13382 - RNA, 9879 nt, synthetic construct
  misc_feature 1..9879: note = derived and/or modified CDS sequence (opt3) from DENV-1__KJ189335__SS-prME
  source 1..9879: mol_type = other RNA
agcgtgaccatgctgctcatgcttctgcccacagccttggctttccacttaactacgagaggaggggaacctcatatgatcgtctccaagcaggaaaggggaaaatctctgctgtttaagacctcagctggtgttaacatgtgcacactcattgccatggacctgggcgagctttgtgaagatactatgacctacaaatgcccacaaataacagaggcggaaccggacgatgtggactgttggtgcaatgctaccgatacttgggtaacatatgggacctgtagtcagacgggagagcaccggcgcgacaagcgaagcgtggccctggcaccccatgtcggcttgggtctcgagactcgtaccgaaacatggatgtcctctgagggggcctggaaacagatccagagagtggaaacttgggctctgaggcaccctggattcaccgttattgcatttttcctggcccatgctatcggcacatcgattacccaaaagggcatcatatttatcctcttaatgctggtgacgccatcaatggccatgcggtgcgtcgggattggaaaccgcgatttcgtggagggtcttagcggcgcgacttgggtagacgttgtgttggagcacgggagttgtgtcacaaccatggcaaagaataaacccactctggatatcgaactactcaagacagaggtgaccaaccctgccattctgagaaaactttgcatcgaagctaagatatccaatacgaccacagactctaggtgtccaactcagggagaggccaccctggtggaagaacaggatgcaaactttgtctgccggcgcacattcgttgaccgaggctggggtaatgggtgtggattgtttggcaaaggcagcctcctgacttgcgctaagttcaagtgcgtgaccaaattagaggggaagattgtacagtacgaaaacctgaaatattccgtgatcgtcacagtgcacaccggagatcaacatcaggttggtaatgagactacggaacacggcacaattgccaccatcactccccaggcgcctacctcagagatccagctcacagactacggggcccttaccctggactgtagtccaagaactggattggattttaacgaaatggtgctactgacaatgaaggagaaaagctggctcgtccataagcaatggttcctggaccttccgctgccctggacgtctggcgcatccacctcacaggagacttggaataggcaggatttgctcgtgacatttaaaaccgctcacgccaagaagcaagaagtagttgtgctgggtagccaggagggggctatgcacacagccttaactggcgcaaccgaaattcagacgagtggaaccacaactatattcgccggccatctgaaatgccggctaaagatggacaaactcaccctgaaggggacatcttatgtcatgtgtactggatccttcaaacttgagaaggaagtggctgagacccagcacggtacggtcttggtgcaagttaagtacgagggcacagatgcgccttgcaaaatcccatttagcacccaggacgaaaagggggtgactcagaacggacgtctgattacagcaaatcccatcgtaaccgataaagagaagcctgtcaacatagaaactgagccacccttcggcgagtcgtatattgtggttggtgccggggaaaaagctctcaagctgtcttggtttaagaaaggctcctcaatcggaaagatgttcgaggccaccgcacgcggcgccagaaggatggctatccttggggacacagcctgggattttggaagtattggtggcgtgttcacgagcgtcgggaaactggtgcatcaggtatttggaaccgcatacggcgtgttgttctccggtgtttcttggactatgaagatcgggattggcatactcctgacatggttaggactgaatagccggtcaaccagtctatccatgacatgtatcgcggtcggcatggtgactctctacctgggggtgatggtccaagctgacagcggatgcgttattaactggaaaggccgagaacttaagtgtggttctgggatctttgtgaccaacgaggtgcacacgtggacagaacagtataagttccaggccgattcaccgaaacgcttgagtgcagccatcggaaaggcttgggaggagggcgtatgcggtattagaagcgccaccaggctggaaaatataatgtggaaacagatctccaacgagctcaatcatattctgttagaaaacgacatgaagtttactgtcgtggttggcgacgcaaatgggatcctggctcaaggcaagaagatgattcggcctcagcccatggagcacaaatactcttggaagtcgtggggcaaggccaaaatcataggggcggatatccagaacaccacattcattatcgacggaccagatactcctgaatgtcccgacaatcagcgcgcctggaacatttgggaggtggaggattatggctttggtatcttcaccacaaatatatggcttaagttgagagacagctacacgcaaatgtgcgatcacaggctcatgtccgctgcaattaaagactcaaaggccgtccatgctgatatggggtattggatcgaaagtgagaaaaacgaaacctggaagctggcccgtgcatctttcattgaggtgaagacttgtacatggccaaaaagccacaccctatggtccaatggagttctggaatcagagatgatcatacccaagatctacggcggtcctattagccagcataactatcggccaggctactttactcagacagcggggccgtggcacctcggaaaactggagcttgacttcgatttgtgcgaaggcaccacggtggtagtcgacgagcactgcgggaatcgaggaccctctctgagaactaccacagtgaccggcaagatcattcatgaatggtgttgcaggtcctgtactttacctccactccgctttcggggtgaggatgggtgctggtacggaatggagatcagacccgtgaaagaaaaggaggaaaacctggtcaggagtatggttagcgccggctctggtgaggtggactccttctcacttggcatactgtgtgtaagtattatgatcgaagaggtgatgcgcagccgatggtcgcggaagatgttgatgacagggaccctcgctgtctttctgctactggtgatgggacaactcacatggaatgacctgatccgtctttgcattatggttggcgccaacgcatccgatagaatggggatgggaactacctatttggctctgatggccacgttcaaaatgaggcctatgtttgcagtgggcttactcttccgccggctgacatctagagaggtccttctgctaaccatcggtctcagcctggtggcctcagttgaattgccaaacagtctggaggaattaggggacggactcgctatgggcattatgatgctgaaacttctgactgagtttcagccccaccagttgtggaccacactcctgtccctaactttcataaaaaccacgctgtctcttgattacgcgtggaagacaaccgccatggcactcagcatcgtgtccctgtttccgttgtgtctgtcaactacaagccagaaaaccacttggttacctgtcctcctgggcagtttcgggtgcaagccacttacaatgtttctgattaccgaaaataagatctggggaaggaaatcttggcccttgaacgagggtattatggctatcggcatagtatccatcctcctgagctcgctactgaagaatgacgtgcctcttgccgggcccctcattgccggaggcatgctgatcgcttgttatgttatttcaggttctagtgcagatttgtccttagagaaagccgcggaagtgagctgggagcaagaagctgagcattctgggacgagccacaacatcctggtcgaagtgcaggacgatggaactatgaagataaaagacgaggagcgagatgacaccctcacaattctgcttaaggccaccctgttggcagtatccggcgtgtacccaatgtcaatccctgccacactattcgtctggtatttctggcagaaaaagaagcagcgcagtggcgttctgtgggatactcccagcccaccggaagtggagcgggctgtgctcgacgatgggatctacaggattctgcaacgaggacttttaggtcgttctcaggtcggcgtgggggtttttcaggacggagtattccataccatgtggcacgtgacgcgcggcgcagtcctgatgtatcagggtaaacggctcgaaccttcctgggcctcagtgaagaaagacttgataagttacgggggaggctggagatttcaaggcagctggaatacaggggaggaggttcaggtgatcgcggtcgaacccggaaagaaccccaaaaatgtgcagactacccccggtacattcaagacccctgagggcgaagtaggggctattgccctggattttaagccaggaacttccggctctcccatcgtcaacagggagggtaaaattgtggggctctacggaaatggcgttgtgaccacatcgggcacgtatgtcagcgcaatcgcccaagctaaggcctcacaggaagggcctctgccggagatagaggacgaagtgttcaaaaagcgaaaccttactatcatggatctgcacccaggatccggtaaaacccggcgctacttgcccgcaattgttagagaggctatcaagaggaagctacggacactgattctcgcccctacccgagtggtcgcgagtgaaatggccgaggcattaaaaggcatgccaatcagatatcagactacagctgtgaagtctgaacataccgggcgcgagatagtagacctgatgtgccacgccacgtttactatgaggcttctgagccccgtgcgtgttcctaattacaacatgattatcatggatgaggctcatttcacagacccggcatccatcgccgcccggggatatatttcaaccagagtcggcatgggtgaagctgcggcaatctttatgaccgccactcccccagggtctgtggaggctttccctcagagcaatgccgtgatacaagatgaagagagggacattcccgaacgcagttggaactccggatacgattggatcacagactttccaggcaaaaccgtctggttcgtacctagcattaagtctggcaatgatatcgcaaactgtctcagaaagaacgggaaaagagtgatacagttgtcacggaagacattcgacactgagtatcagaaaacgaagaataacgactgggattacgttgtgaccacagacatttccgagatgggagccaattttagggctgatcgcgtcatcgacccccgtagatgcctgaaaccagtgatcctcaaggatggtccggaacgggttattctggcgggccctatgcccgtgactgtcgccagtgcagctcagaggcgcgggcgaatcggaagaaaccaaaataaagagggcgaccagtacgtgtatatgggtcagccacttaacaatgatgaagaccacgcccattggaccgaggcaaagatgctactggataacattaatacacccgaggggataatccctgccttgttcgaaccagagcgggaaaagaacgctgccattgacggcgagtacaggttacgcggagaagcgagaaaaacctttgtagagctgatgaggcggggcgatctccccgtgtggctgagctataaggttgcatcggaggggttccagtactctgaccgtcgctggtgctttgatggagaacgaaataaccaagtccttgaggaaaatatggacgtggagatctggactaaagaaggtgagagaaagaaactgaggcctcggtggctcgacgcccgcacgtattccgatccgttggctctgagagagttcaaggaatttgccgctggcaggcggagcgtgtcaggggacctaatcctggagattggaaaactcccacagcaccttaccctgcgagcacagaacgccttagataatttggtcatgctgcacaacagtgaacagggcggtaaggcttacagacatgccatggaggaactccccgacacaatagagactctgatgcttctggcactcatcgcggttttgaccgggggcgtgacactgttctttttatctggaaagggcctagggaaaacctccattggactgctctgtgtaactgccagctcagcacttctgtggatggccagtgtggagcctcactggatcgcagctagcattatcttggagttctttctgatggtcctcctgatacccgagccagatcgccaaaggacacctcaggacaaccagcttgcctatgtggttatcggtctcctgttcatgattttgacggtggcagccaatgaaatgggcctgttagagaccactaagaaagatctagggatcggacatgtcgctgcggagaaccaccaacacgccacaatgctggacgtagatctccggcccgcatccgcttggaccctttacgccgtggccaccacagttattactccaatgatgcgtcatacgatcgaaaataccacagcaaacatatctctgactgctattgccaatcaggcggctatcttgatgggcctggacaagggttggcctattagcaaaatggatatcggggtgccgctcctggcccttggctgctactcccaggtcaaccccttaaccctgacagcagccgtgctcatgttggtcgctcactatgcaataatcggaccaggcctgcaggccaaggcgaccagagaggctcaaaagaggactgccgcagggattatgaaaaatcctacggtggacggaatcgttgccattgatctagaccccgtggtatacgacgctaagtttgaaaaacagctgggccagatcatgctccttatactgtgtacatcacagattttgctgatgcgcaccacttgggccctctgcgagtctatcaccctggcaacaggtccattaactaccctttgggaagggagtcctggaaagttctggaacacaacgatcgctgtgtcgatggccaatattttccggggcagctatctggcgggtgccggcctcgcattttccctaatgaaatctctagggggaggccgaagagggaccggagctcaaggcgagactttgggtgagaagtggaagaggcagctgaaccagctctcaaaaagcgagttcaatacatacaagcgctccgggatcatggaggtcgatcggagtgaagccaaagagggacttaagagaggcgaaaccactaaacatgcagtttctcgtggtacagctaagctgaggtggtttgtggagcggaacttggtcaagcccgagggcaaagtgatagacctggggtgtggacgcggcgggtggagctattactgcgccggactcaagaaagtaaccgaagtgaagggctatacgaaaggtgggccgggacacgaggaaccaattcctatggccacctacggctggaatttagttaagctgcattcaggcaaagatgtgttctttatcccaccagagaagtgtgacacacttctgtgcgatattggggaatccagtcccaaccctactatcgaggagggacgaaccctaagagtcctcaagatggtggaaccgtggctgaggggtaatcagttctgtataaaaatcttgaacccctacatgccaagcgtcgtggaggcgctggaacaaatgcagcggaagcacggcgggatgctcgttcgcaatcctctttctagaaactccacacacgagatgtattgggtatcatgcggaactggcaacattgtgagcgctgtcaatatgacctcgaggatgctgttaaaccgatttacaatggcacatcggaaacccacctacgagcgtgacgtggatctgggtgccgggactagacacgttgctgtggaacctgaggtcgccaatttggacatcattggacagcgcatcgaaaacattaagaatgagcataaatctacgtggcactatgatgaagacaacccatacaagacatgggcatatcacggcagttacgaggtgaagccctccggcagcgcctcatccatggtaaatggggtggttaggctcctgaccaaaccttgggatgtcatcccaatggtgactcaaatagctatgaccgacacaacgcccttcggacagcagcgggtgtttaaggagaaagtcgacaccagaactccgcgcgcgaagaggggtacaacccagattatggaagttactgccaaatggctatggggcttcctttctcgaaacaagaagcctcggatctgtacaagagaggaatttaccaggaaagtgcgcagcaatgcagctatcggggccgtattcgtggatgagaaccaatggaatagtgcaaaggaagccgtcgaggacgagcgtttttgggatctggtgcatcgggaaagagagctccacaaacagggaaagtgcgctacatgcgtttataacatgatgggcaaaagggaaaagaagctgggtgagttcgggaaagccaagggatcccgcgcgatttggtacatgtggttgggcgcacgattcctggaatttgaggccctcggcttcatgaatgaggaccattggtttagccgggaaaactctctttcaggggtggagggagaaggtctgcacaaattaggctacatactgagagatatcagtaagattccagggggaaatatgtatgctgacgatactgccggctgggacaccaggatcacggaggatgacttgcagaacgaggcaaaaattaccgaaatcatggagcccgaacatgctctcctggccacatccatattcaagctaacttaccagaacaaagtcgtgcgcgtacaaagacctgctaagaatggtaccgttatggatgtgatcagccggagggaccagcgtgggtctggacaggtcggcacatatggccttaacacttttaccaatatggaggtgcagctgattcgacaaatggaatcggaggggatcttcctcccatcagagctggaaacgcccaacttggccgagcgcgtgttagattggctggaaaagcacggagcagagagactcaaacggatggcgattagcggtgacgactgtgtcgttaagccgatcgatgacaggtttgccacagctcttaccgccctgaatgatatgggcaaagtgcgcaaggacatacctcagtgggaaccctccaaagggtggaacgattggcagcaggtaccattctgcagtcaccattttcaccaactaattatgaaggacggaagagagatcgtggtcccttgtcggaatcaggatgagctggtgggcagggcacgagtttctcagggtgctgggtggagcctccgtgaaactgcctgcttgggaaagtcctacgcacaaatgtggcagctgatgtatttccatagacgcgaccttcggctggccgcgaacgctatctgttcagccgtgcccgtcgattgggtgccaacaagtaggaccacttggtctattcacgcacaccatcagtggatgaccacagaggacatgctcagcgtatggaatagagtttggatagaagagaacccctggatggaagataaaacgcacgtgtcctcatgggaggaggtcccttacttaggcaagcgcgaagaccagtggtgcggcagcctgatcgggttgaccgcccgggctacttgggccacaaatattcaagtggcaatcaaccaggttaggcgactgattggaaatgagaactatctcgactacatgacctctatgaaaagatttaagaatgaatccgatccagagggtgctctttggtga

SEQ ID NO: 13383 - RNA, 9879 nt, synthetic construct
  misc_feature 1..9879: note = derived and/or modified CDS sequence (opt3) from DENV-1__KJ189336__SS-prME
  source 1..9879: mol_type = other RNA
agcgtgaccatgctgctcatgcttctgcccacagccttggctttccacttaactacgagaggcggggagcctcatatgatcgtctccaagcaggaaaggggaaaatctctgctatttaagacctcagcaggtgttaacatgtgcacactcattgccatggacctgggcgagctttgtgaagatactatgacctacaaatgcccacaaataacagaggcggaaccggacgatgtggactgttggtgcaatgctaccgatacttgggtaacatatgggacctgtagtcagacgggagagcaccggcgcgacaagcgaagcgtggccctggcaccccatgtcggcttgggtctcgagactcgtaccgaaacatggatgtcctctgagggggcctggaaacagatccagagagtggaaacttgggctctgaggcaccctggattcaccgttattgcactgtttctcgcccatgctatcggcacatcgattacccaaaagggcatcatattcatcttactgatgcttgtgacgccatcaatggccatgcggtgcgtcgggattggaaaccgcgattttgtggagggtttgagcggcgcgacttgggtagacgttgtgctggagcacgggagttgtgtcacaaccatggcaaagaataaacccactctagatatcgaactcctgaagacagaggtgaccaaccctgccattcttagaaaactgtgcatcgaagctaagatatccaatacgaccacagactctaggtgtccaactcagggagaggccaccttggtggaagagcaggatgcaaacttcgtctgccggcgcacatttgttgaccgaggctggggtaatgggtgtggactcttcggcaaaggcagcctgttaacttgcgctaagtttaagtgcgtgaccaaactggaggggaagattgtacagtacgaaaacctcaaatattccgtgatcgtcacagtgcacaccggagatcaacatcaggttggtaatgagactacggaacacggcacaattgccaccatcactccccaggcgcctacctcagagatccagcttacagactacggggccctgaccttggactgtagtccaagaactggactagatttcaacgaaatggtgctgctcacaatgaaggagaaaagctggctggtccataagcaatggtttcttgacctgccgttgccctggacgtctggcgcatccacctcacaggagacttggaataggcaggatctcctggtgacattcaaaaccgctcacgccaagaagcaagaagtagttgtgttaggtagccaggagggggctatgcacacagccctgactggcgcaaccgaaattcagacgagtggaaccacaactatatttgccggccatctaaaatgccggctcaagatggacaaactgacccttaaggggacatcttatgtcatgtgtactggatccttcaaattggagaaggaagtggctgagacccagcacggtacggtcctggtgcaagttaagtacgagggcacagatgcgccttgcaaaatcccattcagcacccaggacgaaaagggggtgactcagaacggacgtctcattacagcaaatcccatcgtaaccgataaagagaagcctgtcaacatagaaactgagccaccctttggcgagtcgtatattgtggttggtgccggggaaaaagctctgaagctttcttggttcaagaaaggctcctcaatcggaaagatgtttgaggccaccgcacgcggcgccagaaggatggctatcctgggggacacagcctgggatttcggaagtattggtggcgtgtttacgagcgtcgggaaattggtgcatcaggtattcggaaccgcatacggcgtgctcttttccggtgtttcttggactatgaagatcgggattggcatactgttaacatggctgggactaaatagccggtcaaccagtctctccatgacatgtatcgcggtcggcattgtgactctgtaccttggggtgatggtccaagctgacagcggatgcgttatcaactggaaaggccgagaattgaagtgtggttctgggatcttcgtgaccaacgaggtgcacacgtggacagaacagtataagtttcaggccgattcaccgaaacgcctgagtgcagccattggaaaggcttgggaggagggcgtatgcggtataagaagcgccaccaggctcgaaaatatcatgtggaaacagatttccaacgagctgaatcatatcttactggaaaacgacatgaagttcactgtcgtggttggcgacgcaaatgggattcttgctcaaggaaaaaagatgatccggcctcagcccatggagcacaaatactcttggaagtcgtggggcaaggccaaaataatcggggcggatattcagaacaccacatttatcattgacggaccagatactcctgaatgtcccgacaatcagcgcgcctggaacatctgggaggtggaggattatggcttcggtatatttaccacaaatatttggttgaagctcagagacagctacacgcaaatgtgcgatcacaggctgatgtccgctgcaatcaaagactcaaaggccgtccatgctgatatggggtattggattgaaagtgagaaaaacgaaacctggaagctagcccgtgcatctttcatcgaggtgaagacttgtacatggccaaaaagccacaccctgtggtccaatggagttctcgaatcagagatgataatccccaagatttacggcggtcctatcagccagcataactatcggccaggctacttcactcagacagcggggccgtggcacctgggaaaacttgagttggactttgatctgtgcgaaggcaccacggtggtagtcgacgagcactgcgggaatcgaggaccctctttaagaactaccacagtgaccggcaagattatccatgaatggtgttgcaggtcctgtactctccctccactgcgcttccggggtgaggatgggtgctggtacggaatggagataagacccgtgaaagaaaaggaggaaaaccttgtcaggagtatggttagcgccggctctggtgaggtggactccttttcactgggcattttgtgtgtaagtatcatgatcgaagaggtgatgcgcagccgatggtcgcggaagatgctcatgacagggaccctggctgtcttcctactgctcgtgatgggacaactgacatggaatgaccttattcgtttgtgcatcatggttggcgccaacgcatccgatagaatggggatgggaactacctatctggctttaatggccacgtttaaaatgaggcctatgttcgcagtgggcctcctgtttcgccggcttacatctagagaggtcctgctactcaccattggtctgagcttggtggcctcagttgaactgccaaacagtttagaggaactcggggacggactggctatgggcataatgatgcttaagctgttgactgagttccagccccaccagctctggaccacactgctatccctgacttttatcaaaaccacgctttctctcgattacgcgtggaagacaaccgccatggcactgagcattgtgtccttgttcccgctgtgtttatcaactacaagccagaaaaccacttggctccctgtcctgcttggcagttttgggtgcaagccactgacaatgttcttgatcaccgaaaataagatttggggaaggaaatcttggcccctcaacgagggtatcatggctataggcatcgtatccattctgctaagctcgctgcttaagaatgacgtgcctctcgccgggcccctgatcgccggaggcatgttgattgcttgttatgttatctcaggttctagtgcagatttatccctggagaaagccgcggaagtgagctgggagcaagaagctgagcattctgggacgagccacaacatactcgtcgaagtgcaggacgatggaactatgaagattaaagacgaggagcgagatgacaccctgacaatccttctgaaggccaccttgctagcagtatccggcgtgtacccaatgtcaatccctgccacactgtttgtctggtatttctggcagaaaaagaagcagcgcagtggcgttctctgggatactcccagcccaccggaagtggagcgggctgtgctggacgatgggatttacagaatacttcaaaggggattactgggtcgttctcaggtcggcgtgggggttttccaggacggagtatttcataccatgtggcacgtgacgcgcggcgcagtcctcatgtatcagggtaaacggttggaaccttcctgggcctcagtgaagaaagacctgatcagttacgggggaggctggagattccaaggcagctggaatacaggggaggaggttcaggtgattgcggtcgaacccggaaagaacccaaaaaatgtgcagactacccccggtacatttaagacccctgagggcgaagtaggggctatcgccctcgatttcaagccaggaacttccggctctcccattgtcaacagggagggtaaaatcgtggggctgtacggaaatggcgttgtgaccacatcgggcacgtatgtcagcgcaatagcccaagctaaggcctcacaggaagggcctcttccggagatcgaggacgaagtgtttaaaaagcgaaacctgactattatggatttgcacccaggatccggtaaaacccggcgctacctacccgcaatcgttagagaggctattaagaggaagctgcggacactcatcttagcccctacccgagtggtcgcgagtgaaatggccgaggcactgaaaggcatgccaataagatatcagactacagctgtgaagtctgaacataccgggcgcgagattgtagaccttatgtgccacgccacgttcactatgaggctgctcagccccgtgcgtgttcctaattacaacatgatcatcatggatgaggctcattttacagacccggcatccattgccgcccggggatatatctcaaccagagtcggcatgggtgaagctgcggcaatattcatgaccgccactcccccagggtctgtggaggcttttcctcagagcaatgccgtgattcaagatgaagagagggacatccccgaacgcagttggaactccggatacgattggattacagacttcccaggcaaaaccgtctggtttgtacctagcatcaagtctggcaatgatatagcaaactgtttgcgaaaaaacgggaagagagtgattcagctgtcacggaagacattcgacactgagtatcagaaaacgaagaataacgactgggattacgttgtgaccacagacatctccgagatgggagccaatttcagggctgatcgcgtcatcgacccccgtagatgcctcaaaccagtgattctgaaggatggtccggaacgggttatccttgcgggccctatgcccgtgactgtcgccagtgcagctcagaggcgcgggcgaattggaagaaaccaaaataaagagggcgaccagtacgtgtatatgggtcagccactaaacaatgatgaagaccacgcccattggaccgaggcaaagatgctgttggataacataaatacacccgaggggatcattcctgccttatttgaaccagagcgggaaaagagcgctgccatcgacggcgagtacaggctgcgcggagaagcgagaaaaaccttcgtagagctcatgaggcggggcgatctgcccgtgtggctttcgtataaggttgcatctgaggggtttcagtactccgaccgtcgctggtgcttcgatggagaacgaaacaatcaagtcctggaggaaaacatggacgtggagatctggactaaagaaggtgagagaaagaaactcaggcctcggtggttggacgcccgcacgtatagcgatccgctggctctaagagagtttaaggaattcgccgctggcaggcggtcagtgagtggggacctgattctcgagataggaaaacttccacagcacctgaccttacgagcacagaatgccttggataacctggtcatgctccacaattctgaacagggcggtaaggcttacagacatgccatggaggaactgcccgacacaatcgagactcttatgctgctcgcattgattgcggttctgaccgggggcgtgacattatttttcctatccggaaagggcctggggaaaaccagcatcggactcctttgtgtaactgcctcaagtgctctgttgtggatggccagcgtggagcctcactggattgcagcttccatcatactggaatttttcctcatggtcctgcttatccccgagccagatcgccaaaggacacctcaggacaaccagctcgcctatgtggttattggtctgttgtttatgatcctgacggtggcagccaacgaaatgggcttactagagaccactaagaaagatctggggattggacatgtcgctgcggagaatcaccaacacgccacaatgctcgacgtagatcttcggcccgcatctgcttggaccctgtacgccgtggccaccacagttatcactccaatgatgcgtcatacgatagaaaacaccacagcaaatattagcttgactgctatcgccaaccaggcggctattctgatgggcctcgacaagggttggcctatctccaaaatggatataggggtgccgctgcttgccttaggctgctactcacaggtcaatcccctgaccctcacagcagccgtgttgatgctggtcgctcactatgcaatcattggaccaggcctacaggccaaggcgaccagagaggctcaaaagaggactgccgcagggatcatgaaaaaccctacggtggacggaattgttgccatcgatctggaccccgtggtatacgacgctaagttcgaaaaacagctcggccagataatgcttctgattttgtgtacatctcagatcctgctcatgcgcaccacttgggccctgtgcgagagtatcaccttagcaacaggtccacttactaccctgtgggaagggtcgcctggaaagttttggaatacaacgattgctgtgagcatggccaacatcttccggggctcctatctcgcgggtgccggcctagcattctctctgatgaaatcattggggggaggccgaagagggaccggagctcaaggcgagactctgggtgagaagtggaagaggcagctcaatcagcttagcaaatccgaatttaacacatacaagcgcagtgggataatggaggtcgatcggtctgaagccaaagagggactgaagagaggcgaaaccactaaacatgcagttagccgtggtacagctaagttgaggtggttcgtggagcggaatctggtcaagcccgagggcaaagtgattgacctcgggtgtggacgcggcgggtggtcatattactgcgccggattaaagaaagtaaccgaagtgaagggctatacgaaaggtgggccgggacacgaggaaccaatccctatggccacctacggctggaacctggttaagcttcattccggcaaagatgtgtttttcatgcccccagagaagtgtgacacactgctatgcgatattggggaaagtagccccaatcctactatcgaggagggacgaaccctcagagtcctgaagatggtggaaccgtggttgaggggtaaccagttttgtataaaaatcctgaatccctacatgccatctgtcgtggaggcgctcgaacaaatgcagcggaagcacggcgggatgcttgttcgcaaccctctgtccagaaattcaacacacgagatgtattgggtaagctgcggaactggcaacattgtgtcggctgtcaacatgacctctaggatgttactgaatcgattcacaatggcacatcggaaacccacctacgagcgtgacgtggatttgggtgccgggactagacacgttgctgtggaacctgaggtcgccaacctcgacatcattggacagcgcatcgaaaatattaagaacgagcataaaagtacgtggcactatgatgaagacaatccatacaagacatgggcatatcacggctcctacgaggtgaagcccagcggctcagcctcctctatggtaaacggggtggttaggctgctaaccaaaccttgggatgtcatcccaatggtgactcaaatagctatgaccgacacaacgccctttggacagcagcgggtgttcaaggagaaagtcgacaccagaactccgcgcgcgaagaggggtacaacccagattatggaagttactgccaaatggctttggggctttctgagccgaaataagaagcctcggatctgtacaagagaggaattcaccaggaaagtgcgcagtaacgcagctatcggggccgtatttgtggatgagaatcaatggaactccgcaaaggaagccgtcgaggacgagcgtttctgggatctcgtgcatcgggaaagagagctgcacaaacagggaaagtgcgctacatgcgtttataatatgatgggcaaaagggaaaagaagttgggtgagtttgggaaagccaagggaagccgcgcgatttggtacatgtggctgggcgcacgattcctcgaattcgaggcccttggctttatgaacgaggaccattggttctctcgggaaaattcactgagtggggtggagggagaaggtttacacaaactgggctacatattgagagatatctccaagattccagggggaaacatgtatgctgacgatactgccggctgggacaccaggatcacggaggatgacctccagaatgaggcaaaaattaccgaaatcatggagcccgaacatgctctgctagccacaagcatatttaagcttacttaccagaacaaagtcgtgcgcgtacaaagacctgctaagaacggtaccgttatggatgtgatctctcggagggaccagcgtgggtcgggacaggtcggcacatatggcctgaatactttcaccaacatggaggtgcagctcattcgacaaatggaatcagaggggatctttctgccaagcgagttggaaacgcccaatttagccgagcgcgtgctggattggctcgaaaagcacggagcagagagacttaaacggatggcgatttccggtgacgactgtgtcgttaagccgatcgatgacaggttcgccacagctctgaccgccctaaacgatatgggcaaagtgcgcaaggacatacctcagtgggaacccagtaaagggtggaatgattggcagcaggtaccattttgctctcaccatttccaccaactgattatgaaggacggaagagagatcgtggtcccttgtcggaaccaggatgagctcgtgggcagggcacgagttagccagggtgctgggtggtccttgcgtgaaactgcctgcctgggaaagtcatacgcacaaatgtggcagcttatgtattttcatagacgcgacctgcggctcgccgcgaatgctatctgtagtgccgtgcccgtcgattgggtgccaacatctaggaccacttggagcattcacgcacaccatcagtggatgaccacagaggacatgttatccgtatggaacagagtttggatagaagagaatccctggatggaagataaaacgcacgtgtcaagctgggaggaggtcccttacctgggcaagcgcgaagaccagtggtgcggctctttgatcgggctgaccgcccgggctacttgggccacaaacattcaagtggcaatcaatcaggttaggcgactcattggaaacgagaattatcttgactacatgacctccatgaaaagattcaagaacgaaagtgatccagagggtgctctgtggtga

SEQ ID NO: 13384 - RNA, 9879 nt, synthetic construct
  misc_feature 1..9879: note = derived and/or modified CDS sequence (opt3) from DENV-1__KJ189337__SS-prME
  source 1..9879: mol_type = other RNA
agcgtgaccatgctgctcatgcttctgcccacagcattggctttccacttaactacgaggggaggggagcctcatatgatcgtctccaagcaggaaaggggaaaatctctgttatttaagacctcagccggtgttaacatgtgcaccctcattgccatggacctgggagagctttgtgaagatactatgacctacaaatgcccacagataacagaggcggaaccggacgatgtggactgttggtgcaatgctaccgatacttgggtaacatatgggacctgtagtcagacgggagagcaccggcgcgacaagcgaagcgtggccctggcaccccatgtcggcttgggtctcgagactcgtaccgaaacatggatgtcctctgagggggcctggaaacagatccagagagtggaaacttgggctctgaggcaccctggattcaccgttattgcactgtttctcgcccatgctatcggcacatcgattacccaaaagggcatcatattcatcttactgatgcttgtgacgccatcaatggccatgcggtgcgtcgggattggaaaccgcgattttgtggagggtttgagcggcgcgacttgggtagacgttgtgctggagcacgggagttgtgtcacaaccatggcaaagaataaacccactttggatatcgaactcctgaagacagaggtgaccaaccctgccattcttagaaaactgtgcatcgaagctaagatatccaatacgaccacagactctaggtgtccaactcagggagaggccaccttggtggaagaacaggatgcaaacttcgtctgccggcgcacatttgttgaccgaggctggggtaatgggtgtggactcttcggcaaaggcagcctgttaacttgcgctaagtttaagtgcgtgaccaaactggaggggaagattgtacagtacgaaaacctcaaatattccgtgatcgtcacagtgcacaccggagatcaacatcaggttggtaatgagactacggaacacggcacaattgccaccatcactccccaggcgcctacctcagagatccagcttacagactacggggccctgaccttggactgtagtccaagaactggactagatttcaacgaaatggtgctgctcacaatgaaggagaaaagctggctggtccataagcaatggtttcttgacctgccgttgccctggacgtctggcgcatccacctcacaggagatttggaataggcaggatctcctggtgactttcaaaacagctcacgccaagaagcaagaagtagttgtgttaggtagccaggagggggctatgcacaccgccctgacaggcgcaactgaaatacagaccagtggaacgaccacaatctttgccggccatctaaaatgccggctcaagatggacaaactgactcttaaggggacctcttatgtcatgtgtacaggatccttcaaattggagaaggaagtggctgagactcagcacggtaccgtcctggtgcaagttaagtacgagggcacggatgcgccttgcaaaattccattcagcacacaggacgaaaagggggtgacccagaacggacgtctcatcactgcaaatcccatagtaacagataaagagaagcctgtcaacattgaaaccgagccaccctttggcgagtcgtatatcgtggttggtgccggggaaaaagctctgaaactttcttggttcaagaaaggctcctcaatcggaaagatgtttgaggccactgcacgcggcgccagaaggatggctattctgggggacaccgcctgggatttcggaagtatcggtggcgtgtttacaagcgtcgggaaattggtgcatcaggtattcggaacggcatacggcgtgctcttttccggtgtttcttggaccatgaagattgggataggcatcctgttaacttggctgggactaaatagccggtcaacaagtctctccatgacctgtattgcggtcggcatggtgacactgtaccttggggtgatggtccaagctgacagcggatgcgttatcaactggaaaggccgagaattgaagtgtggttctgggatcttcgtgactaacgaggtgcacacctggacggaacagtataagtttcaggccgattcaccgaaacgcctgagtgcagccattggaaaggcttgggaggagggcgtatgcggtataagaagcgccacaaggctcgaaaatatcatgtggaaacagatttccaacgagctgaatcatatcttactggaaaacgacatgaagttcaccgtcgtggttggcgacgcaaatgggattcttgctcaaggcaagaagatgatccggcctcagcccatggagcacaaatactcttggaagtcgtggggcaaggccaaaataatcggggcggatattcagaacactacctttatcattgacggaccagatacacctgaatgtcccgacaatcagcgcgcctggaacatctgggaggtggaggattatggcttcggtatatttactaccaatatttggttgaagctcagagacagctacacacaaatgtgcgatcacaggctgatgtccgctgcaatcaaagactcaaaggccgtccatgctgatatggggtattggattgaaagtgagaaaaacgaaacgtggaagctagcccgtgcatctttcatcgaggtgaagacctgtacttggccaaaaagccacacactgtggtccaatggagttctcgaatcagagatgataatccccaagatttacggcggtcctatcagccagcataactatcggccaggctacttcacccagactgcggggccgtggcacctgggaaaacttgagttggactttgatctgtgcgaaggcacaaccgtggtagtcgacgagcactgcgggaatcgaggaccctctttaagaacgactaccgtgacaggcaagattatccatgaatggtgttgcaggtcctgtaccctccctccactgcgcttccggggtgaggatgggtgctggtacggaatggagataagacccgtgaaagaaaaggaggaaaaccttgtcaggagtatggttagcgccggctctggtgaggtggactccttttcactgggcattttgtgtgctagtatcatgatcgaagaggtaatgcgcagccgatggtcgcggaagatgctcatgactgggacactggccgtgttcctactgctcattatgggacaactgacctggaatgaccttatccgtttgtgcattatggtcggcgcaaacgcttccgatagaatggggatgggaacaacttatctggccttaatggcaacctttaaaatgaggcctatgttcgccgtgggcctcctgtttcgccggcttacgtctagagaggttctgctactcacaataggtctgagcttggtggcttcagtcgaactgccaaacagtttagaggaactcggggacggactggcgatgggcatcatgatgcttaagctgttgaccgagttccagccccaccagctctggactaccctgctatccctgacatttattaaaactaccctttctctcgattacgcctggaagacgacagcaatggctctgagcatcgtgtccttgttcccgctgtgtttatcaaccactagccagaaaacaacctggctccctgttctgcttggcagttttgggtgcaagccactgactatgttcttgattacagaaaataagatctggggaaggaaatcttggcccctcaacgagggtataatggccatcggcattgtgtccatcctgctaagctcgctgcttaagaatgacgtccctctcgccgggcccctgattgctggaggcatgttgatcgcatgttatgtaatatcaggttctagtgccgatttatccctggagaaagcggctgaagtgagctgggagcaagaagccgagcattctgggaccagccacaacattctcgttgaagtgcaggacgatggaacgatgaagatcaaagacgaggagcgagatgacactctgaccatccttctgaaggcaacattgctagccgtctccggcgtgtacccaatgtcaattcctgctaccctgtttgtatggtatttctggcagaaacgcaagcagcggagtggcgtgctctgggatacacccagcccaccggaagtcgagagagcagttctggacgatgggatatacaggatccttcaacgtggattactgggtcgctctcaggtgggcgtgggggtcttccaggacggagtgtttcatactatgtggcacgttacccggggcgccgtactcatgtatcagggtaagagattggaaccttcctgggcgtcagtgaaaaaggacctgattagttacgggggaggctggaggttccaaggcagctggaatacgggggaggaggtccaggtgatcgctgttgaacccggcaagaacccaaagaatgtgcagacaactcccggtacctttaaaacacctgagggcgaagtcggggccattgcactcgatttcaagccaggaacctccggctctcccatcgtgaaccgagagggtaagatagtagggctgtacggaaatggcgtcgtgactacctcgggcacatatgttagcgccatcgctcaagccaaagcatcacaggaagggcctcttccggagattgaggacgaagtgtttaagaaacggaacctgacgatcatggatttgcacccaggatccggtaagactcgcagatacctacccgctattgtcagggaggccatcaaacggaagctgcgaaccctcatattagcgcctacaagagtggttgccagtgaaatggcagaggctctgaagggcatgccaattcgctatcagaccactgccgtgaaatctgaacatacagggagggagatcgtcgaccttatgtgccacgctaccttcacgatgcgtctgctcagccccgtgcgggtacctaattacaacatgatcattatggatgaggcacattttactgacccggcctccatcgccgctagaggatatatatcaacaagggtgggcatgggtgaagcggcagccattttcatgaccgctacacccccagggtctgttgaggcctttcctcagagcaatgcagtcatccaagatgaagaacgcgacattcccgaacgaagttggaactccggatacgattggatcactgacttcccaggcaagacagtgtggtttgtgcctagcataaaatctggcaatgatattgccaactgtttgagaaagaacgggaaacgggtcatccagctgtcaaggaagaccttcgacacagagtatcagaagactaaaaataacgactgggattacgtagtgacgaccgacatctccgagatgggagctaatttccgcgcggatcgtgttattgaccccagacggtgcctcaagccagtgatcctgaaagatggtccggaaagggtcattcttgccggccctatgcccgtgacagttgcaagtgctgcccagcgccgagggagaataggacggaaccaaaataaggagggcgaccagtacgtgtatatgggtcagccactaaacaatgatgaagaccacgcacattggactgaggccaaaatgctgttggataacatcaatacccccgaggggattatccctgctttatttgaaccagagagggaaaagagcgccgcgatcgacggcgagtaccgcctgagaggagaagcaaggaagacattcgtcgagctcatgcggcgtggcgatctgcccgtgtggctttcgtataaagtagcctctgaggggtttcagtactccgaccgccgatggtgcttcgatggagaaagaaacaatcaagtgctggaggaaaacatggacgttgagatttggaccaaggaaggtgagaggaaaaagctccggcctcgctggttggacgctagaacttatagcgatccgctggccctaagggagtttaaagagttcgctgcaggccggcgatcagtcagtggggacctgatactcgagatcggaaaacttccacagcacctgacgttaagagcccagaatgctttggataacctggtgatgctccacaattctgaacagggcggtaaagcctaccgccatgcaatggaggaactgcccgacaccattgagacacttatgctgctcgcgttgatcgccgtgctgactgggggcgtcaccttatttttcctatccggaaagggcctggggaagacaagcattggactcctttgtgttaccgcttcaagtgccctgttgtggatggcaagcgtggagcctcactggatcgctgcctccataatcctggaatttttcctcatggtactgcttattcccgagccagataggcaacggactcctcaggacaaccagctcgcatatgtggtcatcggtctgttgtttatgattctgacagtggccgctaacgaaatgggcttactagagacgaccaaaaaggatctggggatcggacatgttgcggccgagaatcaccaacacgcaactatgctcgacgtggatcttcgtcccgcttctgcctggacactgtacgccgtcgcaaccaccgtaataacaccaatgatgagacatactattgaaaacacgaccgctaatatcagcttgacagccattgcgaaccaggctgccatcctgatgggcctcgacaaaggttggcctatatccaagatggatatcggggtgccgctgcttgcattaggctgctactcacaggttaatcccctgactctcaccgccgctgtgttgatgctggtcgcacactatgccattatcggaccaggcctacaggcgaaagctacaagggaggcccaaaagcgcaccgcagccgggattatgaagaaccctactgtggacggaatcgtcgctatagatctggaccccgtggtttacgacgccaaattcgaaaagcagctcggccagattatgcttctgatcttgtgtacgtctcagatcctgctcatgcggacaacctgggcactgtgcgagagtattactttagctaccggtccacttacaactctgtgggaagggtcgcctggaaaattttggaataccacaatcgccgtgagcatggcgaacatattccgaggctcctatctcgccggtgcaggcctagctttctctctgatgaagtcactagggggaggcagaagggggacgggagcccaaggcgagaccctgggtgagaaatggaagcgccagctcaatcagcttagcaagtccgaatttaacacttacaaacggagtgggattatggaggtagatagatctgaagcaaaggagggactgaaacgtggcgaaacaaccaagcatgctgtgagcaggggtactgccaaattgcggtggttcgtcgagcgcaatctggttaagcccgagggcaaggtgatcgacctcgggtgtggacgaggcgggtggtcatattactgcgccggactgaaaaaggtcacagaagtgaaaggctataccaagggtgggccgggacacgaggaaccaattcctatggcgacgtacggctggaacctagtaaaacttcattccggcaaggatgtgtttttcatgcccccagagaaatgtgacaccctgctatgcgatatcggggaaagtagccccaatcctacaatagaggagggaagaactctcagggttctgaagatggtggaaccgtggttgcggggtaaccagttttgtatcaagattctgaatccctacatgccatctgtcgtggagaccctcgaacaaatgcagcgcaaacacggcgggatgcttgtcagaaaccctctgtccagaaattcaacacacgagatgtattgggtgagctgcggaactggcaacatcgtttcggctgtaaacatgacctctcgaatgttactgaatcggttcacaatggcacatcgtaagcccacctttgagagagacgtggatttgggtgccgggactcgccacgtcgctgtggaacctgaggttgccaacctcgacattatcggacagaggattgaaaatgtgaaaaacgagcataagagtacgtggcactacgatgaagacaatccatataaaacatgggcataccacggctcctatgaggtcaagcccagcggctcagcctcctctatggtgaacggggtagtgcggctgctaaccaagccttgggatgttatcccaatggtcactcaaatagctatgaccgacacaacgcccttcggacagcagagagtgtttaaagagaaggtggacacccgcactccgagggcgaaacgaggtacaacccagattatggaagtcactgccaagtggctttggggcttcctgagccggaataaaaagcctagaatctgtacaagggaggaatttacccgcaaggttcgtagtaacgcagctatcggggccgtgttcgtagatgagaatcaatggaactccgcaaaagaagccgtggaggacgagcggttttgggatctcgtccatagagaaagggagctgcacaagcagggaaaatgcgctacatgcgtgtacaatatgatgggcaagcgcgagaaaaagttgggtgagttcgggaaggccaaaggaagccgagcgatttggtatatgtggctgggcgcacggttcctcgaatttgaggcccttggcttcatgaacgaggaccattggttttctagagaaaattcactgagtggggttgagggagaaggtttacacaagctgggctacatattgagggatatctccaaaattccagggggaaacatgtacgctgacgatactgccggctgggacacccgcatcacggaggatgacctccagaatgaggcaaagattaccgatatcatggaacccgagcatgctctgctagccacaagcatattcaaacttacttatcagaacaaggtggtcagagtgcaacggcctgctaaaaacggtaccgtaatggacgttatctctaggcgtgatcagcgagggtcgggacaggtgggcacatacggcctgaatacttttaccaacatggaagtccagctcattcgccaaatggagtcagaagggatcttcctgccaagcgagttggagacgcccaatttagccgaaagagtgctggactggctcgagaagcacggagcagaacggcttaagaggatggcgatttccggtgacgattgtgtggtcaaaccgatcgacgatcgctttgccacagctctgaccgccctaaacgacatgggcaaggttagaaaagatatacctcagtgggagcccagtaaggggtggaatgactggcaacaggtgccattctgctctcaccattttcaccaactgattatgaaagatggacgggaaatcgtagtgccttgtaggaaccaggacgagctcgtcggccgagcacgtgtgagccagggtgctgggtggtccttgagagagactgcctgcctgggaaagtcatatgcacaaatgtggcagcttatgtacttccatcgccgggatctgaggctcgccgcgaatgctatctgtagtgccgttcccgtggactgggtcccaacatctagaaccacttggagcattcacgcacaccatcagtggatgaccacagaagatatgttatccgtgtggaaccgcgtatggatagaggaaaatccctggatggaggacaagacgcacgtttcaagctgggaagaggtgccttatctgggcaaacgggaggaccagtggtgcggctctttgatcgggctgaccgccagggctacttgggccacaaacattcaagtcgcaatcaatcaggtgcgaagactcattggaaacgaaaattaccttgattatatgacctccatgaagcggtttaaaaacgagagtgacccagaaggtgctctgtggtga

SEQ ID NO: 13385 - RNA, 9879 nt, synthetic construct
  misc_feature 1..9879: note = derived and/or modified CDS sequence (opt3) from DENV-1__KJ189340__SS-prME
  source 1..9879: mol_type = other RNA
agcgtgaccatgctgctcatgcttctgccaacagcattggctttccacttaactacgcggggaggggaacctcatatgatcgtctccaagcaggaaaggggaaaatctctgctatttaagacctcagccggtgttaacatgtgcacactcattgccatggacctgggcgaactttgtgaagatactatgacctacaaatgcccacaaataacagaggcggaaccggacgatgtggactgttggtgcaatgctaccgatacttgggtaacatatgggacctgtagtcagacgggagagcaccggcgcgacaagcgaagcgtggccctggcaccccatgtcggcttgggtctcgagactcgtaccgaaacatggatgtcctctgagggggcctggaaacagatccagagagtggaaacttgggctctgaggcaccctggattcaccgttattgcactgtttctcgcccatgctatcggcacatcgattacccaaaagggcatcatattcatcttactgatgcttgtgacgccatcaatggccatgcggtgcgtcgggattggaaaccgcgattttgtggagggtttgagcggcgcgacttgggtagacgttgtgctggagcacgggagttgtgtcacaaccatggcaaagaataaacccactctagatatcgaactcctgaagacagaggtgaccaaccctgccattcttagaaaactgtgcatcgaagctaagatatccaatacgaccacagactctaggtgtccaactcagggagaggccaccttggtggaagaacaggatgcaaacttcgtctgccggcgcacatttgttgaccgaggctggggtaatgggtgtggactcttcggcaaaggcagcctgttaacttgcgctaagtttaagtgcgtgaccaaactggaggggaagattgtacagtacgaaaacctcaaatattccgtgatcgtcacagtgcacaccggagatcaacatcaggttggtaatgagactacggaacacggcacaattgccaccatcactccccaggcgcctacctcagagatccagcttacagactacggggccctgaccttggactgtagtccaagaactggactagatttcaacgaaatggtgctgctcacaatgaaggagaaaagctggctggtccataagcaatggtttcttgacctgccgttgccctggacgtctggcgcatccacctcacaggagacttggaataggcaggatctcctggtgacattcaaaaccgctcacgccaagaagcaagaagtagttgtgttaggtagccaggagggggctatgcacacagccctgactggcgcaaccgaaattcagacgagtggaaccacaactatatttgccggccatctaaaatgccggctcaagatggacaaactgacccttaaggggacatcttatgtcatgtgtactggatccttcaaattggagaaggaagtggctgagacccagcacggtacggtcctggtgcaagttaagtacgagggcacagatgcgccttgcaaaatcccattcagcacccaggacgaaaagggggtgactcagaacggacgtctcattacagcaaatcccatcgtaaccgataaagagaagcctgtcaacatagaaactgagccaccctttggcgagtcgtatattgtggttggtgccggggaaaaagctctgaaactttcttggttcaagaaaggctcctcaatcggaaagatgtttgaggccaccgcacgcggcgccagaaggatggctatcctgggggacacagcctgggatttcggaagtattggtggcgtgtttacgagcgtcgggaaattggtgcatcaggtattcggaaccgcatacggcgtgctcttttccggtgtttcttggactatgaagatcgggattggcatactgttaacatggctgggactaaatagccggtcaaccagtctctccatgacatgtatcgcggtcggcatggtgactctgtaccttggggtgatggtccaagctgacagcggatgcgttattaactggaaaggccgagaattgaagtgtggttctgggatcttcgtgaccaacgaggtgcacacgtggacagaacagtataagtttcaggccgattcaccgaaacgcctgagtgcagccatcggaaaggcttgggaggagggcgtatgcggtattagaagcgccaccaggctcgaaaatataatgtggaaacagatctccaacgagctgaatcatattttactggaaaacgacatgaagttcactgtcgtggttggcgacgcaaatgggatccttgctcaaggcaagaagatgattcggcctcagcccatggagcacaaatactcttggaagtcgtggggcaaggccaaaatcataggggcggatatccagaacaccacatttattatcgacggaccagatactcctgaatgtcccgacaatcagcgcgcctggaacatttgggaggtggaggattatggcttcggtatctttaccacaaatatatggttgaagctcagagacagctacacgcaaatgtgcgatcacaggctgatgtccgctgcaattaaagactcaaaggccgtccatgctgatatggggtattggatcgaaagtgagaaaaacgaaacctggaagctagcccgtgcatctttcattgaggtgaagacttgtacatggccaaaaagccacaccctgtggtccaatggagttctcgaatcagagatgatcatacccaagatctacggcggtcctattagccagcataactatcggccaggctacttcactcagacagcggggccgtggcacctgggaaaacttgagttggactttgatctgtgcgaaggcaccacggtggtagtcgacgagcactgcgggaatcgaggaccctctttaagaactaccacagtgaccggcaagatcattcatgaatggtgttgcaggtcctgtactctccctccactgcgcttccggggtgaggatgggtgctggtacggaatggagatcagacccgtgaaagaaaaggaggaaaaccttgtcaggagtatggttagcgccggctctggtgaggtggactccttttcactgggcatattgtgtgtaagtattatgatcgaagaggtgatgcgcagccgatggtcgcggaagatgctcatgacagggaccctggctgtcttcctactgctcgtgatgggacaactgacatggaatgaccttatccgtttgtgcattatggttggcgccaacgcatccgatagaatggggatgggaactacctatctggctttaatggccacgtttaaaatgaggcctatgttcgcagtgggcctcctgtttcgccggcttacatctagagaggtcctgctactcaccatcggtctgagcttggtggcctcagttgaactgccaaacagtttagaggaactcggggacggactggctatgggcattatgatgcttaagctgttgactgagttccagccccaccagctctggaccacactgctatccctgacttttataaaaaccacgctttctctcgattacgcgtggaagacaaccgccatggcactgagcatcgtgtccttgttcccgctgtgtttatcaactacaagccagaaaaccacttggctccctgtcctgcttggcagttttgggtgcaagccactgacaatgttcttgattaccgaaaataagatctggggaaggaaatcttggcccctcaacgagggtattatggctatcggcatagtatccatcctgctaagctcgctgcttaagaatgacgtgcctctcgccgggcccctgattgccggaggcatgttgatcgcttgttatgttatttcaggttctagtgcagatttatccctggagaaagccgcggaagtgagctgggagcaagaagctgagcattctgggacgagccacaacatcctcgtcgaagtgcaggacgatggaactatgaagataaaagacgaggagcgagatgacaccctgacaattcttctgaaggccaccttgctagcagtatccggcgtgtacccaatgtcaatccctgccacactgtttgtctggtatttctggcagaaaaagaagcagcgcagtggcgttctctgggatactcccagcccaccggaagtggagcgggctgtgctggacgatgggatctacaggattcttcaacgaggattactgggtcgttctcaggtcggcgtgggggttttccaggacggagtatttcataccatgtggcacgtgacgcgcggcgcagtcctcatgtatcagggtaaacggttggaaccttcctgggcctcagtgaagaaagacctgataagttacgggggaggctggagattccaaggcagctggaatacaggggaggaggttcaggtgatcgcggtcgaacccggaaagaaccccaagaatgtgcagactacccccggtacatttaagacccctgagggcgaagtaggggctattgccctcgatttcaagccaggaacttccggctctcccatcgtcaacagggagggtaaaattgtggggctgtacggaaatggcgttgtgaccacaggcgggacgtatgtctcggcaatcgcccaagctaaggccagccaggaaggacctcttccggagatagaggacgaagtgtttaaaaagcgaaacctgactatcatggatttgcacccaggttcaggcaaaacccggcgctacctacccgcaattgttagagaggctatcaagaggaagctgcggacactcattttagcccctacccgagtggtcgcgtccgaaatggccgaggcactgaaagggatgccaatcagatatcagactacagctgtgaagagtgaacataccggacgcgagatagtagaccttatgtgccacgccacgttcactatgaggctgctctctcccgtgcgtgttcctaattacaacatgattatcatggatgaggctcattttacagacccggcaagcatcgccgcccggggctatatttccaccagagtcggtatgggggaagctgcggcaatcttcatgaccgccactcccccaggatcagtggaggcttttcctcagtctaatgccgtgatacaagatgaagagagggacattcccgaacgcagctggaacagtggctacgattggatcacagacttcccaggcaaaaccgtctggtttgtaccttccattaagagcgggaatgatatcgcaaactgtttgagaaagaacggaaaaagagtgatacagctgtctcggaagacattcgacactgagtatcagaaaacgaagaataacgactgggattacgttgtgaccacagacatttcagagatgggtgccaatttcagggctgatcgcgtcatcgacccccgtagatgcctcaaaccagtgatcctgaaggatggcccggaacgggttattcttgcggggcctatgcccgtgactgtcgcctccgcagctcagaggcgcggacgaatcggcagaaaccaaaataaagagggtgaccagtacgtgtatatggggcagccactaaacaatgatgaagaccacgcccattggaccgaggcaaagatgctgttggataacattaatacacccgagggcataatccctgccttatttgaaccagagcgggaaaagagtgctgccattgacggagagtacaggctgcgcggcgaagcgagaaaaaccttcgtagagctcatgaggagaggggatctgcccgtgtggcttagctataaggttgcatcggagggatttcagtactctgaccgtcgctggtgcttcgatggtgaacgaaacaatcaagtcctggaggaaaacatggacgtggagatctggactaaagaaggcgagagaaagaaactcaggcctcggtggttggacgcccgcacgtattccgatccgctggctctaagagagtttaaggagttcgccgctgggaggcggagcgtgtcaggagacctgatcctcgagattggcaaacttccacagcacctgaccttacgagcacagaatgccttggataacctggtcatgctccacaatagtgaacagggtgggaaggcttacagacatgccatggaggaactgcccgacacaatagagactcttatgctgctcgcattgatcgcggttctgaccggcggagtgacattatttttcctatctggcaaggggctgggaaaaacctccattggtctcctttgtgtaactgccagctcagctctgttgtggatggccagtgtggagcctcactggatcgcagctagcattatcctggaatttttcctcatggtcctgcttatacccgagccagatcgccaaaggacacctcaggacaaccagctcgcctatgtggttatcggcctgttgtttatgattctgacggtggcagccaacgaaatggggttactagagaccactaagaaagatctgggaatcggccatgtcgctgcggagaatcaccaacacgccacaatgctcgacgtagatcttcggcccgcatccgcttggaccctgtacgccgtggccaccacagttattactccaatgatgcgtcatacgatcgaaaacaccacagcaaatatatctttgactgctattgccaaccaggcggctatcctgatgggtctcgacaaggggtggcctattagcaaaatggatatcggcgtgccgctgcttgccttaggatgctactcccaggtcaatcccctgaccctcacagcagccgtgttgatgctggtcgctcactatgcaataatcggcccagggctacaggccaaggcgaccagagaggctcaaaagaggactgccgcaggaattatgaaaaaccctacggtggacggcatcgttgccattgatctggaccccgtggtatacgacgctaagttcgaaaaacagctcggtcagatcatgcttctgatattgtgtacatcacagattctgctcatgcgcaccacttgggccctgtgcgagtctatcaccttagcaacagggccacttactaccctgtgggaaggaagtcctggcaagttttggaatacaacgatcgctgtgtcgatggccaacattttccggggtagctatctcgcgggcgccgggctagcattctccctgatgaaatctttgggaggcgggcgaagaggaaccggcgctcaaggtgagactctgggggagaagtggaagaggcagctcaatcagctttcaaaaagcgaatttaacacatacaagcgctccggaatcatggaggtcgatcggagtgaagccaaagagggcctgaagagaggtgaaaccactaaacatgcagtttctcgtggcacagctaagttgaggtggttcgtggagcggaatctggtcaagcccgaggggaaagtgatagacctcggatgtggccgcgggggatggagctattactgcgccggcttaaagaaagtaaccgaagtgaagggttatacgaaagggggaccgggccacgaggaaccaattcctatggccacctacggctggaacctggttaaacttcattcagggaaagatgtgtttttcatgcccccagagaagtgtgacacactgctatgcgatatcggagaatccagtcccaatcctactattgaggagggtcgaaccctcagagtcctgaagatggtggaaccgtggttgaggggcaaccagttttgtatcaaaatactgaatccctacatgccaagcgtcgtggaggcgctcgaacaaatgcagcggaagcacgggggaatgcttgttcgcaaccctctgtctagaaattccacacacgagatgtattgggtatcatgcggcactggtaacatcgtgagcgctgtcaacatgacctcgaggatgttactgaatcgattcacaatggcacatcggaaacccacctacgagcgtgacgtggatttgggggccggaactagacacgttgctgtggaacctgaggtcgccaacctcgacattatcggccagcgcattgaaaatatcaagaacgagcataaatctacgtggcactatgatgaagacaatccatacaagacatgggcatatcacggcagttacgaggtgaagccctccgggagcgcctcatccatggtaaacggagtggttaggctgctaaccaaaccttgggatgtcattccaatggtgactcaaatcgctatgaccgacacaacgccctttggtcagcagcgggtgttcaaggagaaagtcgacaccagaactccgaaggcgaaacgcggcacaacccagataatggaagttactgccaagtggctttgggggtttctgtctaggaataagaaacctcgaatttgtacacgggaggagttcaccagaaaggtgaggagcaacgcagctatcggagccgtatttgtggatgagaatcaatggaacagtgcaaaagaagccgtcgaggacgagcgcttctgggatctcgtgcatcgtgaacgggagctgcacaagcagggcaaatgcgctacatgcgtttataatatgatgggtaagagagaaaagaaattgggggagtttggaaaggccaaaggctccagggcgatctggtacatgtggctgggcgcacgcttcctcgagttcgaggcccttgggtttatgaacgaggaccattggttcagccgagaaaattctctgtcaggagtggagggtgaaggcttacacaagctggggtacattttgcgggatataagtaaaatcccaggaggcaacatgtatgctgacgatactgccggttgggacaccagaattacggaggatgacctccagaatgaggcaaagatcaccgaaattatggagcccgaacatgctctgctagccacatccatctttaaacttacttaccagaacaaggtcgtgagggtacaacgccctgctaagaacgggaccgttatggatgtgataagcagacgggaccagaggggatctggccaggtcggcacatatgggctgaatactttcaccaacatggaggtgcagctcatccgtcaaatggaatcggagggaatttttctgccatcagagttggaaacgcccaatttagccgagcgagtgctggattggctcgaaaaacacggtgcagagcgccttaagagaatggcgatcagcggcgacgactgtgtcgttaaaccgattgatgaccggttcgccacagctctgaccgccctaaacgatatggggaaggtgaggaaagacatccctcagtgggaaccctccaagggatggaatgattggcagcaggtaccattttgcagtcaccatttccaccaactgataatgaaggacggccgcgagattgtggtcccttgtagaaaccaggatgagctcgtgggtcgggcaagggtttctcagggggctggatggagcttgcgagaaactgcctgcctgggcaaatcctacgcacaaatgtggcagcttatgtattttcatcgtagagacctgcgcctcgccgcgaatgctatctgttcagccgtgcccgtcgattgggtgccaacaagtcggaccacttggtctatccacgcacaccatcagtggatgaccacagaggacatgttaagcgtatggaacagggtttggattgaagagaatccctggatggaagataagacgcacgtgtcctcatgggaggaggtcccttacctgggcaaaagagaagaccagtggtgcgggagcttgataggactgaccgcccgcgctacttgggccacaaacatccaagtggcaattaatcaggttcggaggctcatcggtaacgagaattatcttgactacatgacctctatgaagcgattcaaaaacgaatccgatccagagggcgctctgtggtga

SEQ ID NO: 13386 - RNA, 9879 nt, synthetic construct
  misc_feature 1..9879: note = derived and/or modified CDS sequence (opt3) from DENV-1__KJ189341__SS-prME
  source 1..9879: mol_type = other RNA
agcgtgacaatgctgctcatgcttctgcccacagccttggctttccacttaactacgagaggaggggaacctcatatgatcgtctccaagcaggaaaggggaaaatctctgttatttaagacctcagctggtgttaatatgtgcacactcattgccatggacctgggcgaactttgtgaagatactatgacctacaaatgcccacaaataacagaggcggaaccggacgatgtggactgttggtgcaatgctaccgatacttgggtaacatatgggacctgtagtcagacgggaggccaccggcgcgagaagcgaagcgtggccctggcaccccatgtcggtttggggctcgagactcgtaccgaaacatggatgtcctctgagggagcctggaaacagatccagagagtggaaacttgggctctgaggcaccctggcttcaccgttattgcactgtttctcgcccatgctatcggcacatcgattacccaaaaggggatcatattcatcttactgatgcttgtgacgccatcaatggccatgcggtgcgtcggaattggtaatcgcgactttgtggagggcttgagcggggcgacttgggtagatgttgtgctggagcacggaagttgtgtcacaaccatggcaaagaataaacccactctagacatcgaactcctgaagacagaggtgaccaaccctgccgtgcttagaaaactgtgcattgaagctaagatctccaatacgaccacagattctaggtgtccaactcagggcgaggccaccttggtcgaagaacaggacgcaaacttcgtttgccggcgcacatttgtggatcgaggttgggggaatggatgtggcctcttcggcaaagggagcctgttaacttgcgctaagtttaagtgcgtaaccaaactggagggaaagatagtgcagtacgaaaacctcaaatattccgtcattgtgacagttcacaccggtgaccaacatcaggtgggcaatgagactacggaacacgggacaatcgccaccattactccccaggcgcctacctcagagatccagcttacagattacggagccctgaccttggactgtagtccaagaactggcctagacttcaacgaaatggtcctgctcacaatgaaggagaaaagctggctggtgcataagcaatggtttcttgatctgccgttgccctggacgtctggtgcatccacctcacaggagacttggaataggcaggacctcctggtaacattcaaaaccgctcacgccaagaagcaagaagttgtggtcttagggagccaggagggcgctatgcacacagccctgactggagcaaccgaaatccagacgagtggcaccacaactatttttgccgggcatctaaaatgccggctcaagatggataaactgacccttaagggaacatcttatgtgatgtgtactggtcctttcaaattggagaaggaagtcgctgagacccagcacggcacggtgctggttcaagtgaagtacgaggggacagacgcgccatgcaaaatacccttctccacccaggatgaaaagggagtaactcagaacggccgtctcatcacagcaaatcctattgtcaccgacaaagagaagccagtgaacatcgaaactgagcccccgtttggtgagagctatatagttgtgggggccggcgaaaaagctctgaaactttcgtggttcaagaaaggatcttccattggcaagatgtttgaggccaccgcacgcggggccagaaggatggctatcctgggagatacagcctgggacttcggttcaatcggcggggtctttacgagtgtgggaaaattggtacatcaggtgttcggcaccgcatacggtgttctctttagcggggtctcctggactatgaagattggcatcggcattctgttaacatggctgggcctaaattctcggagcacctcactcagtatgacatgtatagtggtggggatcgtcactctgtaccttggagttatggtgcaagcggattccggctgcgtgattaactggaaaggtcgagaattgaagtgtgggagcggaatcttcgtaaccaacgaggtccacacgtggacagaacagtataagtttcaggctgactctcctaaacgcctgtcagccgcaatcggcaaggcctgggaggagggtgtgtgcggcattagaagtgctaccaggctcgaaaatataatgtggaaacagatcagcaacgagctgaatcatattttactggaaaacgatatgaagttcactgttgtggtcggggacgccaatggaatccttgcacaaggcaaaaagatgattcggccccagccaatggagcacaaatactcctggaagtcttgggggaaggctaaaatcataggagccgacacccagaacacaacttttatcattgatggccctgacacccccgaatgtccagataatcagcgcgcgtggaacatctgggaggtggaggactatggtttcgggatttttacaacgaatatctggttgaagctcagagattcgtacacccaaatgtgcgaccacaggctgatgagcgccgctataaaagattccaaggcagttcatgccgacatgggatattggattgaatcagagaaaaacgaaacttggaagctagctcgtgccagtttcatcgaggtgaagacatgtacctggcccaaatctcacactctgtggagcaatggcgtactcgaatccgagatgattatccctaagatatacggtggcccaatctcacagcataactatcggccggggtacttcacacagaccgcaggaccctggcacctgggcaaacttgagttggattttgacctgtgcgaagggacgactgtcgtggtggatgagcactgcggaaatcgaggccctagcttaagaaccacaaccgtcactggtaagattatccatgaatggtgttgcaggtcttgtacactcccacccctgcgcttcagaggggaagacggatgctggtacggcatggagattagacctgttaaagaaaaggaggaaaaccttgtgaggtccatggtaagtgcgggtagcggcgaggtggattctttttccctggggatcttgtgtgcctcaataatgattgaagaggtcatgcgcagtcgatggagccggaagatgctcatgaccggaacactggctgtgttcctactgctcatcatgggccaactgacttggaaagaccttatccgtttgtgcattatggttggggccaatgcatcggacagaatgggaatgggcaccacgtatctggctttaatggccacatttaagatgaggccaatgttcgcagtgggtctcctgtttcgccggcttacctccagagaggtcctgctactcactatcgggctgtctttggtggccagcgttgaactgcccaactcattagaggaactcggagatggcctggctatgggcattatgatgcttaaactgttgaccgagttccagccgcaccagctctggacaactctgctaagtctgacctttataaagacgacactttccctcgactacgcgtggaaaaccactgccatggcactgtctatcgtgagcttgttccctctgtgtttatccacaacctcacagaagactacatggctcccagtcctgcttgggagctttggatgcaagcccagtaccatgttcctgattacggaaaacaaaatctggggtaggaagtcttggcctttgaatgagggcattatggctatcgggatagtatccatcctcctgagctcgctactgaaaaacgatgtgccccttgccggaccactcattgccggcggtatgctgatcgcttgttatgttatttcagggtctagtgcagacttgtccttagagaaggccgcggaagtgagctgggagcaagaagctgagcattctggaactagccacaatatcctggtcgaagtgcaggatgacggcaccatgaaaataaaggatgaggagcgagacgatacactcaccattctgcttaaagccacactgttggcagtatccggcgtgtaccctatgtcaatccccgccactctatttgtctggtatttctggcagaagaagaaacagcgcagtggggttctgtgggacaccccaagcccgcctgaagtggagcgggctgtgctcgatgacggaatctaccggattctgcaaaggggtcttttaggccgttctcaggtcggggtgggagttttccaggatggcgtatttcatacgatgtggcacgtgacacgcggtgcagtcctgatgtatcaggggaagcggctcgaaccctcctgggcctcagtgaaaaaggacttgataagttacggaggcggctggagattccaagggagctggaacactggagaggaggttcaggtgatcgcggtcgaaccaggtaaaaatcccaagaacgtgcagaccacacctggcacctttaagactccagagggggaagtaggagctattgccctggacttcaaacccggcacctccggttctcctatcgtcaatagggaggggaagattgtgggactctacggcaacggcgttgtgacaacgtcggggacttatgtcagcgcaatcgcccaagctaaagcctcacaggaaggaccgctgccagagatagaggatgaagtgtttaagaaacgaaatcttaccatcatggacctgcaccccggttccggcaagacacggcgctacttgcctgcaattgttagagaggctatcaagaggaaactacggaccctgattctcgccccaactcgagtggtcgcgagtgaaatggccgaggcattaaaggggatgcccatcagatatcagacaaccgctgtgaaatctgaacatacgggacgcgagatagtagatctgatgtgccacgccactttcacaatgaggcttctgagccctgtgcgtgttccgaactacaatatgattatcatggacgaggctcattttaccgatcccgcatccatcgccgcccggggctatatttcaaccagagtcggtatgggggaagctgcggcaatcttcatgactgccacaccacctggatctgtggaggcttttccccagagcaacgccgtgatacaagacgaagagagggatattccagaacgcagttggaactccggctacgactggatcaccgatttccctggcaagacagtctggtttgtacccagcattaaatctgggaacgacatcgcaaattgtctccgaaagaacggaaagagagtgatacagttgtcacggaaaactttcgatacggagtatcagaagaccaaaaacaatgactgggactacgttgtgacaactgatatttccgagatgggtgccaacttcagggctgaccgcgtcatcgatccacgtagatgcctgaagccggtgatcctcaaagacggccctgaacgggttattctggcggggcccatgccagtgaccgtcgccagtgcagctcagaggcgcggacgaatcggcagaaatcaaaacaaggagggtgatcagtacgtgtatatggggcagccccttaataacgacgaagatcacgcccattggacagaggcaaagatgctactggacaatattaacacccctgagggcataatcccagccttgtttgaacccgagcgggagaaaagcgctgccattgatggagagtacaggttacgcggcgaagcgagaaagactttcgtagagctgatgaggagaggggacctccctgtgtggctgtcgtataaagttgcatctgagggaatccagtactccgatcgtcgctggtgctttgacggtgaacgaaataaccaagtccttgaggaaaatatggatgtggagatctggacgaaggaaggcgagaggaagaagctgaggccgcggtggctcgacgcccgcacctatagcgacccattggctctgagagagttcaaagaatttgccgctgggaggcggtcagtgagtggagatctaattctggagataggcaagctcccccagcaccttacactgcgagcacagaacgccttagacaatttggtcatgctgcacaactctgaacagggtgggaaggcttacagacatgccatggaggaactccctgatactatcgagaccctgatgcttctggcactcattgcggttttgacaggcggagtgaccctgttctttttatccggcaaagggctaggaaagactagcatcggtctgctctgtgtaacagcctcaagtgcacttctgtggatggccagcgtggagttgcactggattgcagcttccatcatactggagttctttctcatggtcctgcttatccccgagccagaccgccaaaggacgcctcaggataatcagctcgcctatgtggttattggcctgttgttcatgatcctgaccgtggcagccaacgaaatggggttactagagactaccaaaaaggacctgggaattggccatgtcgctgcggagaaccaccaacacgccaccatgctcgatgtagaccttcggcccgcatctgcttggaccctgtacgccgtggccacaactgttatcacgccaatgatgcgtcataccatagaaaatacaactgcaaacattagcttgaccgctatcgccaatcaggcggctattctgatgggtctcgataaagggtggcctatctccaagatggacataggcgtgccgctgcttgccttaggatgctactcacaggtcaaccccctgacactcaccgcagccgtgttgatgctggtcgctcactatgcaatcattggcccagggctacaggccaaggcgactagagaggctcaaaaacggacggccgcaggaatcatgaagaatcctacagtggatggcattgttgccatcgacctggatcccgtggtatacgacgctaaatttgaaaagcagctcggtcagataatgcttctgattttgtgtacctctcagatcctgctcatgcgcactacctgggccctgtgcgagagtatcacattagcaactgggccacttaccacactgtgggaaggatcgcctggcaaattctggaacacgaccattgctgtgagcatggccaatatctttcggggttcctatctcgcgggcgccgggctagcattctctctgatgaagtcattgggaggcgggcgaagaggaactggcgctcaaggtgagacactgggggagaagtggaaaaggcagctcaaccagcttagcaagtccgagttcaatatatacaaacgcagtggaattatggaggtcgaccggtctgaagccaaggagggcctgaaaagaggtgaaaccactaagcatgcagttagccgtggcacagctaagttgaggtggtttgtggagcggaacctggtcaaacccgaggggaaggtgatcgatctcggatgtggccgcgggggatggtcatattactgcgccggcctaaagaaggtaaccgaagtgaaaggttatacgaaagggggaccgggccacgaggaaccaattcctatggccacctacggctggaatctggttaaacttcattccgggaaggacgtgttctttatgcccccagagaagtgtgatacactgctatgcgacatcggagaaagtagccccaaccctactatagaggagggtcgaaccctcagagtcctgaaaatggtggaaccgtggttgaggggcaatcagttctgtatcaagattctgaacccctacatgccatctgtcgtggagacactcgaacaaatgcagcggaaacacgggggaatgcttgttcgcaatcctctgtccagaaactcaactcacgagatgtattgggtaagctgcggcaccggtaatatcgtgtcggcggtcaacatgacatctaggatgttactgaaccgatttaccatggctcatcggaagcccacttacgagcgtgatgtggacttgggggcaggaacgagacacgttgccgtggaacctgaggtcgctaatctcgatattatcggccagcgcattgaaaacatcaaaaatgagcataagagtacatggcactatgacgaagataacccatacaagacctgggcctatcacggctcctacgaggtgaaacccagcgggtcagcatcctctatggtaaatggagtggttaggctgctaactaagccttgggacgtcataccaatggtgacccaaattgccatgacagatacgacccccttcggtcagcagcgggtgtttaaagagaaggtcgacactagaacaccgcgcgctaaaaggggcaccactcagatcatggaagttacagcgaagtggctttgggggttcctgagccgaaacaagaaacctcggatctgtaccagagaggaatttacaaggaaggtgcgcagtaatgccgcaattggagctgtattcgtggacgagaaccaatggaactccgccaaagaagcagtcgaggatgagcgtttttgggacctcgtgcatcgggaaagagagctgcacaagcagggcaaatgcgccacttgcgtttataacatgatgggtaagagggaaaagaaattgggggagttcggaaaggctaaaggcagccgcgccatatggtacatgtggctgggcgcgcgatttctcgagttcgaggcacttgggttcatgaatgaggatcattggttttctcgggaaaactcactgagtggagtggagggtgaaggcttacacaagctggggtacatcttgagagacatttccaaaatcccaggaggcaatatgtatgccgatgacaccgctggttgggatacgaggattaccgaggacgatctccagaacgaggccaagatcacagacataatggaacccgagcatgcactgctagctactagcatcttcaaacttacctaccagaataaggtcgtgcgcgtacaaagacctgccaagaacgggacagttatggatgtgatttctcggagggaccagcgtggatcgggccaggtcggcacttatgggctgaacacctttacgaatatggaagtgcagctcatccgacaaatggagtcagaaggaattttcctgccaagcgagttggagacacccaacttagctgaacgcgtgctggattggctcgagaaacacggtgccgaaagacttaagcggatggcaatctccggcgacgactgtgtcgttaaaccgatagatgacaggtttgcgaccgccctgactgctctaaatgatatggggaaggtgcgcaaagacattcctcagtgggagcccagtaagggatggaacgattggcagcaggtaccattctgctctcaccattttcaccaactgatcatgaaggacggcagagaaatcgtggtcccttgtcggaatcaggatgagctcgtgggtagggcccgagttagccagggggcaggatggtccttgcgtgagacagcttgcctgggcaaatcatacgcccaaatgtggcagcttatgtatttccatagacgcgacctgcggctcgcagccaacgcgatttgtagtgctgtgcccgtcgattgggtgccaacctctaggactacctggagcatacacgcccaccatcagtggatgacaacggaagacatgttatccgtatggaatagagtttggatcgaggaaaacccctggatggaggataagacccacgtgtcaagctgggaagaggtcccttacctgggcaaacgcgaggaccagtggtgcgggtctttgattggactgactgcacgggccacatgggctaccaatatccaagtggccattaaccaggttaggcgactcatcggtaatgaaaactatcttgactacatgacttccatgaagagatttaaaaatgagagtgatccagaaggcgcactgtggtga

SEQ ID NO: 13387 - RNA, 9879 nt, synthetic construct
  misc_feature 1..9879: note = derived and/or modified CDS sequence (opt3) from DENV-1__KJ189343__SS-prME
  source 1..9879: mol_type = other RNA
agcgtgaccatgctgctcatgcttctgcccacagcattggctttccacttaactacgagaggaggggagcctcatatgatagtctccaagcaggaaaggggaaaatctctgttgtttaagacctcagccggtgttaacatgtgcacactcattgccatggacctgggcgagctttgtgaagatactatgacctacaaatgcccacaaataacagaggcggaaccggacgatgtggactgttggtgcaatgctaccgatacttgggtaacatatgggacctgtagtcagacgggagagcaccggcgcgacaagcgaagcgtggccctggcaccccatgtcggcttgggtctcgagactcgtaccgaaacatggatgtcctctgagggggcctggaaacagatccagagagtggaaacttgggctctgaggcaccctggattcaccgttacagcactgtttctcgcccatgctattggcacctcgatcacgcaaaagggcattatcttcatattactgatgcttgtgactccatcaatggccatgcggtgcgtcgggatcggaaaccgcgattttgtggagggtttgagcggcgcgacatgggtagacgttgtgctggagcacgggagttgtgtcaccactatggcaaagaataaacccacactagatattgaactcctgaagaccgaggtgacgaaccctgccatccttagaaaactgtgcattgaagctaagatctccaataccacaactgactctaggtgtccaacccagggagaggccacattggtggaagaacaggatgcaaacttcgtctgccggcgcacttttgttgaccgaggctggggtaatgggtgtggactcttcggcaaaggcagcctgttaacctgcgctaagtttaagtgcgtgacaaaactggaggggaagatagtacagtacgaaaacctcaaatattccgtgattgtcaccgtgcacactggagatcaacatcaggttggtaatgagacgacagaacacggcaccatcgccactattaccccacaggcgcctacatcagagatccagcttaccgactacggggccctgactttggactgtagtccaagaacaggactagatttcaacgaaatggtgctgctcacgatgaaggagaaaagctggctggtccataagcaatggtttcttgacctgccgttgccctggacctctggcgcatccacttcacaggagacatggaataggcaggatctcctggtgaccttcaaaacagctcacgccaagaagcaagaagtagttgtgttaggtagccaggagggggctatgcacactgccctgaccggcgcaacggaaatccagaccagtggaacaactaccatttttgccggccatctaaaatgccggctcaagatggacaaactgacacttaaggggacttcttatgtcatgtgtaccggatccttcaaattggagaaggaagtggctgagacgcagcacggtacagtcctggtgcaagttaagtacgagggcaccgatgcgccttgcaaaataccattcagcactcaggacgaaaagggggtgacacagaacggacgtctcatcaccgcaaatcccattgtaactgataaagagaagcctgtcaacatcgaaaccgagccaccctttggcgagtcgtatatagtggttggtgccggggaaaaagctctgaaactttcttggttcaagaaaggctcctcaattggaaagatgtttgaggccacagcacgcggcgccagaaggatggctatcctgggggacacggcctgggatttcggaagtatcggtggcgtgtttaccagcgtcgggaaattggtgcatcaggtattcggaactgcatacggcgtgctcttttccggtgtttcttggacaatgaagattgggatcggcattctgttaacctggctgggactaaatagccggtcaacaagtctctccatgacttgtatagcggtcggcatggtgaccctgtaccttggggtgatggtccaagctgacagcggatgcgttgtgaactggaaaggccgagaattgaagtgtggttctgggatcttcgtgacgaacgaggtacacacatggaccgaacagtataagtttcaggccgattcaccgaaacgcctgagtgcagccattggaaaggcttgggaggagggcgtctgcggtatcagaagcgccactaggctcgaaaatatcatgtggaaacagatttccaacgagctgaatcatatattactggaaaacgacatgaagttcaccgtggttgtgggcgacgcaaatgggatccttgctcaaggcaagaagatgattcggcctcagcccatggagcacaaatactcttggaagtcgtggggcaaggccaaaatcattggggcggatatccagaacacaacttttataatcgacggaccagatacccctgaatgtcccgacaatcagcgcgcctggaacatttgggaggtcgaggattatggcttcggtatctttacaacgaatatttggttgaagctcagagacagctacacccaaatgtgcgatcacaggctgatgtccgctgcaatcaaagactcaaaggccgtgcatgctgatatggggtattggatagaaagtgagaaaaacgaaacttggaagctagcccgtgcatctttcattgaggttaagacatgtacctggccaaaaagccacactctgtggtccaatggagtgctcgaatcagagatgatcattcccaagatctacggcggtcctataagccagcataactatcggccaggctacttcacacagaccgcggggccgtggcacctgggaaaacttgagttggactttgatctgtgcgaaggcacgactgtagtcgtggacgagcactgcgggaatcgaggaccctctttaagaaccacaaccgtgactggcaagatcattcatgaatggtgttgcaggtcctgtacactccctccactgcgcttccggggtgaggatgggtgctggtacggaatggagatcagacccgtcaaagaaaaggaggaaaaccttgttaggagtatggtgagcgccggctctggtgaggtagactccttttcactgggcattttgtgtgctagtatcatgatagaagaggtgatgcgcagccgatggtcgcggaagatgctcatgattgggaccctggccgtcttcctactgctcatcatgggacaactgacatggaatgaccttatccgtttgtgcattatggtgggcgcaaacgcttccgatagaatggggatgggaactacctatctggccttaatggcaacgtttaaaatgaggcctatgttcgccgttggcctcctgtttcgccggcttacatctagagaggtgctgctactcaccatcggtctgagcttggtcgcttcagtggaactgccaaacagtttagaggaactcggggacggactggcgatgggcattatgatgcttaagctgttgactgagttccagccccaccagctctggaccacactgctatccctgacttttataaaaaccacgctttctctcgattacgcctggaagacaaccgcaatggctctgagcatcgtttccttgttcccgctgtgtttatcaactacaagccagaaaaccacttggctccctgtgctgcttggcagttttgggtgcaagccactgacaatgttcttgattaccgaaaataagatctggggaaggaaatcttggcccctcaacgagggtattatggccatcggcatagtctccatcctgctaagctcgctgcttaagaatgacgtacctctcgccgggcccctgattgctggaggcatgttgatcgcatgttatgtgatttcaggttctagtgccgatttatccctggagaaaacggcggaagttagctgggagcaagaagctgagcattctgggactagccacaacatcctcgtggaagtccaggacgatggaaccatgaagataaaagacgaggagcgagatgacacactgaccattcttctgaaggccacattgctagcagtgtccggcgtatacccaatgtcaatccctgccactctgtttgtgtggtatttctggcagaaaaagaagcagcgcagtggcgtcctctgggatacccccagcccaccggaagttgagcgggctgtgctggacgatgggatctacaggattcttcaacgaggattactgggtcgttctcaggtgggcgtcggggtgttccaggacggagtttttcatacgatgtggcacgtaacacgcggcgcagtgctcatgtatcagggtaaacggttggaaccttcctgggcctcagtcaagaaagacctgataagttacgggggaggctggagattccaaggcagctggaatactggggaggaggtgcaggttatcgcggtggaacccggaaagaaccccaagaatgtccagaccacacccggtacctttaagactcctgagggcgaagtgggggctattgccctcgatttcaagccaggaacctccggctctcccatcgtaaacagggagggtaaaattgtcgggctgtacggaaatggcgtggttacaacgtcgggcacttatgtgagcgcaatcgcccaagctaaggcctcacaggaagggcctcttccggagatagaggacgaagtctttaaaaagcgaaacctgaccatcatggatttgcacccaggatccggtaaaacacggcgctacctacccgcaattgtgagagaggctatcaagaggaagctgcggaccctcattttagcccctactcgagttgtggcgagtgaaatggccgaggcactgaaaggcatgccaatcagatatcagacaaccgctgtcaagtctgaacatacggggcgcgagatagtggaccttatgtgccacgccactttcacaatgaggctgctcagccccgtacgtgtgcctaattacaacatgattatcatggatgaggctcattttaccgacccggcatccatcgccgcccggggatatatttcaaccagagttggcatgggtgaagctgcggcaatcttcatgactgccacacccccagggtctgtcgaggcttttcctcagagcaatgccgtgatacaagatgaagagagggacattcccgaacgcagttggaactccggatacgattggatcaccgacttcccaggcaaaacagtgtggtttgtccctagcattaagtctggcaatgatatcgcaaactgtttgagaaagaacgggaagagagtaatacagctgtcacggaagactttcgacacggagtatcagaaaaccaagaataacgactgggattacgtggttacaactgacatttccgagatgggagccaatttcagggctgatcgcgtgatcgacccccgtagatgcctcaaaccagtcatcctgaaggatggtccggaacgggtgattcttgcgggccctatgcccgttaccgtggccagtgcagctcagaggcgcgggcgaatcggaagaaaccaaaataaagagggcgaccagtacgtctatatgggtcagccactaaacaatgatgaagaccacgcccattggacagaggcaaagatgctgttggataacattaatacccccgaggggataatccctgccttatttgaaccagagcgggaaaagagcgctgccattgacggcgagtacaggctgcgcggagaagcgagaaaaactttcgtggagctcatgaggcggggcgatctgcccgtatggctttcgtataaggtggcatctgaggggtttcagtactccgaccgtcgctggtgcttcgatggagaacgaaacaatcaagttctggaggaaaacatggacgtcgagatctggacgaaagaaggtgagagaaagaaactcaggcctcggtggttggacgcccgcacctatagcgatccgctggctctaagagagtttaaggagttcgccgctggcaggcggtcagtgagtggggacctgatcctcgagattggaaaacttccacagcacctgacattacgagcacagaatgccttggataacctggctatgctccacaattctgaacagggcggtaaggcctacagacatgcaatggaggaactgcccgacactatagagacccttatgctgctcgcgttgatcgccgtgctgacagggggcgtcaccttatttttcctatccggaaagggcctggggaaaactagcattggactcctttgtgttacagcttcaagtgccctgttgtggatggcaagcgtggagcctcactggatcgctgcctccattatcctggaatttttcctcatggtactgcttatacccgagccagatcgccaaaggacgcctcaggacaaccagctcgcatatgtggtcatcggtctgttgtttatgattctgaccgtggccgctaacgaaatgggcttactagagactacaaagaaagatctggggatcggacatgttgcggccgagaatcaccaacacgcaaccatgctcgacgtggatcttcggcccgcttctgcctggaccctgtacgccgtcgcaacaactgtaattacgccaatgatgcgtcataccatcgaaaacacaactgctaatatcagcttgaccgccattgcgaaccaggctgccatcctgatgggcctcgacaagggttggcctatttccaaaatggatatcggggtgccgctgcttgcattaggctgctactcacaggttaatcccctgacactcaccgccgctgtgttgatgctggtcgcacactatgccataatcggaccaggcctacaggcgaaggctactagagaggcccaaaagaggacggcagccgggattatgaaaaaccctacagtggacggaatcgtcgctattgatctggaccccgtggtttacgacgccaagttcgaaaaacagctcggccagatcatgcttctgatattgtgtacctctcagattctgctcatgcgcactacctgggcactgtgcgagagtatcacattagctactggtccacttaccacactgtgggaagggtcgcctggaaagttttggaatacgaccatcgccgtgagcatggcgaacattttccggggctcctatctcgccggtgcaggcctagctttctctctgatgaaatcactagggggaggccgaagagggactggagcccaaggcgagacactgggtgagaagtggaagaggcagctcaatcagcttagcaaatccgaatttaacacctacaagcgcagtgggatcatggaggtagatcggtctgaagcaaaagagggactgaagagaggcgaaactacaaaacatgctgtgagccgtggtaccgccaagttgaggtggttcgtcgagcggaatctggttaagcccgagggcaaagtgatagacctcgggtgtggacgcggcgggtggtcatattactgcgccggattaaagaaagtcacggaagtgaagggctataccaaaggtgggccgggacacgaggaaccaattcctatggcgacatacggctggaacctggtaaaacttcattccggcaaagatgtgtttttcatgcccccagagaagtgtgacactctgctatgcgatatcggggaaagtagccccaatcctaccattgaggagggacgaacactcagagttctgaagatggtggaaccgtggttgaggggtaaccagttttgtatcaaaatactgaatccctacatgccatctgtcgtggagactctcgaacaaatgcagcggaagcacggcgggatgcttgtccgcaaccctctgtccagaaattcaacccacgagatgtattgggtgagctgcggaacaggcaacatcgtttcggctgtaaacatgacctctaggatgttactgaatcgattcactatggcacatcggaaacccacgtttgagcgtgacgtggatttgggtgccgggacaagacacgtcgctgtggaacctgaggttgccaacctcgacattatcggacagcgcattgaaaatatcaagaacgagcataaaagtacctggcactacgatgaagacaatccatataagacttgggcataccacggctcctatgaggtgaagcccagcggctcagcctcctctatggtcaacggggtggtaaggctgctaaccaaaccttgggatgtgattccaatggttacacaaatcgctatgacggacaccactcccttcggacagcagcgggtctttaaggagaaagtggacacaagaaccccgcgcgcgaagaggggtactacacagataatggaagtgaccgccaaatggctttggggcttcctgagccgaaataagaagcctcggatttgtacaagagaggaatttactaggaaagtccgcagtaacgcagctatcggggccgttttcgtggatgagaatcaatggaactccgcaaaggaagccgtagaggacgagcgtttttgggatctcgtgcatcgggaaagagagctgcacaaacagggaaagtgcgctacctgcgtctacaatatgatgggcaaaagggaaaagaagttgggtgagttcgggaaagccaagggaagccgcgcgatctggtatatgtggctgggcgcacgattcctcgaatttgaggcccttggcttcatgaacgaggaccattggttttctcgggaaaattcactgagtggggtggagggagaaggtttacacaaactgggctacattttgagagatatatccaagatcccagggggaaacatgtacgctgacgatacggccggctgggacaccaggattacagaggatgacctccagaatgaggcaaaaatcactgatattatggaacccgagcatgctctgctagccaccagcatcttcaaacttacatatcagaacaaagttgtgcgcgtccaaagacctgctaagaacggtactgtgatggacgtaatatctcggagggatcagcgtgggtcgggacaggttggcacctacggcctgaatacgtttacaaacatggaagtgcagctcatccgacaaatggagtcagaagggattttcctgccaagcgagttggagacccccaatttagccgaacgcgtcctggactggctcgagaagcacggagcagaaagacttaaacggatggcgatctccggtgacgattgtgtggtgaagccgattgacgataggtttgccactgctctgacagccctaaacgacatgggcaaagtccgcaaggatatccctcagtgggagcccagtaaagggtggaatgactggcagcaggttccattctgctctcaccattttcaccaactgataatgaaggatggaagagaaattgtggtaccttgtcggaaccaggacgagctcgtgggcagggcacgagtcagccagggtgctgggtggtccttgcgtgagaccgcctgcctgggaaagtcatatgcacaaatgtggcagcttatgtacttccatagacgcgatctgcggctcgccgcgaatgctatctgtagtgccgtgcccgttgactgggtgccaacttctaggaccacatggagcatccacgcacaccatcagtggatgacgaccgaagatatgttatccgtctggaacagagtgtggattgaggaaaatccctggatggaggacaaaactcacgtatcaagctgggaagaggttccttatctgggcaagcgcgaggaccagtggtgcggctctttgatagggctgacagcccgggctacctgggccactaacatccaagtggcaattaatcaggtcaggcgactcatcggaaacgaaaattaccttgattatatgacatccatgaaaagatttaagaacgagagtgacccagaaggtgctctgtggtga

SEQ ID NO: 13388 - RNA, 9879 nt, synthetic construct
  misc_feature 1..9879: note = derived and/or modified CDS sequence (opt3) from DENV-1__KJ189344__SS-prME
  source 1..9879: mol_type = other RNA
agcgtgaccatgctgctcatgcttctgcccacagccttggctttccacttaactacgagaggcggggagcctcatatgatcgtctccaagcaggaaaggggaaaatctctgctatttaagacctcagcaggtgttaacatgtgcacactcattgccatggacctgggcgagctttgtgaagatactatgacctacaaatgcccacaaataacagaggcggaaccggacgatgtggactgttggtgcaatgctaccgatacttgggtaacatatgggacctgtagtcagacgggagagcaccggcgcgacaagcgaagcgtggccctggcaccccatgtcggcttgggtctcgagactcgtaccgaaacatggatgtcctctgagggggcctggaaacagatccagagagtggaaacttgggctctgaggcaccctggattcaccgttacagcactgtttctcgcccatgctattggcacctcgatcacgcaaaagggcattatcttcatattactgatgcttgtgactccatcaatggccatgcggtgcgtcgggatcggaaaccgcgattttgtggagggtttgagcggcgcgacatgggtagacgttgtgctggagcacgggagttgtgtcaccactatggcaaagaataaacccacactagatattgaactcctgaagaccgaggtgacgaaccctgccatccttagaaaactgtgcattgaagctaagatctccaataccacaactgactctaggtgtccaacccagggagaggccacattggtggaagagcaggatgcaaacttcgtctgccggcgcacttttgttgaccgaggctggggtaatgggtgtggactcttcggcaaaggcagcctgttaacctgcgctaagtttaagtgcgtgacaaaactggaggggaagatagtacagtacgaaaacctcaaatattccgtgattgtcaccgtgcacactggagatcaacatcaggttggtaatgagacgacagaacacggcaccatcgccactattaccccccaggcgcctacatcagagatccagcttaccgactacggggccctgactttggactgtagtccaagaacaggactagatttcaacgaaatggtgctgctcacgatgaaggagaaaagctggctggtccataagcaatggtttcttgacctgccgttgccctggacctctggcgcatccacttcacaggagacatggaataggcaggatctcctggtgaccttcaaaacagctcacgccaagaagcaagaagtagttgtgttaggtagccaggagggggctatgcacactgccctgaccggcgcaacggaaatccagaccagtggaacaactaccatttttgccggccatctaaaatgccggctcaagatggacaaactgacacttaaggggacttcttatgtcatgtgtaccggatccttcaaattggagaaggaagtggctgagacgcagcacggtacagtcctggtgcaagttaagtacgagggcaccgatgcgccttgcaaaataccattcagcactcaggacgaaaagggggtgacacagaacggacgtctcatcaccgcaaatcccattgtaactgataaagagaagcctgtcaacatcgaaaccgagccaccctttggcgagtcgtatatagtggttggtgccggggaaaaagctctgaagctttcttggttcaagaaaggctcctcaattggaaagatgtttgaggccacagcacgcggcgccagaaggatggctatcctgggggacacggcctgggatttcggaagtatcggtggcgtgtttaccagcgtcgggaaattggtgcatcaggtattcggaactgcatacggcgtgctcttttccggtgtttcttggacaatgaagattgggatcggcattctgttaacctggctgggactaaatagccggtcaacaagtctctccatgacttgtatagcggtcggcatggtgaccctgtaccttggggtgatggtccaagctgacagcggatgcgttgtgaactggaaaggccgagaattgaagtgtggttctgggatcttcgtgacgaacgaggtacacacatggaccgaacagtataagtttcaggccgattcaccgaaacgcctgagtgcagccattggaaaggcttgggaggagggcgtctgcggtatcagaagcgccactaggctcgaaaatatcatgtggaaacagatttccaacgagctgaatcatatattactggaaaacgacatgaagttcaccgtggttgtgggcgacgcaaatgggatccttgctcaaggaaaaaagatgattcggcctcagcccatggagcacaaatactcttggaagtcgtggggcaaggccaaaatcattggggcggatatccagaacacaacttttataatcgacggaccagatacccctgaatgtcccgacaatcagcgcgcctggaacatttgggaggtcgaggattatggcttcggtatctttacaacgaatatttggttgaagctcagagacagctacacccaaatgtgcgatcacaggctgatgtccgctgcaatcaaagactcaaaggccgtgcatgctgatatggggtattggatagaaagtgagaaaaacgaaacttggaagctagcccgtgcatctttcattgaggttaagacatgtacctggccaaaaagccacactctgtggtccaatggagtgctcgaatcagagatgatcattcccaagatctacggcggtcctataagccagcataactatcggccaggctacttcacacagaccgcggggccgtggcacctgggaaaacttgagttggactttgatctgtgcgaaggcacgactgtagtcgtggacgagcactgcgggaatcgaggaccctctttaagaaccacaaccgtgactggcaagatcattcatgaatggtgttgcaggtcctgtacactccctccactgcgcttccggggtgaggatgggtgctggtacggaatggagatcagacccgtcaaagaaaaggaggaaaaccttgttaggagtatggtgagcgccggctctggtgaggtagactccttttcactgggcattttgtgtgtgagtatcatgatagaagaggtcatgcgcagccgatggtcgcggaagatgctcatgaccgggacactggctgtgttcctactgctcgttatgggacaactgacttggaatgaccttattcgtttgtgcatcatggtgggcgccaacgcatccgatagaatggggatgggaaccacgtatctggctttaatggccacatttaaaatgaggcctatgttcgcagtcggcctcctgtttcgccggcttacctctagagaggtgctgctactcactatcggtctgagcttggttgcctcagtggaactgccaaacagtttagaggaactcggggacggactggctatgggcattatgatgcttaagctgttgaccgagttccagccccaccagctctggacaactctgctatccctgacctttatcaaaacgacactttctctcgattacgcgtggaagaccactgccatggcactgagcattgtctccttgttcccgctgtgtttatcaacaaccagccagaaaactacatggctccctgtactgcttggcagttttgggtgcaagccactgaccatgttcttgataacggaaaataagatctggggaaggaaatcttggcccctcaacgagggtattatggctatcggcattgtgtccatcctgctaagctcgctgcttaagaatgacgttcctctcgccgggcccctgatagccggaggcatgttgatcgcttgttatgtgatttcaggttctagtgcagatttatccctggagaaagccgcggaagtcagctgggagcaagaagctgagcattctgggactagccacaacatcctcgtggaagtacaggacgatggaaccatgaagattaaagacgaggagcgagatgacacactgaccatccttctgaaggccacattgctagcagtgtccggcgtctacccaatgtcaatacctgccactctgtttgtttggtatttctggcagaaaaagaagcagcgcagtggcgtgctctgggatacccccagcccaccggaagtggagcgggctgtcctggacgatgggatttacagaatccttcaaaggggattactgggtcgttctcaggtgggcgttggggtattccaggacggagtgtttcatacgatgtggcacgtcacacgcggcgcagtgctcatgtatcagggtaaacggttggaaccttcctgggcctcagttaagaaagacctgatcagttacgggggaggctggagattccaaggcagctggaatactggggaggaggtgcaggtcattgcggtggaacccggaaagaacccaaaaaatgtacagaccacacccggtacctttaagactcctgagggcgaagtcggggctatagccctcgatttcaagccaggaacctccggctctcccatcgtgaacagggagggtaaaattgttgggctgtacggaaatggcgtggtcacaacgtcgggcacttatgtgagcgcaatcgcccaagctaaggcctcacaggaagggcctcttccggagattgaggacgaagtttttaaaaagcgaaacctgaccatcatggatttgcacccaggatccggtaaaacacggcgctacctacccgcaatagtgagagaggctatcaagaggaagctgcggaccctcattttagcccctactcgagtcgtggcgagtgaaatggccgaggcactgaaaggcatgccaatcagatatcagacaaccgctgtaaagtctgaacatacggggcgcgagattgtggaccttatgtgccacgccactttcacaatgaggctgctcagccccgttcgtgtccctaattacaacatgatcataatggatgaggctcattttaccgacccggcatccattgccgcccggggatatatctcaaccagagtgggcatgggtgaagctgcggcaatcttcatgactgccacacccccagggtctgtggaggcttttcctcagagcaatgccgtcattcaagatgaagagagggacatccccgaacgcagttggaactccggatacgattggataaccgacttcccaggcaaaacagtatggtttgtgcctagcattaagtctggcaatgatatcgcaaactgtttgcgaaaaaacgggaagagagttattcagctgtcacggaagactttcgacacggagtatcagaaaaccaagaataacgactgggattacgtggtcacaactgacatctccgagatgggagccaatttcagggctgatcgcgtgatagacccccgtagatgcctcaaaccagttattctgaaggatggtccggaacgggtgatccttgcgggccctatgcccgtcaccgtggccagtgcagctcagaggcgcgggcgaatcggaagaaaccaaaataaagagggcgaccagtacgtatatatgggtcagccactaaacaatgatgaagaccacgcccattggacagaggcaaagatgctgttggataacattaatacccccgaggggatcattcctgccttatttgaaccagagcgggaaaagagcgctgccatagacggcgagtacaggctgcgcggagaagcgagaaaaactttcgtggagctcatgaggcggggcgatctgcccgtttggctttcgtataaggtcgcatctgaggggtttcagtactccgaccgtcgctggtgcttcgatggagaacgaaacaatcaagtgctggaggaaaacatggacgtggagatctggacgaaagaaggtgagagaaagaaactcaggcctcggtggttggacgcccgcacctatagcgatccgctggctctaagagagtttaaggaattcgccgctggcaggcggtcagtcagtggggacctgattctcgagatcggaaaacttccacagcacctgacattacgagcacagaatgccttggataacctggttatgctccacaattctgaacagggcggtaaggcttacagacatgccatggaggaactgcccgacactatcgagacccttatgctgctcgcattgattgcggtgctgacagggggcgtaaccttatttttcctatccggaaagggcctggggaaaactagcataggactcctttgtgtgacagcctcaagtgctctgttgtggatggccagcgtcgagcctcactggatcgcagcttccattatcctggaatttttcctcatggtgctgcttattcccgagccagatcgccaaaggacgcctcaggacaaccagctcgcctatgttgtgatcggtctgttgtttatgatactgaccgtcgcagccaacgaaatgggcttactagagactacaaagaaagatctggggatcggacatgtagctgcggagaatcaccaacacgccaccatgctcgacgtggatcttcggcccgcatctgcttggaccctgtacgccgttgccacaactgtgattacgccaatgatgcgtcataccatcgaaaacacaactgcaaatattagcttgaccgctatcgccaaccaggcggctatactgatgggcctcgacaagggttggcctatttccaaaatggatatcggggtcccgctgcttgccttaggctgctactcacaggtgaatcccctgacactcaccgcagccgtcttgatgctggtggctcactatgcaattatcggaccaggcctacaggccaaggcgactagagaggctcaaaagaggacggccgcagggataatgaaaaaccctacagttgacggaatcgtggccattgatctggaccccgtagtgtacgacgctaagttcgaaaaacagctcggccagatcatgcttctgattttgtgtacctctcagatcctgctcatgcgcactacctgggccctgtgcgagagtataacattagcaactggtccacttaccacactgtgggaagggtcgcctggaaagttttggaatacgaccattgctgtcagcatggccaacatcttccggggctcctatctcgcgggtgccggcctagcattctctctgatgaaatcattggggggaggccgaagagggactggagctcaaggcgagacactgggtgagaagtggaagaggcagctcaatcagcttagcaaatccgaatttaacacctacaagcgcagtgggatcatggaggttgatcggtctgaagccaaagagggactgaagagaggcgaaactacaaaacatgcagtgagccgtggtaccgctaagttgaggtggttcgtcgagcggaatctggtgaagcccgagggcaaagtaattgacctcgggtgtggacgcggcgggtggtcatattactgcgccggattaaagaaagtgacggaagttaagggctataccaaaggtgggccgggacacgaggaaccaatccctatggccacatacggctggaacctggtgaagcttcattccggcaaagatgtctttttcatgcccccagagaagtgtgacactctgctatgcgatataggggaaagtagccccaatcctaccattgaggagggacgaacactcagagtgctgaagatggtcgaaccgtggttgaggggtaaccagttttgtatcaaaattctgaatccctacatgccatctgtggttgaggcgctcgaacaaatgcagcggaagcacggcgggatgcttgtacgcaaccctctgtccagaaattcaactcacgagatgtattgggtgagctgcggaaccggcaacatcgtctcggctgtgaacatgacatctaggatgttactgaatcgattcaccatggcacatcggaaacccacttacgagcgtgacgttgatttgggtgccgggacgagacacgtggctgtcgaacctgaggtggccaacctcgacataatcggacagcgcattgaaaatatcaagaacgagcataaaagtacatggcactatgatgaagacaatccatacaagacctgggcatatcacggctcctacgaggtaaagcccagcggctcagcctcctctatggtgaacggggttgtcaggctgctaactaaaccttgggatgtgattccaatggtgacccaaatcgctatgacagacacgaccccctttggacagcagcgggtcttcaaggagaaagttgacactagaacaccgcgcgcgaagaggggtaccactcagattatggaagtgacagccaaatggctttggggctttctgagccgaaataagaagcctcggatctgtaccagagaggaattcacaaggaaagtacgcagtaacgcagctataggggccgtgtttgtcgatgagaatcaatggaactccgcaaaggaagccgtggaggacgagcgtttctgggatctcgttcatcgggaaagagagctgcacaaacagggaaagtgcgctacttgcgtgtataatatgatgggcaaaagggaaaagaagttgggtgagtttgggaaagccaagggaagccgcgcgatttggtacatgtggctgggcgcacgattcctcgaattcgaggcccttggctttatgaacgaggaccattggttctctcgggaaaattcactgagtggggtcgagggagaaggtttacacaaactgggctacatcttgagagatatctccaagattccagggggaaacatgtatgctgacgataccgccggctgggacacgaggataaccgaggatgacctccagaatgaggcaaaaatcacagaaattatggagcccgaacatgctctgctagccactagcatctttaagcttacctaccagaacaaagtggtacgcgttcaaagacctgctaagaacggtacagtgatggatgtcatttctcggagggaccagcgtgggtcgggacaggtgggcacttatggcctgaataccttcacgaacatggaggtgcagctcatccgacaaatggaatcagaggggatatttctgccaagcgagttggaaacacccaatttagccgagcgcgtcctggattggctcgaaaagcacggagcagagagacttaaacggatggcgatctccggtgacgactgtgttgtgaagccgattgatgacaggttcgccaccgctctgactgccctaaacgatatgggcaaagtacgcaaggacatccctcagtgggaacccagtaaagggtggaatgattggcagcaggtgccattttgctctcaccatttccaccaactgattatgaaggacggaagagagatcgtcgtgccttgtcggaaccaggatgagctcgttggcagggcacgagtgagccagggtgctgggtggtccttgcgtgaaacagcctgcctgggaaagtcatacgcacaaatgtggcagcttatgtattttcatagacgcgacctgcggctcgccgcgaatgctatatgtagtgccgtccccgtggattgggtaccaacctctaggactacctggagcattcacgcacaccatcagtggatgacaacggaggacatgttatccgtttggaacagagtgtggatcgaagagaatccctggatggaagataaaacccacgtctcaagctgggaggaggtgccttacctgggcaagcgcgaagaccagtggtgcggctctttgatcgggctgactgcccgggctacatgggccaccaacattcaagttgcaataaatcaggtgaggcgactcatcggaaacgagaattatcttgactacatgacttccatgaaaagattcaagaacgaaagtgatccagagggtgctctgtggtga

SEQ ID NO: 13389 - RNA, 9879 nt, synthetic construct
  misc_feature 1..9879: note = derived and/or modified CDS sequence (opt3) from DENV-1__KJ189346__SS-prME
  source 1..9879: mol_type = other RNA
agcgtgaccatgctgctcatgcttctgccaactgcattggctttccacttaactacgagaggaggggaacctcatatgatcgtctccaagcaggaaaggggaaaatctctgctgtttaagacctcagccggtgttaacatgtgcacactcattgccatggacctgggcgaactttgtgaagatactatgacctacaaatgcccacaaataaccgaggcggaaccggacgatgtggactgttggtgcaatgctaccgatacttgggtaacatatgggacctgtagtcagacgggagagcaccggcgcgacaagcgaagcgtggccctggcaccccatgtcggcttgggtctcgagactcgtaccgaaacatggatgtcctctgagggggcctggaaacagatccagagagtggaaacttgggctctgaggcaccctggattcaccgttattgcactgtttctcgcccatgctatcggcacatcgattacccaaaagggcatcatattcatcttactgatgcttgtgacgccatcaatggccatgcggtgcgtcgggattggaaaccgcgattttgtggagggtttgagcggcgcgacttgggtagacgttgtgctggagcacgggagttgtgtcacaaccatggcaaagaataaacccactctagatatcgaactcctgaagacagaggtgaccaaccctgccattcttagaaaactgtgcatcgaagctaagatatccaatacgaccacagactctaggtgtccaactcagggagaggccaccttggtggaagaacaggatgcaaacttcgtctgccggcgcacatttgttgaccgaggctggggtaatgggtgtggactcttcggcaaaggcagcctgttaacttgcgctaagtttaagtgcgtgaccaaactggaggggaagattgtacagtacgaaaacctcaaatattccgtgatcgtcacagtgcacaccggagatcaacatcaggttggtaatgagactacggaacacggcacaattgccaccatcactccccaggcgcctacctcagagatccagcttacagactacggggccctgaccttggactgtagtccaagaactggactagatttcaacgaaatggtgctgctcacaatgaaggagaaaagctggctggtccataagcaatggtttcttgacctgccgttgccctggacgtctggcgcatccacctcacaggagacttggaataggcaggatctcctggtgacattcaaaaccgctcacgccaagaagcaagaagtagttgtgttaggtagccaggagggggctatgcacacagccctgactggcgcaaccgaaattcagatgagtggaacgaccacaatatttgccggccatctaaaatgccggctcaagatggacaaactgactcttaaggggacctcttatgtcatgtgtacaggatccttcaaattggagaaggaagtggctgagactcagcacggtaccgtcctggtgcaagttaagtacgagggcacggatgcgccttgcaaaatcccattcagcacacaggacgaaaagggggtgacccagaacggacgtctcattactgcaaatcccatcgtaacagataaagagaagcctgtcaacatagaaaccgagccaccctttggcgagtcgtatattgtggttggtgccggggaaaaagctctgaaactttcttggttcaagaaaggctcctcaatcggaaagatgtttgaggccactgcacgcggcgccagaaggatggctatcctgggggacaccgcctgggatttcggaagtattggtggcgtgtttacaagcgtcgggaaattggtgcatcaggtattcggaacggcatacggcgtgctcttttccggtgtttcttggaccatgaagatcgggattggcatactgttaacttggctgggactaaatagccggtcaacaagtctctccatgacctgtatcgcggtcggcatggtgacactgtaccttggggtgatggtccaagctgacagcggatgcgttattaactggaaaggccgagaattgaagtgtggttctgggatcttcgtgactaacgaggtgcacacctggacggaacagtataagtttcaggccgattcaccgaaacgcctgagtgcagccatcggaaaggcttgggaggagggcgtatgcggtattagaagcgccacaaggctcgaaaatataatgtggaaacagatctccaacgagctgaatcatattttactggaaaacgacatgaagttcaccgtcgtggttggcgacgcaaatgggatccttgctcaaggcaagaagatgattcggcctcagcccatggagcacaaatactcttggaagtcgtggggcaaggccaaaatcataggggcggatatccagaacactacctttattatcgacggaccagatacacctgaatgtcccgacaatcagcgcgcctggaacatttgggaggtggaggattatggcttcggtatctttactaccaatatatggttgaagctcagagacagctacacacaaatgtgcgatcacaggctgatgtccgctgcaattaaagactcaaaggccgtccatgctgatatggggtattggatcgaaagtgagaaaaacgaaacgtggaagctagcccgtgcatctttcattgaggtgaagacctgtacttggccaaaaagccacacactgtggtccaatggagttatggaatcagagatgatcatacccaagatctacggcggtcctattagccagcataactatcggccaggctacttcacccagactgcggggccgtggcacctcggaaaactggagcttgactttgatttgtgcgaaggcacaaccgtggtagtcgacgagcactgcgggaatcgaggaccctctctgagaacgactaccgtgacaggcaagatcattcatgaatggtgttgcaggtcctgtaccttacctccactccgcttccggggtgaggatgggtgctggtacggaatggagatcagacccgtgaaagaaaaggaggaaaacctggtcaggagtatggttagcgccggctctggtgaggtggactccttttcacttggcatactgtgtgctagtattatgatcgaagaggtaatgcgcagccgatggtcgcggaagatgttgatgactgggacactcgccgtgttcctgctactggtcatgggacaactcacctggaatgacctgatccgtctttgcattatggtgggcgcaaacgcttccgatagaatggggatgggaacaacttatttggccctgatggcaacctttaaaatgaggcctatgttcgccgttggcttactctttcgccggctgacgtctagagaggtgcttctgctaacaatcggtctcagcctggtcgcttcagtggaattgccaaacagtctggaggaattaggggacggactcgcgatgggcattatgatgctgaaacttctgaccgagttccagccccaccagttgtggactaccctcctgtccctaacatttataaaaactaccctgtctcttgattacgcctggaagacgacagcaatggctctcagcatcgtttccctgttcccgttgtgtctgtcaaccactagccagaaaacaacctggttacctgtgctcctgggcagttttgggtgcaagccacttactatgttcctgattacagaaaataagatctggggaaggaaatcttggcccttgaacgagggtattatggccatcggcatagtctccatcctcctgagctcgctactgaagaatgacgtacctcttgccgggcccctcattgctggaggcatgctgatcgcatgttatgtgatttcaggttctagtgccgatttgtccttagagaaagcggctgaagttagctgggagcaagaagccgagcattctgggaccagccacaacatcctggtggaagtccaggacgatggaacgatgaagataaaagacgaggagcgagatgacactctcaccattctgcttaaggcaacactgttggccgtgtccggcgtatacccaatgtcaatccctgctaccctatttctgtggtatttctggcagaaaaagaagcagcgcagtggcgtgctctgggatacacccagcccaccggaagtcgagcgggcagttctggacgatgggatctacaggattcttcaacgaggattactgggtcgttctcaggtgggcgtgggggtcttccaggacggagtgtttcatactatgtggcacgttacccgcggcgccgtactcatgtatcagggtaaacggttggaaccttcctgggcgtcagtgaagaaagacctgataagttacgggggaggctggagattccaaggcagctggaatacgggggaggaggtccaggtgatcgctgttgaacccggaaagaaccccaagaatgtgcagacaactcccggtacctttaagacacctgagggcgaagtcggggccattgcactcgatttcaagccaggaacctccggctctcccatcgtgaacagggagggtaaaattgtagggctgtacggaaatggcgtcgtgactacctcgggcacatatgttagcgccatcgctcaagccaaggcatcacaggaagggcctcttccggagatagaggacgaagtgtttaaaaagcgaaacctgacgatcatggatttgcacccaggatccggtaaaactcggcgctacctacccgctattgtcagagaggccatcaagaggaagctgcggaccctcattttagcgcctacacgagtggttgccagtgaaatggcagaggctctgaaaggcatgccaatcagatatcagaccactgccgtgaagtctgaacatacagggcgcgagatagtcgaccttatgtgccacgctaccttcacgatgaggctgctcagccccgtgcgtgtacctaattacaacatgattatcatggatgaggcacattttactgacccggcctccatcgccgctcggggatatatttcaacaagagtgggcatgggtgaagcggcagccatcttcatgaccgctacacccccagggtctgttgaggcctttcctcagagcaatgcagtcatacaagatgaagagagggacattcccgaacgcagttggaactccggatacgattggatcactgacttcccaggcaaaacagtgtggtttgtgcctagcattaagtctggcaatgatatcgccaactgtttgagaaagaacgggaaaagagtcatacagctgtcacggaagaccttcgacacagagtatcagaaaactaagaataacgactgggattacgtagtgacgaccgacatttccgagatgggagctaatttcagggcggatcgcgttatcgacccccgtagatgcctcaaaccagtgatcctgaaggatggtccggaacgggtcattcttgccggccctatgcccgtgacagttgcaagtgctgcccagaggcgcgggcgaatcggaagaaaccaaaataaagagggcgaccagtacgtgtatatgggtcagccactaaacaatgatgaagaccacgcacattggactgaggccaagatgctgttggataacattaatacccccgaggggataatccctgctttatttgaaccagagcgggaaaagagcgccgcgattgacggcgagtacaggctgcgcggagaagcaagaaaaacattcgtcgagctcatgaggcggggcgatctgcccgtgtggctttcgtataaggtagcctctgaggggtttcagtactccgaccgtcgctggtgcttcgatggagaacgaaacaatcaagtgctggaggaaaacatggacgttgagatctggaccaaagaaggtgagagaaagaaactcaggcctcggtggttggacgctcgcacttatagcgatccgctggccctaagagagtttaaggagttcgctgcaggcaggcggtcagtcagtggggacctgatcctcgagattggaaaacttccacagcacctgacgtctcgagcccagaatgctttagataacttggtgatgctgcacaattccgaacagggcggtaaggcctacagacatgcaatggaggaactccccgacaccatagagacactgatgcttctggcgctcatcgccgtgttgactgggggcgtcaccctgtttttcttaagcggaaagggcctagggaaaacatcaattggactgctctgtgttaccgctagtagcgcccttctgtggatggcatccgtggagcctcactggatcgctgcctctattatcttggaatttttcctgatggtactcctgatacccgagccagatcgccaaaggactcctcaggacaaccagcttgcatatgtggtcatcggtctcctgtttatgattttgacagtggccgctaacgaaatgggcctgttagagacgaccaagaaagatctagggatcggacatgttgcggccgagaatcaccaacacgcaactatgctggacgtggatctccggcccgctagcgcctggacactttacgccgtcgcaaccaccgtaattacaccaatgatgcgtcatactatcgaaaacacgaccgctaatatatccctgacagccattgcgaaccaggctgccatcttgatgggcctggacaagggttggcctatttcaaaaatggatatcggggtgccgctcctggcacttggctgctactctcaggttaatcccttaactctgaccgccgctgtgctcatgttggtcgcacactatgccataatcggaccaggcctgcaggcgaaggctacaagagaggcccaaaagaggaccgcagccgggattatgaaaaaccctactgtggacggaatcgtcgctattgatctagaccccgtggtttacgacgccaagttcgaaaaacagctgggccagatcatgctccttatactgtgtacgagtcagattttgctgatgcgcacaacctgggcactctgcgagtcgatcactctggctaccggtccattaacaactctttgggaagggagccctggaaagttttggaataccacaatcgccgtgtccatggcgaacattttccggggctcttatctggccggtgcaggcctcgctttctcactaatgaaaagcctagggggaggccgaagagggacgggagcccaaggcgagaccttgggtgagaagtggaagaggcagctgaatcagctctccaaaagtgaatttaacacttacaagcgctctgggatcatggaggtagatcggagcgaagcaaaagagggacttaagagaggcgaaacaaccaaacatgctgtgtcacgtggtactgccaagctgaggtggttcgtcgagcggaatttggttaagcccgagggcaaagtgatagacctggggtgtggacgcggcgggtggtcctattactgcgccggactcaagaaagtcacagaagtgaagggctataccaaaggtgggccgggacacgaggaaccaattcctatggcgacgtacggctggaacttagctaagctgcatagtggcaaagatgtatttttcatgcccccagagaagtgtgacacccttctgtgcgatatcggggaaagctctcccaatcctacaattgaggagggacgaactctaagagtgctcaagatggttgaaccgtggctgaggggtaaccagttttgtatcaaaatattgaatccctacatgccatccgtggtcgagaccctggaacaaatgcagcggaagcacggcgggatgctcgtgcgcaaccctctttcaagaaatagcacacacgagatgtattgggtctcgtgcggaactggcaacatcgtgtctgcagttaacatgaccagtaggatgctgttaaatcgattcacaaccgcccatcggaaacccacttacgagcgtgacgtagatctgggtgctgggacgagacacgtggccgtcgaacctgaggtggcaaacttggacattatcggacagcgcattgaaaatatcaagaacgagcataaatccacatggcactatgatgaagacaatccatacaagacctgggcctatcacggcagctacgaggttaagccctcaggctccgcttctagcatggtgaacggggtcgtgaggctcctgactaaaccttgggatgtaattccaatggtgacccaaatcgcgatgacagacacgaccccctttggacagcagcgggttttcaaggagaaagtcgacactagaacaccgcgcgccaagaggggtaccactcagataatggaagtgacagcaaaatggctatggggctttcttagtcgaaataagaagcctcggatttgtaccagagaggagttcacaaggaaagtgcgctccaacgctgccatcggggcagtctttgttgatgagaatcaatggaacagcgccaaggaagctgtggaggacgagcgtttctgggatctggtacatcgggaaagagagctccacaaacagggaaagtgcgccacttgcgtgtataatatgatgggcaaaagggaaaagaagctgggtgagtttgggaaagcgaagggatctcgcgcaatctggtacatgtggttgggcgcccgattcctggagttcgaggctctcggctttatgaacgaggaccattggttctcacgggaaaatagtctttccggggtcgagggagaaggtctgcacaaattaggctacattctgagagatataagcaagatcccagggggaaacatgtatgccgacgataccgcaggctgggacacgaggattaccgaggatgacttgcagaatgaggctaaaatcacagaaattatggagcccgaacatgccctcctggctacttctatctttaagctaacctaccagaacaaagtggttcgcgtgcaaagacctgccaagaacggtacagtcatggatgtgatatcgcggagggaccagcgtgggtcaggacaggtaggcacttatggccttaataccttcacgaacatggaggttcagctgatccgacaaatggaaagcgaggggatttttctcccatccgagctggaaacacccaatttggcagagcgcgtgttagattggctggaaaagcacggagcggagagactcaaacggatggccatcagtggtgacgactgtgtcgtgaagccgattgatgacaggttcgctaccgcccttactgcactgaacgatatgggcaaagtgcgcaaggacatcctacagtgggaaccttctaaagggtggaatgattggcagcaggtccccttttgcagccaccatttccaccaactgataatgaaggacggaagagagattgttgtgccatgtcggaaccaggatgagctcgtaggcagggctcgagtgtcccagggtgccgggtggtcattgcgtgaaacagcatgcctgggaaagagttacgcccaaatgtggcagcttatgtattttcatagacgcgacctgcggctcgcggctaatgccatctgttctgcagtccctgtggattgggttcccaccagcaggactacctggtccatccacgcccaccatcagtggatgacaacggaggacatgttatcagtgtggaacagagtctggattgaagagaatccatggatggaagataaaacccacgtgagctcttgggaggaggtaccctacctgggcaagcgcgaagaccagtggtgcggctccttgatagggctgactgctcgggccacatgggcaaccaacatccaagttgctattaatcaggtgaggcgactcatcggaaacgagaattatcttgactacatgacaagtatgaaaagattcaagaacgaaagcgatcctgagggtgccctgtggtga

SEQ ID NO: 13390 - RNA, 9879 nt, synthetic construct
  misc_feature 1..9879: note = derived and/or modified CDS sequence (opt3) from DENV-1__KJ189347__SS-prME
  source 1..9879: mol_type = other RNA
agcgtgaccatgctgctcatgcttctgcccactgcattggctttccacttaactacgcgaggaggggaacctcatatgatcgtctccaagcaggaaaggggaaaatctctgctgtttaagacctcagccggtgttaacatgtgcactctcattgccatggacctgggcgaactttgtgaagatactatgacctacaaatgcccacagataacagaggcggaaccggacgatgtggactgttggtgcaatgctaccgatacttgggtaacatatgggacctgtagtcagacgggagagcaccggcgcgacaagcgaagcgtggccctggcaccccatgtcggcttgggtctcgagactcgtaccgaaacatggatgtcctctgagggggcctggaaacagatccagagagtggaaacttgggctctgaggcaccctggattcaccgttattgcactgtttctcgcccatgctatcggcacatcgattacccaaaagggcatcattttcatcttactgatgcttgtgacgccatcaatggccatgcggtgcgtcgggattggaaaccgcgattttgtggagggtttgagcggcgcgacttgggttgacgttgtgctggagcacgggagttgtgtcacaaccatggcaaagaataaacccactctagatatcgaactcctgaagacagaggtgaccaaccctgccattcttagaaaactgtgcatcgaagctaagatatccaatacgaccacagactctaggtgtccaactcagggagaggccaccttggtggaagaacaggatgcaaacttcgtctgccggcgcacatttgttgaccgaggctggggtaatgggtgtggactcttcggcaaaggcagcctgttaacttgcgctaagtttaagtgcgtgaccaaactggaggggaagattgtacagtacgaaaacctcaaatattccgtgatcgtcacagtgcacaccggagatcaacatcaggttggtaatgagactacggaacacggcacaattgccaccatcactccccaggcgcctacctcagagatccagcttacagactacggggccctgaccttggactgtagtccaagaactggactagatttcaacgaaatggtgctgctcacaatgaaggagaaaagctggctggtccataagcaatggtttcttgacctgccgttgccctggacgtctggcgcatccacctcacaggagacttggaataggcaggatctcctggtgacattcaaaaccgctcacgccaagaagcaagaagtagttgtgttaggtagccaggagggggctatgcacacagccctgactggcgcaaccgaaattcagacgagtggaaccacaactatatttgccggccatctaaaatgccggctcaagatggacaaactgacccttaaggggacatcttatgtcatgtgtactggacctttcaaattggagaaggaagtggctgagacccagcacggtacggtcctggtgcaagttaagtacgagggcacagatgcgccatgcaaaatccccttcctcacccaggacgaaaagggggtgactcagaacggacgtctgattacagcaaatcctatcgtaaccgataaagagaagccagtcaacatagaaactgagcccccgtttggcgagtcctatattgtggttggtgccggggaaaaagctcttaagctgagctggttcaagaaaggctcgtctatcggaaagatgtttgaggccaccgcacgcggcgccagaaggatggctatcttgggggacacagcctgggatttcggatccattggtggcgtgtttacgtcagtcgggaaactcgtgcatcaggtattcggaaccgcatacggcgtgctgtttagtggtgttagctggactatgaagatcgggattggcatattactgacatggctaggactcaattcccggtctaccagcctgtcaatgacatgtatcgcggtcggcatggtgactctttacttgggggtgatggtccaagctgacagtggatgcgttattaactggaaaggccgagaactgaagtgtggttccgggatcttcgtgaccaacgaggtgcacacgtggacagaacagtataagtttcaggccgatagccctaaacgcctctctgcagccatcggaaaggcttgggaggagggcgtatgcggtattagatcagccaccaggctggaaaatataatgtggaaacagatcagtaacgagttaaatcatattctgcttgaaaacgacatgaagttcactgtcgtggttggcgacgcaaatgggatcttggctcaaggcaaaaagatgattcggccccagccaatggagcacaaatacagctggaagtcctggggcaaggccaaaatcataggggcggatatccagaacaccacatttattatcgacggacctgatactcccgaatgtccagacaatcagcgcgcctggaacatttgggaggtggaggattatggcttcggtatctttaccacaaatatatggctcaagctgagagactcttacacgcaaatgtgcgatcacaggctaatgtcggctgcaattaaagacagcaaggccgtccatgctgatatggggtattggatcgaatccgagaaaaacgaaacctggaagctggcccgtgcatcattcattgaggtgaagacttgtacatggcccaaaagtcacaccctctggtctaatggagttctggaaagcgagatgatcatacctaagatctacggcggtccaatttcccagcataactatcggccgggctacttcactcagacagcggggccctggcaccttggaaaattggagctggactttgatttatgcgaaggcaccacggtggtagtcgacgagcactgcgggaatcgaggaccttcactcagaactaccacagtgaccggcaagatcattcatgaatggtgttgcaggagctgtactctgccaccccttcgcttccggggtgaggatgggtgctggtacggaatggagatcagacctgtgaaagaaaaggaggaaaacctggtcaggtctatggtttccgccggcagtggtgaggtggacagcttttctttgggcatactctgtgtatccattatgatcgaagaggtgatgcgctcacgatggagtcggaagatgctgatgacagggaccctagctgtcttcctgctcctggtgatgggacaacttacatggaatgacttgatccgtctgtgcattatggttggcgccaacgcaagcgatagaatggggatgggaactacctatttagctctcatggccacgtttaaaatgaggccaatgttcgcagtgggcctgctttttcgccggctgacatcgagagaggtcctactcctgaccatcggtttgtccctgatggcctctgtggaattacccaacagcctcgaggaactgggggacggacttgctatgggcattatgatgctgaagttgctcactgagttccagccgcaccagctgtggaccacactactgtcacttacttttataaaaaccacgctcagtctggattacgcgtggaagacaaccgccatggcattgtccatcgtttctctgttccctttatgtctcagcactacatcccagaaaaccacttggctgccagtgcttctgggctcatttgggtgcaagcccttgacaatgttcctcattaccgaaaataagatctggggaaggaaaagctggcctctgaacgagggtattatggctatcggcatagtcagtatcctactgtcttcccttctcaagaatgacgtacccctggccgggccattgattgccggaggcatgttaatcgcttgttatgtgattagcggttcgtcagcagatctgtctctcgagaaagccgcggaagttagttgggagcaagaagctgagcattccgggacgagccacaacatcctggtggaagtccaggacgatggaactatgaagataaaagacgaggagcgagatgacacccttacaattctgttgaaggccaccctactggcagtgtctggcgtataccctatgagcatccccgccacactctttgtgtggtatttctggcagaaaaagaagcagcgctccggcgtcctgtgggatactccatcaccgcctgaagttgagcgggctgtgcttgacgatgggatctacagaattttacaaaggggactgctcggtcgtagtcaggtgggcgtcggggtgttccaggacggagtttttcataccatgtggcacgtaacgcgcggcgcagtgttgatgtatcagggtaaacggctggaacccagctgggcctctgtcaagaaagacctcatatcctacgggggaggctggagattccaaggctcatggaatacaggggaggaggtgcaggttatcgcggtggaaccaggaaagaaccccaaaaatgtccagactacccctggtacatttaagaccccagagggcgaagtgggggctattgccctggatttcaagcccggaacaagtggcagccctatcgtaaacagggagggtaaaattgtcgggctttacggaaatggcgtggttaccacatccggcacgtatgtgtctgcaatcgcccaagctaaggcctcgcaggaagggccgctgccagagatagaggacgaagtctttaaaaagcgaaacttgactatcatggatctacaccccggaagcggtaaaacccggcgctacctgcctgcaattgtgagagaggctatcaagaggaagctccggacattaattctggccccaacccgagttgtggcgtcagaaatggccgaggcacttaaaggcatgcccatcagatatcagactacagctgtcaagtccgaacataccgggcgcgagatagtggacctgatgtgccacgccacgttcactatgaggctcttgagtcctgtacgtgtgccgaattacaacatgattatcatggatgaggctcattttacagaccccgcatctatcgccgcccggggatatattagcaccagagttggcatgggtgaagctgcggcaatcttcatgaccgccactccacctgggtccgtcgaggcttttccccagtcaaatgccgtgatacaagatgaagagagggacattccagaacgctcttggaacagcggatacgattggatcacagacttccctggcaaaaccgtgtggtttgtccccagtattaagtccggcaatgatatcgcaaactgtctgcggaaaaacgggaagagagtaatacagctcagcagaaagacattcgacactgagtatcagaaaacgaagaataacgactgggattacgtggttaccacagacatttctgagatgggagccaatttcagggctgatcgcgtgatcgacccacgtagatgcctgaaaccggtcatccttaaggatggtcctgaacgggtgattctagcgggccccatgccagttactgtggcctcagcagctcagaggcgcgggcgaatcggaagaaaccaaaataaagagggcgaccagtacgtctatatgggtcagcccctgaacaatgatgaagaccacgcccattggaccgaggcaaagatgttgttagataacattaatacacctgaggggataatcccagccctgtttgaacccgagcgggaaaagtccgctgccattgacggcgagtacaggctccgcggagaagcgagaaaaaccttcgtggagctgatgaggcggggcgatcttcctgtatggctgagttataaggtggcaagcgaggggtttcagtactcggaccgtcgctggtgcttcgatggagaacgaaacaatcaagttctcgaggaaaacatggacgtcgagatctggactaaagaaggtgagagaaagaaattgaggccgcggtggctggacgcccgcacgtattctgatccactagctctgagagagtttaaggagttcgccgctggcaggcggtccgtgagcggggacctcatccttgagattggaaaactgccccagcacttaaccttgcgagcacagaatgccctggataacctcgtgatgctgcacaattcagaacagggcggtaaggcttacagacatgccatggaggaacttcctgacacaatagagactctgatgctcttggcactgatcgcggtcttaaccgggggcgttacactatttttcctgagtggaaagggcctcgggaaaacctctattggacttctgtgtgtgactgcctccagcgctttgctgtggatggcctcagtagagccccactggatcgcagctagtattatcctcgaatttttcctgatggtgcttctcataccagagcctgatcgccaaaggacaccccaggacaaccagctggcctatgtcgtgatcggtttgctgtttatgattttaacggttgcagccaacgaaatgggcctactggagaccactaagaaagatctcgggatcggacatgtggctgcggagaatcaccaacacgccacaatgcttgacgtcgatctgcggccagcaagcgcttggaccttgtacgccgtagccaccacagtgattactcctatgatgcgtcatacgatcgaaaacaccacagcaaatatatccctgactgctattgccaaccaggcggctatcctcatgggcctggacaagggttggccgatttctaaaatggatatcggggttccccttttagccctgggctgctacagccaggtgaatccactcaccttgacagcagccgtcctgatgctagtggctcactatgcaataatcggacctggcctgcaggccaaggcgaccagagaggctcaaaagaggactgccgcagggattatgaaaaaccccacggtcgacggaatcgtggccattgatctcgacccagttgtgtacgacgctaagttcgaaaaacagcttggccagatcatgctgttgatactgtgtacatcccagattctcctgatgcgcaccacttgggccttatgcgagtcaatcacccttgcaacaggtcctctgactaccctctgggaagggtctcccggaaagttttggaatacaacgatcgctgtaagtatggccaacattttccggggctcgtatctagcgggtgccggcctggcattcagcttgatgaaatccctagggggaggccgaagagggaccggagctcaaggcgagactctcggtgagaagtggaagaggcagcttaatcagctgtctaaatcagaatttaacacatacaagcgcagcgggatcatggaggtggatcggtccgaagccaaagagggattgaagagaggcgaaaccactaaacatgcagtcagtcgtggtacagctaagctgaggtggttcgttgagcggaatctcgtgaagccggagggcaaagtcatagacttagggtgtggacgcggcgggtggtcttattactgcgccggactgaagaaagtgaccgaagtaaagggctatacgaaaggtgggccaggacacgaggaacctattcccatggccacctacggctggaaccttgtgaagctgcatagcggcaaagatgtatttttcatgccacccgagaagtgtgacacactactctgcgatatcggggaatcatcccctaatccgactattgaggagggacgaaccctgagagtgttgaagatggtcgaaccctggctgaggggtaaccagttttgtatcaaaatactcaatccatacatgcctagtgtggtcgagacacttgaacaaatgcagcggaagcacggcgggatgctggtgcgcaaccccttaagcagaaattctactcacgagatgtattgggtttcctgcggaaccggcaacatcgtatcagcggtgaacatgacaagcaggatgctgttgaatcgattcaccatggctcatcggaaacctacttacgagcgtgacgtcgatctcggtgcagggacgagacacgtggccgttgaaccagaggtggctaacctggacattatcggacagcgcattgaaaatatcaagaacgagcataaatcgacatggcactatgatgaagacaatccctacaagacctgggcctatcacggctcttacgaggtcaggcctagtggctccgcaagctcaatggtgaacggggtagtgcggctacttactaagccatgggatgttattcccatggtcacccaaatcgccatgacagacacgaccccgtttggacagcagagagtgttcaaagagaaggtggacactcgcacacctagggctaaacgaggtaccactcagataatggaagtcacagcgaagtggctgtggggctttctctcccggaataaaaagccaagaatttgtaccagggaggagttcacacgcaaggttcgttctaacgccgcaatcggggctgtgtttgtagatgagaatcaatggaacagcgccaaagaagcagtggaggacgagcggttctgggatctggtccatagagaaagggagttgcacaagcagggacgctgcgccacttgcgtgtataatatgatgggcaaacgagaaaagaaactgggtgagtttgggaaggctaagggaagtcgggccatctggtacatgtggctcggcgcgagattccttgagttcgaggcactgggctttatgaacgaggaccattggttctccagggaaaatagcttatctggggttgagggagaaggtctgcacaaattgggctacattctccgcgatatatcaaagatccccgggggaaacatgtatgccgacgataccgctggctgggacacgagaattaccgaggatgacctgcagaatgaggccaaaatcacagaaattatggagcctgaacatgcactacttgctacaagtatctttaagctgacctaccagaacaaagtggtccgggtgcaaaggccagccaagaacggtacagtaatggatgttatatcccgtcgagaccagcgcgggagcggacaggtgggcacttatggcctcaataccttcacgaacatggaggtccagctgatcagacaaatggaatctgaggggatatttttgccctcggagttagaaacaccgaatctggctgagcgggtgctcgattggcttgaaaaacacggagccgagaggctgaagcgcatggcaatctcaggtgacgactgtgtggtcaagcctattgatgacagattcgcgaccgccctaactgctctgaacgatatgggcaaagttcggaaggacatcccccagtgggaaccaagcaaagggtggaatgattggcaacaggtgcctttttgctcccaccatttccaccaactcataatgaaggacggaagggagattgtagtgccctgtcgaaaccaggatgagttggtcggccgtgccagagtgagtcagggtgcagggtggtctctgcgcgaaacagcttgccttggaaaaagctacgcccaaatgtggcagctgatgtattttcatcggagggacctcagattagcagccaatgcgatctgttccgctgttccagtggattgggtccccacctcacgcactacctggagtatccacgcccaccatcagtggatgacaacggaggacatgctgtctgtgtggaaccgggtatggattgaagagaatccttggatggaagataagacccacgttagctcctgggaggaggtgccatacttgggcaagagggaagaccagtggtgcggctcactgatagggctcactgcacgagccacatgggctaccaacatccaagtcgccattaatcaggtgagacggcttatcggaaacgagaattatctggactacatgactagcatgaaaaggttcaagaacgaatctgatccggagggtgcactatggtga

SEQ ID NO: 13391 - RNA, 9879 nt, synthetic construct
  misc_feature 1..9879: note = derived and/or modified CDS sequence (opt3) from DENV-1__KJ189348__SS-prME
  source 1..9879: mol_type = other RNA
agcgtgaccatgctgctcatgcttctgcccacagccttggctttccacttaactacgagaggcggggagcctcatatgatcgtctccaagcacgaaaggggaaaatctctgctatttaagacctcagcaggtgttaacatgtgcacactcattgccatggacctgggcgagctttgtgaagatactatgacctacaaatgcccacggataacagaggcggaaccggacgatgtggactgttggtgcaatgctaccgatacttgggtaacatatgggacctgtagtcagacgggagagcatcgccgagacaagcgtagcgtggccctggcaccccacgtcggcttgggtctcgagactagaaccgaaacatggatgtcctctgagggggcctggaaacaaatccagagggtggaaacttgggctctgcggcatcctggattcaccgttattgcactgtttctcgcccacgctatcggcacatcgattacccagaagggcatcatattcatcttactgatgcttgtgacgccatcaatggccatgcgctgcgtcgggattggaaacagagattttgtggagggtttgagcggcgcgacttgggtagacgttgtgctggagcacgggagttgtgtcacaaccatggcaaagaataaacccactctagatatcgaactcctgaagacagaggtgaccaaccctgccgtgcttaggaaactgtgcattgaagctaagatctccaatacgaccacagactctcggtgtccaactcagggagaggccaccttggtcgaagagcaagatgcaaacttcgtttgccgccgaacatttgtggacagaggctggggtaatgggtgtggactcttcggcaaaggcagcctgttaacttgcgctaagtttaagtgcgtaaccaaactggaggggaagatagtgcagtacgaaaacctcaaatattccgtcattgtgacagttcataccggagatcagcaccaggtgggtaatgagactacggaacatggcacaatcgccaccattactccccaagcgcctacctcagagatccagcttacagactacggggccctgaccttggactgtagtccaaggactggactagatttcaacgaaatggtcctgctcacaatgaaggagaaaagctggctggtgcacaagcagtggtttcttgacctgccgttgccctggacgtctggcgcatccacctcacaggagacttggaatcggcaagatctcctggtaacattcaaaaccgctcacgccaagaagcaggaagttgtggtcttaggtagccaggagggggctatgcatacagccctgactggcgcaaccgaaatccaaacgagtggaaccacaactatttttgccggccacctaaaatgccgtctcaagatggacaaactgacccttaaggggacatcttatgtgatgtgtactggatccttcaaattggagaaggaagtcgctgagacccagcatggtacggtgctggttcaggtgaagtacgagggcacagatgcgccttgcaaaataccattcagcacccaggacgaaaagggggtaactcaaaacggacgcctcatcacagcaaatcccattgtcaccgataaagagaagcctgtgaacatcgaaactgagccaccctttggcgagtcgtatatagttgtgggtgccggggaaaaagctctgaagctttcttggttcaagaaaggctcctcaattggaaagatgtttgaggccaccgcaagaggcgccaggcggatggctatcctgggggacacagcctgggatttcggaagtatcggtggcgtctttacgagcgtggggaaattggtacaccaggtgttcggaaccgcatacggcgttctcttttccggtgtctcttggactatgaagattgggatcggcattctgttaacatggctgggactaaatagccgatcaaccagtttctccatgacatgtatagcggtgggcatggtgactctctacctgggggtcatggttcaggctgacagcggatgcgtgatcaactggaaaggccgcgaacttaagtgtggttctgggatttttgtgaccaacgaggtacatacgtggacagaacagtataagttccaagccgattcaccgaaaagattgagtgcagccatcggaaaggcttgggaggagggcgtctgcggtatcaggagcgccacccggctggaaaatattatgtggaaacagatatccaacgagctcaatcacatcctgttagaaaacgacatgaagtttactgtggttgtgggcgacgcaaatgggattctggctcagggaaaaaagatgatccgccctcagcccatggagcacaaatactcttggaagtcgtggggcaaggccaaaattatcggggcggatatacaaaacaccacattcatcattgacggaccagatactcctgaatgtcccgacgatcagagagcctggaatatctgggaggtcgaggactatggctttggtattttcaccacaaacatctggcttaagttgagggatagctacacgcagatgtgcgaccatcgtctcatgtccgctgcaataaaagattcaaaggccgtgcacgctgacatggggtattggattgaaagtgagaaaaatgaaacctggaagctggcccgggcatctttcatcgaggttaagacttgtacatggccaaaaagccataccctatggtccaacggagtgctggaatcagagatgattatccccaagatatacggcggtcctatcagccagcacaattatcgaccaggctactttactcaaacagcggggccgtggcacctcggaaaactggagcttgatttcgacttgtgcgaaggcaccacggtagtcgtggatgagcattgcgggaacagaggaccctctctgaggactaccacagtgaccggcaagattatccacgaatggtgttgccgctcctgtactttacctccactccggtttagaggtgaggacgggtgctggtacggaatggagattaggcccgtcaaagaaaaggaggaaaatctggttcgcagtatggtgagcgccggctctggtgaggtagactccttctcacttggcatcctgtgtgtgagtataatgattgaagaggtcatgcgaagccggtggtcgcgtaagatgttgatgacagggaccctcgctgtgtttctgctactgatcatgggacagctcacatggaacgatctgatcagactttgcattatggttggcgccaatgcatccgacaggatggggatgggaactacctatttggctctgatggccacgttcaaaatgcgccctatgtttgcagtgggcatcttattccggagactcacatctagggaggtcctgcttctgaccattggtctaagcctcgtggcctcagttgaactgccaaacagtttggaggaactgggggatggattagctatgggcataatgatgctcaagctgcttactgagtttcagccccatcaactgtggaccacattgctctccctgactttcatcaaaaccacgctatctctggactacgcgtggaagacaaccgccatggcacttagcattgtgtccctctttccgctgtgtttgtcaactacaagccagaaaaccacttggctgcctgtcttactcggcagtttcgggtgcaagccactgacaatgtttcttatcaccgaaaacaagatttggggacgaaaatcttggcccatcaatgagggtataatggctatcggcattgtatccatcctgttgagctcgctcctgaagaacgatgtgcctctagccgggcccctgattgccggaggcatgcttatcgcttgttatgttatatcaggttctagtgcagacctctccctggagaaagccgcggaagtgagctgggagcaggaagctgagcactctgggacgagccataatattttggtcgaagtgcaggatgacggaactatgcgcatcaaggatgaggagaaagacgataccttaacaatcctgctcaaggccaccctgcttgcagtatccggcgtgtacccaatgtcaattcctgccacactgttcgtctggtatttctggcaaaaaaagaagcagcggagtggcgttttgtgggacactcccagcccaccggaagtggagagagctgtgctagatgacgggatatacaggatcctgcagcgtggactcctgggtcgctctcaggtcggcgtgggggtttttcaagacggagtattccacaccatgtggcacgtgacgcggggcgcagtccttatgtatcagggtaaaagattagaaccttcctgggcctcagtgaagaaagatctgattagttacgggggaggctggaggtttcagggcagctggaacacaggggaggaggttcaggtgatcgcggtcgaacccggaaagaatccaaaaaacgtgcaaactacccccggtacattcaagacccctgagggcgaagtaggggctattgccctcgactttaagccaggaacttccggctctcccatcgtcaatcgagagggtaaaatagtggggttgtacggaaacggcgttgtgaccacatcgggcacgtatgtcagcgcaatcgcccaggctaaggcctcacaggaagggcctctgccggagattgaggatgaagtgttcaaaaagcggaatctcactatcatggacctgcatccaggatccggtaaaacccgcagataccttcccgcaattgttagggaggctatcaagcggaagctgcgaacattgatactagcccctaccagagtggtcgcgagtgaaatggccgaggcactgaaaggcatgccaattcgctatcaaactacagctgtgaagtctgaacacaccgggagggagatcgtagatctcatgtgccatgccacgtttactatgcgtttactgagccccgtgcgggttcctaactacaatatgatcattatggacgaggctcacttcacagatccggcatccatcgccgccagaggatatatatcaaccagggtcggcatgggtgaagctgcggcaatttttatgaccgccactcccccagggtctgtggaggctttccctcagagcaacgccgtgatccaggacgaagagcgcgatattcccgaacgaagttggaattccggatacgactggatcacagattttccaggcaaaaccgtctggttcgtacctagcataaagtctggcaacgacattgcaaattgtcttagaaaaaacgggaagcgggtgatccagctgtcaaggaagacattcgacactgagtatcaaaaaacgaagaacaatgattgggactacgttgtgaccacagatatctccgagatgggagccaactttcgcgctgaccgtgtcattgatcccagacggtgcctcaaaccagtgatcttgaaggacggtccggaaagggttattctggcgggccctatgcccgtgactgtcgccagtgcagctcagcgccgagggagaataggacggaatcagaacaaagagggcgatcagtacgtgtatatgggtcaaccactcaataacgacgaagatcatgcccactggaccgaggcaaagatgctgcttgacaatatcaacacacccgaggggattatccctgccctattcgaaccagagagggaaaagagcgctgccatcgatggcgagtaccgcctgagaggagaagcgaggaaaacctttgtagagttgatgcggcgtggcgacttacccgtgtggctgtcgtataaggttgcatctgaggggttccagtactccgatcgccgatggtgctttgacggagaaagaaataaccaggtcctcgaggaaaatatggacgtggagatttggactaaagaaggtgagaggaagaaactgcggcctcgctggcttgatgccagaacgtatagcgacccgctggctctcagggagttcaaggaatttgccgctggccggcgatcagtgagtggggatttgatactggagatcggaaaactaccacagcacctgaccctcagagcacaaaacgcccttgacaatctggtcatgttacataactctgaacagggcggtaaggcttaccgccacgccatggaggaattgcccgatacaattgagactctgatgctcctggcacttatcgcggttctgaccgggggcgtgacactcttctttttgtccggaaagggcctggggaaaaccagcattggattactatgtgtaactgcctcaagtgctctgctctggatggccagcgtggagcctcattggatcgcagcttccataatccttgaattctttctgatggtcttgctgattcccgagccagacaggcagcggacacctcaggataatcaactcgcctatgtggttatcggtctgcttttcatgattctcacggtggcagccaacgaaatgggcctgttggagaccactaagcgtgacctggggatcggacacgtcgctgcggagaaccaccagcatgccacaatgttagatgtagacctaagacccgcatctgcttggaccctgtacgccgtggccaccacagttataactccaatgatgaggcacacgattgaaaataccacagcaaacatcagcctcactgctattgccaatcaggcggctatccttatgggcctggataaaggttggcctatatccaagatggacatcggggtgccgttgctggccctcggctgctactcacaagtcaaccccctgacccttacagcagccgtgttaatgctggtcgctcattatgcaattatcggaccaggcctccaggccaaagcgacccgcgaggctcagaagcggactgccgcagggattatgaagaatcctacggtggatggaatcgttgccatagacttggaccccgtggtatacgatgctaaatttgaaaagcagctgggccaaattatgctactgatcctctgtacatctcagatccttctgatgcgaaccacttgggccttgtgcgagagtattaccctggcaacaggtccactcactaccctgtgggaagggtcgcctggaaaattctggaacacaacgatcgctgtgagcatggccaatatattcagaggctcctatttagcgggtgccggccttgcattttctctgatgaagtcactcgggggaggcaggcgcgggaccggagctcagggcgagactctaggtgagaaatggaagcggcagctgaaccaattgagcaagcccgaattcaatacatacaaaagatccgggattatggaggtcgaccgtagtgaagccaaggagggactgaaaaggggcgaaaccactaagcacgcagtttctcggggtacagctaaactccgctggtttgtggagcgaaaccttgtcaagccggagggcaaggtgatcgatctggggtgtggaagaggcgggtggagctattactgcgccggattgaaaaaggtaaccgaagtgaaaggctatacgaagggtgggccaggacatgaggaacctattcccatggccacctacggctggaatctggttaaactccactcaggcaaggacgtgttctttatgccacccgagaaatgtgatacattactgtgcgacatcggggaatccagtcctaacccgactatagaggagggaaggacccttcgggtcctgaagatggtggaaccctggctacgcggtaatcagttctgtatcaagattctcaacccatacatgcctagcgtcgtggagacactggaacagatgcagagaaaacacggcgggatgttggttaggaatcccctgtctcgaaactccactcatgagatgtattgggtatcatgcggaaccggcaatatcgtgagcgcggtcaacatgacatcgcggatgctccttaaccgttttaccatggctcacagaaagcctacttacgagcgcgatgtggacctgggtgcagggacgaggcatgttgccgtggaaccagaggtcgctaatttagatattatcggacaacggattgaaaacatcaaaaatgagcacaagtctacatggcactatgacgaagataacccctacaaaacctgggcctatcatggcagttacgaggtgaagccttccggcagcgcatcatccatggtaaatggggtggttagactgttgactaagccatgggacgtcatacccatggtgacccagattgccatgacagacacgaccccgttcggacagcaacgcgtgtttaaagagaaggtcgatactaggacacctcgagctaaacggggtaccactcagatcatggaagttacagcgaagtggctctggggcttcctgtctagaaacaaaaagccaaggatctgtacccgcgaggaatttacacgtaaggtgcggagcaatgccgcaattggggctgtattcgtggacgagaaccagtggaatagtgccaaagaagcagtcgaggatgagagattttgggacctagtgcacagggaacgcgagcttcataagcagggaaaatgcgccacttgcgtttataacatgatgggcaagcgagaaaaaaagctgggtgagttcgggaaggctaaaggatcccgggccatatggtacatgtggctcggcgcgagattcctggaatttgaggcattgggcttcatgaatgaggatcactggtttagcagggaaaactctctgtcaggggtggagggagaaggtctccataagcttggctacatcctgcgcgacattagtaaaatccccgggggaaatatgtatgccgatgacaccgctggctgggatacgagaattaccgaggacgatttacaaaacgaggccaagatcacagacataatggaacctgagcacgcactgttggctacttccatcttcaaactcacctaccagaataaggtcgtgcgggtacagaggccagccaaaaacggtacagttatggatgtgattagccgtcgagaccagcgcgggtctggacaagtcggcacttatggcctgaacacctttacgaatatggaagtgcagctaatcagacagatggagtcggaagggattttccttccctcagagctggagacaccgaacctcgctgaacgggtgctgaattggttggagaagcacggagccgaaaggttaaagcgcatggcaatcagcggtgacgattgtgtcgttaaacctatagacgatagatttgcgaccgccctgactgctctcaacgacatgggcaaggtgcggaaagatattccccagtgggagccatccaaggggtggaatgactggcaacaggtacctttctgcagtcatcactttcatcagcttatcatgaaagatggaagggaaatcgtggtcccctgtcgaaaccaggacgagctggtgggccgtgccagagtttctcaaggtgcagggtggagcctacgcgagacagcttgcctgggaaagtcctacgcccagatgtggcagctcatgtatttccaccggagggatttgagactggcagccaatgcgatttgttcagctgtgccagtcgactgggtgcccaccagtcgcactacctggtctatacacgcccatcaccaatggatgacaacggaagatatgcttagcgtatggaaccgggtttggatcgaggaaaatccttggatggaggacaagacccatgtgtcctcatgggaagaggtcccatacctgggcaaaagggaggaccagtggtgcggcagcctcattgggttaactgcacgagccacatgggctaccaacatccaggtggccattaatcaggttagacggctgatcggaaacgaaaattatttggattacatgacttctatgaagaggtttaaaaacgagtccgacccggaaggtgcactgtggtga

SEQ ID NO: 13392 - RNA, 9879 nt, synthetic construct
  misc_feature 1..9879: note = derived and/or modified CDS sequence (opt3) from DENV-1__KJ189368__SS-prME
  source 1..9879: mol_type = other RNA
agcgtgaccatgctgctcatgcttctgcccaccgcattggctttccacttaactacgagaggcggggaacctcatatgatcgtctccaagcaggaaaggggaaagtctctgttgtttaagacctcagccggtgttaacatgtgcacactcattgccatggacctgggcgaactttgtgaagatactatgacctacaaatgcccacagataacagaggcggaaccggacgatgtggactgttggtgcaatgctaccgatacttgggtaacatatgggacctgtagtcagaacggagagcaccggcgcgacaagcgaagcgtggccctggcaccccatgtcggcttgggtctcgagacgcgtactgaaacctggatgtcctctgagggggcctggaaacagatccagagagtggaaacatgggctctgaggcaccctggattcactgttattgcactgtttctcgcccatgctatcggcacctcgattacacaaaagggcatcatattcatcttactgatgcttgtgaccccatcaatggccatgcggtgcgtcgggattggaaatcgcgattttgtggagggtttgagcggcgcgacgtgggttgacgttgtgctggagcacgggagttgtgtcactacaatggcaaagaacaaacccaccctagatatcgaactcctgaagactgaggtgacaaatcctgccattcttagaaaactgtgcatcgaagctaagatatccaacaccacgaccgactctaggtgtccaacacagggagaggccactttggtggaagaacaggatgcaaatttcgtctgccggcgcacctttgttgaccgaggctggggtaacgggtgtggactcttcggcaaaggcagcctgttaacatgcgctaagtttaagtgcgtgactaaactggaggggaagattgtacagtacgaaaatctcaaatattccgtgatcgtcaccgtgcacacaggagatcaacatcaggttggtaacgagaccactgaacacggcacgattgccacaatcacaccccaggcgcctacttcagagatccagcttaccgactacggggccctgacattggactgtagtccaagaaccggactagatttcaatgaaatggtgctgctcactatgaaggagaaaagctggctggtccataagcaatggtttcttgacctgccgttgccctggacatctggcgcatccacgtcacaggagacctggaacaggcaggatctcctggtgactttcaaaacagctcacgccaagaagcaagaagtagttgtgttaggtagccaggagggggctatgcacaccgccctgacaggcgcaactgaaattcagaccagtggaacgaccacaatatttgccggccatctaaaatgccggctcaagatggacaaactgactcttaaggggacctcttatgtcatgtgtacaggacctttcaaattggagaaggaagtggctgagactcagcacggtaccgtcctggtgcaagttaagtacgagggcacggatgcgccatgcaaaatccccttctccacacaggacgaaaagggggtgacccagaatggacgtctcattactgcaaaccctatcgtaacagataaagagaagccagtcaatatagaaaccgagcccccgtttggcgagagctatattgtggttggtgccggggaaaaagctctgaaactttcgtggttcaagaaaggatcttccatcggaaagatgtttgaggccactgcacgcggcgccagaaggatggctatcctgggggacaccgcctgggatttcggatcaattggtggcgtgtttacaagtgtcgggaaattggtgcatcaggtattcggaacggcatacggcgtgctctttagcggtgtttcctggaccatgaagatcgggattggcatactgttaacttggctgggactaaactctcggagcacatcactcagtatgacctgtatcgcggtcggcatggtgacactgtaccttggggtgatggtccaagctgactccggatgcgttattaactggaaaggccgagaattgaagtgtggtagcgggatcttcgtgactaatgaggtgcacacctggacggaacagtataagtttcaggccgattctcctaaacgcctgtcagcagccatcggaaaggcttgggaggagggcgtatgcggtattagaagtgccacaaggctcgaaaacataatgtggaaacagatcagcaatgagctgaaccatattttactggaaaatgacatgaagttcaccgtcgtggttggcgacgcaaacgggatccttgctcaaggcaagaagatgattcggccccagccaatggagcacaaatactcctggaagtcttggggcaaggccaaaatcataggggcggatatccagaatactacctttattatcgacggacctgatacacccgaatgtccagacaaccagcgcgcctggaatatttgggaggtggaggattatggcttcggtatctttactaccaacatatggttgaagctcagagactcgtacacacaaatgtgcgatcacaggctgatgagcgctgcaattaaagactccaaggccgtccatgctgatatggggtattggatcgaatcagagaaaaatgaaacgtggaagctagcccgtgcaagtttcattgaggtgaagacctgtacttggcccaaatctcacacactgtggagcaacggagttctcgaatccgagatgatcatacctaagatctacggcggtccaatttcacagcataattatcggccgggctacttcacccagactgcggggccctggcacctgggaaaacttgagttggactttgatctgtgcgaaggcacaaccgtggtagtcgacgagcactgcgggaaccgaggacctagcttaagaacgactaccgtgacaggcaagatcattcatgaatggtgttgcaggtcttgtaccctcccacccctgcgcttccggggtgaggatgggtgctggtacggaatggagatcagacctgtgaaagaaaaggaggaaaatcttgtcaggtccatggttagtgccggcagcggtgaggtggactctttttccctgggcatattgtgtgtatcaattatgatcgaagaggtgatgcgcagtcgatggagccggaagatgctcatgactgggacactggctgtcttcctactgctcgtgatgggacaactgacctggaacgaccttatccgtttgtgcattatggttggcgccaacgcatcggatagaatggggatgggaacaacttatctggctttaatggccacctttaaaatgaggccaatgttcgcagtgggcctcctgtttcgccggcttacgtccagagaggtcctgctactcacaatcggtctgtctttggtggccagcgttgaactgcccaattcattagaggaactcggggacggactggctatgggcattatgatgcttaagctgttgaccgagttccagccgcaccagctctggactaccctgctaagtctgacatttataaaaactaccctttccctcgattacgcgtggaagacgacagccatggcactgtctatcgtgagcttgttccctctgtgtttatccaccacttcacagaaaacaacctggctcccagtcctgcttggcagctttgggtgcaagcccctgactatgttcttgattacagaaaacaagatctggggaaggaaaagttggcctctcaatgagggtattatggctatcggcatagtatctatcctgctatccagcctgcttaagaacgacgtgcccctcgccgggccactgattgccggaggcatgttgatcgcttgttatgttatttcgggttcatctgcagatttaagtctggagaaagccgcggaagtgtcctgggagcaagaagctgagcatagcgggacctctcacaatatcctcgtcgaagtgcaggacgatggaacgatgaagataaaagacgaggagcgagatgacactctgaccattcttctgaaggccacattgctagcagtaagcggcgtgtaccctatgtccatccccgccaccctgtttgtctggtatttctggcagaaaaagaagcagcgctcaggcgttctctgggatacaccaagtccgcctgaagtggagcgggctgtgctggacgatgggatctacaggattcttcaacgaggattactgggtcgtagccaggtcggcgtgggggttttccaggacggagtatttcatactatgtggcacgtgacccgcggcgcagtcctcatgtatcagggtaaacggttggaaccctcttgggcctccgtgaagaaagacctgatatcatacgggggaggctggagattccaaggcagttggaacacgggggaggaggttcaggtgatcgcggtcgaaccaggaaagaatcccaaaaacgtgcagacaactcctggtacctttaagacaccagagggcgaagtaggggctattgccctcgatttcaagcccggaaccagcggctcccctatcgtcaatagggagggtaaaattgtggggctgtacggaaacggcgttgtgactacctctggcacatatgtctcggcaatcgcccaagctaaggccagccaggaagggccgcttccagagatagaggacgaagtgtttaaaaagcgaaatctgacgatcatggatttgcaccccggatcaggtaaaactcggcgctacctacctgcaattgttagagaggctatcaagaggaagctgcggaccctcattttagccccaacacgagtggtcgcgtccgaaatggccgaggcactgaaaggcatgcccatcagatatcagaccactgctgtgaagagtgaacatacagggcgcgagatagtagaccttatgtgccacgccaccttcacgatgaggctgctctctcctgtgcgtgttccgaactacaatatgattatcatggatgaggctcattttactgaccccgcaagcatcgccgcccggggatatatttccacaagagtcggcatgggtgaagctgcggcaatcttcatgaccgccaccccacctgggtcagtggaggcttttccccagtctaacgccgtgatacaagatgaagagagggacattccagaacgcagctggaatagtggatacgattggatcactgacttccctggcaaaacagtctggtttgtaccctccattaagagcggcaacgatatcgcaaactgtttgagaaagaatgggaagagagtgatacagctgtctcggaagaccttcgacacagagtatcagaaaactaagaacaatgactgggattacgttgtgacgaccgacatttcagagatgggagccaacttcagggctgatcgcgtcatcgacccacgtagatgcctcaaaccggtgatcctgaaggatggtcctgaacgggttattcttgcgggccccatgccagtgacagtcgcctccgcagctcagaggcgcgggcgaatcggaagaaatcaaaacaaagagggcgaccagtacgtgtatatgggtcagcccctaaataacgatgaagaccacgcccattggactgaggcaaagatgctgttggataatattaacacccctgaggggataatcccagccttatttgaacccgagcgggaaaagagtgctgccattgacggcgagtacaggctgcgcggagaagcgagaaaaacattcgtagagctcatgaggcggggcgatctgcctgtgtggcttagctataaggttgcatcggaggggtttcagtactctgaccgtcgctggtgcttcgatggagaacgaaataaccaagtcctggaggaaaatatggacgtggagatctggaccaaagaaggtgagagaaagaaactcaggccgcggtggttggacgcccgcacttattccgatccactggctctaagagagtttaaggagttcgccgctggcaggcggagcatctcaggggacctgattctcgagataggaaaacttccccagcacctgacgttacgagcacagaacgccttggataatctggtgatgctccacaacagtgaacagggcggtaaggcttacagacatgccatggaggaactgcctgacaccatcgagacacttatgctgctcgcattgattgcggtcctgactgggggcgttaccttatttttcctatctggaaagggcctggggaaaacatccatcggactcctttgtgtgaccgccagctcagctctgttgtggatggccagtgtagagccccactggattgcagctagcatcatactggaatttttcctcatggtgctgcttatcccagagcctgatcgccaaaggactccccaggacaaccagctcgcctatgtcgtgattggtctgttgtttatgatcctgacagttgcagccaatgaaatgggcttactagagacgaccaagaaagatctggggattggacatgtggctgcggagaaccaccaacacgccactatgctcgacgtcgatcttcggccagcatccgcttggacactgtacgccgtagccaccaccgtgatcacacctatgatgcgtcatactatagaaaatacgaccgcaaacatttctttgacagctatcgccaatcaggcggctattctgatgggcctcgacaagggttggccgatcagcaaaatggatataggggttcccctgcttgccttaggctgctactcccaggtgaacccactgactctcaccgcagccgtcttgatgctggtggctcactatgcaatcattggacctggcctacaggccaaggcgacaagagaggctcaaaagaggaccgccgcagggatcatgaaaaatcccactgtcgacggaattgtggccatcgatctggacccagttgtgtacgacgctaagttcgaaaaacagctcggccagataatgcttctgattttgtgtacgtcacagatcctgctcatgcgcacaacctgggccctgtgcgagtctatcactttagcaaccggtcctcttacaactctgtgggaagggagtcccggaaagttttggaacaccacaattgctgtatcgatggccaatatcttccggggcagctatctcgcgggtgccggcctagcattctccctgatgaaatctctagggggaggccgaagagggacgggagctcaaggcgagaccctgggtgagaagtggaagaggcagctcaaccagctttcaaaaagcgaatttaatacttacaagcgctccgggataatggaggtggatcggagtgaagccaaagagggactgaagagaggcgaaacaaccaaacatgcagtctctcgtggtactgctaagttgaggtggttcgttgagcggaacctggtgaagccggagggcaaagtcattgacctcgggtgtggacgcggcgggtggagctattactgcgccggattaaagaaagtgacagaagtaaagggctataccaaaggtgggccaggacacgaggaacctatccccatggccacgtacggctggaatctggtgaaacttcattcaggcaaagatgtatttttcatgccacccgagaagtgtgacaccctgctatgcgatattggggaatccagtcctaacccgacaatcgaggagggacgaactctcagagtgctgaagatggtcgaaccctggttgaggggtaatcagttttgtataaaaatcctgaacccatacatgcctagcgtggtcgagaccctcgaacaaatgcagcggaagcacggcgggatgcttgtgcgcaatcccctgtctagaaactccacacacgagatgtattgggtttcatgcggaactggcaacattgtaagcgcggtgaatatgacctcgaggatgttactgaaccgattcacaatggctcatcggaaacctacctacgagcgtgacgtcgatttgggtgcagggactagacacgtggccgttgaaccagaggtggctaatctcgacatcattggacagcgcatcgaaaacattaagaatgagcataaatctacgtggcactatgatgaagacaacccctacaagacatgggcctatcacggcagttacgaggtcaagccttccggcagcgcatcatccatggtgaatggggtagtgaggctgctaaccaaaccatgggatgttatccccatggtcactcaaatagccatgaccgacacaacgccgtttggacagcagcgggtgttcaaggagaaagtggacaccagaactcctcgcgctaagaggggtacaacccagattatggaagtcactgcgaaatggctttggggctttctgtctcgaaacaagaagccacggatctgtacaagagaggagttcaccaggaaagttcgcagcaatgccgcaatcggggctgtgtttgtagatgagaaccaatggaatagtgccaaggaagcagtggaggacgagcgtttctgggatctcgtccatcgggaaagagagctgcacaaacagggaaagtgcgccacatgcgtgtataacatgatgggcaaaagggaaaagaagttgggtgagtttgggaaagctaagggatcccgcgccatttggtacatgtggctgggcgcgcgattcctcgagttcgaggcacttggctttatgaatgaggaccattggttcagccgggaaaactctctgtcaggggttgagggagaaggtttacacaaactgggctacatattgagagatatcagtaagattcccgggggaaatatgtatgccgacgatactgctggctgggacaccaggatcacggaggatgacctccagaacgaggccaaaattaccgaatttatggagcctgaacatgcactgctagctacatccatcttcaaacttacttaccagaacaaagtggtccgcgtgcaaagaccagccaagaatggtaccgtaatggatgttataagccggagggaccagcgtgggtctggacaggtgggcacatatggcctgaacacttttaccaatatggaggtccagctcatccgacaaatggaatcggaggggattttcctgccctcagagttggaaacgccgaacttagctgagcgcgtgtttgattggctggaaaagcacggagccgagagactcaaacggatggcaatcagcggtgacgactgtgtggtcaagcctattgatgacaggttcgcgacagcccttaccgctctgaatgatatgggcaaagttcgcaaggacatcccccagtgggaaccatccaaagggtggaacgattggcaacaggtgcctttttgcagtcaccatttccaccaactaataatgaaggacggaagagagattgtagtgccctgtcggaatcaggatgagctggtcggcagggcccgagtgtctcagggtgcagggtggagcctccgtgaaactgcttgcttgggaaagtcctacgcccaaatgtggcagctgatgtattttcatagacgcgaccttcggctggcagccaacgcgatctgttcagctgttccagtggattgggtccccacaagtaggaccacttggtctatccacgcccaccatcagtggatgaccacagaggacatgctcagcgtgtggaatagagtatggattgaagagaacccttggatggaagataaaacgcacgtttcctcatgggaggaggtgccatacttaggcaagcgcgaagaccagtggtgcggcagcctgatagggttgaccgcacgggccacttgggctacaaatatccaagtcgccattaaccaggtgaggcgactgatcggaaatgagaactatctcgactacatgacctctatgaaaagattcaagaatgaatccgatccggagggtgcactttggtga

SEQ ID NO: 13393 - RNA, 9879 nt, synthetic construct
  misc_feature 1..9879: note = derived and/or modified CDS sequence (opt3) from DENV-1__KJ189369__SS-prME
  source 1..9879: mol_type = other RNA
agcgtgaccatgctgctcatgcttctgccaacagcattggctttccacttaactacgagaggaggggaacctcatatgatcgtctccaagcaggaaaggggaaaatctctgttgtttaagacctcagccggtgttaacatgtgcacactcattgccatggacctgggcgaactttgtgaagatactatgacctacaaatgcccacaaataacagaggcggaaccggacgatgtggactgttggtgcaatgctaccgatacttgggtaacatatgggacctgtagtcagacgggagagcaccggcgcgacaagcgaagcgtggccctggcaccccatgtcggcttgggtctcgagactcgtaccgaaacatggatgtcctctgagggggcctggaaacagatccagagagtggaaacttgggctctgaggcaccctggattcaccgttattgcactgtttctcgcccatgctatcggcacatcgattacccaaaagggcatcatattcatcttactgatgcttgtgacgccatcaatggccatgcggtgcgtcgggattggaaaccgcgattttgtggagggtttgagcggcgcgacttgggtagacgttgtgctggagcacgggagttgtgtcacaaccatggcaaagaataaacccactctagatatcgaactcctgaagacagaggtgaccaaccctgccattcttagaaaactgtgcatcgaagctaagatatccaatacgaccacagactctaggtgtccaactcagggagaggccaccttggtggaagaacaggatgcaaacttcgtctgccggcgcacatttgttgaccgaggctggggtaatgggtgtggactcttcggcaaaggcagcctgttaacttgcgctaagtttaagtgcgtgaccaaactggaggggaagattgtacagtacgaaaacctcaaatattccgtgatcgtcacagtgcacaccggagatcaacatcaggttggtaatgagactacggaacacggcacaattgccaccatcactccccaggcgcctacctcagagatccagcttacagactacggggccctgaccttggactgtagtccaagaactggactagatttcaacgaaatggtgctgctcacaatgaaggagaaaagctggctggtccataagcaatggtttcttgacctgccgttgccctggacgtctggcgcatccacctcacaggagacttggaataggcaggatctcctggtgacattcaaaaccgctcacgccaagaagcaagaagtagttgtgttaggtagccaggagggggctatgcacacagccctgactggcgcaaccgaaattcagacgagtggaaccacaactatatttgccggccatctaaaatgccggctcaagatggacaaactgacccttaaggggacatcttatgtcatgtgtactggatccttcaaattggagaaggaagtggctgagacccagcacggtacggtcctggtgcaagttaagtacgagggcacagatgcgccttgcaaaatcccattcagcacccaggacgaaaagggggtgactcagaacggacgtctcattacagcaaatcccatcgtaaccgataaagagaagcctgtcaacatagaaactgagccaccctttggcgagtcgtatattgtggttggtgccggggaaaaagctctgaaactttcttggttcaagaaaggctcctcaatcggaaagatgtttgaggccaccgcacgcggcgccagaaggatggctatcctgggggacacagcctgggatttcggaagtattggtggcgtgtttacgagcgtcgggaaattggtgcatcaggtattcggaaccgcatacggcgtgctcttttccggtgtttcttggactatgaagatcgggattggcatactgttaacatggctgggactaaatagccggtcaaccagtctctccatgacatgtatcgcggtcggcatggtgactctgtaccttggggtgatggtccaagctgacagcggatgcgttattaactggaaaggccgagaattgaagtgtggttctgggatcttcgtgaccaacgaggtgcacacgtggacagaacagtataagtttcaggccgattcaccgaaacgcctgagtgcagccatcggaaaggcttgggaggagggcgtatgcggtattagaagcgccaccaggctcgaaaatataatgtggaaacagatctccaacgagctgaatcatattttactggaaaacgacatgaagttcactgtcgtggttggcgacgcaaatgggatccttgctcaaggcaagaagatgattcggcctcagcccatggagcacaaatactcttggaagtcgtggggcaaggccaaaatcataggggcggatatccagaacaccacatttattatcgacggaccagatactcctgaatgtcccgacaatcagcgcgcctggaacatttgggaggtggaggattatggcttcggtatctttaccacaaatatatggttgaagctcagagacagctacacgcaaatgtgcgatcacaggctgatgtccgctgcaattaaagactcaaaggccgtccatgctgatatggggtattggatcgaaagtgagaaaaacgaaacctggaagctagcccgtgcatctttcattgaggtgaagacttgtacatggccaaaaagccacaccctgtggtccaatggagttctcgaatcagagatgatcatacccaagatctacggcggtcctattagccagcataactatcggccaggctacttcactcagacagcggggccgtggcacctgggaaaacttgagttggactttgatctgtgcgaaggcaccacggtggtagtcgacgagcactgcgggaatcgaggaccctctttaagaactaccacagtgaccggcaagatcattcatgaatggtgttgcaggtcctgtactctccctccactgcgcttccggggtgaggatgggtgctggtacggaatggagatcagacccgtgaaagaaaaggaggaaaaccttgtcaggagtatggttagcgccggctctggtgaggtggactccttttcactgggcatattgtgtgtaagtattatgatcgaagaggtgatgcgcagccgatggtcgcggaagatgctcatgacagggaccctggctgtcttcctactgctcgtgatgggacaactgacatggaatgaccttatccgtttgtgcattatggttggcgccaacgcatccgatagaatggggatgggaactacctatctggctttaatggccacgtttaaaatgaggcctatgttcgcagtgggcctcctgtttcgccggcttacatctagagaggtcctgctactcaccatcggtctgagcttggtggcctcagttgaactgccaaacagtttagaggaactcggggacggactggctatgggcattatgatgcttaagctgttgactgagttccagccccaccagctctggaccacactgctatccctgacttttataaaaaccacgctttctctcgattacgcgtggaagacaaccgccatggcactgagcatcgtgtccttgttcccgctgtgtttatcaactacaagccagaaaaccacttggctccctgtcctgcttggcagttttgggtgcaagccactgacaatgttcttgattaccgaaaataagatctggggaaggaaatcttggcccctcaacgagggtattatggctatcggcatagtatccatcctgctaagctcgctgcttaagaatgacgtgcctctcgccgggcccctgattgccggaggcatgttgatcgcttgttatgttatttcaggttctagtgcagatttatccctggagaaagccgcggaagtgagctgggagcaagaagctgagcattctgggacgagccacaacatcctcgtcgaagtgcaggacgatggaactatgaagataaaagacgaggagcgagatgacaccctgacaattcttctgaaggccaccttgctagcagtatccggcgtgtacccaatgtcaatccctgccacactgtttgtctggtatttctggcagaaaaagaagcagcgcagtggcgttctctgggatactcccagcccaccggaagtggagcgggctgtgctggacgatgggatctacaggattcttcaacgaggattactgggtcgttctcaggtcggcgtgggggttttccaggacggagtatttcataccatgtggcacgtgacgcgcggcgcagtcctcatgtatcagggtaaacggttggaaccttcctgggcctcagtgaagaaagacctgataagttacgggggaggctggagattccaaggcagctggaatacaggggaggaggttcaggtgatcgcggtcgaacccggaaagaaccccaagaatgtgcagactacccccggtacatttaagacccctgagggcgaagtaggggctattgccctcgatttcaagccaggaacttccggctctcccatcgtcaacagggagggtaaaattgtggggctgtacggaaatggcgttgtgaccacatcgggcacgtatgtcagcgcaatcgcccaagctaaggcctcacaggaagggcctcttccggagatagaggacgaagtgtttaaaaagcgaaacctgactatcatggatttgcacccaggatccggtaaaacccggcgctacctacccgcaattgttagagaggctatcaagaggaagctgcggacactcattttagcccctacccgagtggtcgcgagtgaaatggccgaggcactgaaaggcatgccaatcagatatcagactacagctgtgaagtctgaacataccgggcgcgagatagtagaccttatgtgccacgccacgttcactatgaggctgctcagccccgtgcgtgttcctaattacaacatgattatcatggatgaggctcattttacagacccggcatccatcgccgcccggggatatatttcaaccagagtcggcatgggtgaagctgcggcaatcttcatgaccgccactcccccagggtctgtggaggcttttcctcagagcaatgccgtgatacaagatgaagagagggacattcccgaacgcagttggaactccggatacgattggatcacagacttcccaggcaaaaccgtctggtttgtacctagcattaagtctggcaatgatatcgcaaactgtttgagaaagaacgggaagagagtgatacagctgtcacggaagacattcgacactgagtatcagaaaacgaagaataacgactgggattacgttgtgaccacagacatttccgagatgggagccaatttcagggctgatcgcgtcatcgacccccgtagatgcctcaaaccagtgatcctgaaggatggtccggaacgggttattcttgcgggccctatgcccgtgactgtcgccagtgcagctcagaggcgcgggcgaatcggaagaaaccaaaataaagagggcgaccagtacgtgtatatgggtcagccactaaacaatgatgaagaccacgcccattggaccgaggcaaagatgctgttggataacattaatacacccgaggggataatccctgccttatttgaaccagagcgggaaaagaacgctgccattgacggcgagtacaggctgcgcggagaagcgagaaaaaccttcgtagagctcatgaggcggggcgatctgcccgtgtggcttagctataaggttgcatcggaggggtttcagtactctgaccgtcgctggtgcttcgatggagaacgaaataaccaagtcctggaggaaaatatggacgtggagatctggactaaagaaggtgagagaaagaaactcaggcctcggtggttggacgcccgcacgtattccgatccgctggctctaagagagtttaaggagttcgccgctggcaggcggagcgtgtcaggggacctgatcctcgagattggaaaacttccacagcacctgaccttacgagcacagaacgccttggataatctggtcatgctccacaacagtgaacagggcggtaaggcttacagacatgccatggaggaactgcccgacacaatagagactcttatgctgctcgcattgatcgcggttctgaccgggggcgtgacattatttttcctatctggaaagggcctggggaaaacctccattggactcctttgtgtaactgccagctcagctctgttgtggatggccagtgtggagcctcactggatcgcagctagcattatcctggaatttttcctcatggtcctgcttatacccgagccagatcgccaaaggacacctcaggacaaccagctcgcctatgtggttatcggtctgttgtttatgattctgacggtggcagccaatgaaatgggcttactagagaccactaagaaagatctggggatcggacatgtcgctgcggagaaccaccaacacgccacaatgctcgacgtagatcttcggcccgcatccgcttggaccctgtacgccgtggccaccacagttattactccaatgatgcgtcatacgatcgaaaataccacagcaaacatatctttgactgctattgccaatcaggcggctatcctgatgggcctcgacaagggttggcctattagcaaaatggatatcggggtgccgctgcttgccttaggctgctactcccaggtcaaccccctgaccctcacagcagccgtgttgatgctggtcgctcactatgcaataatcggaccaggcctacaggccaaggcgaccagagaggctcaaaagaggactgccgcagggattatgaaaaatcctacggtggacggaatcgttgccattgatctggaccccgtggtatacgacgctaagttcgaaaaacagctcggccagatcatgcttctgatattgtgtacatcacagattctgctcatgcgcaccacttgggccctgtgcgagtctatcaccttagcaacaggtccacttactaccctgtgggaagggagtcctggaaagttttggaacacaacgatcgctgtgtcgatggccaatattttccggggcagctatctcgcgggtgccggcctagcattctccctgatgaaatctctagggggaggccgaagagggaccggagctcaaggcgagactctgggtgagaagtggaagaggcagctcaaccagctttcaaaaagcgaatttaatacatacaagcgctccgggatcatggaggtcgatcggagtgaagccaaagagggactgaagagaggcgaaaccactaaacatgcagtttctcgtggtacagctaagttgaggtggttcgtggagcggaacctggtcaagcccgagggcaaagtgatagacctcgggtgtggacgcggcgggtggagctattactgcgccggattaaagaaagtaaccgaagtgaagggctatacgaaaggtgggccgggacacgaggaaccaattcctatggccacctacggctggaatctggttaaacttcattcaggcaaagatgtgtttttcatgcccccagagaagtgtgacacactgctatgcgatatcggggaatccagtcccaaccctactattgaggagggacgaaccctcagagtcctgaagatggtggaaccgtggttgaggggtaatcagttttgtatcaaaatactgaacccctacatgccaagcgtcgtggagacactcgaacaaatgcagcggaagcacggcgggatgcttgttcgcaatcctctgtctagaaactccactcacgagatgtattgggtatcatgcggaaccggcaacatcgtgagcgcggtcaatatgacatcgaggatgttactgaaccgattcaccatggctcatcggaaacccacttacgagcgtgacgtggatttgggtgcagggacgagacacgttgccgtggaacctgaggtcgctaatctcgacattatcggacagcgcattgaaaacatcaagaatgagcataaatctacatggcactatgatgaagacaacccatacaagacctgggcctatcacggcagttacgaggtgaagccctccggcagcgcatcatccatggtaaatggggtggttaggctgctaactaaaccttgggatgtcattccaatggtgacccaaatcgccatgacagacacgaccccctttggacagcagcgggtgttcaaggagaaagtcgacactagaacaccgcgcgctaagaggggtaccactcagataatggaagttacagcgaaatggctttggggctttctgtctcgaaacaagaagcctcggatttgtaccagagaggagttcacaaggaaagtgcgcagcaatgccgcaatcggggctgtatttgtggatgagaaccaatggaatagtgccaaggaagcagtcgaggacgagcgtttctgggatctcgtgcatcgggaaagagagctgcacaaacagggaaagtgcgccacttgcgtttataacatgatgggcaaaagggaaaagaagttgggtgagtttgggaaagctaagggatcccgcgccatctggtacatgtggctgggcgcgcgattcctcgagttcgaggcacttggctttatgaatgaggaccattggttcagccgggaaaactctctgtcaggggtggagggagaaggtttacacaaactgggctacattttgagagatataagtaagatcccagggggaaatatgtatgccgacgataccgctggctgggacacgaggattaccgaggatgacctccagaacgaggccaaaatcacagaaattatggagcccgaacatgcactgctagctacttccatctttaaacttacctaccagaacaaagtcgtgcgcgtacaaagacctgccaagaatggtacagttatggatgtgataagccggagggaccagcgtgggtctggacaggtcggcacttatggcctgaacaccttcacgaatatggaggtgcagctcatccgacaaatggaatcggaggggatttttctgccatcagagttggaaacacccaacttagctgagcgcgtgctggattggctcgaaaagcacggagccgagagacttaaacggatggcaatcagcggtgacgactgtgtcgttaagccgattgatgacaggttcgcgaccgccctgactgctctaaatgatatgggcaaagtgcgcaaggacatccctcagtgggaaccctccaaagggtggaacgattggcagcaggtaccattttgcagtcaccatttccaccaactgataatgaaggacggaagagagattgtggtcccttgtcggaatcaggatgagctcgtgggcagggcccgagtttctcagggtgcagggtggagcttgcgtgaaacagcttgcctgggaaagtcctacgcccaaatgtggcagcttatgtattttcatagacgcgacctgcggctcgcagccaacgcgatctgttcagctgtgcccgtcgattgggtgccaaccagtaggactacctggtctatccacgcccaccatcagtggatgacaacggaggacatgttaagcgtatggaatagagtttggattgaagagaacccctggatggaagataaaacccacgtgtcctcatgggaggaggtcccttacctgggcaagcgcgaagaccagtggtgcggcagcttgatagggctgactgcacgggccacatgggctaccaatatccaagtggccattaaccaggttaggcgactcatcggaaatgagaactatcttgactacatgacttctatgaaaagattcaagaatgaatccgatccagagggtgcactgtggtga

SEQ ID NO: 13394 - RNA, 9879 nt, synthetic construct
  misc_feature 1..9879: note = derived and/or modified CDS sequence (opt3) from DENV-1__EU482615__SS-prME
  source 1..9879: mol_type = other RNA
agcgtgaccatgctgctcatgcttctgcccacagccttggctttccacttaactacgagaggcggggagcctcatatgatcgtctccaagcaggaaaggggaaaatctctgctatttaagacctcagcaggtgttaacatgtgcacactcattgccatggacctgggcgagctttgtgaagatactatgacctacaaatgcccacaaataacagaggcggaaccggacgatgtggactgttggtgcaatgctaccgatacttgggtaacatatgggacctgtagtcagacgggagagcaccggcgcgacaagcgaagcgtggccctggcaccccatgtcggcttgggtctcgagactcgtaccgaaacatggatgtcctctgagggggcctggaaacagatccagagagtggaaacttgggctctgaggcaccctggattcaccgttattgcactgtttctcgcccatgctatcggcacatcgattacccaaaagggcatcatattcatcttactgatgcttgtgacgccatcaatggccatgcggtgcgtcgggattggaaaccgcgattttgtggagggtttgagcggcgcgacttgggtagacgttgtgctggagcacgggagttgtgtcacaaccatggcaaagaataaacccactctagatatcgaactcctgaagacagaggtgaccaaccctgccattcttagaaaactgtgcatcgaagctaagatatccaatacgaccacagactctaggtgtccaactcagggagaggccaccttggtggaagagcaggatgcaaacttcgtctgccggcgcacatttgttgaccgaggctggggtaatgggtgtggactcttcggcaaaggcagcctgttaacttgcgctaagtttaagtgcgtgaccaaactggaggggaagattgtacagtacgaaaacctcaaatattccgtgatcgtcacagtgcacaccggagatcaacatcaggttggtaatgagactacggaacacggcacaattgccaccatcactccccaggcgcctacctcagagatccagcttacagactacggggccctgaccttggactgtagtccaagaactggactagatttcaacgaaatggtgctgctcacaatgaaggagaaaagctggctggtccataagcaatggtttcttgacctgccgttgccctggacgtctggcgcatccacctcacaggagacttggaataggcaggatctcctggtgacattcaaaaccgctcacgccaagaagcaagaagtagttgtgttaggtagccaggagggggctatgcacacagccctgactggcgcaaccgaaattcagacgagtggaaccacaactatatttgccggccatctaaaatgccggctcaagatggacaaactgacccttaaggggacatcttatgtcatgtgtactggatccttcaaattggagaaggaagtggctgagacccagcacggtacggtcctggtgcaagttaagtacgagggcacagatgcgccttgcaaaatcccattcagcacccaggacgaaaagggggtgactcagaacggacgtctcattacagcaaatcccatcgtaaccgataaagagaagcctgtcaacatagaaactgagccaccctttggcgagtcgtatattgtggttggtgccggggaaaaagctctgaagctttcttggttcaagaaaggctcctcaatcggaaagatgtttgaggccaccgcacgcggcgccagaaggatggctatcctgggggacacagcctgggatttcggaagtattggtggcgtgtttacgagcgtcgggaaattggtgcatcaggtattcggaaccgcatacggcgtgctcttttccggtgtttcttggactatgaagatcgggattggcatactgttaacatggctgggactaaatagccggtcaaccagtctctccatgacatgtatcgcggtcggcatggtgactctgtaccttggggtgatggtccaagctgacagcggatgcgttattaactggaaaggccgagaattgaagtgtggttctgggatcttcgtgaccaacgaggtgcacacgtggacagaacagtataagtttcaggccgattcaccgaaacgcctgagtgcagccatcggaaaggcttgggaggagggcgtatgcggtattagaagcgccaccaggctcgaaaatataatgtggaaacagatctccaacgagctgaatcatattttactggaaaacgacatgaagttcactgtcgtggttggcgacgcaaatgggatccttgctcaaggaaaaaagatgattcggcctcagcccatggagcacaaatactcttggaagtcgtggggcaaggccaaaatcataggggcggatatccagaacaccacatttattatcgacggaccagatactcctgaatgtcccgacaatcagcgcgcctggaacatttgggaggtggaggattatggcttcggtatctttaccacaaatatatggttgaagctcagagacagctacacgcaaatgtgcgatcacaggctgatgtccgctgcaattaaagactcaaaggccgtccatgctgatatggggtattggatcgaaagtgagaaaaacgaaacctggaagctagcccgtgcatctttcattgaggtgaagacttgtacatggccaaaaagccacaccctgtggtccaatggagttctcgaatcagagatgatcatacccaagatctacggcggtcctattagccagcataactatcggccaggctacttcactcagacagcggggccgtggcacctgggaaaacttgagttggactttgatctgtgcgaaggcaccacggtggtagtcgacgagcactgcgggaatcgaggaccctctttaagaactaccacagtgaccggcaagatcattcatgaatggtgttgcaggtcctgtactctccctccactgcgcttccggggtgaggatgggtgctggtacggaatggagatcagacccgtgaaagaaaaggaggaaaaccttgtcaggagtatggttagcgccggctctggtgaggtggactccttttcactgggcatattgtgtgctagtattatgatcgaagaggtaatgcgcagccgatggtcgcggaagatgctcatgacagggaccctggccgtgttcctactgctcatcatgggacaactgacatggaatgaccttattcgtttgtgcatcatggtcggcgcaaacgcttccgatagaatggggatgggaactacctatctggccttaatggcaacgtttaaaatgaggcctatgttcgccgtgggcctcctgtttcgccggcttacatctagagaggttctgctactcaccattggtctgagcttggtggcttcagtcgaactgccaaacagtttagaggaactcggggacggactggcgatgggcataatgatgcttaagctgttgactgagttccagccccaccagctctggaccacactgctatccctgacttttatcaaaaccacgctttctctcgattacgcctggaagacaaccgcaatggctctgagcattgtgtccttgttcccgctgtgtttatcaactacaagccagaaaaccacttggctccctgttctgcttggcagttttgggtgcaagccactgacaatgttcttgatcaccgaaaataagatttggggaaggaaatcttggcccctcaacgagggtatcatggccataggcatcgtgtccattctgctaagctcgctgcttaagaatgacgtccctctcgccgggcccctgatcgctggaggcatgttgattgcatgttatgtaatctcaggttctagtgccgatttatccctggagaaagcggctgaagtgagctgggagcaagaagccgagcattctgggacgagccacaacatactcgttgaagtgcaggacgatggaactatgaagattaaagacgaggagcgagatgacaccctgacaatccttctgaaggcaaccttgctagccgtctccggcgtgtacccaatgtcaatccctgctacactgtttgtatggtatttctggcagaaaaagaagcagcgcagtggcgtgctctgggatactcccagcccaccggaagtcgagcgggcagttctggacgatgggatttacagaatacttcaaaggggattactgggtcgttctcaggtgggcgtgggggtcttccaggacggagtgtttcataccatgtggcacgttacgcgcggcgccgtactcatgtatcagggtaaacggttggaaccttcctgggcgtcagtgaagaaagacctgatcagttacgggggaggctggagattccaaggcagctggaatacaggggaggaggtccaggtgattgctgttgaacccggaaagaacccaaaaaatgtgcagactacccccggtacatttaagacccctgagggcgaagtcggggccatcgcactcgatttcaagccaggaacttccggctctcccattgtgaacagggagggtaaaatcgtagggctgtacggaaatggcgtcgtgaccacatcgggcacgtatgttagcgccatagctcaagccaaggcatcacaggaagggcctcttccggagatcgaggacgaagtgtttaaaaagcgaaacctgactattatggatttgcacccaggatccggtaaaacccggcgctacctacccgctatcgtcagagaggccattaagaggaagctgcggacactcatcttagcgcctacccgagtggttgccagtgaaatggcagaggctctgaaaggcatgccaataagatatcagactacagccgtgaagtctgaacataccgggcgcgagattgtcgaccttatgtgccacgctacgttcactatgaggctgctcagccccgtgcgtgtacctaattacaacatgatcatcatggatgaggcacattttacagacccggcctccattgccgctcggggatatatctcaaccagagtgggcatgggtgaagcggcagccatattcatgaccgctactcccccagggtctgttgaggcctttcctcagagcaatgcagtcattcaagatgaagagagggacatccccgaacgcagttggaactccggatacgattggattacagacttcccaggcaaaaccgtgtggtttgtgcctagcatcaagtctggcaatgatatagccaactgtttgcgaaaaaacgggaagagagtcattcagctgtcacggaagacattcgacactgagtatcagaaaacgaagaataacgactgggattacgtagtgaccacagacatctccgagatgggagctaatttcagggcggatcgcgttatcgacccccgtagatgcctcaaaccagtgattctgaaggatggtccggaacgggtcatccttgccggccctatgcccgtgactgttgcaagtgctgcccagaggcgcgggcgaattggaagaaaccaaaataaagagggcgaccagtacgtgtatatgggtcagccactaaacaatgatgaagaccacgcacattggaccgaggccaagatgctgttggataacataaatacacccgaggggatcattcctgctttatttgaaccagagcgggaaaagagcgccgcgatcgacggcgagtacaggctgcgcggagaagcaagaaaaaccttcgtcgagctcatgaggcggggcgatctgcccgtgtggctttcgtataaggtagcctctgaggggtttcagtactccgaccgtcgctggtgcttcgatggagaacgaaacaatcaagtgctggaggaaaacatggacgttgagatctggactaaagaaggtgagagaaagaaactcaggcctcggtggttggacgctcgcacgtatagcgatccgctggccctaagagagtttaaggaattcgctgcaggcaggcggtcagtcagtggggacctgattctcgagataggaaaacttccacagcacctgaccttacgagcccagaatgctttggataacctggtgatgctccacaattctgaacagggcggtaaggcctacagacatgcaatggaggaactgcccgacacaatcgagactcttatgctgctcgcgttgattgccgtgctgaccgggggcgtcacattatttttcctatccggaaagggcctggggaaaaccagcatcggactcctttgtgttactgcttcaagtgccctgttgtggatggcaagcgtggagcctcactggattgctgcctccatcatactggaatttttcctcatggtactgcttatccccgagccagatcgccaaaggacacctcaggacaaccagctcgcatatgtggtcattggtctgttgtttatgatcctgacggtggccgctaacgaaatgggcttactagagaccactaagaaagatctggggattggacatgttgcggccgagaatcaccaacacgcaacaatgctcgacgtggatcttcggcccgcttctgcctggaccctgtacgccgtcgcaaccacagtaatcactccaatgatgcgtcatacgatagaaaacaccacagctaatattagcttgactgccatcgcgaaccaggctgccattctgatgggcctcgacaagggttggcctatctccaaaatggatataggggtgccgctgcttgcattaggctgctactcacaggttaatcccctgaccctcacagccgctgtgttgatgctggtcgcacactatgccatcattggaccaggcctacaggcgaaggctaccagagaggcccaaaagaggactgcagccgggatcatgaaaaaccctacggtggacggaattgtcgctatcgatctggaccccgtggtttacgacgccaagttcgaaaaacagctcggccagataatgcttctgattttgtgtacatctcagatcctgctcatgcgcaccacttgggcactgtgcgagagtatcaccttagctacaggtccacttactaccctgtgggaagggtcgcctggaaagttttggaatacaacgattgccgtgagcatggcgaacatcttccggggctcctatctcgccggtgcaggcctagctttctctctgatgaaatcattggggggaggccgaagagggaccggagcccaaggcgagactctgggtgagaagtggaagaggcagctcaatcagcttagcaaatccgaatttaacacatacaagcgcagtgggataatggaggtagatcggtctgaagcaaaagagggactgaagagaggcgaaaccactaaacatgctgtgagccgtggtacagccaagttgaggtggttcgtcgagcggaatctggttaagcccgagggcaaagtgattgacctcgggtgtggacgcggcgggtggtcatattactgcgccggattaaagaaagtcaccgaagtgaagggctatacgaaaggtgggccgggacacgaggaaccaatccctatggcgacctacggctggaacctggtaaagcttcattccggcaaagatgtgtttttcatgcccccagagaagtgtgacacactgctatgcgatattggggaaagtagccccaatcctactatcgaggagggacgaaccctcagagttctgaagatggtggaaccgtggttgaggggtaaccagttttgtataaaaatcctgaatccctacatgccatctgtcgtggagacactcgaacaaatgcagcggaagcacggcgggatgcttgtccgcaaccctctgtccagaaattcaactcacgagatgtattgggtgagctgcggaaccggcaacattgtttcggctgtaaacatgacatctaggatgttactgaatcgattcaccatggcacatcggaaacccacttacgagcgtgacgtggatttgggtgccgggacgagacacgtcgctgtggaacctgaggttgccaacctcgacatcattggacagcgcatcgaaaatattaagaacgagcataaaagtacatggcactatgatgaagacaatccatacaagacctgggcatatcacggctcctacgaggtgaagcccagcggctcagcctcctctatggtcaacggggtggtaaggctgctaactaaaccttgggatgtgatcccaatggttacccaaatagctatgacagacacgaccccctttggacagcagcgggtcttcaaggagaaagtggacactagaacaccgcgcgcgaagaggggtaccactcagattatggaagtgacagccaaatggctttggggctttctgagccgaaataagaagcctcggatctgtaccagagaggaattcacaaggaaagtccgcagtaacgcagctatcggggccgtttttgtggatgagaatcaatggaactccgcaaaggaagccgtagaggacgagcgtttctgggatctcgtgcatcgggaaagagagctgcacaaacagggaaagtgcgctacttgcgtctataatatgatgggcaaaagggaaaagaagttgggtgagtttgggaaagccaagggaagccgcgcgatttggtacatgtggctgggcgcacgattcctcgaattcgaggcccttggctttatgaacgaggaccattggttctctcgggaaaattcactgagtggggtggagggagaaggtttacacaaactgggctacatattgagagatatctccaagattccagggggaaacatgtatgctgacgataccgccggctgggacacgaggatcaccgaggatgacctccagaatgaggcaaaaattacagatatcatggaacccgagcatgctctgctagccactagcatatttaagcttacctaccagaacaaagttgtgcgcgtccaaagacctgctaagaacggtacagtgatggacgtaatctctcggagggatcagcgtgggtcgggacaggttggcacttatggcctgaataccttcacgaacatggaagtgcagctcattcgacaaatggagtcagaagggatctttctgccaagcgagttggagacacccaatttagccgaacgcgtcctggactggctcgagaagcacggagcagaaagacttaaacggatggcgatttccggtgacgattgtgtggtgaagccgatcgacgataggttcgccaccgctctgactgccctaaacgacatgggcaaagtccgcaaggatatacctcagtgggagcccagtaaagggtggaatgactggcagcaggttccattttgctctcaccatttccaccaactgattatgaaggatggaagagaaatcgtggtaccttgtcggaaccaggacgagctcgtgggcagggcacgagtcagccagggtgctgggtggtccttgcgtgagacagcctgcctgggaaagtcatacgcacaaatgtggcagcttatgtattttcatagacgcgatctgcggctcgccgcgaatgctatctgtagtgccgtgcccgttgactgggtgccaacctctaggactacctggagcattcacgcacaccatcagtggatgacaacggaagatatgttatccgtctggaacagagtgtggatagaggaaaatccctggatggaggacaaaacccacgtatcaagctgggaagaggttccttacctgggcaagcgcgaggaccagtggtgcggctctttgatcgggctgactgcccgggctacatgggccaccaacattcaagtggcaatcaatcaggtcaggcgactcattggaaacgaaaattatcttgattacatgacttccatgaaaagattcaagagtgagagcgacccagaaggtgctctgtggtga

SEQ ID NO: 13395 - RNA, 9879 nt, synthetic construct
  misc_feature 1..9879: note = derived and/or modified CDS sequence (opt3) from DENV-1__EU482616__SS-prME
  source 1..9879: mol_type = other RNA
agcgtgaccatgctgctcatgcttctgcccacagcattggctttccacttaactacgagaggaggggaacctcatatgatcgtcaacaagcaggaaaggggaaaatccctgttatttaagacctctgccggtgttaatatgtgcacactcattgccatggacctgggcgaactttgtgaagatactatgacctacaaatgcccacaaataacagaagcggaaccggacgatgtggactgttggtgcaacgctaccgatacttgggtaacatatgggacctgttcacagacgggagagcaccggcgcgacaagcgaagtgtggccctggcaccccatgtcggcttgggtctcgagactcgtaccgaaacatggatgagctccgagggggcctggaaacagatccagagagtggaaacttgggctctgaggcaccctggattcaccgttattgcactgtttctcgcccatgctatcggcacatctattacccaaaagggcatcatattcatcttactgatgcttgtgacgccatcgatggccatgcggtgcgtcgggattggaaatcgcgattttgtggagggtttgtcaggcgcgacttgggtagacgttgtgctggagcacgggagctgtgtcacaaccatggcaaagaacaaacccactttggatatcgaactcctgaagacagaggtgaccaatcctgccattcttagaaaactgtgcatcgaagctaagataagtaacacgaccacagactccaggtgtccaactcagggagaggccaccttggtggaagaacaggatgcaaatttcgtctgccggcgcacatttgttgaccgaggctggggtaacgggtgtggactcttcggcaaaggctctctgttaacttgcgctaagtttaagtgcgtgaccaaactggaggggaagattgtacagtacgaaaatctcaaatatagcgtgatcgtcacagtgcacaccggagatcaacatcaggttggtaacgagactacggaacacggcacaattgccaccatcactccccaggcgcctacctccgagatccagcttacagactacggggccctgaccttggactgttcaccaagaactggactagatttcaatgaaatggtgctgctcacaatgaaggagaaaagttggctggtccataagcaatggtttcttgacctgccgttgccctggacgagcggcgcatctacctcccaggagacttggaacaggcaggatctcctggtgacattcaaaaccgctcacgccaagaagcaagaagtagttgtgttaggttcacaggagggggctatgcacacagccctgactggcgcaaccgaaattcagacgagcggaaccacaactatatttgccggccatctaaaatgccggctcaagatggacaaactgacccttaaggggacaagttatgtcatgtgtactggatctttcaaattggagaaggaagtggctgagacccagcacggtacggtcctggtgcaagttaagtacgagggcacagatgcgccttgcaaaatcccattctccacccaggacgaaaagggggtgactcagaatggacgtctcattacagcaaaccccatcgtaaccgataaagagaagcctgtcaatatagaaactgagccaccctttggcgagagctatattgtggttggtgccggggaaaaagctctgaaactttcgtggttcaagaaaggatcttccatcggaaagatgtttgaggccaccgcacgcggcgccagaaggatggctatcctgggggacacagcctgggatttcggatcaattggtggcgtgtttacgagtgtcgggaaattggtgcatcaggtattcggaaccgcatacggcgtgctctttagcggtgtttcctggactatgaagatcgggattggcatactgttaacatggctgggactaaactctcggagcacctcactcagtatgacatgtatcgcggtcggcatggtgactctgtaccttggggtgatggtccaagctgactccggatgcgttattaactggaaaggccgagaattgaagtgtggtagcgggatcttcgtgaccaatgaggtgcacacgtggacagaacagtataagtttcaggccgattctccgaaacgcctgtcagcagccatcggaaaggcttgggaggagggcgtatgcggtattagaagtgccaccaggctcgaaaacataatgtggaaacagatcagcaatgagctgaaccatattttactggaaaatgacatgaagttcactgtcgtggttggcgacgcaaacgggatccttgctcaaggcaagaagatgattcggcctcagcccatggagcacaaatactcctggaagtcttggggcaaggccaaaatcataggggcggatatccagaataccacatttattatcgacggaccagatactcctgaatgtcccgacgatcagcgcgcctggaacatttgggaggtggaggactatggcttcggtatctttaccacaaatatatggttgaagctcagagattcgtacacgcaaatgtgcgaccacaggctgatgagcgctgcaattaaagattccaaggccgtccatgctgacatggggtattggatcgaatcagagaaaaacgaaacctggaagctagcccgtgcaagtttcattgaggtgaagacttgtacatggccaaaatctcacaccctgtggagcaatggagttctcgaatccgagatgatcatacccaagatctacggcggtcctatttcacagcataactatcggccaggctacttcactcagacagcggggccgtggcacctgggaaaacttgagttggattttgacctgtgcgaaggcaccacggtggtagtcgatgagcactgcgggaatcgaggacccagcttaagaactaccacagtgaccggcaagatcattcatgaatggtgttgcaggtcttgtactctccctccactgcgcttccggggtgaggacgggtgctggtacggaatggagatcagacccgtgaaagaaaaggaggaaaaccttgtcaggtccatggttagtgccggcagcggtgaggtggactctttttccctgggcatattgtgtgcttcaattatgatcgaagaggtaatgcgcagtcgatggagccggaagatgctcatgacagggaccctggccgtgttcctactgctcatcatgggacaactgacatggaatgatcttattcgtttgtgcatcatggtcggcgcaaacgcttcggacagaatggggatgggaactacctatctggccttaatggcaacgtttaaaatgaggcctatgttcgccgtgggcctcctgtttcgccggcttacatccagagaggttctgctactcaccattggtctgtctttggtggctagcgtcgaactgccaaactcattagaggaactcggggatggactggcgatgggcataatgatgcttaagctgttgactgagttccagccccaccagctctggaccacactgctaagtctgacttttatcaaaaccacgctttccctcgactacgcctggaagacaaccgcaatggctctgtctattgtgagcttgttcccgctgtgtttatccactacatcacagaaaaccacttggctccctgttctgcttggcagctttgggtgcaagccactgacaatgttcttgatcaccgaaaataagatttggggaaggaaaagttggcccctcaacgagggtatcatggccataggcatcgtgtctattctgctatccagcctgcttaagaatgatgtccctctcgccgggcccctgatcgctggaggcatgttgattgcatgttatgtaatctcgggttcatctgccgacttaagtctggagaaagcggctgaagtgtcctgggagcaagaagccgagcatagcgggacgtctcacaacatactcgttgaagtgcaggatgacggaactatgaagattaaagatgaggagaaggacgataccctgacaatccttctgaaagcaaccttgctagccgtcagcggcgtgtacccaatgtccatccctgctacactgtttgtatggtatttctggcagaagaagaaacagcgatcaggcgtgctctgggacactcccagtccaccggaagtcgagcgcgcagttctggatgacgggatttaccggatacttcaaagaggattactgggtaggagccaggtgggcgtgggggtcttccaggacggagtgtttcataccatgtggcacgttacgcgtggcgccgtactcatgtatcagggtaagcgcttggaaccttcttgggcgtccgtgaaaaaggatctgatctcatacgggggaggctggcggttccaaggcagttggaatacaggggaggaggtccaggtgattgctgttgaacccggcaagaacccaaagaatgtgcagactacccccggtacatttaagacccctgagggcgaagtcggggccatcgcactcgacttcaaaccaggaactagcggctcccccattgtgaacagagagggtaagatcgtagggctgtacggaaatggcgtcgtgaccacatctggcacgtatgtttcggccatagctcaagccaaagcaagccaggaagggcctcttccggagatcgaggatgaagtgtttaagaaaaggaacctgactattatggacttgcacccaggatcaggtaagacccgacggtacctacccgctatcgtccgcgaggccattaagagaaaactgaggacactcatcttagcgcctacccgggtggttgcctccgaaatggcagaggctctgaagggcatgccaatacgatatcagactacagccgtgaaaagtgaacataccgggagagagattgtcgatcttatgtgccacgctacgttcactatgcgcctgctctctcccgtgagggtacctaattacaacatgatcatcatggacgaggcacattttacagatccggccagcattgccgctcgtggatatatctccacccgggtgggcatgggtgaagcggcagccatattcatgaccgctactcccccagggtcagttgaggcctttcctcagtctaatgcagtcattcaagacgaagagagagatatccccgaaaggagctggaacagtggatacgactggattacagatttcccaggcaagaccgtgtggtttgtgccttccatcaaaagcggcaatgacatagccaactgtttgcgcaagaacgggaagcgagtcattcagctgtctagaaaaacattcgacactgagtatcagaagacgaaaaataacgattgggactacgtagtgaccacagatatctcagagatgggagctaatttccgggcggacagggttatcgatccccgccgttgcctcaagccagtgattctgaaagacggtccggaaagagtcatccttgccggccctatgcccgtgactgttgcatccgctgcccagcggagggggcgcattggacgaaaccaaaataaggagggcgatcagtacgtgtatatgggtcagccactaaacaatgacgaagatcacgcacattggaccgaggccaagatgctgttggacaacataaatacacccgaggggatcattcctgctttatttgaaccagagagagagaaaagtgccgcgatcgatggcgagtaccggctgaggggagaagcacgcaagaccttcgtcgagctcatgagaaggggcgacctgcccgtgtggcttagctataaagtagcctcggaggggtttcagtactctgatcggcgttggtgcttcgacggagaacgcaacaatcaagtgctggaggaaaacatggacgttgagatctggactaaggaaggtgagaggaaaaagctcagacctagatggttggatgctcggacgtattccgacccgctggccctacgcgagtttaaagagttcgctgcaggcagaaggagcgtctcaggggatctgattctcgagataggaaaacttccacagcacctgaccttacgggcccagaatgctttggacaacctggtgatgctccacaatagtgaacagggcggtaaggcctaccgacatgcaatggaggaactgcccgatacaatcgagactcttatgctgctcgcgttgattgccgtgctgaccgggggcgtcacattatttttcctatctggaaaaggcctggggaagacctccatcggactcctttgtgttactgctagctcagccctgttgtggatggcaagtgtggagcctcactggattgctgccagcatcatactggaatttttcctcatggtactgcttatccccgagccagacagacaacgcacacctcaggataaccagctcgcatatgtggtcattggtctgttgtttatgatcctgacggtggccgctaacgaaatgggcttactagagaccactaaaaaggacctggggattggacatgttgcggccgagaatcaccaacacgcaacaatgctcgatgtggaccttaggcccgcttccgcctggaccctgtacgccgtcgcaaccacagtaatcactccaatgatgcggcatacgatagaaaacaccacagctaatatttctttgactgccatcgcgaaccaggctgccattctgatgggcctcgataaaggttggcctatcagcaagatggacataggggtgccgctgcttgcattaggctgctactcccaggttaatcccctgaccctcacagccgctgtgttgatgctggtcgcacactatgccatcattggaccaggcctacaggcgaaggctacccgtgaggcccaaaaacgaactgcagccgggatcatgaagaaccctacggtggatggaattgtcgctatcgacctggaccccgtggtttacgatgccaaattcgaaaagcagctcggccagataatgcttctgattttgtgtacatcacagatcctgctcatgaggaccacttgggcactgtgcgagtctatcaccttagctacaggtccacttactaccctgtgggaagggagtcctggaaaattttggaatacaacgattgccgtgtcgatggcgaacatcttccgcggcagctatctcgccggtgcaggcctagctttctccctgatgaagtctctagggggaggccggcgagggaccggagcccaaggcgagactctgggtgagaagtggaaaagacagctcaatcagctttcaaagagcgaatttaacacatacaaaaggtccgggataatggaggtagaccgcagtgaagcaaaggagggactgaaacggggcgaaaccactaagcatgctgtgtctagaggtacagccaagttgcgttggttcgtcgagaggaatctggttaaacccgagggcaaggtgattgatctcgggtgtggacggggcgggtggagctattactgcgccggactgaaaaaggtcaccgaagtgaaaggctatacgaagggtgggccgggacacgaggaaccaatccctatggcgacctacggctggaacctagtaaaacttcattcaggcaaggacgtgtttttcatgcccccagagaagtgtgatacactgctatgcgacattggggaatccagtcccaatcctactatcgaggagggacgcaccctccgagttctgaaaatggtggaaccgtggttgagaggtaaccagttttgtataaagatcctgaatccctacatgccaagcgtcgtggagacactcgaacaaatgcagaggaaacacggcgggatgcttgtccggaaccctctgtctcgcaattccactcacgagatgtattgggtgtcatgcggaaccggcaacattgttagcgctgtaaacatgacatcgagaatgttactgaataggttcaccatggcacatcgaaagcccacttacgagcgggatgtggacttgggtgccgggacgcgtcacgtcgctgtggaacctgaggttgccaacctcgatatcattggacagagaatcgaaaatattaaaaacgagcataagtctacatggcactatgacgaagataatccatacaagacctgggcatatcacggcagttacgaggtgaaaccctccggcagcgcctcatccatggtcaacggggtggtacgcctgctaactaagccttgggacgtgatcccaatggttacccaaatagctatgacagacacgaccccctttggacagcagagggtcttcaaagagaaggtggatactcggacaccgagagcgaaacgcggtaccactcagattatggaagtgacagccaagtggctttggggctttctgtctaggaataagaaacctcgaatctgtacccgggaggagttcacaagaaaggtcaggagcaacgcagctatcggggccgtttttgtggacgagaatcaatggaacagtgcaaaagaagccgtagaggatgagcgcttctgggacctcgtgcatcgtgaacgggagctgcacaagcagggaaaatgcgctacttgcgtctataatatgatgggcaagagagaaaagaaattgggtgagtttgggaaggccaaaggatccagggcgatttggtacatgtggctgggcgcacgcttcctcgagttcgaggcccttggctttatgaacgaggatcattggttcagccgagaaaattctctgtcaggggtggagggagaaggtttacacaagctgggctacatattgcgggacatcagtaaaattccagggggaaacatgtatgctgatgacaccgccggctgggatacgagaatcaccgaggacgatctccagaatgaggcaaagattacagacatcatggaacccgagcatgctctgctagccacttccatatttaaacttacctaccagaacaaggttgtgagggtccaacgccctgctaagaacggtacagtgatggatgtaatcagcagacgggaccagagggggtctggacaggttggcacttatggcctgaataccttcacgaacatggaagtgcagctcattcgtcaaatggagtcggaagggatctttctgccatcagagttggagacacccaatttagccaaacgagtcctggactggctcgaaaagcacggagcagagcgccttaaaagaatggcgattagcggtgatgactgtgtggtgaagccgatcgatgaccggttcgccaccgctctgactgccctaaacgatatgggcaaagtcaggaaggacatacctcagtgggaaccctccaaggggtggaatgattggcagcaggttccattttgcagtcaccatttccaccaactgattatgaaagacggacgcgagatcgtggtaccttgtagaaaccaggatgaactcgtgggccgggcaagggtctctcagggtgctgggtggagcttgcgagagacagcctgcctgggaaagtcctacgcacaaatgtggcagcttatgtattttcatcgtagagacctgcgcctcgccgcgaatgctatctgttcagccgtgcccgttgattgggtgccaaccagtcggactacctggtctattcacgcacaccatcagtggatgacaacggaggacatgttaagcgtctggaacagggtgtggatagaagagaatccctggatggaagacaaaacccacgtatcctcatgggaggaagttccttacctgggcaagagagaggatcagtggtgcggcagcttgatcgggctgactgcccgcgctacatgggccaccaacattcaagtggcaatcaatcaggtccggaggctcattggaaacgagaattatcttgactacatgacttctatgaaacgattcaagaacgaatccgatccagagggtgctctgtggtga

SEQ ID NO: 13396 - RNA, 9879 nt, synthetic construct
  misc_feature 1..9879: note = derived and/or modified CDS sequence (opt3) from DENV-1__EU482618__SS-prME
  source 1..9879: mol_type = other RNA
agcgtgaccatgctgctcatgcttctgcccacagccttggctttccacttaactacgagaggcggggagcctcatatgatcgtctccaagcaggaaaggggaaaatctctgctatttaagacctcagcaggtgttaacatgtgcacactcattgccatggacctgggcgagctttgtgaagatactatgacctacaaatgcccacaaataacagaggcggaaccggacgatgtggactgttggtgcaatgctaccgatacttgggtaacatatgggacctgtagtcagacgggagagcaccggcgcgacaagcgaagcgtggccctggcaccccatgtcggcttgggtctcgagactcgtaccgaaacatggatgtcctctgagggggcctggaaacagatccagagagtggaaacttgggctctgaggcaccctggattcaccgttattgcactgtttctcgcccatgctatcggcacatcgattacccaaaagggcatcatattcatcttactgatgcttgtgacgccatcaatggccatgcggtgcgtcgggattggaaaccgcgattttgtggagggtttgagcggcgcgacttgggtagacgttgtgctggagcacgggagttgtgtcacaaccatggcaaagaataaacccactctagatatcgaactcctgaagacagaggtgaccaaccctgccattcttagaaaactgtgcatcgaagctaagatatccaatacgaccacagactctaggtgtccaactcagggagaggccaccttggtggaagagcaggatgcaaacttcgtctgccggcgcacatttgttgaccgaggctggggtaatgggtgtggactcttcggcaaaggcagcctgttaacttgcgctaagtttaagtgcgtgaccaaactggaggggaagattgtacagtacgaaaacctcaaatattccgtgatcgtcacagtgcacaccggagatcaacatcaggttggtaatgagactacggaacacggcacaattgccaccatcactccccaggcgcctacctcagagatccagcttacagactacggggccctgaccttggactgtagtccaagaactggactagatttcaacgaaatggtgctgctcacaatgaaggagaaaagctggctggtccataagcaatggtttcttgacctgccgttgccctggacgtctggcgcatccacctcacaggagacttggaataggcaggatctcctggtgacattcaaaaccgctcacgccaagaagcaagaagtagttgtgttaggtagccaggagggggctatgcacacagccctgactggcgcaaccgaaattcagacgagtggaaccacaactatatttgccggccatctaaaatgccggctcaagatggacaaactgacccttaaggggacatcttatgtcatgtgtactggatccttcaaattggagaaggaagtggctgagacccagcacggtacggtcctggtgcaagttaagtacgagggcacagatgcgccttgcaaaatcccattcagcacccaggacgaaaagggggtgactcagaacggacgtctcattacagcaaatcccatcgtaaccgataaagagaagcctgtcaacatagaaactgagccaccctttggcgagtcgtatattgtggttggtgccggggaaaaagctctgaagctttcttggttcaagaaaggctcctcaatcggaaagatgtttgaggccaccgcacgcggcgccagaaggatggctatcctgggggacacagcctgggatttcggaagtattggtggcgtgtttacgagcgtcgggaaattggtgcatcaggtattcggaaccgcatacggcgtgctcttttccggtgtttcttggactatgaagatcgggattggcatactgttaacatggctgggactaaatagccggtcaaccagtctctccatgacatgtatcgcggtcggcatggtgactctgtaccttggggtgatggtccaagctgacagcggatgcgttattaactggaaaggccgagaattgaagtgtggttctgggatcttcgtgaccaacgaggtgcacacgtggacagaacagtataagtttcaggccgattcaccgaaacgcctgagtgcagccatcggaaaggcttgggaggagggcgtatgcggtattagaagcgccaccaggctcgaaaatataatgtggaaacagatctccaacgagctgaatcatattttactggaaaacgacatgaagttcactgtcgtggttggcgacgcaaatgggatccttgctcaaggaaaaaagatgattcggcctcagcccatggagcacaaatactcttggaagtcgtggggcaaggccaaaatcataggggcggatatccagaacaccacatttattatcgacggaccagatactcctgaatgtcccgacaatcagcgcgcctggaacatttgggaggtggaggattatggcttcggtatctttaccacaaatatatggttgaagctcagagacagctacacgcaaatgtgcgatcacaggctgatgtccgctgcaattaaagactcaaaggccgtccatgctgatatggggtattggatcgaaagtgagaaaaacgaaacctggaagctagcccgtgcatctttcattgaggtgaagacttgtacatggccaaaaagccacaccctgtggtccaatggagttctcgaatcagagatgatcatacccaagatctacggcggtcctattagccagcataactatcggccaggctacttcactcagacagcggggccgtggcacctgggaaaacttgagttggactttgatctgtgcgaaggcaccacggtggtagtcgacgagcactgcgggaatcgaggaccctctttaagaactaccacagtgaccggcaagatcattcatgaatggtgttgcaggtcctgtactctccctccactgcgcttccggggtgaggatgggtgctggtacggaatggagatcagacccgtgaaagaaaaggaggaaaaccttgtcaggagtatggttagcgccggctctggtgaggtggactccttttcactgggcatattgtgtgctagtattatgatcgaagaggtaatgcgcagccgatggtcgcggaagatgctcatgacagggaccctggccgtgttcctactgctcatcatgggacaactgacatggaatgaccttattcgtttgtgcatcatggtcggcgcaaacgcttccgatagaatggggatgggaactacctatctggccttaatggcaacgtttaaaatgaggcctatgttcgccgtgggcctcctgtttcgccggcttacatctagagaggttctgctactcaccattggtctgagcttggtggcttcagtcgaactgccaaacagtttagaggaactcggggacggactggcgatgggcataatgatgcttaagctgttgactgagttccagccccaccagctctggaccacactgctatccctgacttttatcaaaaccacgctttctctcgattacgcctggaagacaaccgcaatggctctgagcattgtgtccttgttcccgctgtgtttatcaactacaagccagaaaaccacttggctccctgttctgcttggcagttttgggtgcaagccactgacaatgttcttgatcaccgaaaataagatttggggaaggaaatcttggcccctcaacgagggtatcatggccataggcatcgtgtccattctgctaagctcgctgcttaagaatgacgtccctctcgccgggcccctgatcgctggaggcatgttgattgcatgttatgtaatctcaggttctagtgccgatttatccctggagaaagcggctgaagtgagctgggagcaagaagccgagcattctgggacgagccacaacatactcgttgaagtgcaggacgatggaactatgaagattaaagacgaggagcgagatgacaccctgacaatccttctgaaggcaaccttgctagccgtctccggcgtgtacccaatgtcaatccctgctacactgtttgtatggtatttctggcagaaaaagaagcagcgcagtggcgtgctctgggatactcccagcccaccggaagtcgagcgggcagttctggacgatgggatttacagaatacttcaaaggggattactgggtcgttctcaggtgggcgtgggggtcttccaggacggagtgtttcataccatgtggcacgttacgcgcggcgccgtactcatgtatcagggtaaacggttggaaccttcctgggcgtcagtgaagaaagacctgatcagttacgggggaggctggagattccaaggcagctggaatacaggggaggaggtccaggtgattgctgttgaacccggaaagaacccaaaaaatgtgcagactacccccggtacatttaagacccctgagggcgaagtcggggccatcgcactcgatttcaagccaggaacttccggctctcccattgtgaacagggagggtaaaatcgtagggctgtacggaaatggcgtcgtgaccacatcgggcacgtatgttagcgccatagctcaagccaaggcatcacaggaagggcctcttccggagatcgaggacgaagtgtttaaaaagcgaaacctgactattatggatttgcacccaggatccggtaaaacccggcgctacctacccgctatcgtcagagaggccattaagaggaagctgcggacactcatcttagcgcctacccgagtggttgccagtgaaatggcagaggctctgaaaggcatgccaataagatatcagactacagccgtgaagtctgaacataccgggcgcgagattgtcgaccttatgtgccacgctacgttcactatgaggctgctcagccccgtgcgtgtacctaattacaacatgatcatcatggatgaggcacattttacagacccggcctccattgccgctcggggatatatctcaaccagagtgggcatgggtgaagcggcagccatattcatgaccgctactcccccagggtctgttgaggcctttcctcagagcaatgcagtcattcaagatgaagagagggacatccccgaacgcagttggaactccggatacgattggattacagacttcccaggcaaaaccgtgtggtttgtgcctagcatcaagtctggcaatgatatagccaactgtttgcgaaaaaacgggaagagagtcattcagctgtcacggaagacattcgacactgagtatcagaaaacgaagaataacgactgggattacgtagtgaccacagacatctccgagatgggagctaatttcagggcggatcgcgttatcgacccccgtagatgcctcaaaccagtgattctgaaggatggtccggaacgggtcatccttgccggccctatgcccgtgactgttgcaagtgctgcccagaggcgcgggcgaattggaagaaaccaaaataaagagggcgaccagtacgtgtatatgggtcagccactaaacaatgatgaagaccacgcacattggaccgaggccaagatgctgttggataacataaatacacccgaggggatcattcctgctttatttgaaccagagcgggaaaagagcgccgcgatcgacggcgagtacaggctgcgcggagaagcaagaaaaaccttcgtcgagctcatgaggcggggcgatctgcccgtgtggctttcgtataaggtagcctctgaggggtttcagtactccgaccgtcgctggtgcttcgatggagaacgaaacaatcaagtgctggaggaaaacatggacgttgagatctggactaaagaaggtgagagaaagaaactcaggcctcggtggttggacgctcgcacgtatagcgatccgctggccctaagagagtttaaggaattcgctgcaggcaggcggtcagtcagtggggacctgattctcgagataggaaaacttccacagcacctgaccttacgagcccagaatgctttggataacctggtgatgctccacaattctgaacagggcggtaaggcctacagacatgcaatggaggaactgcccgacacaatcgagactcttatgctgctcgcgttgattgccgtgctgaccgggggcgtcacattatttttcctatccggaaagggcctggggaaaaccagcatcggactcctttgtgttactgcttcaagtgccctgttgtggatggcaagcgtggagcctcactggattgctgcctccatcatactggaatttttcctcatggtactgcttatccccgagccagatcgccaaaggacacctcaggacaaccagctcgcatatgtggtcattggtctgttgtttatgatcctgacggtggccgctaacgaaatgggcttactagagaccactaagaaagatctggggattggacatgttgcggccgagaatcaccaacacgcaacaatgctcgacgtggatcttcggcccgcttctgcctggaccctgtacgccgtcgcaaccacagtaatcactccaatgatgcgtcatacgatagaaaacaccacagctaatattagcttgactgccatcgcgaaccaggctgccattctgatgggcctcgacaagggttggcctatctccaaaatggatataggggtgccgctgcttgcattaggctgctactcacaggttaatcccctgaccctcacagccgctgtgttgatgctggtcgcacactatgccatcattggaccaggcctacaggcgaaggctaccagagaggcccaaaagaggactgcagccgggatcatgaaaaaccctacggtggacggaattgtcgctatcgatctggaccccgtggtttacgacgccaagttcgaaaaacagctcggccagataatgcttctgattttgtgtacatctcagatcctgctcatgcgcaccacttgggcactgtgcgagagtatcaccttagctacaggtccacttactaccctgtgggaagggtcgcctggaaagttttggaatacaacgattgccgtgagcatggcgaacatcttccggggctcctatctcgccggtgcaggcctagctttctctctgatgaaatcattggggggaggccgaagagggaccggagcccaaggcgagactctgggtgagaagtggaagaggcagctcaatcagcttagcaaatccgaatttaacacatacaagcgcagtgggataatggaggtagatcggtctgaagcaaaagagggactgaagagaggcgaaaccactaaacatgctgtgagccgtggtacagccaagttgaggtggttcgtcgagcggaatctggttaagcccgagggcaaagtgattgacctcgggtgtggacgcggcgggtggtcatattactgcgccggattaaagaaagtcaccgaagtgaagggctatacgaaaggtgggccgggacacgaggaaccaatccctatggcgacctacggctggaacctggtaaagcttcattccggcaaagatgtgtttttcatgcccccagagaagtgtgacacactgctatgcgatattggggaaagtagccccaatcctactatcgaggagggacgaaccctcagagttctgaagatggtggaaccgtggttgaggggtaaccagttttgtataaaaatcctgaatccctacatgccatctgtcgtggagacactcgaacaaatgcagcggaagcacggcgggatgcttgtccgcaaccctctgtccagaaattcaactcacgagatgtattgggtgagctgcggaaccggcaacattgtttcggctgtaaacatgacatctaggatgttactgaatcgattcaccatggcacatcggaaacccacttacgagcgtgacgtggatttgggtgccgggacgagacacgtcgctgtggaacctgaggttgccaacctcgacatcattggacagcgcatcgaaaatattaagaacgagcataaaagtacatggcactatgatgaagacaatccatacaagacctgggcatatcacggctcctacgaggtgaagcccagcggctcagcctcctctatggtcaacggggtggtaaggctgctaactaaaccttgggatgtgatcccaatggttacccaaatagctatgacagacacgaccccctttggacagcagcgggtcttcaaggagaaagtggacactagaacaccgcgcgcgaagaggggtaccactcagattatggaagtgacagccaaatggctttggggctttctgagccgaaataagaagcctcggatctgtaccagagaggaattcacaaggaaagtccgcagtaacgcagctatcggggccgtttttgtggatgagaatcaatggaactccgcaaaggaagccgtagaggacgagcgtttctgggatctcgtgcatcgggaaagagagctgcacaaacagggaaagtgcgctacttgcgtctataatatgatgggcaaaagggaaaagaagttgggtgagtttgggaaagccaagggaagccgcgcgatttggtacatgtggctgggcgcacgattcctcgaattcgaggcccttggctttatgaacgaggaccattggttctctcgggaaaattcactgagtggggtggagggagaaggtttacacaaactgggctacatattgagagatatctccaagattccagggggaaacatgtatgctgacgataccgccggctgggacacgaggatcaccgaggatgacctccagaatgaggcaaaaattacagatatcatggaacccgagcatgctctgctagccactagcatatttaagcttacctaccagaacaaagttgtgcgcgtccaaagacctgctaagaacggtacagtgatggacgtaatctctcggagggatcagcgtgggtcgggacaggttggcacttatggcctgaataccttcacgaacatggaagtgcagctcattcgacaaatggagtcagaagggatctttctgccaagcgagttggagacacccaatttagccgaacgcgtcctggactggctcgagaagcacggagcagaaagacttaaacggatggcgatttccggtgacgattgtgtggtgaagccgatcgacgataggttcgccaccgctctgactgccctaaacgacatgggcaaagtccgcaaggatatacctcagtgggagcccagtaaagggtggaatgactggcagcaggttccattttgctctcaccatttccaccaactgattatgaaggatggaagagaaatcgtggtaccttgtcggaaccaggacgagctcgtgggcagggcacgagtcagccagggtgctgggtggtccttgcgtgagacagcctgcctgggaaagtcatacgcacaaatgtggcagcttatgtattttcatagacgcgatctgcggctcgccgcgaatgctatctgtagtgccgtgcccgttgactgggtgccaacctctaggactacctggagcattcacgcacaccatcagtggatgacaacggaagatatgttatccgtctggaacagagtgtggatagaggaaaatccctggatggaggacaaaacccacgtatcaagctgggaagaggttccttacctgggcaagcgcgaggaccagtggtgcggctctttgatcgggctgactgcccgggctacatgggccaccaacattcaagtggcaatcaatcaggtcaggcgactcattggaaacgaaaattatcttgattacatgacttccatgaaaagattcaagaacgagagtgacccagaaggtgctctgtggtga

SEQ ID NO: 13397 - RNA, 9879 nt, synthetic construct
  misc_feature 1..9879: note = derived and/or modified CDS sequence (opt3) from DENV-1__EU482619__SS-prME
  source 1..9879: mol_type = other RNA
agcgtgaccatgctgctcatgcttctgcccacagccttggctttccacttaactacgagaggcggggagcctcatatgatcgtctccaagcaggaaaggggaaaatctctgctatttaagacctcagcaggtgttaacatgtgcacactcattgccatggacctgggcgagctttgtgaagatactatgacctacaaatgcccacaaataacagaggcggaaccggacgatgtggactgttggtgcaatgctaccgatacttgggtaacatatgggacctgtagtcagacgggagagcaccggcgcgacaagcgaagcgtggccctggcaccccatgtcggcttgggtctcgagactcgtaccgaaacatggatgtcctctgagggggcctggaaacagatccagagagtggaaacttgggctctgaggcaccctggattcaccgttattgcactgtttctcgcccatgctatcggcacatcgattacccaaaagggcatcatattcatcttactgatgcttgtgacgccatcaatggccatgcggtgcgtcgggattggaaaccgcgattttgtggagggtttgagcggcgcgacttgggtagacgttgtgctggagcacgggagttgtgtcacaaccatggcaaagaataaacccactctagatatcgaactcctgaagacagaggtgaccaaccctgccattcttagaaaactgtgcatcgaagctaagatatccaatacgaccacagactctaggtgtccaactcagggagaggccaccttggtggaagagcaggatgcaaacttcgtctgccggcgcacatttgttgaccgaggctggggtaatgggtgtggactcttcggcaaaggcagcctgttaacttgcgctaagtttaagtgcgtgaccaaactggaggggaagattgtacagtacgaaaacctcaaatattccgtgatcgtcacagtgcacaccggagatcaacatcaggttggtaatgagactacggaacacggcacaattgccaccatcactccccaggcgcctacctcagagatccagcttacagactacggggccctgaccttggactgtagtccaagaactggactagatttcaacgaaatggtgctgctcacaatgaaggagaaaagctggctggtccataagcaatggtttcttgacctgccgttgccctggacgtctggcgcatccacctcacaggagacttggaataggcaggatctcctggtgacattcaaaaccgctcacgccaagaagcaagaagtagttgtgttaggtagccaggagggggctatgcacacagccctgactggcgcaaccgaaattcagacgagtggaaccacaactatatttgccggccatctaaaatgccggctcaagatggacaaactgacccttaaggggacatcttatgtcatgtgtactggatccttcaaattggagaaggaagtggctgagacccagcacggtacggtcctggtgcaagttaagtacgagggcacagatgcgccttgcaaaatcccattcagcacccaggacgaaaagggggtgactcagaacggacgtctcattacagcaaatcccatcgtaaccgataaagagaagcctgtcaacatagaaactgagccaccctttggcgagtcgtatattgtggttggtgccggggaaaaagctctgaagctttcttggttcaagaaaggctcctcaatcggaaagatgtttgaggccaccgcacgcggcgccagaaggatggctatcctgggggacacagcctgggatttcggaagtattggtggcgtgtttacgagcgtcgggaaattggtgcatcaggtattcggaaccgcatacggcgtgctcttttccggtgtttcttggactatgaagatcgggattggcatactgttaacatggctgggactaaatagccggtcaaccagtctctccatgacatgtatcgcggtcggcatggtgactctgtaccttggggtgatggtccaagctgacagcggatgcgttattaactggaaaggccgagaattgaagtgtggttctgggatcttcgtgaccaacgaggtgcacacgtggacagaacagtataagtttcaggccgattcaccgaaacgcctgagtgcagccatcggaaaggcttgggaggagggcgtatgcggtattagaagcgccaccaggctcgaaaatataatgtggaaacagatctccaacgagctgaatcatattttactggaaaacgacatgaagttcactgtcgtggttggcgacgcaaatgggatccttgctcaaggaaaaaagatgattcggcctcagcccatggagcacaaatactcttggaagtcgtggggcaaggccaaaatcataggggcggatatccagaacaccacatttattatcgacggaccagatactcctgaatgtcccgacaatcagcgcgcctggaacatttgggaggtggaggattatggcttcggtatctttaccacaaatatatggttgaagctcagagacagctacacgcaaatgtgcgatcacaggctgatgtccgctgcaattaaagactcaaaggccgtccatgctgatatggggtattggatcgaaagtgagaaaaacgaaacctggaagctagcccgtgcatctttcattgaggtgaagacttgtacatggccaaaaagccacaccctgtggtccaatggagttctcgaatcagagatgatcatacccaagatctacggcggtcctattagccagcataactatcggccaggctacttcactcagacagcggggccgtggcacctgggaaaacttgagttggactttgatctgtgcgaaggcaccacggtggtagtcgacgagcactgcgggaatcgaggaccctctttaagaactaccacagtgaccggcaagatcattcatgaatggtgttgcaggtcctgtactctccctccactgcgcttccggggtgaggatgggtgctggtacggaatggagatcagacccgtgaaagaaaaggaggaaaaccttgtcaggagtatggttagcgccggctctggtgaggtggactccttttcactgggcatattgtgtgctagtattatgatcgaagaggtaatgcgcagccgatggtcgcggaagatgctcatgacagggaccctggccgtgttcctactgctcatcatgggacaactgacatggaatgaccttattcgtttgtgcatcatggtcggcgcaaacgcttccgatagaatggggatgggaactacctatctggccttaatggcaacgtttaaaatgaggcctatgttcgccgtgggcctcctgtttcgccggcttacatctagagaggttctgctactcaccattggtctgagcttggtggcttcagtcgaactgccaaacagtttagaggaactcggggacggactggcgatgggcataatgatgcttaagctgttgactgagttccagccccaccagctctggaccacactgctatccctgacttttatcaaaaccacgctttctctcgattacgcctggaagacaaccgcaatggctctgagcattgtgtccttgttcccgctgtgtttatcaactacaagccagaaaaccacttggctccctgttctgcttggcagttttgggtgcaagccactgacaatgttcttgatcaccgaaaataagatttggggaaggaaatcttggcccctcaacgagggtatcatggccataggcatcgtgtccattctgctaagctcgctgcttaagaatgacgtccctctcgccgggcccctgatcgctggaggcatgttgattgcatgttatgtaatctcaggttctagtgccgatttatccctggagaaagcggctgaagtgagctgggagcaagaagccgagcattctgggacgagccacaacatactcgttgaagtgcaggacgatggaactatgaagattaaagacgaggagcgagatgacaccctgacaatccttctgaaggcaaccttgctagccgtctccggcgtgtacccaatgtcaatccctgctacactgtttgtatggtatttctggcagaaaaagaagcagcgcagtggcgtgctctgggatactcccagcccaccggaagtcgagcgggcagttctggacgatgggatttacagaatacttcaaaggggattactgggtcgttctcaggtgggcgtgggggtcttccaggacggagtgtttcataccatgtggcacgttacgcgcggcgccgtactcatgtatcagggtaaacggttggaaccttcctgggcgtcagtgaagaaagacctgatcagttacgggggaggctggagattccaaggcagctggaatacaggggaggaggtccaggtgattgctgttgaacccggaaagaacccaaaaaatgtgcagactacccccggtacatttaagacccctgagggcgaagtcggggccatcgcactcgatttcaagccaggaacttccggctctcccattgtgaacagggagggtaaaatcgtagggctgtacggaaatggcgtcgtgaccacatcgggcacgtatgttagcgccatagctcaagccaaggcatcacaggaagggcctcttccggagatcgaggacgaagtgtttaaaaagcgaaacctgactattatggatttgcacccaggatccggtaaaacccggcgctacctacccgctatcgtcagagaggccattaagaggaagctgcggacactcatcttagcgcctacccgagtggttgccagtgaaatggcagaggctctgaaaggcatgccaataagatatcagactacagccgtgaagtctgaacataccgggcgcgagattgtcgaccttatgtgccacgctacgttcactatgaggctgctcagccccgtgcgtgtacctaattacaacatgatcatcatggatgaggcacattttacagacccggcctccattgccgctcggggatatatctcaaccagagtgggcatgggtgaagcggcagccatattcatgaccgctactcccccagggtctgttgaggcctttcctcagagcaatgcagtcattcaagatgaagagagggacatccccgaacgcagttggaactccggatacgattggattacagacttcccaggcaaaaccgtgtggtttgtgcctagcatcaagtctggcaatgatatagccaactgtttgcgaaaaaacgggaagagagtcattcagctgtcacggaagacattcgacactgagtatcagaaaacgaagaataacgactgggattacgtagtgaccacagacatctccgagatgggagctaatttcagggcggatcgcgttatcgacccccgtagatgcctcaaaccagtgattctgaaggatggtccggaacgggtcatccttgccggccctatgcccgtgactgttgcaagtgctgcccagaggcgcgggcgaattggaagaaaccaaaataaagagggcgaccagtacgtgtatatgggtcagccactaaacaatgatgaagaccacgcacattggaccgaggccaagatgctgttggataacataaatacacccgaggggatcattcctgctttatttgaaccagagcgggaaaagagcgccgcgatcgacggcgagtacaggctgcgcggagaagcaagaaaaaccttcgtcgagctcatgaggcggggcgatctgcccgtgtggctttcgtataaggtagcctctgaggggtttcagtactccgaccgtcgctggtgcttcgatggagaacgaaacaatcaagtgctggaggaaaacatggacgttgagatctggactaaagaaggtgagagaaagaaactcaggcctcggtggttggacgctcgcacgtatagcgatccgctggccctaagagagtttaaggaattcgctgcaggcaggcggtcagtcagtggggacctgattctcgagataggaaaacttccacagcacctgaccttacgagcccagaatgctttggataacctggtgatgctccacaattctgaacagggcggtaaggcctacagacatgcaatggaggaactgcccgacacaatcgagactcttatgctgctcgcgttgattgccgtgctgaccgggggcgtcacattatttttcctatccggaaagggcctggggaaaaccagcatcggactcctttgtgttactgcttcaagtgccctgttgtggatggcaagcgtggagcctcactggattgctgcctccatcatactggaatttttcctcatggtactgcttatccccgagccagatcgccaaaggacacctcaggacaaccagctcgcatatgtggtcattggtctgttgtttatgatcctgacggtggccgctaacgaaatgggcttactagagaccactaagaaagatctggggattggacatgttgcggccgagaatcaccaacacgcaacaatgctcgacgtggatcttcggcccgcttctgcctggaccctgtacgccgtcgcaaccacagtaatcactccaatgatgcgtcatacgatagaaaacaccacagctaatattagcttgactgccatcgcgaaccaggctgccattctgatgggcctcgacaagggttggcctatctccaaaatggatataggggtgccgctgcttgcattaggctgctactcacaggttaatcccctgaccctcacagccgctgtgttgatgctggtcgcacactatgccatcattggaccaggcctacaggcgaaggctaccagagaggcccaaaagaggactgcagccgggatcatgaaaaaccctacggtggacggaattgtcgctatcgatctggaccccgtggtttacgacgccaagttcgaaaaacagctcggccagataatgcttctgattttgtgtacatctcagatcctgctcatgcgcaccacttgggcactgtgcgagagtatcaccttagctacaggtccacttactaccctgtgggaagggtcgcctggaaagttttggaatacaacgattgccgtgagcatggcgaacatcttccggggctcctatctcgccggtgcaggcctagctttctctctgatgaaatcattggggggaggccgaagagggaccggagcccaaggcgagactctgggtgagaagtggaagaggcagctcaatcagcttagcaaatccgaatttaacacatacaagcgcagtgggataatggaggtagatcggtctgaagcaaaagagggactgaagagaggcgaaaccactaaacatgctgtgagccgtggtacagccaagttgaggtggttcgtcgagcggaatctggttaagcccgagggcaaagtgattgacctcgggtgtggacgcggcgggtggtcatattactgcgccggattaaagaaagtcaccgaagtgaagggctatacgaaaggtgggccgggacacgaggaaccaatccctatggcgacctacggctggaacctggtaaagcttcattccggcaaagatgtgtttttcatgcccccagagaagtgtgacacactgctatgcgatattggggaaagtagccccaatcctactatcgaggagggacgaaccctcagagttctgaagatggtggaaccgtggttgaggggtaaccagttttgtataaaaatcctgaatccctacatgccatctgtcgtggagacactcgaacaaatgcagcggaagcacggcgggatgcttgtccgcaaccctctgtccagaaattcaactcacgagatgtattgggtgagctgcggaaccggcaacattgtttcggctgtaaacatgacatctaggatgttactgaatcgattcaccatggcacatcggaaacccacttacgagcgtgacgtggatttgggtgccgggacgagacacgtcgctgtggaacctgaggttgccaacctcgacatcattggacagcgcatcgaaaatattaagaacgagcataaaagtacatggcactatgatgaagacaatccatacaagacctgggcatatcacggctcctacgaggtgaagcccagcggctcagcctcctctatggtcaacggggtggtaaggctgctaactaaaccttgggatgtgatcccaatggttacccaaatagctatgacagacacgaccccctttggacagcagcgggtcttcaaggagaaagtggacactagaacaccgcgcgcgaagaggggtaccactcagattatggaagtgacagccaaatggctttggggctttctgagccgaaataagaagcctcggatctgtaccagagaggaattcacaaggaaagtccgcagtaacgcagctatcggggccgtttttattgatgagaatcaatggaactccgcaaaggaagccgtggaggacgagcgtttctgggatctcgtacatcgggaaagagagctgcacaaacagggaaagtgcgctacttgcgtgtataatatgatgggcaaaagggaaaagaagttgggtgagtttgggaaagccaagggaagccgcgcgatatggtacatgtggctgggcgcacgattcctcgaattcgaggcccttggctttatgaacgaggaccattggttctctcgggaaaattcactgagtggggtcgagggagaaggtttacacaaactgggctacatcttgagagatatttccaagatcccagggggaaacatgtatgctgacgataccgccggctgggacacgagggtgaccgaggatgacctccagaatgaggcaaaaattacagatatcatggaacccgagcatgctctgctagccactagcatatttaagcttacctaccagaacaaagttgtgcgcgtccaaagacctgctaagaacggtacagtgatggacgtaatctctcggagggatcagcgtgggtcgggacaggttggcacttatggcctgaataccttcacgaacatggaagtgcagctcattcgacaaatggagtcagaagggatctttctgccaagcgagttggagacacccaatttagccgaacgcgtcctggactggctcgagaagcacggagcagaaagacttcggaggatggcgatttccggtgacgattgtgtggtgaaaccgatcgacgatcgcttcgccaccgctctgactgccctaaacgacatgggcaaggtcagaaaagatatacctcagtgggagcccagtaaggggtggaatgactggcagcaggttccattttgctctcaccatttccaccaactgattatgaaagatggacgggaaatcgtggtaccttgtaggaaccaggacgagctcgtgggccgagcacgtgtcagccagggtgctgggtggtccttgagagagacagcctgcctgggaaagtcatacgcacaaatgtggcagcttatgtattttcatcgccgggatctgaggctcgccgcgaatgctatctgtagtgccgtgcccgttgactgggtgccaacctctagaactacctggagcattcacgcacaccatcagtggatgacaacggaagatatgttatccgtctggaaccgcgtgtggatagaggaaaatccctggatggaggacaagacccacgtatcaagctgggaagaggttccttacctgggcaaacgggaggaccagtggtgcggctctttgatcgggctgactgccagggctacatgggccaccaacattcaagtggcaatcaatcaggtccgaagactcattggaaacgaaaattatcttgattacatgacttccatgaagcggttcaaaaacgagagtgacccagaaggtgctctgtggtga

SEQ ID NO: 13398 - RNA, 9879 nt, synthetic construct
  misc_feature 1..9879: note = derived and/or modified CDS sequence (opt3) from DENV-1__FJ898433__SS-prME
  source 1..9879: mol_type = other RNA
agcgtgaccatgctgctcatgcttctgcccacagccttggctttccacttaactacgagaggaggggagcctcatatgatcgtctccaagcaggaaagaggaaaatctctgctgtttaagacctcagctggtgttaacatgtgcacactcattgccatggacctgggagagctttgtgaagatactatgacctacaaatgcccacagataacagaggcggaaccggacgatgtggactgttggtgcaatgctaccgatacttgggtaacatatgggacctgtagtcagacgggagagcaccggcgcgagaagcgaagcgtggccctggctccccatgtcggcttgggtctcgaaactcgtaccgagacatggatgtcctctgaaggggcctggaaacagatccagagagtggagacttgggctctgagacaccctggattcaccgttacagcactgtttctcgcccatgctattggcacctcgatcacgcaaaagggcattatcttcatattactgatgcttgtgactccatcaatggccatgcggtgcgtcgggatcggaaaccgcgactttgtggagggtttgagcggcgcgacatgggttgatgttgtgctggaacacgggagttgtgtcaccactatggcaaagaataaacccacactagacattgagctcctgaagaccgaagtgacgaaccctgccatccttagaaaactgtgcattgaggctaagatctccaataccacaactgattctaggtgtccaacccagggagaagccacattggtggaggagcaggacgcaaacttcgtctgccggcgcacttttgttgatcgaggctggggtaatgggtgtggactcttcggcaaaggcagcctgttaacctgcgctaagtttaagtgcgtgacaaaactggaagggaagatagtacagtacgagaacctcaaatattccgtgattgtcaccgtgcacactggagaccaacatcaggttggtaatgaaacgacagagcacggcaccatcgccactattacaccccaggcgcctacatcagaaatccagcttaccgattacggggccctgactttggactgtagtccaagaacaggactagacttcaacgagatggtgctgctcacgatgaaggagaaaagctggctggtccataagcaatggtttcttgatctgccgttgccctggacctctggcgcatccacttcacaggaaacatggaataggcaggacctcctggtgaccttcaaaacagctcacgccaagaagcaagaggtagttgtgttaggtagccaggaaggggctatgcacactgccctgaccggcgcaacggagatccagaccagtggaacaactaccatttttgccggccatctaaaatgccggctcaagatggataaactgacacttaaggggacttcttatgtcatgtgtaccggatccttcaaattggaaaaggaggtggctgagacgcagcacggtacagtcctggtgcaagttaagtacgaaggcaccgacgcgccttgcaaaataccattcagcactcaggatgagaagggggtgacacagaacggacgtctcatcaccgcaaatcccattgtaactgacaaagaaaagcctgtcaacatcgagaccgagccaccctttggcgaatcgtatatagtggttggtgccggggagaaagctctgaaactttcttggttcaagaaaggctcctcaattggaaagatgtttgaagccacagcacgcggcgccagaaggatggctatcctgggggatacggcctgggacttcggaagtatcggtggcgtgtttaccagcgtcgggaaattggtgcatcaggtattcggaactgcatacggcgtgctcttttccggtgtttcttggacaatgaagattgggatcggcattctgttaacctggctgggactaaatagccggtcaacaagtctctccatgacttgtatagcggtcggcatggtgaccctgtaccttggggtgatggtccaagctgatagcggatgcgttatcaactggaaaggccgagagttgaagtgtggttctgggattttcgtgacgaacgaagtgcacacatggaccgagcagtataagtttcaggccgactcaccgaaacgcctgagtgcagccatcggaaaggcttgggaggaaggcgtatgcggtatcagaagcgccactaggctcgagaatattatgtggaaacagatatccaacgaactgaatcatatcttactggagaacgatatgaagttcaccgtcgtggttggcgacgcaaatgggattcttgctcaaggcaagaagatgatccggcctcagcccatggaacacaaatactcttggaagtcgtggggcaaggccaaaattatcggggcggacatacagaacacaacttttatcattgatggaccagacacccctgagtgtcccgataatcagcgcgcctggaacatctgggaggtggaagactatggcttcggtatttttacaacgaatatctggttgaagctcagagatagctacacccaaatgtgcgaccacaggctgatgtccgctgcaataaaagattcaaaggccgtccatgctgacatggggtattggattgagagtgagaagaacgagacttggaagctagcccgtgcatctttcatcgaagtgaagacatgtacctggccaaaaagccacactctgtggtccaatggagttctcgagtcagagatgattatccccaagatatacggcggtcctatcagccagcataactatcggccaggctacttcacacagaccgcggggccgtggcacctgggaaaacttgaattggattttgactcttgcgagggcacgactgtggtagtcgatgaacactgcgggaatcgaggaccctccctgagaaccacaaccgtgactggcaagattatccatgagtggtgttgcaggagttgtacattacctccactccgcttccggggtgaggacgggtgctggtacggaatggaaattagacccgtgaaagagaaggaagagaacctggtcaggagcatggtttctgccggctccggtgaagtggattcatttagtcttggcatcctgtgtgtaagcataatgattgaggaggtgatgcgctcgcgatggtcccggaagatgttgatgaccgggacactcgctgtcttcctgctactgatcatgggacaactcacttggaaagacctgatccgtctttgcattatggtgggcgccaatgcatctgacagaatggggatgggaaccacgtatttggctctgatggccacatttaagatgaggcctatgttcgcagttggcttactctttcgccggctgaccagcagagaagtgcttctgctaactatcggtctctcactggtcgccagtgtggagttgccaaactccctggaagagttaggggatggactcgctatgggcattatgatgctgaaacttctgaccgagttccacccccatcagttgtggacaactctcctgtctctaacctttataaagacgacactgagccttgactacgcgtggaaaaccactgccatggcactctccatcgtttcactgttcccgttgtgtctgagcacaaccagtcagaagactacatggttacctgtgctcctgggctcttttgggtgcaagccacttaccatgttcctgattacggagaacaaaatctggggaaggaagtcctggcccttgaatgagggtattatggctatcggcatagtcagcatcctcctgtcgtcactactgaaaaacgatgtacctcttgccgggcccctcattgccggaggcatgctgatcgcttgttatgtgatttctggtagttccgcagacttgagcttagaaaaggccgcggaggtttcttgggaacaggaggctgaacacagcgggacttcccataatatcctggtggaggtccaagatgacggaaccatgaaaataaaggatgaggaacgagacgatacactcaccattctgcttaaagccacactgttggcagtgtcaggcgtatacccaatgagtatccctgccactctatttgtgtggtatttctggcagaagaagaaacagcgcagcggcgtcctgtgggacaccccctctccaccggaggttgaacgggctgtgctcgatgacgggatctacaggattctgcagaggggacttttaggtcgttcccaagtgggcgtcggggtgttccaggatggagtttttcacacgatgtggcacgtaacacgcggcgcagtgctgatgtatcagggtaagcggctcgagccttcatgggccagtgtcaaaaaggacttgataagctacgggggaggctggagattccagggctcctggaacactggggaggaagtgcaagttatcgcggtggagcccggcaaaaatccaaagaacgtccagaccacacccggtacctttaagactcctgaaggcgaggtgggggctattgccctggacttcaaaccaggaacctctggctcgcccatcgtaaatagggaaggtaagattgtcgggctctacggaaacggcgtggttacaacgagcggcacttatgtgtcagcaatcgcccaggctaaagcctcccaagaggggcctctgccggagatagaagatgaggtctttaagaaacgaaatcttaccatcatggacctgcatccaggaagtggtaagacacggcgctacttgcccgcaattgtgagagaagctatcaagaggaaactacggaccctgattctcgcccctactcgagttgtggcgtctgagatggccgaagcattaaagggcatgccaatcagatatcagacaaccgctgtcaaaagcgagcacacggggcgcgagatagtggatctgatgtgccatgccactttcacaatgaggcttctgtcccccgtacgtgtgcctaactacaatatgattatcatggacgaagctcactttaccgatccggcatcaatcgccgcccggggatatatttctaccagagttggcatgggtgaggctgcggcaatcttcatgactgccacacccccagggagcgtcgaagcctttcctcagagtaacgccgtgatacaggacgaggaaagggatattcccgagcgctcctggaatagcggatacgactggatcaccgatttcccaggcaagacagtgtggtttgtcccttctattaaatcaggcaacgacatcgcaaattgtctccgaaagaacgggaagagagtaatacaattgtcccggaaaactttcgatacggagtatcagaagaccaaaaacaatgactgggactacgtggttacaactgatattagtgaaatgggagccaacttcagggctgaccgcgtgatcgatccccgtagatgcctgaagccagtcatcctcaaagacggtccggagcgggtgattctggcgggccctatgcccgttaccgtggccagcgcagctcagaggcgcgggcgaatcggaagaaatcagaacaaggaaggcgatcaatacgtctatatgggtcagccacttaataacgacgaggatcatgcccactggacagaggcaaagatgctactggacaatattaacacccccgaagggataatccctgccttgtttgagccagaacgggagaaatcggctgccattgatggcgaatacaggttacgcggagaggcgagaaagactttcgtggagctgatgaggcggggcgacctccccgtatggctgtcttataaagtggcatccgaagggtttcagtacagcgatcgtcgctggtgcttcgacggagagcgaaataaccaggttcttgaagagaatatggatgtcgaaatctggacgaaggagggtgagaggaaaaagctgaggcctcggtggctcgacgcccgcacctattcagacccgttggctctgagagaatttaaagagttcgccgctggcaggcggagtgtgtctggggatctaatcctggaaattggaaagctcccacaacaccttacactgcgagcacagaacgccttagacaatttggtgatgctgcataactccgagcagggcggtaaggcttacagacacgccatggaagaactccccgatactatagagaccctgatgcttctggcactcatcgcggtcttgacagggggcgttaccctgtttttcttaagcggaaaaggcctagggaagacttcaattggactgctctgtgtgacagccagtagcgcacttctgtggatggcctccgtagaacctcattggatcgcagcttctattatcttggagtttttcctgatggtgctcctgatacccgaaccagaccgccagaggacgcctcaagataatcagcttgcctatgtcgtgatcggtctcctgtttatgattttgaccgttgcagccaacgagatgggcctgttagagactaccaaaaaggacctagggatcggacacgtggctgcggaaaaccaccagcatgccaccatgctggatgtcgacctccggcccgcaagcgcttggaccctttacgccgtagccacaactgtgattacgccaatgatgcgtcacaccatcgagaatacaactgcaaacatatccctgaccgctattgccaatcaagcggctatcttgatgggcctggataaaggttggcctatttcaaagatggacatcggggttccgctcctggcccttggctgctactctcaggtgaaccccttaacactgaccgcagccgtcctcatgttggtggctcattatgcaataatcggaccaggcctgcaggccaaggcgactagagaagctcagaaaaggacggccgcagggattatgaagaatcctacagtcgatggaatcgtggccattgacctagatcccgttgtgtacgacgctaaattcgagaagcaactgggccagatcatgctccttatactgtgtaccagtcagattttgctgatgcgcactacctgggccctctgcgaatcgatcacactggcaactggtccattaaccacactttgggaggggagccctggaaaattttggaacacgaccatcgctgtatccatggccaatattttccggggctcttatctggcgggtgccggcctcgcattctcactaatgaaaagcctagggggaggccgaagagggactggagctcagggcgagacattgggtgaaaagtggaaaaggcaactgaaccagctctccaagagtgagtttaatacctacaaacgctctgggatcatggaagtggaccggagcgaggccaaggaaggacttaaaagaggcgagactacaaagcacgcagtctcacgtggtaccgctaagctgaggtggttcgttgagcggaacttggtgaaacccgaaggcaaggtcatagatctggggtgtggacgcggcgggtggtcctattactgcgccggactcaaaaaggtgacggaggtaaaaggctataccaagggtgggccgggacatgaagaaccaattcctatggccacatacggctggaatttagtgaaactgcacagtggcaaggacgtatttttcatgcccccagaaaagtgtgatactcttctgtgcgacatcggggagagctctcccaaccctaccattgaggaaggacgaacactaagagtgctcaaaatggtcgagccgtggctgaggggtaatcagttttgtatcaagatattgaacccctacatgccatccgtggtcgaaactctggagcagatgcaacggaaacacggcgggatgctcgtgcgcaatcctctttcaagaaacagcacccatgagatgtattgggtttcgtgcggaacaggcaatatcgtatctgcggtgaacatgaccagtaggatgctgttaaaccgattcactatggctcaccggaagcccacgtacgaaaaagatgtcgacctgggtgcagggacacgtcatgtggccgttgagcctgaagtggctaatttggatattatcggacagagaattgagaacatcaagaatgaacacaagtccacctggcactatgacgaggataacccatacaaaacttgggcctatcatggcagctacgaggtcaagccctcaggctccgcatctagcatggtgaatggggtagtgcgcctcctgaccaaaccttgggacgttattccaatggtcacacagatcgccatgacggataccactccctttggacaacagagggtgttcaaggaaaaagtggacacacggaccccgagagctaagcgcggtactacacagataatggaggtcaccgcgaagtggctatggggctttcttagtaggaacaaaaagcctcgaatttgtacacgggaagagttcactagaaaagttaggtccaatgccgcaatcggggctgtgtttgtagacgaaaaccagtggaatagcgccaaggaggcagtggaggatgaacgcttctgggacctggtccaccgtgagcgggaactccataaacaaggaaagtgcgcaacctgcgtgtataacatgatgggcaagagagagaaaaagctgggtgaatttgggaaagctaagggatctagggccatctggtacatgtggttgggcgcgcgcttcctggagttcgaggcactcggctttatgaatgaagatcactggttctcacgagagaacagtctttccggggttgaaggagagggtctgcataaattaggctacattctgcgggacataagcaagatcccagggggaaatatgtatgccgatgacacggctggctgggataccagaattacagaggacgatttgcagaacgaagccaaaatcactgacattatggagcccgaacacgcactcctggctacctctatctttaagctaacataccagaataaggtggtcagggtgcagcgccctgccaaaaacggtactgtaatggatgttatatcgagacgggaccaaagggggtcaggacaggtgggcacctatggccttaacacgttcacaaatatggaggtccagctgatccgtcagatggaaagcgaggggatttttctcccatccgagctggaaacccccaacttggctgagcgagtgttagattggctgggaaagcacggtgccgaacgcctcaaaagaatggcaatcagtggcgacgactgtgtggtcaagccgattgatgaccggttcgcgactgcccttacagctctgaatgatatggggaaagttaggaaggacatccctcaatgggagccctctaagggatggaacgattggcaacaggtgccattttgcagccatcacttccatcagctaataatgaaagacggccgcgaaattgtagtgccttgtagaaatcaagatgagctggtcggtcgggccagggtgtcccagggggcaggatggtcactcaaggagaccgcttgcttgggcaaaagttacgcccagatgtggcaactgatgtattttcaccgacgtgaccttagactggcagccaacgcgatctgttctgctgttcccgtggattgggtcccaactagccgcaccacatggtccatccacgcccatcaccagtggatgacgaccgaagacatgctctcagtgtggaatcgggtatggattgaggaaaacccctggatggaggataagactcatgttagctcttgggaagaggtgccttacttaggcaaaagggaggaccagtggtgcgggtccctgataggattgacagcaagagccacctgggctactaatatccaggtcgccattaaccaagtgcgccggctgatcggtaatgaaaactatctcgactacatgacaagtatgaagaggttcaagaatgagagcgatccagaaggcgcactttggtga

SEQ ID NO: 13399 - RNA, 9879 nt, synthetic construct
  misc_feature 1..9879: note = derived and/or modified CDS sequence (opt3) from DENV-1__FJ547088__SS-prME
  source 1..9879: mol_type = other RNA
agcgtgaccatgctgctcatgcttctgcccacagccttggctttccacttaactacgagaggcggggagcctcatatgatcgtctccaagcaggaaaggggaaaatctctgctatttaagacctcagcaggtgttaacatgtgcacactcattgccatggacctgggcgagctttgtgaagatactatgacctacaaatgcccacaaataacagaggcggaaccggacgatgtggactgttggtgcaatgctaccgatacttgggtaacatatgggacctgtagtcagacgggagagcaccggcgcgacaagcgaagcgtggccctggcaccccatgtcggcttgggtctcgagactcgtaccgaaacatggatgtcctctgagggggcctggaaacagatccagagagtggaaacttgggctctgaggcaccctggattcaccgttattgcactgtttctcgcccatgctatcggcacatcgattacccaaaagggcatcatattcatcttactgatgcttgtgacgccatcaatggccatgcggtgcgtcgggattggaaaccgcgattttgtggagggtttgagcggcgcgacttgggtagacgttgtgctggagcacgggagttgtgtcacaaccatggcaaagaataaacccactctagatatcgaactcctgaagacagaggtgaccaaccctgccattcttagaaaactgtgcatcgaagctaagatatccaatacgaccacagactctaggtgtccaactcagggagaggccaccttggtggaagagcaggatgcaaacttcgtctgccggcgcacatttgttgaccgaggctggggtaatgggtgtggactcttcggcaaaggcagcctgttaacttgcgctaagtttaagtgcgtgaccaaactggaggggaagattgtacagtacgaaaacctcaaatattccgtgatcgtcacagtgcacaccggagatcaacatcaggttggtaatgagactacggaacacggcacaattgccaccatcactccccaggcgcctacctcagagatccagcttacagactacggggccctgaccttggactgtagtccaagaactggactagatttcaacgaaatggtgctgctcacaatgaaggagaaaagctggctggtccataagcaatggtttcttgacctgccgttgccctggacgtctggcgcatccacctcacaggagacttggaataggcaggatctcctggtgacattcaaaaccgctcacgccaagaagcaagaagtagttgtgttaggtagccaggagggggctatgcacacagccctgactggcgcaaccgaaattcagacgagtggaaccacaactatatttgccggccatctaaaatgccggctcaagatggacaaactgacccttaaggggacatcttatgtcatgtgtactggatccttcaaattggagaaggaagtggctgagacccagcacggtacggtcctggtgcaagttaagtacgagggcacagatgcgccttgcaaaatcccattcagcacccaggacgaaaagggggtgactcagaacggacgtctcattacagcaaatcccatcgtaaccgataaagagaagcctgtcaacatagaaactgagccaccctttggcgagtcgtatattgtggttggtgccggggaaaaagctctgaagctttcttggttcaagaaaggctcctcaatcggaaagatgtttgaggccaccgcacgcggcgccagaaggatggctatcctgggggacacagcctgggatttcggaagtattggtggcgtgtttacgagcgtcgggaaattggtgcatcaggtattcggaaccgcatacggcgtgctcttttccggtgtttcttggactatgaagatcgggattggcatactgttaacatggctgggactaaatagccggtcaaccagtctctccatgacatgtatcgcggtcggcatggtgactctgtaccttggggtgatggtccaagctgacagcggatgcgttattaactggaaaggccgagaattgaagtgtggttctgggatcttcgtgaccaacgaggtgcacacgtggacagaacagtataagtttcaggccgattcaccgaaacgcctgagtgcagccatcggaaaggcttgggaggagggcgtatgcggtattagaagcgccaccaggctcgaaaatataatgtggaaacagatctccaacgagctgaatcatattttactggaaaacgacatgaagttcactgtcgtggttggcgacgcaaatgggatccttgctcaaggaaaaaagatgattcggcctcagcccatggagcacaaatactcttggaagtcgtggggcaaggccaaaatcataggggcggatatccagaacaccacatttattatcgacggaccagatactcctgaatgtcccgacaatcagcgcgcctggaacatttgggaggtggaggattatggcttcggtatctttaccacaaatatatggttgaagctcagagacagctacacgcaaatgtgcgatcacaggctgatgtccgctgcaattaaagactcaaaggccgtccatgctgatatggggtattggatcgaaagtgagaaaaacgaaacctggaagctagcccgtgcatctttcattgaggtgaagacttgtacatggccaaaaagccacaccctgtggtccaatggagttctcgaatcagagatgatcatacccaagatctacggcggtcctattagccagcataactatcggccaggctacttcactcagacagcggggccgtggcacctgggaaaacttgagttggactttgatctgtgcgaaggcaccacggtggtagtcgacgagcactgcgggaatcgaggaccctctttaagaactaccacagtgaccggcaagatcattcatgaatggtgttgcaggtcctgtactctccctccactgcgcttccggggtgaggatgggtgctggtacggaatggagatcagacccgtgaaagaaaaggaggaaaaccttgtcaggagtatggttagcgccggctctggtgaggtggactccttttcactgggcatattgtgtgctagtattatgatcgaagaggtaatgcgcagccgatggtcgcggaagatgctcatgacagggaccctggccgtgttcctactgctcatcatgggacaactgacatggaatgaccttattcgtttgtgcatcatggtcggcgcaaacgcttccgatagaatggggatgggaactacctatctggccttaatggcaacgtttaaaatgaggcctatgttcgccgtgggcctcctgtttcgccggcttacatctagagaggttctgctactcaccattggtctgagcttggtggcttcagtcgaactgccaaacagtttagaggaactcggggacggactggcgatgggcataatgatgcttaagctgttgactgagttccagccccaccagctctggaccacactgctatccctgacttttatcaaaaccacgctttctctcgattacgcctggaagacaaccgcaatggctctgagcattgtgtccttgttcccgctgtgtttatcaactacaagccagaaaaccacttggctccctgttctgcttggcagttttgggtgcaagccactgacaatgttcttgatcaccgaaaataagatttggggaaggaaatcttggcccctcaacgagggtatcatggccataggcatcgtgtccattctgctaagctcgctgcttaagaatgacgtccctctcgccgggcccctgatcgctggaggcatgttgattgcatgttatgtaatctcaggttctagtgccgatttatccctggagaaagcggctgaagtgagctgggagcaagaagccgagcattctgggacgagccacaacatactcgttgaagtgcaggacgatggaactatgaagattaaagacgaggagcgagatgacaccctgacaatccttctgaaggcaaccttgctagccgtctccggcgtgtacccaatgtcaatccctgctacactgtttgtatggtatttctggcagaaaaagaagcagcgcagtggcgtgctctgggatactcccagcccaccggaagtcgagcgggcagttctggacgatgggatttacagaatacttcaaaggggattactgggtcgttctcaggtgggcgtgggggtcttccaggacggagtgtttcataccatgtggcacgttacgcgcggcgccgtactcatgtatcagggtaaacggttggaaccttcctgggcgtcagtgaagaaagacctgatcagttacgggggaggctggagattccaaggcagctggaatacaggggaggaggtccaggtgattgctgttgaacccggaaagaacccaaaaaatgtgcagactacccccggtacatttaagacccctgagggcgaagtcggggccatcgcactcgatttcaagccaggaacttccggctctcccattgtgaacagggagggtaaaatcgtagggctgtacggaaatggcgtcgtgaccacatcgggcacgtatgttagcgccatagctcaagccaaggcatcacaggaagggcctcttccggagatcgaggacgaagtgtttaaaaagcgaaacctgactattatggatttgcacccaggatccggtaaaacccggcgctacctacccgctatcgtcagagaggccattaagaggaagctgcggacactcatcttagcgcctacccgagtggttgccagtgaaatggcagaggctctgaaaggcatgccaataagatatcagactacagccgtgaagtctgaacataccgggcgcgagattgtcgaccttatgtgccacgctacgttcactatgaggctgctcagccccgtgcgtgtacctaattacaacatgatcatcatggatgaggcacattttacagacccggcctccattgccgctcggggatatatctcaaccagagtgggcatgggtgaagcggcagccatattcatgaccgctactcccccagggtctgttgaggcctttcctcagagcaatgcagtcattcaagatgaagagagggacatccccgaacgcagttggaactccggatacgattggattacagacttcccaggcaaaaccgtgtggtttgtgcctagcatcaagtctggcaatgatatagccaactgtttgcgaaaaaacgggaagagagtcattcagctgtcacggaagacattcgacactgagtatcagaaaacgaagaataacgactgggattacgtagtgaccacagacatctccgagatgggagctaatttcagggcggatcgcgttatcgacccccgtagatgcctcaaaccagtgattctgaaggatggtccggaacgggtcatccttgccggccctatgcccgtgactgttgcaagtgctgcccagaggcgcgggcgaattggaagaaaccaaaataaagagggcgaccagtacgtgtatatgggtcagccactaaacaatgatgaagaccacgcacattggaccgaggccaagatgctgttggataacataaatacacccgaggggatcattcctgctttatttgaaccagagcgggaaaagagcgccgcgatcgacggcgagtacaggctgcgcggagaagcaagaaaaaccttcgtcgagctcatgaggcggggcgatctgcccgtgtggctttcgtataaggtagcctctgaggggtttcagtactccgaccgtcgctggtgcttcgatggagaacgaaacaatcaagtgctggaggaaaacatggacgttgagatctggactaaagaaggtgagagaaagaaactcaggcctcggtggttggacgctcgcacgtatagcgatccgctggccctaagagagtttaaggaattcgctgcaggcaggcggtcagtcagtggggacctgattctcgagataggaaaacttccacagcacctgaccttacgagcccagaatgctttggataacctggtgatgctccacaattctgaacagggcggtaaggcctacagacatgcaatggaggaactgcccgacacaatcgagactcttatgctgctcgcgttgattgccgtgctgaccgggggcgtcacattatttttcctatccggaaagggcctggggaaaaccagcatcggactcctttgtgttactgcttcaagtgccctgttgtggatggcaagcgtggagcctcactggattgctgcctccatcatactggaatttttcctcatggtactgcttatccccgagccagatcgccaaaggacacctcaggacaaccagctcgcatatgtggtcattggtctgttgtttatgatcctgacggtggccgctaacgaaatgggcttactagagaccactaagaaagatctggggattggacatgttgcggccgagaatcaccaacacgcaacaatgctcgacgtggatcttcggcccgcttctgcctggaccctgtacgccgtcgcaaccacagtaatcactccaatgatgcgtcatacgatagaaaacaccacagctaatattagcttgactgccatcgcgaaccaggctgccattctgatgggcctcgacaagggttggcctatctccaaaatggatataggggtgccgctgcttgcattaggctgctactcacaggttaatcccctgaccctcacagccgctgtgttgatgctggtcgcacactatgccatcattggaccaggcctacaggcgaaggctaccagagaggcccaaaagaggactgcagccgggatcatgaaaaaccctacggtggacggaattgtcgctatcgatctggaccccgtggtttacgacacaaagttcgaaaaacagctcggccagataatgcttctgattttgtgtacctctcagatcctgctcatgcgcactacctgggccctgtgcgagagtatcacattagcaactggtccacttaccacactgtgggaagggtcgcctggaaagttttggaatacgaccattgctgtgagcatggccaacatcttccggggctcctatctcgcgggtgccggcctagcattctctctgatgaaatcattggggggaggccgaagagggactggagctcaaggcgagacactgggtgagaagtggaagaggcagctcaatcagcttagcaaatccgaatttaacatatacaagcgcagtgggattatggaggtagatcggtctgaagccaaagagggactgaagagaggcgaaaccactaaacatgcagtgagccgtggtacagctaagttgaggtggttcgtcgagcggaatctggttaagcccgagggcaaagtgatcgacctcgggtgtggacgcggcgggtggtcatattactgcgccggattaaagaaagtcaccgaagtgaagggctatacgaaaggtgggccgggacacgaggaaccaattcctatggccacctacggctggaacctggtaaagcttcattccggcaaagatgtgtttttcatgcccccagagaagtgtgacacactgctatgcgatatcggggaaagtagccccaatcctactatagaggagggacgaaccctcagagttctgaagatggtggaaccgtggttgaggggtaaccagttttgtatcaaaattctgaatccctacatgccatctgtcgtggagacactcgaacaaatgcagcggaagtatggcgggatgcttgtccgcaaccctctgtccagaaattcaactcacgagatgtactgggtgagctgcggaaccggcaacatcgtttcggcggtaaacatgacatctaggatgttactgaatcgattcaccatggctcaccggaaacccacttatgagcgtgacgtggatttgggtgcagggacgagacatgtcgccgtggaacctgaggttgctaacctcgacattatcggacagcgcattgaaaatatcaagaacgagcacaaaagtacatggcattacgatgaagacaatccatataagacctgggcctaccacggctcctatgaggtgaagcccagcggctcagcatcctctatggtcaacggggtggtaaggctgctaactaaaccttgggatgtgataccaatggttacccaaattgccatgacagacacgaccccctttggacagcagcgggtcttcaaggagaaagtggacactagaacaccgcgcgctaagaggggtaccactcagatcatggaagtgacagcgaaatggctttggggctttctgagccgaaataagaagcctcggatctgtaccagagaggaattcacaaggaaagtccgcagtaacgccgcaattggggctgtttttgtggatgagaatcaatggaactccgccaaggaagcagtagaggacgagcgtttctgggatctcgtgcaccgggaaagagagctgcataaacagggaaagtgcgccacttgcgtctacaatatgatgggcaaaagggaaaagaagttgggtgagtttgggaaagctaagggaagccgcgccatatggtacatgtggctgggcgcgcgattcctcgaattcgaggcacttggctttatgaacgaggaccactggttctctcgggaaaattcactgagtggggtggagggagaaggtttacataaactgggctatatcttgagagatatttccaagatcccagggggaaacatgtacgccgacgataccgctggctgggacacgaggattaccgaggatgacctccagaatgaggccaaaatcacagatataatggaacccgagcacgcactgctagctactagcatctttaagcttacctatcagaacaaagttgtgcgcgtccaaagacctgccaagaacggtacagtgatggacgtaatttctcggagggatcagcgtgggtcgggacaggttggcacttacggcctgaataccttcacgaacatggaagtgcagctcatccgacaaatggagtcagaagggatttttctgccaagcgagttggagacacccaatttagctggacgcgtcctggactggctcgaaaagcatggtgccgagagacttaaacggatggcaatctccggcgacgattgtgtggtgaagccgatagacgataggttcgcgaccgccctgactgctctaaacgacatggggaaagtccgcaaggatattcctcagtgggaacccagtaaaggatggaatgactggcagcaggttccattttgctctcaccacttccatcaactgatcatgaaggatggcagagagatcgtggtaccttgtcggaaccaggacgaactcgtgggtagggcccgagtcagccagggggcaggatggtccttgcgtgagacagcttgcctgggcaagtcatatgcccaaatgtggcagcttatgtactttcacagacgcgatctgcggctcgcagccaatgcgatttgtagtgctgtgcccgttgactgggtgccaacctctaggactacctggagcatacatgcccaccaccagtggatgacaacggaggatatgttatccgtctggaacagagtgtggatcgaagagaatccctggatggaagacaaaacccatgtatcaagctgggaggaagttccttatctgggcaagcgcgaggaccagtggtgcgggtctttgattggactgactgcacgggccacatgggctaccaacatccaagtggccattaatcaggtcaggcgactcatcggtaacgagaattaccttgattacatgacttccatgaaaagattcaagaacgaaagtgacccagagggcgcactgtggtga

SEQ ID NO: 13400 - RNA, 9879 nt, synthetic construct
  misc_feature 1..9879: note = derived and/or modified CDS sequence (opt3) from DENV-1__FJ810419__SS-prME
  source 1..9879: mol_type = other RNA
agcgtgaccatgctgctcatgcttctgccaactgcattggctttccacttaactacgcgaggaggggaacctcatatgatcgtctccaagcaggaaaggggaaaatctctgttgtttaagacctcagccggtgttaacatgtgcacactcattgccatggacctgggcgaactttgtgaagatactatgacctacaaatgcccacaaataacagaggcggaaccggacgatgtggactgttggtgcaatgctaccgatacttgggtgacatatgggacctgtagtcagacgggagagcaccggcgcgacaagcgaagcgtggccctggcaccccatgtcggcttgggtctcgagactcgtaccgaaacatggatgtcctctgagggggcctggaaacagatccagagagtggaaacttgggctctgaggcaccctggattcaccgttattgcactgtttctcgcccatgctatcggcacatcgattacccaaaagggcatcatattcatcttactgatgcttgtgacgccatcaatggccatgcggtgcgtcgggattggaaaccgcgattttgtggagggtttgagcggcgcgacttgggtagacgttgtgctggagcacgggagttgtgtcacaaccatggcaaagaataaacccactctagatatcgaactcctgaagacagaggtgaccaaccctgccattcttagaaaactgtgcatcgaagctaagatatccaatacgaccacagactctaggtgtccaactcagggagaggccaccttggtggaagaacaggatgcaaacttcgtctgccggcgcacatttgttgaccgaggctggggtaatgggtgtggactcttcggcaaaggcagcctgttaacttgcgctaagtttaagtgcgtgaccaaactggaggggaagattgtacagtacgaaaacctcaaatattccgtgatcgtcacagtgcacaccggagatcaacatcaggttggtaatgagactacggaacacggcacaattgccaccatcactccccaggcgcctacctcagagatccagcttacagactacggggccctgaccttggactgtagtccaagaactggactagatttcaacgaaatggtgctgctcacaatgaaggagaaaagctggctggtccataagcaatggtttcttgacctgccgttgccctggacgtctggcgcatccacctcacaggagacttggaataggcaggatctcctggtgacattcaaaaccgctcacgccaagaagcaagaagtagttgtgttaggtagccaggagggggctatgcacacagccctgactggcgcaaccgaaattcagacgagtggaaccacaactatatttgccggccatctaaaatgccggctcaagatggacaaactgacccttaaggggacatcttatgtcatgtgtactggatccttcaaattggagaaggaagtggctgagacccagcacggtacggtcctggtgcaagttaagtacgagggcacagatgcgccttgcaaaatcccattcagcacccaggacgaaaagggggtgactcagaacggacgtctcattacagcaaatcccatcgtaaccgataaagagaagcctgtcaacatagaaactgagccaccctttggcgagtcgtatattgtggttggtgccggggaaaaagctctgaaactttcttggttcaagaaaggctcctcaatcggaaagatgtttgaggccaccgcacgcggcgccagaaggatggctatcctgggggacacagcctgggatttcggaagtattggtggcgtgtttacgagcgtcgggaaattggtgcatcaggtattcggaaccgcatacggcgtgctcttttccggtgtttcttggactatgaagatcgggattggcatactgttaacatggctgggactaaatagccggtcaaccagtctctccatgacatgtatcgcggtcggcatggtgactctgtaccttggggtgatggtccaagctgacagcggatgcgttattaactggaaaggccgagaattgaagtgtggttctgggatcttcgtgaccaacgaggtgcacacgtggacagaacagtataagtttcaggccgattcaccgaaacgcctgagtgcagccatcggaaaggcttgggaggagggcgtatgcggtattagaagcgccaccaggctcgaaaatataatgtggaaacagatctccaacgagctgaatcatattttactggaaaacgacatgaagttcactgtcgtggttggcgacgcaaatgggatccttgctcaaggcaagaaaatgattcggcctcagcccatggagcacaaatactcttggaagtcgtggggcaaggccaaaatcataggggcggatatccagaacaccacatttattatcgacggaccagatactcctgaatgtcccgacaatcagcgcgcctggaacatttgggaggtggaggattatggcttcggtatctttaccacaaatatatggttgaagctcagagacagctacacgcaaatgtgcgatcacaggctgatgtccgctgcaattaaagactcaaaggccgtccatgctgatatggggtattggatcgaaagtgagaaaaacgaaacctggaagctagcccgtgcatctttcattgaggtgaagacttgtacatggccaaaaagccacaccctgtggtccaatggagttctcgaatcagagatgatcatacccaagatctacggcggtcctattagccagcataactatcggccaggctacttcactcagacagcggggccgtggcacctgggaaaacttgagttggactttgatctgtgcgaaggcaccacggtggtagtcgacgagcactgcgggaatcgaggaccctctttaagaactaccacagtgaccggcaagatcattcatgaatggtgttgcaggtcctgtactctccctccactgcgcttccggggtgaggatgggtgctggtacggaatggagatcagacccgtgaaagaaaaggaggaaaaccttgtcaggagtatggttagcgccggctctggtgaggtggactccttttcactgggcatattgtgtgctagtattatgatcgaagaggtaatgcgcagccgatggtcgcggaagatgctcatgacagggaccctggccgtgttcctactgctcatcatgggacaactgacatggaatgaccttattcgtttgtgcatcatggtcggcgcaaacgcttccgatagaatggggatgggaactacctatctggccttaatggcaacgtttaaaatgaggcctatgttcgccgtgggcctcctgtttcgccggcttacatctagagaggttctgctactcaccattggtctgagcttggtggcttcagtcgaactgccaaacagtttagaggaactcggggacggactggcgatgggcataatgatgcttaagctgttgactgagttccagccccaccagctctggaccacactgctatccctgacttttatcaaaaccacgctttctctcgattacgcctggaagacaaccgcaatggctctgagcattgtgtccttgttcccgctgtgtttatcaactacaagccagaaaaccacttggctccctgttctgcttggcagttttgggtgcaagccactgacaatgttcttgatcaccgaaaataagatttggggaaggaaatcttggcccctcaacgagggtatcatggccataggcatcgtgtccattctgctaagctcgctgcttaagaatgacgtccctctcgccgggcccctgatcgctggaggcatgttgattgcatgttatgtaatctcaggttctagtgccgatttatccctggagaaagcggctgaagtgagctgggagcaagaagccgagcattctgggacgagccacaacatactcgttgaagtgcaggacgatggaactatgaagattaaagacgaggagcgagatgacaccctgacaatccttctgaaggcaaccttgctagccgtctccggcgtgtacccaatgtcaatccctgctacactgtttgtatggtatttctggcagaaaaagaagcagcgcagtggcgtgctctgggatactcccagcccaccggaagtcgagcgggcagttctggacgatgggatttacagaatacttcaaaggggattactgggtcgttctcaggtgggcgtgggggtcttccaggacggagtgtttcataccatgtggcacgttacgcgcggcgccgtactcatgtatcagggtaaacggttggaaccttcctgggcgtcagtgaagaaagacctgatcagttacgggggaggctggagattccaaggcagctggaatacaggggaggaggtccaggtgattgctgttgaacccggaaagaaccccaagaatgtgcagactacccccggtacatttaagacctccgagggcgaagtcggggccatcgcactcgatttcaagcctggaacttctggctcgccaattgtgaacagggagggtaaaatcgtagggctgtacggaaatggcgtcgtgaccacaagcggcacgtatgtttcagccatagctcaagccaaggcatcccaggaagggccccttcctgagatcgaggacgaagtgtttaaaaagcgaaacctgactattatggatttgcacccgggaagtggtaaaacccggcgctacctaccagctatcgtcagagaggccattaagaggaagctgcggacactcatcttagcgcccacccgagtggttgcctctgaaatggcagaggctctgaaaggcatgcctataagatatcagactacagccgtaaagagcgaacataccgggcgcgagattgtcgaccttatgtgccacgctacgttcactatgaggctgctctccccagtgcgtgtacccaattacaacatgatcatcatggatgaggcacattttacagaccctgcctcaattgccgctcggggatatatctctaccagagtgggcatgggtgaagcggcagccatattcatgaccgctactccgcccgggagcgttgaggcctttccacagagtaatgcagtcattcaagatgaagagagggacatccctgaacgctcctggaacagcggatacgattggattacagacttccccggcaaaaccgtgtggtttgtgccatctatcaagtcaggcaatgatatagccaactgtttgagaaagaacgggaagagagtcattcagctgtcccggaagacattcgacactgagtatcagaaaacgaagaataacgactgggattacgtagtgaccacagacatcagtgagatgggagctaatttcagggcggatcgcgttatcgaccctcgtagatgcctcaaacccgtgattctgaaggatggtccagaacgggtcatccttgccggcccgatgcctgtgactgttgcaagcgctgcccagaggcgcgggcgaattggaagaaaccaaaataaagagggcgaccagtacgtgtatatgggtcagcccctaaacaatgatgaagaccacgcacattggaccgaggccaagatgctgttggataacataaatacaccagaggggatcattcccgctttatttgaacctgagcgggaaaagtcggccgcgatcgacggcgagtacaggctgcgcggagaagcaagaaaaaccttcgtcgagctcatgaggcggggcgatctgccagtgtggctttcttataaggtagcctccgaggggtttcagtacagcgaccgtcgctggtgcttcgatggagaacgaaacaatcaagtgctggaggaaaacatggacgttgagatctggactaaagaaggtgagagaaagaaactcaggccccggtggttggacgctcgcacgtattcagatcctctggccctaagagagtttaaggagttcgctgcaggcaggcggagtgtctctggggacctgattctcgagataggaaaacttccgcagcacctgaccttacgagcccagaatgctttggataacctggtgatgctccacaattccgaacagggcggtaaggcctacagacatgcaatggaggaactgccagacacaatcgagactcttatgctgctcgcgttgattgccgtgctgaccgggggcgtcacattatttttcctaagcggaaagggcctggggaaaacctcaatcggactcctttgtgttactgctagtagcgccctgttgtggatggcatccgtggagccccactggattgctgcctctatcatactggaatttttcctcatggtactgcttatccctgagcccgatcgccaaaggacaccacaggacaaccagctcgcatatgtggtcattggtctgttgtttatgatcctgacggtggccgctaacgaaatgggcttactagagaccactaagaaagatctggggattggacatgttgcggccgagaatcaccaacacgcaacaatgctcgacgtggatcttcggcctgctagcgcctggaccctgtacgccgtcgcaaccacagtaatcactcccatgatgcgtcatacgatagaaaacaccacagctaatatttccttgactgccatcgcgaaccaggctgccattctgatgggcctcgacaagggttggccaatctcaaaaatggatataggggtgcctctgcttgcattaggctgctactctcaggttaatccgctgaccctcacagccgctgtgttgatgctggtcgcacactatgccatcattggacccggcctacaggcgaaggctaccagagaggcccaaaagaggactgcagccgggatcatgaaaaacccaacggtggacggaattgtcgctatcgatctggaccctgtggtttacgacgccaagttcgaaaaacagctcggccagataatgcttctgattttgtgtacaagtcagatcctgctcatgcgcaccacttgggcactgtgcgagtcgatcaccttagctacaggtccccttactaccctgtgggaagggagcccaggaaagttttggaatacaacgattgccgtgtccatggcgaacatcttccggggctcttatctcgccggtgcaggcctagctttctcactgatgaaaagcctagggggaggccgaagagggaccggagcccaaggcgagactctgggtgagaagtggaagaggcagctcaatcagctttccaagagtgaatttaacacatacaagcgctctgggataatggaggtagatcggagcgaagcaaaagagggactgaagagaggcgaaaccactaaacatgctgtgtcacgtggtacagccaagttgaggtggttcgtcgagcggaatctggttaagcctgagggcaaagtgattgacctcgggtgtggacgcggcgggtggtcctattactgcgccggattaaagaaagtcaccgaagtgaagggctatacgaaaggtgggcccggacacgaggaaccgatcccaatggcgacctacggctggaacctggtaaaactttacagtggcaaagatgtgtttttcatgcctcccgagaagtgtgacacactgctatgcgatattggggaaagctctccaaatcccactatcgaggagggacgaaccctcagagttctgaagatggtggaaccttggttgaggggtaaccagttttgtataaaaatcctgaatccgtatatgccctccgtcgtggagacactcgaacaaatgcagcggaagcatggcgggatgcttgtccgcaacccactgtcaagaaatagcactcacgagatgtactgggtgtcgtgcggaaccggcaacattgtttctgctgtaaacatgacaagtaggatgttactgaatcgattcaccatggcacaccggaaacctacttatgagcgtgacgtggatttgggtgccgggacgagacatgtcgctgtggaacccgaggttgccaacctcgacatcattggacagcgcatcgaaaatattaagaacgagcacaaatccacatggcattacgatgaagacaatccttataagacctgggcataccacggcagctatgaggtgaagccatcaggctccgcctctagcatggtcaacggggtggtaaggctgctaactaaaccctgggatgtgatccctatggttacccaaatagctatgacagacacgaccccatttggacagcagcgggtcttcaaggagaaagtggacactagaacaccccgcgcgaagaggggtaccactcagattatggaagtgacagccaaatggctttggggctttctgagtcgaaataagaagccgcggatctgtaccagagaggagttcacaaggaaagtccgctccaacgcagctatcggggccgtttttgtggatgagaatcaatggaacagcgcaaaggaagccgtagaggacgagcgtttctgggatctcgtgcaccgggaaagagagctgcataaacagggaaagtgcgctacttgcgtctacaatatgatgggcaaaagggaaaagaagttgggtgagtttgggaaagccaagggatctcgcgcgatttggtacatgtggctgggcgcacgattcctcgagttcgaggcccttggctttatgaacgaggaccactggttctcacgggaaaatagtctgtccggggtggagggagaaggtttacataaactgggctatatattgagagatatcagcaagattcctgggggaaacatgtacgctgacgataccgccggctgggacacgaggatcaccgaggatgacctccagaatgaggcaaaaattacagatatcatggaaccagagcacgctctgctagccacttctatatttaaacttacctatcagaacaaagttgtgcgcgtccaaagacccgctaagaacggtacagtgatggacgtaatctcgcggagggatcagcgtgggtcaggacaggttggcacttacggcctgaataccttcacgaacatggaagtgcagctcattcgacaaatggagagcgaagggatctttctgccttccgagttggagacaccaaatttagccgaacgcgtcctggactggctcgagaagcatggagcagaaagacttaaacggatggcgattagtggtgacgattgtgtggtgaagcccatcgacgataggttcgccaccgctctgactgccctaaacgacatgggcaaagtccgcaaggatataccgcagtgggagccttctaaagggtggaatgactggcagcaggttcccttttgcagccaccacttccatcaactgattatgaaggatggaagagaaatcgtggtaccatgtcggaaccaggacgagctcgtgggcagggcacgagtctcccagggtgctgggtggtcattgcgtgagacagcctgcctgggaaagagttatgcacaaatgtggcagcttatgtactttcacagacgcgatctgcggctcgccgcgaatgctatctgttctgccgtgcctgttgactgggtgcccaccagcaggactacctggtccattcatgcacaccaccagtggatgacaacggaagatatgttatcagtctggaacagagtgtggatagaggaaaatccatggatggaggacaaaacccatgtaagctcttgggaagaggttccctatctgggcaagcgcgaggaccagtggtgcggctccttgatcgggctgactgcccgggctacatgggccaccaacattcaagtggcaatcaatcaggtcaggcgactcattggaaacgaaaattaccttgattacatgacaagtatgaaaagattcaagaacgagagcgaccctgaaggtgctctgtggtga

SEQ ID NO: 13401 - RNA, 9879 nt, synthetic construct
  misc_feature 1..9879: note = derived and/or modified CDS sequence (opt3) from DENV-1__FJ547068__SS-prME
  source 1..9879: mol_type = other RNA
agcgtgaccatgctgctcatgcttctgcccacagccttggctttccacttaactacgagaggcggggagcctcatatgatcgtctccaagcaggaaaggggaaaatctctgctatttaagacctcagcaggtgttaacatgtgcacactcattgccatggacctgggcgagctttgtgaagatactatgacctacaaatgcccacaaataacagaggcggaaccggacgatgtggactgttggtgcaatgctaccgatacttgggtaacatatgggacctgtagtcagacgggagagcaccggcgcgacaagcgaagcgtggccctggcaccccatgtcggcttgggtctcgagactcgtaccgaaacatggatgtcctctgagggggcctggaaacagatccagagagtggaaacttgggctctgaggcaccctggattcaccgttattgcactgtttctcgcccatgctatcggcacatcgattacccaaaagggcatcatattcatcttactgatgcttgtgacgccatcaatggccatgcggtgcgtcgggattggaaaccgcgattttgtggagggtttgagcggcgcgacttgggtagacgttgtgctggagcacgggagttgtgtcacaaccatggcaaagaataaacccactctagatatcgaactcctgaagacagaggtgaccaaccctgccattcttagaaaactgtgcatcgaagctaagatatccaatacgaccacagactctaggtgtccaactcagggagaggccaccttggtggaagagcaggatgcaaacttcgtctgccggcgcacatttgttgaccgaggctggggtaatgggtgtggactcttcggcaaaggcagcctgttaacttgcgctaagtttaagtgcgtgaccaaactggaggggaagattgtacagtacgaaaacctcaaatattccgtgatcgtcacagtgcacaccggagatcaacatcaggttggtaatgagactacggaacacggcacaattgccaccatcactccccaggcgcctacctcagagatccagcttacagactacggggccctgaccttggactgtagtccaagaactggactagatttcaacgaaatggtgctgctcacaatgaaggagaaaagctggctggtccataagcaatggtttcttgacctgccgttgccctggacgtctggcgcatccacctcacaggagacttggaataggcaggatctcctggtgacattcaaaaccgctcacgccaagaagcaagaagtagttgtgttaggtagccaggagggggctatgcacacagccctgactggcgcaaccgaaattcagacgagtggaaccacaactatatttgccggccatctaaaatgccggctcaagatggacaaactgacccttaaggggacatcttatgtcatgtgtactggatccttcaaattggagaaggaagtggctgagacccagcacggtacggtcctggtgcaagttaagtacgagggcacagatgcgccttgcaaaatcccattcagcacccaggacgaaaagggggtgactcagaacggacgtctcattacagcaaatcccatcgtaaccgataaagagaagcctgtcaacatagaaactgagccaccctttggcgagtcgtatattgtggttggtgccggggaaaaagctctgaagctttcttggttcaagaaaggctcctcaatcggaaagatgtttgaggccaccgcacgcggcgccagaaggatggctatcctgggggacacagcctgggatttcggaagtattggtggcgtgtttacgagcgtcgggaaattggtgcatcaggtattcggaaccgcatacggcgtgctcttttccggtgtttcttggactatgaagatcgggattggcatactgttaacatggctgggactaaatagccggtcaaccagtctctccatgacatgtatcgcggtcggcatggtgactctgtaccttggggtgatggtccaagctgacagcggatgcgttattaactggaaaggccgagaattgaagtgtggttctgggatcttcgtgaccaacgaggtgcacacgtggacagaacagtataagtttcaggccgattcaccgaaacgcctgagtgcagccatcggaaaggcttgggaggagggcgtatgcggtattagaagcgccaccaggctcgaaaatataatgtggaaacagatctccaacgagctgaatcatattttactggaaaacgacatgaagttcactgtcgtggttggcgacgcaaatgggatccttgctcaaggaaaaaagatgattcggcctcagcccatggagcacaaatactcttggaagtcgtggggcaaggccaaaatcataggggcggatatccagaacaccacatttattatcgacggaccagatactcctgaatgtcccgacaatcagcgcgcctggaacatttgggaggtggaggattatggcttcggtatctttaccacaaatatatggttgaagctcagagacagctacacgcaaatgtgcgatcacaggctgatgtccgctgcaattaaagactcaaaggccgtccatgctgatatggggtattggatcgaaagtgagaaaaacgaaacctggaagctagcccgtgcatctttcattgaggtgaagacttgtacatggccaaaaagccacaccctgtggtccaatggagttctcgaatcagagatgatcatacccaagatctacggcggtcctattagccagcataactatcggccaggctacttcactcagacagcggggccgtggcacctgggaaaacttgagttggactttgatctgtgcgaaggcaccacggtggtagtcgacgagcactgcgggaatcgaggaccctctttaagaactaccacagtgaccggcaagatcattcatgaatggtgttgcaggtcctgtactctccctccactgcgcttccggggtgaggatgggtgctggtacggaatggagatcagacccgtgaaagaaaaggaggaaaaccttgtcaggagtatggttagcgccggctctggtgaggtggactccttttcactgggcatattgtgtgctagtattatgatcgaagaggtaatgcgcagccgatggtcgcggaagatgctcatgacagggaccctggccgtgttcctactgctcatcatgggacaactgacatggaatgaccttattcgtttgtgcatcatggtcggcgcaaacgcttccgatagaatggggatgggaactacctatctggccttaatggcaacgtttaaaatgaggcctatgttcgccgtgggcctcctgtttcgccggcttacatctagagaggttctgctactcaccattggtctgagcttggctgcgtcagtggaactgccaaacagtttagaggaactcggggacggactggccatgggcataatgatgcttaagctgttgactgagttccagccccaccagctctggaccacactgctatccctgacttttatcaaaaccacgctttctctcgattacgcatggaagacaaccgctatggccctgagcattgtctccttgttcccgctgtgtttatcaactacaagccagaaaaccacttggctccctgtgctgcttggcagttttgggtgcaagccactgacaatgttcttgatcaccgaaaataagatttggggaaggaaatcttggcccctcaacgagggtatcatggccataggcatcgtttccattctgctaagctcgctgcttaagaatgacgtgcctctcgctgggcccctgatcgcaggaggcatgttgattgcctgttatgtcatctcaggttctagtgcggatttatccctggagaaagctgccgaagtaagctgggagcaagaagcagagcattctgggacgagccacaacatactcgtggaagttcaggacgatggaactatgaagattaaagacgaggagcgagatgacaccctgacaatccttctgaaggccaccttgctagctgtgtccggcgtctacccaatgtcaatccctgcaacactgtttgtgtggtatttctggcagaaaaagaagcagcgcagtggcgtactctgggatactcccagcccaccggaagtggagcgggccgtcctggacgatgggatttacagaatacttcaaaggggattactgggtcgttctcaggttggcgtgggggtgttccaggacggagtctttcataccatgtggcacgtgacgcgcggcgcggttctcatgtatcagggtaaacggttggaaccttcctgggcttcagtaaagaaagacctgatcagttacgggggaggctggagattccaaggcagctggaatacaggggaggaggtgcaggtcattgccgtggaacccggaaagaacccaaaaaatgttcagactacccccggtacatttaagacccctgagggcgaagtgggggcaatcgccctcgatttcaagccaggaacttccggctctcccattgtcaacagggagggtaaaatcgtggggctgtacggaaatggcgtagtcaccacatcgggcacgtatgtgagcgctatagcccaagcaaaggcttcacaggaagggcctcttccggagatcgaggacgaagtttttaaaaagcgaaacctgactattatggatttgcacccaggatccggtaaaacccggcgctacctacccgccatcgtgagagaggcgattaagaggaagctgcggacactcatcttagcccctacccgagtcgtggcaagtgaaatggctgaggccctgaaaggcatgccaataagatatcagactacagctgttaagtctgaacataccgggcgcgagattgtggaccttatgtgccacgcaacgttcactatgaggctgctcagccccgtccgtgtgcctaattacaacatgatcatcatggatgaggcccattttacagacccggcctccattgctgcgcggggatatatctcaaccagagtaggcatgggtgaagcagccgctatattcatgaccgccactcccccagggtctgtggaggcatttcctcagagcaatgccgttattcaagatgaagagagggacatccccgaacgcagttggaactccggatacgattggattacagacttcccaggcaaaaccgtctggtttgtgcctagcatcaagtctggcaatgatatagctaactgtttgcgaaaaaacgggaagagagtgattcagctgtcacggaagacattcgacactgagtatcagaaaacgaagaataacgactgggattacgtcgtaaccacagacatctccgagatgggagcgaatttcagggccgatcgcgtgatcgacccccgtagatgcctcaaaccagttattctgaaggatggtccggaacgggtgatccttgcaggccctatgcccgtcactgtggctagtgccgcacagaggcgcgggcgaattggaagaaaccaaaataaagagggcgaccagtacgtttatatgggtcagccactaaacaatgatgaagaccacgcccattggaccgaggctaagatgctgttggataacataaatacacccgaggggatcattcctgccttatttgaaccagagcgggaaaagagcgcggcaatcgacggcgagtacaggctgcgcggagaagccagaaaaaccttcgtggagctcatgaggcggggcgatctgcccgtctggctttcgtataaggtggcttctgaggggtttcagtactccgaccgtcgctggtgcttcgatggagaacgaaacaatcaagtactggaggaaaacatggacgtggagatctggactaaagaaggtgagagaaagaaactcaggcctcggtggttggacgcccgcacgtatagcgatccgctggctctaagagagtttaaggaattcgcagccggcaggcggtcagttagtggggacctgattctcgagataggaaaacttccacagcacctgaccttacgagctcagaatgccttggataacctggtcatgctccacaattctgaacagggcggtaaggcatacagacatgcgatggaggaactgcccgacacaatcgagactcttatgctgctcgccttgattgctgtgctgaccgggggcgtgacattatttttcctatccggaaagggcctggggaaaaccagcatcggactcctttgtgtcactgcctcaagtgcactgttgtggatggctagcgttgagcctcactggattgccgcatccatcatactggaatttttcctcatggtgctgcttatccccgagccagatcgccaaaggacacctcaggacaaccagctcgcctatgtagtgattggtctgttgtttatgatcctgacggtcgctgcgaacgaaatgggcttactagagaccactaagaaagatctggggattggacatgtggccgcagagaatcaccaacacgctacaatgctcgacgttgatcttcggcccgcctctgcctggaccctgtacgcagtggctaccacagtcatcactccaatgatgcgtcatacgatagaaaacaccacagccaatattagcttgactgcgatcgctaaccaggccgcaattctgatgggcctcgacaagggttggcctatctccaaaatggatataggggtaccgctgcttgccttaggctgctactcacaggtgaatcccctgaccctcacagctgcagttttgatgctggtggcccactatgcgatcattggaccaggcctacaggctaaggccaccagagaggcacaaaagaggactgccgctgggatcatgaaaaaccctacggtcgacggaattgtggccatcgatctggaccccgtcgtgtacgacgcaaagttcgaaaaacagctcggccagataatgcttctgattttgtgtacatctcagatcctgctcatgcgcaccacttgggctctgtgcgagagtatcaccttagccacaggtccacttactaccctgtgggaagggtcgcctggaaagttttggaatacaacgattgcggttagcatggccaacatcttccggggctcctatctcgcaggtgctggcctagccttctctctgatgaaatcattggggggaggccgaagagggaccggagcacaaggcgagactctgggtgagaagtggaagaggcagctcaatcagcttagcaaatccgaatttaacacatacaagcgcagtgggataatggaggtggatcggtctgaagctaaagagggactgaagagaggcgaaaccactaaacatgccgtaagccgtggtacagccaagttgaggtggttcgtggagcggaatctggtcaagcccgagggcaaagttattgacctcgggtgtggacgcggcgggtggtcatattactgcgcgggattaaagaaagtgaccgaagtcaagggctatacgaaaggtgggccgggacacgaggaaccaatccctatggctacctacggctggaacctggtgaagcttcattccggcaaagatgtatttttcatgcccccagagaagtgtgacacactgctatgcgatattggggaaagtagccccaatcctactatcgaggagggacgaaccctcagagtgctgaagatggttgaaccgtggttgaggggtaaccagttttgtataaaaatcctgaatccctacatgccatctgtggtcgagacactcgaacaaatgcagcggaagcacggcgggatgcttgtgcgcaaccctctgtccagaaattcaactcacgagatgtattgggtcagctgcggaaccggcaacattgtgtcggcagttaacatgacatctaggatgttactgaatcgattcaccatggcccatcggaaacccacttacgagcgtgacgtagatttgggtgctgggacgagacacgtggccgtcgaacctgaggtggcaaacctcgacatcattggacagcgcatcgaaaatattaagaacgagcataaaagtacatggcactatgatgaagacaatccatacaagacctgggcctatcacggctcctacgaggttaagcccagcggctcagcttcctctatggtgaacggggtcgtgaggctgctaactaaaccttgggatgtaatcccaatggtgacccaaatagcgatgacagacacgaccccctttggacagcagcgggttttcaaggagaaagtcgacactagaacaccgcgcgccaagaggggtaccactcagattatggaagtgacagcaaaatggctttggggctttctgagccgaaataagaagcctcggatctgtaccagagaggaattcacaaggaaagtgcgcagtaacgctgccatcggggcagtctttgttgatgagaatcaatggaactccgccaaggaagctgtggaggacgagcgtttctgggatctcgtacatcgggaaagagagctgcacaaacagggaaagtgcgccacttgcgtgtataatatgatgggcaaaagggaaaagaagttgggtgagtttgggaaagcgaagggaagccgcgcaatttggtacatgtggctgggcgcccgattcctcgaattcgaggctcttggctttatgaacgaggaccattggttctctcgggaaaattcactgagtggggtcgagggagaaggtttacacaaactgggctacatattgagagatatctccaagattccagggggaaacatgtatgccgacgataccgcaggctgggacacgaggatcaccgaggatgacctccagaatgaggctaaaattacagatatcatggaacccgagcatgccctgctagctactagcatatttaagcttacctaccagaacaaagtggttcgcgtgcaaagacctgccaagaacggtacagtcatggacgtgatctctcggagggatcagcgtgggtcgggacaggtaggcacttatggcctgaataccttcacgaacatggaagttcagctcattcgacaaatggagtcagaagggatctttctgccaagcgagttggagacacccaatttagcagaacgcgtgctggactggctcgagaagcacggagcggaaagacttaaacggatggccatttccggtgacgattgtgtcgtgaagccgatcgacgataggttcgctaccgccctgactgcactaaacgacatgggcaaagtgcgcaaggatatacctcagtgggagcccagtaaagggtggaatgactggcagcaggtcccattttgctctcaccatttccaccaactgattatgaaggatggaagagaaatcgttgtgccttgtcggaaccaggacgagctcgtaggcagggctcgagtgagccagggtgccgggtggtccttgcgtgagacagcatgcctgggaaagtcatacgcccaaatgtggcagcttatgtattttcatagacgcgatctgcggctcgcggctaatgccatctgtagtgcagtccccgtggactgggttccaacctctaggactacctggagcattcacgcccaccatcagtggatgacaacggaagatatgttatccgtgtggaacagagtctggatagaggaaaatccctggatggaggacaaaacccacgtgtcaagctgggaagaggtaccttacctgggcaagcgcgaggaccagtggtgcggctctttgatcgggctgactgctcgggccacatgggcaaccaacattcaagttgctatcaatcaggtgaggcgactcattggaaacgaaaattatcttgattacatgacttccatgaaaagattcaagaacgagagtgacccagaaggtgccctgtggtga

SEQ ID NO: 13402 - RNA, 9879 nt, synthetic construct
  misc_feature 1..9879: note = derived and/or modified CDS sequence (opt3) from DENV-1__FJ562104__SS-prME
  source 1..9879: mol_type = other RNA
agcgtgaccatgctgctcatgcttctgcccacagccttggctttccacttaactacgagaggcggggagcctcatatgatcgtctccaagcaggaaaggggaaaatctctgctatttaagacctcagcaggtgttaacatgtgcacactcattgccatggacctgggcgagctttgtgaagatactatgacctacaaatgcccacaaataacagaggcggaaccggacgatgtggactgttggtgcaatgctaccgatacttgggtaacatatgggacctgtagtcagacgggagagcaccggcgcgacaagcgaagcgtggccctggcaccccatgtcggcttgggtctcgagactcgtaccgaaacatggatgtcctctgagggggcctggaaacagatccagagagtggaaacttgggctctgaggcaccctggattcaccgttattgcactgtttctcgcccatgctatcggcacatcgattacccaaaagggcatcatattcatcttactgatgcttgtgacgccatcaatggccatgcggtgcgtcgggattggaaaccgcgattttgtggagggtttgagcggcgcgacttgggtagacgttgtgctggagcacgggagttgtgtcacaaccatggcaaagaataaacccactctagatatcgaactcctgaagacagaggtgaccaaccctgccattcttagaaaactgtgcatcgaagctaagatatccaatacgaccacagactctaggtgtccaactcagggagaggccaccttggtggaagagcaggatgcaaacttcgtctgccggcgcacatttgttgaccgaggctggggtaatgggtgtggactcttcggcaaaggcagcctgttaacttgcgctaagtttaagtgcgtgaccaaactggaggggaagattgtacagtacgaaaacctcaaatattccgtgatcgtcacagtgcacaccggagatcaacatcaggttggtaatgagactacggaacacggcacaattgccaccatcactccccaggcgcctacctcagagatccagcttacagactacggggccctgaccttggactgtagtccaagaactggactagatttcaacgaaatggtgctgctcacaatgaaggagaaaagctggctggtccataagcaatggtttcttgacctgccgttgccctggacgtctggcgcatccacctcacaggagacttggaataggcaggatctcctggtgacattcaaaaccgctcacgccaagaagcaagaagtagttgtgttaggtagccaggagggggctatgcacacagccctgactggcgcaaccgaaattcagacgagtggaaccacaactatatttgccggccatctaaaatgccggctcaagatggacaaactgacccttaaggggacatcttatgtcatgtgtactggatccttcaaattggagaaggaagtggctgagacccagcacggtacggtcctggtgcaagttaagtacgagggcacagatgcgccttgcaaaatcccattcagcacccaggacgaaaagggggtgactcagaacggacgtctcattacagcaaatcccatcgtaaccgataaagagaagcctgtcaacatagaaactgagccaccctttggcgagtcgtatattgtggttggtgccggggaaaaagctctgaagctttcttggttcaagaaaggctcctcaatcggaaagatgtttgaggccaccgcacgcggcgccagaaggatggctatcctgggggacacagcctgggatttcggaagtattggtggcgtgtttacgagcgtcgggaaattggtgcatcaggtattcggaaccgcatacggcgtgctcttttccggtgtttcttggactatgaagatcgggattggcatactgttaacatggctgggactaaatagccggtcaaccagtctctccatgacatgtatcgcggtcggcatggtgactctgtaccttggggtgatggtccaagctgacagcggatgcgttattaactggaaaggccgagaattgaagtgtggttctgggatcttcgtgaccaacgaggtgcacacgtggacagaacagtataagtttcaggccgattcaccgaaacgcctgagtgcagccatcggaaaggcttgggaggagggcgtatgcggtattagaagcgccaccaggctcgaaaatataatgtggaaacagatctccaacgagctgaatcatattttactggaaaacgacatgaagttcactgtcgtggttggcgacgcaaatgggatccttgctcaaggaaaaaagatgattcggcctcagcccatggagcacaaatactcttggaagtcgtggggcaaggccaaaatcataggggcggatatccagaacaccacatttattatcgacggaccagatactcctgaatgtcccgacaatcagcgcgcctggaacatttgggaggtggaggattatggcttcggtatctttaccacaaatatatggttgaagctcagagacagctacacgcaaatgtgcgatcacaggctgatgtccgctgcaattaaagactcaaaggccgtccatgctgatatggggtattggatcgaaagtgagaaaaacgaaacctggaagctagcccgtgcatctttcattgaggtgaagacttgtacatggccaaaaagccacaccctgtggtccaatggagttctcgaatcagagatgatcatacccaagatctacggcggtcctattagccagcataactatcggccaggctacttcactcagacagcggggccgtggcacctgggaaaacttgagttggactttgatctgtgcgaaggcaccacggtggtagtcgacgagcactgcgggaatcgaggaccctctttaagaactaccacagtgaccggcaagatcattcatgaatggtgttgcaggtcctgtactctccctccactgcgcttccggggtgaggatgggtgctggtacggaatggagatcagacccgtgaaagaaaaggaggaaaaccttgtcaggagtatggttagcgccggctctggtgaggtggactccttttcactgggcatattgtgtgctagtattatgatcgaagaggtaatgcgcagccgatggtcgcggaagatgctcatgacagggaccctggccgtgttcctactgctcatcatgggacaactgacatggaatgaccttattcgtttgtgcatcatggtcggcgcaaacgcttccgatagaatggggatgggaactacctatctggccttaatggcaacgtttaaaatgaggcctatgttcgccgtgggcctcctgtttcgccggcttacatctagagaggttctgctactcaccattggtctgagcttggtggcttcagtcgaactgccaaacagtttagaggaactcggggacggactggcgatgggcataatgatgcttaagctgttgactgagttccagccccaccagctctggaccacactgctatccctgacttttatcaaaaccacgctttctctcgattacgcctggaagacaaccgcaatggctctgagcattgtgtccttgttcccgctgtgtttatcaactacaagccagaaaaccacttggctccctgttctgcttggcagttttgggtgcaagccactgacaatgttcttgatcaccgaaaataagatttggggaaggaaatcttggcccctcaacgagggtatcatggccataggcatcgtgtccattctgctaagctcgctgcttaagaatgacgtccctctcgccgggcccctgatcgctggaggcatgttgattgcatgttatgtaatctcaggttctagtgccgatttatccctggagaaagcggctgaagtgagctgggagcaagaagccgagcattctgggacgagccacaacatactcgttgaagtgcaggacgatggaactatgaagattaaagacgaggagcgagatgacaccctgacaatccttctgaaggcaaccttgctagccgtctccggcgtgtacccaatgtcaatccctgctacactgtttgtatggtatttctggcagaaaaagaagcagcgcagtggcgtgctctgggatactcccagcccaccggaagtcgagcgggcagttctggacgatgggatttacagaatacttcaaaggggattactgggtcgttctcaggtgggcgtgggggtcttccaggacggagtgtttcataccatgtggcacgttacgcgcggcgccgtactcatgtatcagggtaaacggttggaaccttcctgggcgtcagtgaagaaagacctgatcagttacgggggaggctggagattccaaggcagctggaatacaggggaggaggtccaggtgattgctgttgaacccggaaagaacccaaaaaatgtgcagactacccccggtacatttaagacccctgagggcgaagtcggggccatcgcactcgatttcaagccaggaacttccggctctcccattgtgaacagggagggtaaaatcgtagggctgtacggaaatggcgtcgtgaccacatcgggcacgtatgttagcgccatagctcaagccaaggcatcacaggaagggcctcttccggagatcgaggacgaagtgtttaaaaagcgaaacctgactattatggatttgcacccaggatccggtaaaacccggcgctacctacccgctatcgtcagagaggccattaagaggaagctgcggacactcatcttagcgcctacccgagtggttgccagtgaaatggcagaggctctgaaaggcatgccaataagatatcagactacagccgtgaagtctgaacataccgggcgcgagattgtcgaccttatgtgccacgctacgttcactatgaggctgctcagccccgtgcgtgtacctaattacaacatgatcatcatggatgaggcacattttacagacccggcctccattgccgctcggggatatatctcaaccagagtgggcatgggtgaagcggcagccatattcatgaccgctactcccccagggtctgttgaggcctttcctcagagcaatgcagtcattcaagatgaagagagggacatccccgaacgcagttggaactccggatacgattggattacagacttcccaggcaaaaccgtgtggtttgtgcctagcatcaagtctggcaatgatatagccaactgtttgcgaaaaaacgggaagagagtcattcagctgtcacggaagacattcgacactgagtatcagaaaacgaagaataacgactgggattacgtagtgaccacagacatctccgagatgggagctaatttcagggcggatcgcgttatcgacccccgtagatgcctcaaaccagtgattctgaaggatggtccggaacgggtcatccttgccggccctatgcccgtgactgttgcaagtgctgcccagaggcgcgggcgaattggaagaaaccaaaataaagagggcgaccagtacgtgtatatgggtcagccactaaacaatgatgaagaccacgcacattggaccgaggccaagatgctgttggataacataaatacacccgaggggatcattcctgctttatttgaaccagagcgggaaaagagcgccgcgatcgacggcgagtacaggctgcgcggagaagcaagaaaaaccttcgtcgagctcatgaggcggggcgatctgcccgtgtggctttcgtataaggtagcctctgaggggtttcagtactccgaccgtcgctggtgcttcgatggagaacgaaacaatcaagtgctggaggaaaacatggacgttgagatctggactaaagaaggtgagagaaagaaactcaggcctcggtggttggacgctcgcacgtatagcgatccgctggccctaagagagtttaaggaattcgctgcaggcaggcggtcagtcagtggggacctgattctcgagataggaaaacttccacagcacctgaccttacgagcccagaatgctttggataacctggtgatgctccacaattctgaacagggcggtaaggcctacagacatgcaatggaggaactgcccgacacaatcgagactcttatgctgctcgcgttgattgccgtgctgaccgggggcgtcacattatttttcctatccggaaagggcctggggaaaaccagcatcggactcctttgtgttactgcttcaagtgccctgttgtggatggcaagcgtggagcctcactggattgctgcctccatcatactggaatttttcctcatggtactgcttatccccgagccagatcgccaaaggacacctcaggacaaccagctcgcatatgtggtcattggtctgttgtttatgatcctgacggtggccgctaacgaaatgggcttactagagaccactaagaaagatctggggattggacatgttgcggccgagaatcaccaacacgcaacaatgctcgacgtggatcttcggcccgcttctgcctggaccctgtacgccgtcgcaaccacagtaatcactccaatgatgcgtcatacgatagaaaacaccacagctaatattagcttgactgccatcgcgaaccaggctgccattctgatgggcctcgacaagggttggcctatctccaaaatggatataggggtgccgctgcttgcattaggctgctactcacaggttaatcccctgaccctcacagccgctgtgttgatgctggtcgcacactatgccatcattggaccaggcctacaggcgaaggctaccagagaggcccaaaagaggactgcagccgggatcatgaaaaaccctacggtggacggaattgtcgctatcgatctggaccccgtggtttacgacacaaagttcgaaaaacagctcggccagataatgcttctgattttgtgtacctctcagatcctgctcatgcgcactacctgggccctgtgcgagagtatcacattagcaactggtccacttaccacactgtgggaagggtcgcctggaaagttttggaatacgaccattgctgtgagcatggccaacatcttccggggctcctatctcgcgggtgccggcctagcattctctctgatgaaatcattggggggaggccgaagagggactggagctcaaggcgagacactgggtgagaagtggaagaggcagctcaatcagcttagcaaatccgaatttaacatatacaagcgcagtgggattatggaggtagatcggtctgaagccaaagagggactgaagagaggcgaaaccactaaacatgcagtgagccgtggtacagctaagttgaggtggttcgtcgagcggaatctggttaagcccgagggcaaagtgatcgacctcgggtgtggacgcggcgggtggtcatattactgcgccggattaaagaaagtcaccgaagtgaagggctatacgaaaggtgggccgggacacgaggaaccaattcctatggccacctacggctggaacctggtaaagcttcattccggcaaagatgtgtttttcatgcccccagagaagtgtgacacactgctatgcgatatcggggaaagtagccccaatcctactatagaggagggacgaaccctcagagttctgaagatggtggaaccgtggttgaggggtaaccagttttgtatcaaaattctgaatccctacatgccatctgtcgtggagacactcgaacaaatgcagcggaagtatggcgggatgcttgtccgcaaccctctgtccagaaattcaactcacgagatgtactgggtgagctgcggaaccggcaacatcgtttcggcggtaaacatgacatctaggatgttactgaatcgattcaccatggctcaccggaaacccacttatgagcgtgacgtggatttgggtgcagggacgagacatgtcgccgtggaacctgaggttgctaacctcgacattatcggacagcgcattgaaaatatcaagaacgagcacaaaagtacatggcattacgatgaagacaatccatataagacctgggcctaccacggctcctatgaggtgaagcccagcggctcagcatcctctatggtcaacggggtggtaaggctgctaactaaaccttgggatgtgataccaatggttacccaaattgccatgacagacacgaccccctttggacagcagcgggtcttcaaggagaaagtggacactagaacaccgcgcgctaagaggggtaccactcagatcatggaagtgacagcgaaatggctttggggctttctgagccgaaataagaagcctcggatctgtaccagagaggaattcacaaggaaagtccgcagtaacgccgcaattggggctgtttttgtggatgagaatcaatggaactccgccaaggaagcagtagaggacgagcgtttctgggatctcgtgcaccgggaaagagagctgcataaacagggaaagtgcgccacttgcgtctacaatatgatgggcaaaagggaaaagaagttgggtgagtttgggaaagctaagggaagccgcgccatatggtacatgtggctgggcgcgcgattcctcgaattcgaggcacttggctttatgaacgaggaccactggttctctcgggaaaattcactgagtggggtggagggagaaggtttacataaactgggctatatcttgagagatatttccaagatcccagggggaaacatgtacgccgacgataccgctggctgggacacgaggattaccgaggatgacctccagaatgaggccaaaatcacagatataatggaacccgagcacgcactgctagctactagcatctttaagcttacctatcagaacaaagttgtgcgcgtccaaagacctgccaagaacggtacagtgatggacgtaatttctcggagggatcagcgtgggtcgggacaggttggcacttacggcctgaataccttcacgaacatggaagtgcagctcatccgacaaatggagtcagaagggatttttctgccaagcgagttggagacacccaatttagctgaacgcgtcctggactggctcgagaagcatggagccgaaagacttaaacggatggcaatctccggtgacgattgtgtggtgaagccgatagacgataggttcgcgaccgccctgactgctctaaacgacatgggcaaagtccgcaaggatattcctcagtgggagcccagtaaagggtggaatgactggcagcaggttccattttgctctcaccacttccatcaactgatcatgaaggatggaagagaaatcgtggtaccttgtcggaaccaggacgagctcgtgggcagggcccgagtcagccagggtgcagggtggtccttgcgtgagacagcttgcctgggaaagtcatatgcccaaatgtggcagcttatgtactttcacagacgcgatctgcggctcgcagccaatgcgatttgtagtgctgtgcccgttgactgggtgccaacctctaggactacctggagcatacatgcccaccaccagtggatgacaacggaagatatgttatccgtctggaacagagtgtggatcgaggaaaatccctggatggaggacaaaacccatgtatcaagctgggaagaggttccttatctgggcaagcgcgaggaccagtggtgcggctctttgattgggctgactgcacgggccacatgggctaccaacatccaagtggccattaatcaggtcaggcgactcatcggaaacgaaaattaccttgattacatgacttccatgaaaagattcaagaacgagagtgacccagaaggtgcactgtggtga

SEQ ID NO: 13403 - RNA, 9879 nt, synthetic construct
  misc_feature 1..9879: note = derived and/or modified CDS sequence (opt3) from DENV-1__GQ199857__SS-prME
  source 1..9879: mol_type = other RNA
agcgtgaccatgctgctcatgcttctgcccacagccttggctttccacttaactacgagaggcggggagcctcatatgatcgtctccaagcaggaaaggggaaaatctctgctatttaagacctcagcaggtgttaacatgtgcacactcattgccatggacctgggcgagctttgtgaagatactatgacctacaaatgcccacaaataacagaggcggaaccggacgatgtggactgttggtgcaatgctaccgatacttgggtaacatatgggacctgtagtcagacgggagagcaccggcgcgacaagcgaagcgtggccctggcaccccatgtcggcttgggtctcgagactcgtaccgaaacatggatgtcctctgagggggcctggaaacagatccagagagtggaaacttgggctctgaggcaccctggattcaccgttattgcactgtttctcgcccatgctatcggcacatcgattacccaaaagggcatcatattcatcttactgatgcttgtgacgccatcaatggccatgcggtgcgtcgggattggaaaccgcgattttgtggagggtttgagcggcgcgacttgggtagacgttgtgctggagcacgggagttgtgtcacaaccatggcaaagaataaacccactctagatatcgaactcctgaagacagaggtgaccaaccctgccattcttagaaaactgtgcatcgaagctaagatatccaatacgaccacagactctaggtgtccaactcagggagaggccaccttggtggaagagcaggatgcaaacttcgtctgccggcgcacatttgttgaccgaggctggggtaatgggtgtggactcttcggcaaaggcagcctgttaacttgcgctaagtttaagtgcgtgaccaaactggaggggaagattgtacagtacgaaaacctcaaatattccgtgatcgtcacagtgcacaccggagatcaacatcaggttggtaatgagactacggaacacggcacaattgccaccatcactccccaggcgcctacctcagagatccagcttacagactacggggccctgaccttggactgtagtccaagaactggactagatttcaacgaaatggtgctgctcacaatgaaggagaaaagctggctggtccataagcaatggtttcttgacctgccgttgccctggacgtctggcgcatccacctcacaggagacttggaataggcaggatctcctggtgacattcaaaaccgctcacgccaagaagcaagaagtagttgtgttaggtagccaggagggggctatgcacacagccctgactggcgcaaccgaaattcagacgagtggaaccacaactatatttgccggccatctaaaatgccggctcaagatggacaaactgacccttaaggggacatcttatgtcatgtgtactggatccttcaaattggagaaggaagtggctgagacccagcacggtacggtcctggtgcaagttaagtacgagggcacagatgcgccttgcaaaatcccattcagcacccaggacgaaaagggggtgactcagaacggacgtctcattacagcaaatcccatcgtaaccgataaagagaagcctgtcaacatagaaactgagccaccctttggcgagtcgtatattgtggttggtgccggggaaaaagctctgaagctttcttggttcaagaaaggctcctcaatcggaaagatgtttgaggccaccgcacgcggcgccagaaggatggctatcctgggggacacagcctgggatttcggaagtattggtggcgtgtttacgagcgtcgggaaattggtgcatcaggtattcggaaccgcatacggcgtgctcttttccggtgtttcttggactatgaagatcgggattggcatactgttaacatggctgggactaaatagccggtcaaccagtctctccatgacatgtatcgcggtcggcatggtgactctgtaccttggggtgatggtccaagctgacagcggatgcgttattaactggaaaggccgagaattgaagtgtggttctgggatcttcgtgaccaacgaggtgcacacgtggacagaacagtataagtttcaggccgattcaccgaaacgcctgagtgcagccatcggaaaggcttgggaggagggcgtatgcggtattagaagcgccaccaggctcgaaaatataatgtggaaacagatctccaacgagctgaatcatattttactggaaaacgacatgaagttcactgtcgtggttggcgacgcaaatgggatccttgctcaaggaaaaaagatgattcggcctcagcccatggagcacaaatactcttggaagtcgtggggcaaggccaaaatcataggggcggatatccagaacaccacatttattatcgacggaccagatactcctgaatgtcccgacaatcagcgcgcctggaacatttgggaggtggaggattatggcttcggtatctttaccacaaatatatggttgaagctcagagacagctacacgcaaatgtgcgatcacaggctgatgtccgctgcaattaaagactcaaaggccgtccatgctgatatggggtattggatcgaaagtgagaaaaacgaaacctggaagctagcccgtgcatctttcattgaggtgaagacttgtacatggccaaaaagccacaccctgtggtccaatggagttctcgaatcagagatgatcatacccaagatctacggcggtcctattagccagcataactatcggccaggctacttcactcagacagcggggccgtggcacctgggaaaacttgagttggactttgatctgtgcgaaggcaccacggtggtagtcgacgagcactgcgggaatcgaggaccctctttaagaactaccacagtgaccggcaagatcattcatgaatggtgttgcaggtcctgtactctccctccactgcgcttccggggtgaggatgggtgctggtacggaatggagatcagacccgtgaaagaaaaggaggaaaaccttgtcaggagtatggttagcgccggctctggtgaggtggactccttttcactgggcatattgtgtgctagtattatgatcgaagaggtaatgcgcagccgatggtcgcggaagatgctcatgacagggaccctggccgtgttcctactgctcatcatgggacaactgacatggaatgaccttattcgtttgtgcatcatggtcggcgcaaacgcttccgatagaatggggatgggaactacctatctggccttaatggcaacgtttaaaatgaggcctatgttcgccgtgggcctcctgtttcgccggcttacatctagagaggttctgctactcaccattggtctgagcttggtggcttcagtcgaactgccaaacagtttagaggaactcggggacggactggcgatgggcataatgatgcttaagctgttgactgagttccagccccaccagctctggaccacactgctatccctgacttttatcaaaaccacgctttctctcgattacgcctggaagacaaccgcaatggctctgagcattatctccttgttcccgctgtgtttatcaactacaagccagaaaaccacttggctccctgtgctgcttggcagttttgggtgcaagccactgacaatgttcttgattaccgaaaataagatctggggaaggaaatcttggcccctcaacgagggtataatggccatcggcattgtttccatcctgctaagctcgctgcttaagaatgacgtgcctctcgccgggcccctgattgctggaggcatgttgatcgcatgttatgtcatatcaggttctagtgccgatttatccctggagaaagcggctgaagtaagctgggagcaagaagccgagcattctgggacgagccacaacattctcgtggaagttcaggacgatggaactatgaagatcaaagacgaggagcgagatgacaccctgacaatccttctgaaggcaaccttgctagccgtgtccggcgtctacccaatgtcaattcctgctacactgtttgtgtggtatttctggcagaaaaagaagcagcgcagtggcgtactctgggatactcccagcccaccggaagtggagcgggcagtcctggacgatgggatatacagaatccttcaaaggggattactgggtcgttctcaggttggcgtgggggtgttccaggacggagtctttcataccatgtggcacgtgacgcgcggcgccgttctcatgtatcagggtaaacggttggaaccttcctgggcgtcagtaaagaaagacctgattagttacgggggaggctggagattccaaggcagctggaatacaggggaggaggtgcaggtcatcgctgtggaacccggaaagaacccaaaaaatgttcagactacccccggtacatttaagacccctgagggcgaagtgggggccattgcactcgatttcaagccaggaacttccggctctcccatcgtcaacagggagggtaaaatagtggggctgtacggaaatggcgtagtcaccacatcgggcacgtatgtgagcgccatcgctcaagccaaggcatcacaggaagggcctcttccggagattgaggacgaagtttttaaaaagcgaaacctgactatcatggatttgcacccaggatccggtaaaacccggcgctacctacccgctattgtgagagaggccatcaagaggaagctgcggacactcatattagcgcctacccgagtcgtggccagtgaaatggcagaggctctgaaaggcatgccaattagatatcagactacagccgttaagtctgaacataccgggcgcgagatcgtggaccttatgtgccacgctacgttcactatgaggctgctcagccccgtccgtgtgcctaattacaacatgatcattatggatgaggcacattttacagacccggcctccatcgccgctcggggatatatatcaaccagagtaggcatgggtgaagcggcagccattttcatgaccgctactcccccagggtctgtggaggcctttcctcagagcaatgcagttatccaagatgaagagagggacattcccgaacgcagttggaactccggatacgattggatcacagacttcccaggcaaaaccgtctggtttgtgcctagcataaagtctggcaatgatattgccaactgtttgcgaaaaaacgggaagagagtgatccagctgtcacggaagacattcgacactgagtatcagaaaacgaagaataacgactgggattacgtcgtaaccacagacatctccgagatgggagctaatttcagggcggatcgcgtgattgacccccgtagatgcctcaaaccagttatcctgaaggatggtccggaacgggtgattcttgccggccctatgcccgtcactgtggcaagtgctgcccagaggcgcgggcgaataggaagaaaccaaaataaagagggcgaccagtacgtttatatgggtcagccactaaacaatgatgaagaccacgcacattggaccgaggccaagatgctgttggataacatcaatacacccgaggggattatccctgctttatttgaaccagagcgggaaaagagcgccgcgatcgacggcgagtacaggctgcgcggagaagcaagaaaaaccttcgtggagctcatgaggcggggcgatctgcccgtctggctttcgtataaggtggcctctgaggggtttcagtactccgaccgtcgctggtgcttcgatggagaacgaaacaatcaagtactggaggaaaacatggacgtggagatttggactaaagaaggtgagagaaagaaactcaggcctcggtggttggacgctcgcacgtatagcgatccgctggccctaagagagtttaaggaattcgctgcaggcaggcggtcagttagtggggacctgatactcgagatcggaaaacttccacagcacctgaccttacgagcccagaatgctttggataacctggtcatgctccacaattctgaacagggcggtaaggcctacagacatgcaatggaggaactgcccgacacaattgagactcttatgctgctcgcgttgatcgccgtgctgaccgggggcgtgacattatttttcctatccggaaagggcctggggaaaaccagcattggactcctttgtgtcactgcttcaagtgccctgttgtggatggcaagcgttgagcctcactggatcgctgcctccataatcctggaatttttcctcatggtgctgcttattcccgagccagatcgccaaaggacacctcaggacaaccagctcgcatatgtagtgatcggtctgttgtttatgattctgacggtcgccgctaacgaaatgggcttactagagaccactaagaaagatctggggatcggacatgtggcggccgagaatcaccaacacgcaacaatgctcgacgttgatcttcggcccgcttctgcctggaccctgtacgccgtggcaaccacagtcataactccaatgatgcgtcatacgattgaaaacaccacagctaatatcagcttgactgccattgcgaaccaggctgccatcctgatgggcctcgacaagggttggcctatatccaaaatggatatcggggtaccgctgcttgcattaggctgctactcacaggtgaatcccctgaccctcacagccgctgttttgatgctggtggcacactatgccattatcggaccaggcctacaggcgaaggctaccagagaggcccaaaagaggactgcagccgggattatgaaaaaccctacggtcgacggaatcgtggctatagatctggaccccgtcgtgtacgacacaaagttcgaaaaacagctcggccagattatgcttctgatcttgtgtacctctcagatcctgctcatgcgcactacctgggccctgtgcgagagtattacattagcaactggtccacttaccacactgtgggaagggtcgcctggaaagttttggaatacgaccatcgctgttagcatggccaacatattccggggctcctatctcgcgggtgccggcctagcattctctctgatgaaatcattggggggaggccgaagagggactggagctcaaggcgagacactgggtgagaagtggaagaggcagctcaatcagcttagcaaatccgaatttaacatttacaagcgcagtgggatcatggaggtggatcggtctgaagccaaagagggactgaagagaggcgaaaccactaaacatgcagtaagccgtggtacagctaagttgaggtggttcgtggagcggaatctggtcaagcccgagggcaaagttattgacctcgggtgtggacgcggcgggtggtcatattactgcgccggattaaagaaagtgaccgaagtcaagggctatacgaaaggtgggccgggacacgaggaaccaatccctatggccacctacggctggaacctggtgaagcttcattccggcaaagatgtatttttcatgcccccagagaagtgtgacacactgctatgcgatataggggaaagtagccccaatcctactatcgaggagggacgaaccctcagagtgctgaagatggttgaaccgtggttgaggggtaaccagttttgtattaaaatcctgaatccctacatgccatctgtggtcgagacactcgaacaaatgcagcggaagtatggcgggatgcttgtgcgcaaccctctgtccagaaattcaactcacgagatgtactgggtcagctgcggaaccggcaacattgtgtcggcggttaacatgacatctaggatgttactgaatcgattcaccatggctcaccggaaacccacttatgagcgtgacgtagatttgggtgcagggacgagacatgtggccgtcgaacctgaggtggctaacctcgacatcattggacagcgcatcgaaaatataaagaacgagcacaaaagtacatggcattacgatgaagacaatccatataagacctgggcctaccacggctcctatgaggttaagcccagcggctcagcatcctctatggtgaacggggtcgtgaggctgctaactaaaccttgggatgtaattccaatggtgacccaaatcgccatgacagacacgaccccctttggacagcagcgggttttcaaggagaaagtcgacactagaacaccgcgcgctaagaggggtaccactcagatcatggaagtgacagcgaaatggctttggggctttctgagccgaaataagaagcctcggatttgtaccagagaggaattcacaaggaaagtgcgcagtaacgccgcaataggggctgtctttatcgatgagaatcaatggaactccgccaaggaagcagttgaggacgagcgtttctgggatctcgtgcaccgggaaagagagctgcataaacagggaaagtgcgccacttgcgtatacaatatgatgggcaaaagggaaaagaagttgggtgagtttgggaaagctaagggaagccgcgccatttggtacatgtggctgggcgcgcgattcctcgaattcgaggcacttggctttatgaacgaggaccactggttctctcgggaaaattcactgagtggggtggagggagaaggtttacataaactgggctatatcttgagagatatttccaagatcccagggggaaacatgtacgccgacgataccgctggctgggacacgaggataaccgaggatgacctccagaatgaggccaaaatcacagatattatggaacccgagcacgcactgctagctactagcatctttaagcttacctatcagaacaaagtcgtgcgcgttcaaagacctgccaagaacggtacagtgatggacgtcatttctcggagggatcagcgtgggtcgggacaggtgggcacttacggcctgaataccttcacgaacatggaagtacagctcatccgacaaatggagtcagaagggatatttctgccaagcgagttggagacacccaatttagctgaacgcgttctggactggctcgagaagcatggagccgaaagacttaaacggatggcaatttccggtgacgattgtgtggtcaagccgatcgacgataggttcgcgaccgccctgactgctctaaacgacatgggcaaagtgcgcaaggatatccctcagtgggagcccagtaaagggtggaatgactggcagcaggtgccattttgctctcaccacttccatcaactgattatgaaggatggaagagaaatagtcgttccttgtcggaaccaggacgagctcgtgggcagggcccgagtaagccagggtgcagggtggtccttgcgtgagacagcttgcctgggaaagtcatatgcccaaatgtggcagcttatgtactttcacagacgcgatctgcggctcgcagccaatgcgatctgtagtgctgtgcccgtcgactgggtgccaacctctaggactacctggagcattcatgcccaccaccagtggatgacaacggaagatatgttatccgtttggaacagagtgtggatcgaggaaaatccctggatggaggacaaaacccatgtctcaagctgggaagaggtgccttatctgggcaagcgcgaggaccagtggtgcggctctttgattgggctgactgcacgggccacatgggctaccaacatccaagtagccataaatcaggttaggcgactcatcggaaacgaaaattaccttgattacatgacttccatgaaaagattcaagaacgagagtgacccagaaggtgcactgtggtga

SEQ ID NO: 13404 - RNA, 9879 nt, synthetic construct
  misc_feature 1..9879: note = derived and/or modified CDS sequence (opt3) from DENV-1__GQ199858__SS-prME
  source 1..9879: mol_type = other RNA
agcgtgaccatgctgctcatgcttctgccaacagcattggctttccacttaactacgcgaggaggggaacctcatatgatcgtctccaagcaggaaaggggaaaatctctgttgtttaagacctcagccggtgttaacatgtgcacactcattgccatggacctgggcgaactttgtgaagatactatgacctacaaatgcccacaaataacagaggcggaaccggacgatgtggactgttggtgcaatgctaccgatacttgggtaacatatgggacctgtagtcagacgggagagcaccggcgcgacaagcgaagcgtggccctggcaccccatgtcggcttgggtctcgagactcgtaccgaaacatggatgtcctctgagggggcctggaaacagatccagagagtggaaacttgggctctgaggcaccctggattcaccgttattgcactgtttctcgcccatgctatcggcacatcgattacccaaaagggcatcatattcatcttactgatgcttgtgacgccatcaatggccatgcggtgcgtcgggattggaaaccgcgattttgtggagggtttgagcggcgcgacttgggtagacgttgtgctggagcacgggagttgtgtcacaaccatggcaaagaataaacccactctagatatcgaactcctgaagacagaggtgaccaaccctgccattcttagaaaactgtgcatcgaagctaagatatccaatacgaccacagactctaggtgtccaactcagggagaggccaccttggtggaagaacaggatgcaaacttcgtctgccggcgcacatttgttgaccgaggctggggtaatgggtgtggactcttcggcaaaggcagcctgttaacttgcgctaagtttaagtgcgtgaccaaactggaggggaagattgtacagtacgaaaacctcaaatattccgtgatcgtcacagtgcacaccggagatcaacatcaggttggtaatgagactacggaacacggcacaattgccaccatcactccccaggcgcctacctcagagatccagcttacagactacggggccctgaccttggactgtagtccaagaactggactagatttcaacgaaatggtgctgctcacaatgaaggagaaaagctggctggtccataagcaatggtttcttgacctgccgttgccctggacgtctggcgcatccacctcacaggagacttggaataggcaggatctcctggtgacattcaaaaccgctcacgccaagaagcaagaagtagttgtgttaggtagccaggagggggctatgcacacagccctgactggcgcaaccgaaattcagacgagtggaaccacaactatatttgccggccatctaaaatgccggctcaagatggacaaactgacccttaaggggacatcttatgtcatgtgtactggatccttcaaattggagaaggaagtggctgagacccagcacggtacggtcctggtgcaagttaagtacgagggcacagatgcgccttgcaaaatcccattcagcacccaggacgaaaagggggtgactcagaacggacgtctcattacagcaaatcccatcgtaaccgataaagagaagcctgtcaacatagaaactgagccaccctttggcgagtcgtatattgtggttggtgccggggaaaaagctctgaaactttcttggttcaagaaaggctcctcaatcggaaagatgtttgaggccaccgcacgcggcgccagaaggatggctatcctgggggacacagcctgggatttcggaagtattggtggcgtgtttacgagcgtcgggaaattggtgcatcaggtattcggaaccgcatacggcgtgctcttttccggtgtttcttggactatgaagatcgggattggcatactgttaacatggctgggactaaatagccggtcaaccagtctctccatgacatgtatcgcggtcggcatggtgactctgtaccttggggtgatggtccaagctgacagcggatgcgttattaactggaaaggccgagaattgaagtgtggttctgggatcttcgtgaccaacgaggtgcacacgtggacagaacagtataagtttcaggccgattcaccgaaacgcctgagtgcagccatcggaaaggcttgggaggagggcgtatgcggtattagaagcgccaccaggctcgaaaatataatgtggaaacagatctccaacgagctgaatcatattttactggaaaacgacatgaagttcactgtcgtggttggcgacgcaaatgggatccttgctcaaggcaagaagatgattcggcctcagcccatggagcacaaatactcttggaagtcgtggggcaaggccaaaatcataggggcggatatccagaacaccacatttattatcgacggaccagatactcctgaatgtcccgacaatcagcgcgcctggaacatttgggaggtggaggattatggcttcggtatctttaccacaaatatatggttgaagctcagagacagctacacgcaaatgtgcgatcacaggctgatgtccgctgcaattaaagactcaaaggccgtccatgctgatatggggtattggatcgaaagtgagaaaaacgaaacctggaagctagcccgtgcatctttcattgaggtgaagacttgtacatggccaaaaagccacaccctgtggtccaatggagttctcgaatcagagatgatcatacccaagatctacggcggtcctattagccagcataactatcggccaggctacttcactcagacagcggggccgtggcacctgggaaaacttgagttggactttgatctgtgcgaaggcaccacggtggtagtcgacgagcactgcgggaatcgaggaccctctttaagaactaccacagtgaccggcaagatcattcatgaatggtgttgcaggtcctgtactctccctccactgcgcttccggggtgaggatgggtgctggtacggaatggagatcagacccgtgaaagaaaaggaggaaaaccttgtcaggagtatggttagcgccggctctggtgaggtggactccttttcactgggcatattgtgtgctagtattatgatcgaagaggtaatgcgcagccgatggtcgcggaagatgctcatgacagggaccctggccgtgttcctactgctcatcatgggacaactgacatggaatgaccttattcgtttgtgcatcatggtcggcgcaaacgcttccgatagaatggggatgggaactacctatctggccttaatggcaacgtttaaaatgaggcctatgttcgccgtgggcctcctgtttcgccggcttacatctagagaggttctgctactcaccattggtctgagcttggtggcttcagtcgaactgccaaacagtttagaggaactcggggacggactggcgatgggcataatgatgcttaagctgttgactgagttccagccccaccagctctggaccacactgctatccctgacttttatcaaaaccacgctttctctcgattacgcctggaagacaaccgcaatggctctgagcattatctccttgttcccgctgtgtttatcaactacaagccagaaaaccacttggctccctgtgctgcttggcagttttgggtgcaagccactgacaatgttcttgattaccgaaaataagatctggggaaggaaatcttggcccctcaacgagggtataatggccatcggcattgtttccatcctgctaagctcgctgcttaagaatgacgtgcctctcgccgggcccctgattgctggaggcatgttgatcgcatgttatgtcatatcaggttctagtgccgatttatccctggagaaagcggctgaagtaagctgggagcaagaagccgagcattctgggacgagccacaacattctcgtggaagttcaggacgatggaactatgaagatcaaagacgaggagcgagatgacaccctgacaatccttctgaaggcaaccttgctagccgtgtccggcgtctacccaatgtcaattcctgctacactgtttgtgtggtatttctggcagaaaaagaagcagcgcagtggcgtactctgggatactcccagcccaccggaagtggagcgggcagtcctggacgatgggatatacagaatccttcaaaggggattactgggtcgttctcaggttggcgtgggggtgttccaggacggagtctttcataccatgtggcacgtgacgcgcggcgccgttctcatgtatcagggtaaacggttggaaccttcctgggcgtcagtaaagaaagacctgattagttacgggggaggctggagattccaaggcagctggaatacaggggaggaggtgcaggtcatcgctgtggaacccggaaagaaccccaaaaatgttcagactacccccggtacatttaagacccctgagggcgaagtgggggccattgcactcgatttcaagccaggaacttccggctctcccatcgtcaacagggagggtaaaatagtggggctgtacggaaatggcgtagtcaccacatcgggcacgtatgtgagcgccatcgctcaagccaaggcatcacaggaagggcctcttccggagattgaggacgaagtttttaaaaagcgaaacctgactatcatggatttgcacccaggatccggtaaaacccggcgctacctacccgctattgtgagagaggccatcaagaggaagctgcggacactcatattagcgcctacccgagtcgtggccagtgaaatggcagaggctctgaaaggcatgccaattagatatcagactacagccgttaagtctgaacataccgggcgcgagatcgtggaccttatgtgccacgctacgttcactatgaggctgctcagccccgtccgtgtgcctaattacaacatgatcattatggatgaggcacattttacagacccggcctccatcgccgctcggggatatatatcaaccagagtaggcatgggtgaagcggcagccattttcatgaccgctactcccccagggtctgtggaggcctttcctcagagcaatgcagttatccaagatgaagagagggacattcccgaacgcagttggaactccggatacgattggatcacagacttcccaggcaaaaccgtctggtttgtgcctagcataaagtctggcaatgatattgccaactgtttgcggaaaaacgggaagagagtgatccagctgtcaagaaagacattcgacactgagtatcagaaaacgaagaataacgactgggattacgtcgtaaccacagacatctccgagatgggagctaatttcagggcggatcgcgtgattgacccccgtagatgcctcaaaccagttatcctgaaggatggtccggaacgggtgattcttgccggccctatgcccgtcactgtggcaagtgctgcccagaggcgcgggcgaataggaagaaaccaaaataaagagggcgaccagtacgtttatatgggtcagccactaaacaatgatgaagaccacgcacattggaccgaggccaagatgctgttggataacatcaatacacccgaggggattatccctgctttatttgaaccagagcgggaaaagagcgccgcgatcgacggcgagtacaggctgcgcggagaagcaagaaaaaccttcgtggagctcatgaggcggggcgatctgcccgtctggctttcgtataaggtggcctctgaggggtttcagtactccgaccgtcgctggtgcttcgatggagaacgaaacaatcaagtactggaggaaaacatggacgtggagatttggactaaagaaggtgagagaaagaaactcaggcctcggtggttggacgctcgcacgtatagcgatccgctggccctaagagagtttaaggagttcgctgcaggcaggcggtcagttagtggggacctgatactcgagatcggaaaacttccacagcacctgaccttacgagcccagaatgctttggataacctggtcatgctccacaattctgaacagggcggtaaggcctacagacatgcaatggaggaactgcccgacacaattgagactcttatgctgctcgcgttgatcgccgtgctgaccgggggcgtgacattatttttcctatccggaaagggcctggggaaaaccagcattggactcctttgtgtcactgcttcaagtgccctgttgtggatggcaagcgttgagcctcactggatcgctgcctccataatcctggaatttttcctcatggtgctgcttattcccgagccagatcgccaaaggacacctcaggacaaccagctcgcatatgtagtgatcggtctgttgtttatgattctgacggtcgccgctaacgaaatgggcttactagagaccactaagaaagatctggggatcggacatgtggcggccgagaatcaccaacacgcaacaatgctcgacgttgatcttcggcccgcttctgcctggaccctgtacgccgtggcaaccacagtcataactccaatgatgcgtcatacgattgaaaacaccacagctaatatcagcttgactgccattgcgaaccaggctgccatcctgatgggcctcgacaagggttggcctatatccaaaatggatatcggggtaccgctgcttgcattaggctgctactcacaggtgaatcccctgaccctcacagccgctgttttgatgctggtggcacactatgccattatcggaccaggcctacaggcgaaggctaccagagaggcccaaaagaggactgcagccgggattatgaaaaaccctacggtcgacggaatcgtggctatagatctggaccccgtcgtgtacgacacaaagttcgaaaaacagctcggccagattatgcttctgatcttgtgtacctctcagatcctgctcatgcgcactacctgggccctgtgcgagagtattacattagcaactggtccacttaccacactgtgggaagggtcgcctggaaagttttggaatacgaccatcgctgttagcatggccaacatattccggggctcctatctcgcgggtgccggcctagcattctctctgatgaaatcactagggggaggccgaagagggactggagctcaaggcgagacactgggtgagaagtggaagaggcagctcaatcagcttagcaaatccgaatttaacatttacaagcgcagtgggatcatggaggtggatcggtctgaagccaaagagggactgaagagaggcgaaaccactaaacatgcagtaagccgtggtacagctaagttgaggtggttcgtggagcggaatctggtcaagcccgagggcaaagttattgacctcgggtgtggacgcggcgggtggtcatattactgcgccggattaaagaaagtgaccgaagtcaagggctatacgaaaggtgggctgggacacgaggaaccgatcccaatggccacctacggctggaaccttgtgaagctgcattccggcaaagatgtatttttcatgcctcccgagaagtgtgacacactactctgcgatataggggaaagtagcccaaatcccactatcgaggagggacgaaccctgagagtgttgaagatggttgaaccttggctgaggggtaaccagttttgtattaaaatcctcaatccgtacatgccctctgtggtcgagacacttgaacaaatgcagcggaagtatggcgggatgctggtgcgcaacccattatccagaaattcaactcacgagatgtactgggtcagctgcggaaccggcaacattgtgtcggcggttaacatgacatctaggatgctgttgaatcgattcaccatggctcaccggaaacctacttatgagcgtgacgtagatctcggtgcagggacgagacatgtggccgtcgaacccgaggtggctaacctggacatcattggacagcgcatcgaaaatataaagaacgagcacaaaagtacatggcattacgatgaagacaatccttataagacctgggcctaccacggctcctatgaggttaagccaagcggctcagcatcctctatggtgaacggggtcgtgaggctacttactaaaccctgggatgtaattcctatggtgacccaaatcgccatgacagacacgaccccatttggacagcagcgggttttcaaggagaaagtcgacactagaacaccccgcgctaagaggggtaccactcagatcatggaagtgacagcgaaatggctgtggggctttctcagccgaaataagaagccgcggatttgtaccagagaggagttcacaaggaaagtgcgcagtaacgccgcaataggggctgtctttgttgatgagaatcaatggaactccgccaaggaagcagtggaggacgagcgtttctgggatctggtacaccgggaaagagagttgcataaacagggaaagtgcgccacttgcgtgtacaatatgatgggcaaaagggaaaagaagctgggtgagtttgggaaagctaagggaagccgcgccatctggtacatgtggctcggcgcgcgattccttgagttcgaggcactgggctttatgaacgaggaccactggttctctcgggaaaattcattaagtggggtcgagggagaaggtctgcataaattgggctatattctcagagatatctccaagattcctgggggaaacatgtacgccgacgataccgctggctgggacacgaggatcaccgaggatgacctgcagaatgaggccaaaataacagatatcatggaaccagagcacgcactacttgctactagcatttttaagctgacctatcagaacaaagtggttcgcgtgcaaagacccgccaagaacggtacagtcatggacgtgatctctcggagggatcagcgtgggtcgggacaggtaggcacttacggcctcaataccttcacgaacatggaagttcagctgattcgacaaatggagtcagaagggatctttttgcctagcgagttagagacaccaaatctggctgaacgcgtgctcgactggcttgagaagcatggagccgaaagactgaaacggatggcaatatccggtgacgattgtgtcgtgaagcccattgacgataggttcgcgaccgccctaactgctctgaacgacatgggcaaagtgcgcaaggatatcccgcagtgggagcctagtaaagggtggaatgactggcagcaggtccccttttgctctcaccacttccatcaactcatcatgaaggatggaagagaaattgttgtgccatgtcggaaccaggacgagttggtaggcagggcccgagtgagccagggtgcagggtggtccctgcgtgagacagcttgccttggaaagtcatatgcccaaatgtggcagctgatgtactttcacagacgcgatctccggttagcagccaatgcgatatgtagtgctgtccctgtggactgggttcccacctctaggactacctggagcatccatgcccaccaccagtggatgacaacggaagatatgctgtccgtgtggaacagagtctggattgaggaaaatccatggatggaggacaaaacccatgtgtcaagctgggaagaggtaccctatttgggcaagcgcgaggaccagtggtgcggctctctgatcgggctcactgcacgggccacatgggctaccaacattcaagttgccatcaatcaggtgaggcgacttataggaaacgaaaattacctggattacatgacttccatgaaaagattcaagaacgagagtgaccctgaaggtgcactatggtga

SEQ ID NO: 13405 - RNA, 9879 nt, synthetic construct
  misc_feature 1..9879: note = derived and/or modified CDS sequence (opt3) from DENV-1__GQ199859__SS-prME
  source 1..9879: mol_type = other RNA
agcgtgaccatgctgctcatgcttctgcccacagccttggctttccacttaactacgagaggcggggagcctcatatgatcgtctccaagcacgaaaggggaaaatctctgctatttaagacctcaacaggtgttaacatgtgcactctcattgcaatggacctgggcgagctttgtgaagataccatgacatacaaatgcccacggataaccgaggccgaaccggacgatgtggactgttggtgcaatgcgactgatacatgggtaacctatgggacgtgtagtcagactggagagcatcgccgagacaagcgtagcgtggctctggccccccacgtcggcttgggtctcgagaccagaacagaaacttggatgtcctctgagggggcatggaaacaaatccagagggtggaaacctgggccctgcggcatcctggattcacagttattgctctgtttctcgcacacgccatcggcacctcgattacgcagaagggcatcatattcatcttactgatgcttgtgactccatcaatggctatgcgctgcgtcgggattggaaacagagattttgtggagggtttgagcggcgccacatgggtagacgttgtgctggagcacgggagttgtgtcaccactatggcgaagaataaacccacactagatatcgaactcctgaagaccgaggtgacgaaccctgcagtgcttaggaaactgtgcattgaagccaagatctccaataccacaactgactctcggtgtccaacccagggagaggctacattggtcgaagagcaagatgccaacttcgtttgccgccgaactctcgtggacagaggctggggtaatgggtgtggactgtttggcaaaggcagcttactgacctgcgcaaagttcaagtgcgtaacaaaactcgaggggaagatagtgcagtacgaaaaccttaaatattccgtcattgtgaccgttcatactggagatcagcaccaggtgggtaatgagacgacagaacatggcaccatcgctactattaccccccaagcccctacatcagagatccagctgaccgactacggggcgttgactctagactgtagtccaaggacaggactggattttaacgaaatggtcctcctgacgatgaaggagaaaagctggcttgtgcacaagcagtggttcctggacttgccgctcccctggacctctggcgcctccacttcacaggagacatggaatcggcaagatctgttagtaacctttaaaacagcacacgctaagaagcaggaagttgtggtcctgggtagccaggagggggccatgcatactgctctaaccggcgccacggaaatccaaaccagtggaacaactaccattttcgcaggccacctcaaatgccgtctgaagatggacaaacttacattgaaggggacttcttatgtgatgtgtaccggatcctttaaactggagaaggaagtcgccgagacgcagcatggtacagtgctcgttcaggtgaagtacgagggcaccgatgctccttgcaaaataccattcagcactcaggacgaaaagggggtaacacaaaacggacgcctgatcaccgcgaatcccattgtcactgataaagagaagcctgtgaacatcgaaaccgagccacccttcggcgagtcgtatatagttgtgggtgcaggggaaaaagcccttaagctgtcttggtttaagaaaggctcctcaattggaaagatgttcgaggctacagccagaggcgcaaggcggatggccatcttgggggacacggcttgggattttggaagtatcggtggcgtcttcaccagcgtggggaaactcgtacaccaggtgtttggaactgcctacggcgttctgttctccggtgtctcttggacaatgaagattgggatcggcattttactgacctggctaggactcaatagccgatcaacaagtctgtccatgacttgtatagcagtgggcatggtgaccctttacttgggggtcatggttcaggcggacagcggatgcgtgatcaactggaaaggccgcgaactgaagtgtggttctgggatttttgtgacgaacgaggtacatacatggaccgaacagtataagttccaagctgattcaccgaaaagactcagtgccgcaatcggaaaggcctgggaggagggcgtctgcggtatcaggagcgctactcggctggaaaatattatgtggaaacagatatccaacgagttaaatcacatcctgcttgaaaacgacatgaagtttaccgtggttgtgggcgacgccaatgggattttggcacagggaaaaaagatgatccgccctcagcccatggagcacaaatactcttggaagtcgtggggcaaggctaaaattatcggggccgatatacaaaacacaactttcatcattgacggaccagatacccctgaatgtcccgacgatcagagagcgtggaatatctgggaggtcgaggactatggctttggtattttcacaacgaacatctggctcaagctgagggatagctacacccagatgtgcgaccatcgtctaatgtccgccgctataaaagattcaaaggcagtgcacgccgacatggggtattggattgaaagtgagaaaaatgaaacttggaagctggctcgggcctcttttatcgaggttaagacatgtacctggccaaaaagccatactctctggtccaacggagtgctggaatcagagatgattatccccaagatatacggcggtcctatcagccagcacaattatcgaccaggctacttcacacaaaccgcagggccgtggcaccttggaaaattggagctggatttcgacttatgcgaaggcacgactgtagtcgtggatgagcattgcgggaacagaggaccctctctcaggaccacaaccgtgactggcaagattatccacgaatggtgttgccgctcctgtacactgcctccacttcggtttagaggtgaggacgggtgctggtacggaatggagattaggcccgtcaaagaaaaggaggaaaatctggttcgcagtatggtgagcgcgggctctggtgaggtagactccttctcattgggcatcctctgtgtgagtataatgattgaagaggtcatgcgaagccggtggtcgcgtaagatgctgatgaccgggacactagccgtgtttctgctcctgatcatgggacagcttacttggaacgatttgatcagactgtgcattatggttggcgctaatgcctccgacaggatggggatgggaaccacgtatttagcactcatggctacattcaaaatgcgccctatgtttgccgtgggcatcctgttccggagacttacctctagggaggtcctgctactcactattggtctgagcttggtggcatcagttgaactgccaaacagtttagaggaactcggggatggactggccatgggcataatgatgcttaagctgttgaccgagtttcagccccatcaactctggacaactctgctatccctgaccttcatcaaaacgacactttctctcgactacgcttggaagaccactgcgatggccctgagcattgtgtccttgtttccgctgtgtttatcaacaaccagccagaaaactacatggctccctgtcctgcttggcagtttcgggtgcaagccactgaccatgtatttgatcacggaaaacaagatttggggacgaaaatcttggcccatcaatgagggtataatggcaatcggcattgtatccatcctcctgagctcgctactgaagaacgatgtgcctcttgctgggcccctcattgccggaggcatgctgatcgcctgttacgttatatcaggttctagtgctgacttgtccttagagaaagcagccgaagtgagctgggagcaggaagcggagcactctgggactagccataatattctggtcgaagtgcaggatgacggaaccatgcgcatcaaggatgaggagaaagacgatacactcaccatcctgcttaaggctacactgttggccgtatccggcgtgtatccaatgtcaattcctgcaactctatttgtctggtacttctggcaaaaaaagaagcagcggagtggcgttctgtgggacacccccagcccaccggaagtggagagagccgtgctcgatgacgggatatataggatcctgcagcgtggacttttaggtcgctctcaggtcggcgtgggggtttttcaagacggagtattccacacgatgtggcacgtgacacggggcgctgtcctgatgtaccagggtaaaagactcgaaccttcctgggcatcagtgaagaaagatttgattagttacgggggaggctggaggttccagggcagctggaacactggggaggaggttcaggtgatcgccgtcgaacccggaaagaatccaaaaaacgtgcaaaccacacccggtacctttaagactcctgagggcgaagtaggggcgattgctctggacttcaagccaggaacctccggctctcccatcgtcaatcgagagggtaaaatagtggggctctatggaaacggcgttgtgacaacgtcgggcacttacgtcagcgccatcgcacaggccaaggcttcacaggaagggcctctgccggagattgaggatgaagtgtttaaaaagcggaatcttaccatcatggacctgcatccaggatccggtaaaacacgcagatatttgcccgccattgttagggaggcaatcaagcggaagctacgaaccctgatactcgctcctactagagtggtcgccagtgaaatggcggaggccttaaaaggcatgccaattcgctaccaaacaaccgcagtgaagtctgaacacacggggagggagatcgtagatctgatgtgccatgctactttcacaatgcgtcttctgagccccgtgcgggttcctaactataatatgatcattatggacgaggcccactttaccgatccggcttccatcgcagccagaggatacatatcaaccagggtcggcatgggtgaagccgctgcgattttcatgactgcaacacccccagggtctgtggaggcctttcctcagagcaacgctgtgatccaggacgaagagcgcgatattcccgaacgaagttggaattccggatatgactggatcaccgatttcccaggcaaaacagtctggtttgtacctagcataaagtctggcaacgacattgccaattgtctcagaaaaaacgggaagcgggtgatccagttgtcaaggaagactttcgacacggagtaccaaaaaaccaagaacaatgattgggactacgttgtgacaactgatatctccgagatgggagcaaactttcgcgccgaccgtgtcattgatcccagacggtgcctgaaaccagtgatcctcaaggacggtccggaaagggttattctggctggccctatgcccgtgaccgtcgcgagtgccgcacagcgccgagggagaataggacggaatcagaacaaagagggcgatcagtatgtgtacatgggtcaaccacttaataacgacgaagatcatgctcactggacagaggccaagatgctactggacaatatcaacacccccgaggggattatccctgcattgttcgaaccagagagggaaaagagcgccgctatcgatggcgagtatcgcttaagaggagaagccaggaaaactttcgtagagctgatgcggcgtggcgacctccccgtgtggctgtcgtacaaggttgcgtctgaggggtttcagtattccgatcgccgatggtgcttcgacggagaaagaaataaccaggtccttgaggaaaatatggacgtggagatttggacgaaagaaggtgagaggaagaaactgcggcctcgctggctcgatgcaagaacctacagcgacccgttggccctgagggagtttaaggaattcgctgccggccggcgatcagtgagtggggatctaatactggagatcggaaaactcccacagcaccttacactgagagctcaaaacgcattagacaatttggtcatgctgcataactctgaacagggcggtaaggcctatcgccacgctatggaggaactccccgatactattgagaccctgatgcttctggccctcatcgcagttttgacagggggcgtgaccctgtttttcttatccggaaagggcctagggaaaactagcattggactgctctgtgtaacagcgtcaagtgcccttctgtggatggctagcgtggagcctcattggatcgccgcatccataatcttggaatttttcctgatggtcctcctgattcccgagccagacaggcagcggacgcctcaggataatcaacttgcttacgtggttatcggtctcctgtttatgattttgaccgtggccgcaaacgaaatgggcctgttagagactacaaagcgtgacctagggatcggacacgtcgccgctgagaaccaccagcatgcgaccatgctggatgtagacctcagacccgcctctgcatggaccctttacgctgtggccacaactgttataacgccaatgatgaggcacaccattgaaaatacaactgccaacatcagcctgaccgcaattgctaatcaggccgcgatcttgatgggcctggataaaggttggcctatatccaagatggacatcggggtgccgctcctggctcttggctgctattcacaagtcaaccccttaacactgaccgccgcagtgctcatgttggtcgcccattacgctattatcggaccaggcctgcaggcaaaagccactcgcgaggcgcagaagcggacggctgccgggattatgaagaatcctacagtggatggaatcgttgcaatagacctagaccccgtggtatatgatgccaaattcgaaaagcagctgggccaaattatgctccttatcctgtgtacctctcagatcttgctgatgcgaactacctgggctctctgcgagagtattacactggccactggtccattaaccacactttgggaagggtcgcctggaaaattttggaacacgaccatcgcagtgagcatggctaatatattcagaggctcctacctggccggtgcgggcctcgccttttctctaatgaagtcactggggggaggcaggcgcgggactggagcacagggcgagacattgggtgagaaatggaagcggcagctgaaccaactcagcaagcccgaattcaatacctataaaagatccgggattatggaggtcgaccgtagtgaagctaaggagggacttaaaaggggcgaaactacaaagcacgccgtttctcggggtaccgcaaaactgcgctggttcgtggagcgaaacttggtcaagccggagggcaaggtgatcgatctggggtgtggaagaggcgggtggagctactattgcgctggactcaaaaaggtaacggaagtgaaaggctacaccaagggtgggccaggacatgaggaacctattcccatggccacatacggctggaatttagttaaactgcactcaggcaaggacgtgtttttcatgccacccgagaaatgtgatactcttctgtgcgacatcggggaatccagtcctaacccgaccatagaggagggaaggacactacgggtcctcaagatggtggaaccctggctgcgcggtaatcagttttgtatcaagattttgaacccatatatgcctagcgtcgtggagactctggaacagatgcagagaaaacacggcgggatgctcgttaggaatcccctttctcgaaactccacccatgagatgtactgggtatcatgcggaacaggcaatatcgtgagcgccgtcaacatgacctcgcggatgctgttaaaccgtttcactatggcgcacagaaagcctacgtatgagcgcgatgtggacctgggtgctgggacaaggcatgttgcagtggaaccagaggtcgccaatttggatattatcggacaacggattgaaaacatcaaaaatgagcacaagtctacctggcactacgacgaagataacccctataaaacttgggcttaccatggcagttatgaggtgaagccttccggcagcgcctcatccatggtaaatggggtggttagactcctgaccaagccatgggacgtcatacccatggtgacacagattgcaatgacggacaccactccgtttggacagcaacgcgtgttcaaagagaaggtcgatacaaggacccctcgagccaaacggggtactacacagatcatggaagttaccgctaagtggctatggggctttctttctagaaacaaaaagccaaggatctgtacacgcgaggaattcactcgtaaggtgcggagcaatgcggccattggggcagtatttgtggacgagaaccagtggaatagtgctaaagaagccgtcgaggatgagagattctgggacctggtgcacagggaacgcgagctccataagcagggaaaatgcgcaacctgcgtttacaacatgatgggcaagcgagaaaaaaagctgggtgagtttgggaaggccaaaggatcccgggctatatggtacatgtggttgggcgccagattcctggaatttgaggcgctcggcttcatgaatgaggatcactggttcagcagggaaaactctctttcaggggtggagggagaaggtctgcataagttaggctatatcctgcgcgacattagtaaaatccccgggggaaatatgtacgcagatgacacggccggctgggataccagaattacagaggacgatttgcaaaacgaggctaagatcactgacataatggaacctgagcacgccctcctggcaacctccatctttaaactaacatatcagaataaggtcgtgcgggtacagaggccagctaaaaacggtactgttatggatgtgattagccgtcgagaccagcgcgggtctggacaagtcggcacctacggccttaacacgttcacaaatatggaagtgcagctgatcagacagatggagtcggaagggatttttctcccctcagagctggagaccccgaacttggccgaacgggtgttagactggctggagaagcacggagctgaaaggctcaagcgcatggccatcagcggtgatgactgtgtcgttaaacctatagatgacagattcgcaactgcgcttacagccctgaatgatatgggcaaggtgcggaaagacattccccagtgggagccatccaaggggtggaacgattggcaacaggtacctttttgcagtcatcacttccatcagctaatcatgaaagacggaagggaaatcgtggtcccctgtcgaaatcaggatgagctggtgggccgtgctagagtttctcaaggtgccgggtggagcctccgcgagaccgcatgcttgggaaagtcctatgctcagatgtggcagctgatgtactttcaccggagggaccttagactggccgcaaacgccatttgttcagcggtgccagtcgattgggtgcccactagtcgcaccacatggtctatacacgctcatcaccaatggatgacgaccgaagacatgctcagcgtatggaatcgggtttggatcgaggaaaacccttggatggaggacaagactcatgtgtcctcatgggaagaggtcccatatttaggcaaaagggaggatcagtggtgcggcagcctgattgggttgacagcccgagcaacctgggccactaatatccaggtggctattaaccaggttagacggctgatcggaaatgaaaactacctcgactacatgacatctatgaagaggttcaaaaatgagtccgatccggaaggtgccctttggtga

SEQ ID NO: 13406 - RNA, 9879 nt, synthetic construct
  misc_feature 1..9879: note = derived and/or modified CDS sequence (opt3) from DENV-1__JF937645__SS-prME
  source 1..9879: mol_type = other RNA
agcgtgaccatgctgctcatgcttctgccaacagcattggctttccacttaactacgcgaggaggggaacctcatatgatcgtctccaagcaggaaaggggaaaatctctgctgtttaagacctcagccggtgttaacatgtgcacactcattgccatggacctgggcgaactttgtgaagatactatgacctacaaatgcccacaaataacagaggcggaaccggacgatgtggactgttggtgcaatgctaccgatacttgggtaacatatgggacctgtagtcagacgggagagcaccggcgcgacaagcgaagcgtggccctggcaccccatgtcggcttgggtctcgagactcgtaccgaaacatggatgtcctctgagggggcctggaaacagatccagagagtggaaacttgggctctgaggcaccctggattcaccgttattgcactgtttctcgcccatgctatcggcacatcgattacccaaaagggcatcatattcatcttactgatgcttgtgacgccatcaatggccatgcggtgcgtcgggattggaaaccgcgattttgtggagggtttgagcggcgcgacttgggtagacgttgtgctggagcacgggagttgtgtcacaaccatggcaaagaataaacccactctagatatcgaactcctgaagacagaggtgaccaaccctgccattcttagaaaactgtgcatcgaagctaagatatccaatacgaccacagactctaggtgtccaactcagggagaggccaccttggtggaagaacaggatgcaaacttcgtctgccggcgcacactcgttgaccgaggctggggtaatgggtgtggactgtttggcaaaggcagcttactgacttgcgctaagttcaagtgcgtgaccaaactcgaggggaagattgtacagtacgaaaaccttaaatattccgtgatcgtcacagtgcacaccggagatcaacatcaggttggtaatgagactacggaacacggcacaattgccaccatcactccccaggcgcctacctcagagatccagctgacagactacggggccttgaccctagactgtagtccaagaactggactggattttaacgaaatggtgctcctgacaatgaaggagaaaagctggcttgtccataagcaatggttcctggacttgccgctcccctggacgtctggcgcatccacctcacaggagacttggaataggcaggatctgttagtgacatttaaaaccgctcacgccaagaagcaagaagtagttgtgctgggtagccaggagggggctatgcacacagccctaactggcgcaaccgaaattcagacgagtggaaccacaactatattcgccggccatctcaaatgccggctgaagatggacaaacttaccttgaaggggacatcttatgtcatgtgtactggatcctttaaactggagaaggaagtggctgagacccagcacggtacggtcctcgtgcaagttaagtacgagggcacagatgcgccttgcaaaatcccattcagcacccaggacgaaaagggggtgactcagaacggacgtctgattacagcaaatcccatcgtaaccgataaagagaagcctgtcaacatagaaactgagccacccttcggcgagtcgtatattgtggttggtgccggggaaaaagctcttaagctgtcttggtttaagaaaggctcctcaatcggaaagatgttcgaggccaccgcacgcggcgccagaaggatggctatcttgggggacacagcctgggattttggaagtattggtggcgtgttcacgagcgtcgggaaactcgtgcatcaggtatttggaaccgcatacggcgtgctgttctccggtgtttcttggactatgaagatcgggattggcatattactgacatggctaggactcaatagccggtcaaccagtctgtccatgacatgtatcgcggtcggcatggtgactctttacttgggggtgatggtccaagctgacagcggatgcgttattaactggaaaggccgagaactgaagtgtggttctgggatctttgtgaccaacgaggtgcacacgtggacagaacagtataagttccaggccgattcaccgaaacgcctcagtgcagccatcggaaaggcttgggaggagggcgtatgcggtattagaagcgccaccaggctggaaaatataatgtggaaacagatctccaacgagttaaatcatattctgcttgaaaacgacatgaagtttactgtcgtggttggcgacgcaaatgggatcttggctcaaggcaaaaagatgattcggcctcagcccatggagcacaaatactcttggaagtcgtggggcaaggccaaaatcataggggcggatatccagaacaccacattcattatcgacggaccagatactcctgaatgtcccgacaatcagcgcgcctggaacatttgggaggtggaggattatggctttggtatcttcaccacaaatatatggctcaagctgagagacagctacacgcaaatgtgcgatcacaggctaatgtccgctgcaattaaagactcaaaggccgtccatgctgatatggggtattggatcgaaagtgagaaaaacgaaacctggaagctggcccgtgcatcttttattgaggtgaagacttgtacatggccaaaaagccacaccctctggtccaatggagttctggaatcagagatgatcatacccaagatctacggcggtcctattagccagcataactatcggccaggctacttcactcagacagcggggccgtggcaccttggaaaattggagctggacttcgatttatgcgaaggcaccacggtggtagtcgacgagcactgcgggaatcgaggaccctctctcagaactaccacagtgaccggcaagatcattcatgaatggtgttgcaggtcctgtactctgcctccacttcgctttcggggtgaggatgggtgctggtacggaatggagatcagacccgtgaaagaaaaggaggaaaacctggtcaggagtatggttagcgccggctctggtgaggtggactccttctcattgggcatactctgtgctagtattatgatcgaagaggtaatgcgcagccgatggtcgcggaagatgctgatgacagggaccctagccgtgtttctgctcctgatcatgggacaacttacatggaatgacttgattcgtctgtgcatcatggtcggcgcaaacgcttccgatagaatggggatgggaactacctatttagccctcatggcaacgttcaaaatgaggcctatgtttgccgtgggcctgcttttccgccggctgacatctagagaggttctactcctgaccattggtttgagcctggtggcttcagtcgaattaccaaacagtctcgaggaactgggggacggacttgcgatgggcataatgatgctgaagttgctcactgagtttcagccccaccagctgtggaccacactactgtcccttactttcatcaaaaccacgctctctctggattacgcctggaagacaaccgcaatggctttgagcattgtgtccctgtttccgttatgtctctcaactacaagccagaaaaccacttggctgcctgttcttctgggcagtttcgggtgcaagccattgacaatgtttctcatcaccgaaaataagatttggggaaggaaatcttggcccctgaacgagggtatcatggccataggcatcgtgtccattctactgagctcgcttctcaagaatgacgtccctctggccgggcccttgatcgctggaggcatgttaattgcatgttatgtaatctcaggttctagtgccgatctgtccctcgagaaagcggctgaagtgagctgggagcaagaagccgagcattctgggacgagccacaacatactggttgaagtgcaggacgatggaactatgaagattaaagacgaggagcgagatgacacccttacaatcctgttgaaggcaaccctactggccgtctccggcgtgtacccaatgtcaatccctgctacactcttcgtatggtatttttggcagaaaaagaagcagcgcagtggcgtgctgtgggatactcccagcccaccggaagtcgagcgggcagttcttgacgatgggatttacagaatattacaaaggggactgctcggtcgttctcaggtgggcgtgggggtcttccaggacggagtgttccataccatgtggcacgttacgcgcggcgccgtattgatgtatcagggtaaacggctggaaccttcctgggcgtcagtgaagaaagacctcatcagttacgggggaggctggagatttcaaggcagctggaatacaggggaggaggtccaggtgattgctgttgaacccggaaagaaccccaaaaatgtgcagactacccccggtacattcaagacccctgagggcgaagtcggggccatcgcactggattttaagccaggaacttccggctctcccattgtgaacagggagggtaaaatcgtagggctttacggaaatggcgtcgtgaccacatcgggcacgtatgttagcgccatagctcaagccaaggcatcacaggaagggcctctgccggagatcgaggacgaagtgttcaaaaagcgaaacttgactattatggatctacacccaggatccggtaaaacccggcgctacctgcccgctatcgtcagagaggccattaagaggaagctccggacattaatcctggcgcctacccgagtggttgccagtgaaatggcagaggctcttaaaggcatgccaataagatatcagactacagccgtgaagtctgaacataccgggcgcgagattgtcgacctgatgtgccacgctacgtttactatgaggctcttgagccccgtgcgtgtacctaattacaacatgatcatcatggatgaggcacatttcacagacccggcctccattgccgctcggggatatatctcaaccagagtgggcatgggtgaagcggcagccatatttatgaccgctactcccccagggtctgttgaggccttccctcagagcaatgcagtcattcaagatgaagagagggacatccccgaacgcagttggaactccggatacgattggattacagactttccaggcaaaaccgtgtggttcgtgcctagcatcaagtctggcaatgatatagccaactgtctgcggaaaaacgggaagagagtcattcagctctcaagaaagacatttgacactgagtatcagaaaacgaagaataacgactgggattacgtagtgaccacagacatctccgagatgggagctaatttcagggcggatcgcgttatcgacccccgtagatgcctgaaaccagtgattcttaaggatggtccggaacgggtcatcctagccggccctatgcccgtgactgttgcaagtgctgcccagaggcgcgggcgaattggaagaaaccaaaataaagagggcgaccagtacgtgtatatgggtcagccactgaacaatgatgaagaccacgcacattggaccgaggccaagatgttgttagataacataaatacacccgaggggatcattcctgctctgttcgaaccagagcgggaaaagagcgccgcgatcgacggcgagtacaggctccgcggagaagcaagaaaaacctttgtcgagctgatgaggcggggcgatcttcccgtgtggctgtcgtataaggtagcctctgaggggttccagtactccgaccgtcgctggtgctttgatggagaacgaaacaatcaagtgctcgaggaaaacatggacgttgagatctggactaaagaaggtgagagaaagaaattgaggcctcggtggctggacgctcgcacgtatagcgatccgctagccctgagagagttcaaggaatttgctgcaggcaggcggtcagtcagtggggacctcattcttgagataggaaaactgccacagcacttaaccttgcgagcccagaatgctctggataacctcgtgatgctgcacaattctgaacagggcggtaaggcctacagacatgcaatggaggaacttcccgacacaatcgagactctgatgctcttggcgctgattgccgtgttaaccgggggcgtcacactattctttctgtccggaaagggcctcgggaaaaccagcatcggacttctgtgtgttactgcttcaagtgccttgctgtggatggcaagcgtggagcctcactggattgctgcctccatcatactcgagttctttctgatggtacttctcatccccgagccagatcgccaaaggacacctcaggacaaccagctggcatatgtggtcattggtttgctgttcatgatcttaacggtggccgctaacgaaatgggcctactggagaccactaagaaagatctcgggattggacatgttgcggccgagaatcaccaacacgcaacaatgcttgacgtggatctgcggcccgcttctgcctggaccttgtacgccgtcgcaaccacagtaatcactccaatgatgcgtcatacgatagaaaacaccacagctaatattagcctgactgccatcgcgaaccaggctgccattctcatgggcctggacaagggttggcctatctccaaaatggatataggggtgccgcttttagcactgggctgctactcacaggttaatcccctcaccttgacagccgctgtgctgatgctagtcgcacactatgccatcattggaccaggcctgcaggcgaaggctaccagagaggcccaaaagaggactgcagccgggatcatgaaaaaccctacggtggacggaattgtcgctatcgatctcgaccccgtggtttacgacgccaagtttgaaaaacagcttggccagataatgctgttgattctgtgtacatctcagatcctcctgatgcgcaccacttgggcattatgcgagagtatcacccttgctacaggtccactgactaccctctgggaagggtcgcctggaaagttctggaatacaacgattgccgtgagcatggcgaacatctttcggggctcctatctagccggtgcaggcctggctttctctttgatgaaatcactagggggaggccgaagagggaccggagcccaaggcgagactctcggtgagaagtggaagaggcagcttaatcagctgagcaaatccgagttcaacacatacaagcgcagtgggataatggaggtagatcggtctgaagcaaaagagggattgaagagaggcgaaaccactaaacatgctgtgagccgtggtacagccaagctgaggtggtttgtcgagcggaatctcgttaagcccgagggcaaagtgattgacttagggtgtggacgcggcgggtggtcatattactgcgccggactgaagaaagtcaccgaagtgaagggctatacgaaaggtgggccgggacacgaggaaccaatccctatggcgacctacggctggaaccttgtaaagctgcattccggcaaagatgtgttctttatgcccccagagaagtgtgacacactactctgcgatattggggaaagtagccccaatcctactatcgaggagggacgaaccctgagagttttgaagatggtggaaccgtggctgaggggtaaccagttctgtataaaaatcctcaatccctacatgccatctgtcgtggagacacttgaacaaatgcagcggaagcacggcgggatgctggtccgcaaccctttatccagaaattcaactcacgagatgtattgggtgagctgcggaaccggcaacattgtttcggctgtaaacatgacatctaggatgctgttgaatcgatttaccatggcacatcggaaacccacttacgagcgtgacgtggatctcggtgccgggacgagacacgtcgctgtggaacctgaggttgccaacctggacatcattggacagcgcatcgaaaatattaagaacgagcataaaagtacatggcactatgatgaagacaatccatacaagacctgggcatatcacggctcctacgaggtgaagcccagcggctcagcctcctctatggtcaacggggtggtaaggctacttactaaaccttgggatgtgatcccaatggttacccaaatagctatgacagacacgacccccttcggacagcagcgggtctttaaggagaaagtggacactagaacaccgcgcgcgaagaggggtaccactcagattatggaagtgacagccaaatggctgtggggcttcctcagccgaaataagaagcctcggatctgtaccagagaggaatttacaaggaaagtccgcagtaacgcagctatcggggccgttttcgtggatgagaatcaatggaactccgcaaaggaagccgtagaggacgagcgtttttgggatctggtgcatcgggaaagagagttgcacaaacagggaaagtgcgctacttgcgtctataatatgatgggcaaaagggaaaagaagctgggtgagttcgggaaagccaagggaagccgcgcgatttggtacatgtggctcggcgcacgatttcttgagttcgaggccctgggcttcatgaacgaggaccattggttttctcgggaaaattcattaagtggggtggagggagaaggtctgcacaaattgggctacatactcagagatatctccaagattccagggggaaacatgtatgctgacgataccgccggctgggacacgaggatcaccgaggatgacctgcagaatgaggcaaaaattacagatatcatggaacccgagcatgctctacttgccactagcatattcaagctgacctaccagaacaaagttgtgcgcgtccaaagacctgctaagaacggtacagtgatggacgtaatctctcggagggatcagcgtgggtcgggacaggttggcacttatggcctcaatacctttacgaacatggaagtgcagctgattcgacaaatggagtcagaagggatcttcttgccaagcgagttagagacacccaatctggccgaacgcgtcctcgactggcttgagaagcacggagcagaaagactgaaacggatggcgatttccggtgacgattgtgtggtgaagccgatcgacgataggtttgccaccgctctaactgccctgaacgacatgggcaaagtccgcaaggatatacctcagtgggagcccagtaaagggtggaatgactggcagcaggttccattctgctctcaccattttcaccaactcattatgaaggatggaagagaaatcgtggtaccttgtcggaaccaggacgagttggtgggcagggcacgagtcagccagggtgctgggtggtccctgcgtgagacagcctgccttggaaagtcatacgcacaaatgtggcagctgatgtatttccatagacgcgatctccggttagccgcgaatgctatctgtagtgccgtgcccgttgactgggtgccaacctctaggactacctggagcattcacgcacaccatcagtggatgacaacggaagatatgctgtccgtctggaacagagtgtggatagaggaaaatccctggatggaggacaaaacccacgtatcaagctgggaagaggttccttacttgggcaagcgcgaggaccagtggtgcggctctctgatcgggctcactgcccgggctacatgggccaccaacattcaagtggcaatcaatcaggtcaggcgacttattggaaacgaaaattatctggattacatgacttccatgaaaagatttaagaacgagagtgacccagaaggtgctctatggtga

SEQ ID NO: 13407 - RNA, 9879 nt, synthetic construct
  misc_feature 1..9879: note = derived and/or modified CDS sequence (opt3) from DENV-1__FJ850114__SS-prME
  source 1..9879: mol_type = other RNA
agcgtgaccatgctgctcatgcttctgccaacagcattggctttccacttaactacgagaggaggggaacctcatatgatcgtctccaagcaggaaaggggaaaatctctgttgtttaagacctcagccggtgttaacatgtgcacactcattgcaatggacctgggagaactttgtgaagatactatgacctacaaatgcccacaaataacagaggcggaaccggacgatgtggactgttggtgcaatgctaccgatacttgggtgacatatgggacctgtagccagacgggagagcaccggcgcgacaagcgaagcgtggccctggcaccccatgtcggcttgggtctcgagactcgtaccgaaacatggatgtcctctgagggggcctggaaacagatccagagagtggaaacttgggctctgaggcaccctggattcaccgttattgcactgtttctcgcccatgctatcggcacatcgattacccaaaagggcatcatattcatcttactgatgcttgtgacgccatcaatggccatgcggtgcgtcgggattggaaaccgcgattttgtggagggtttgagcggcgcgacttgggtagacgttgtgctggagcacgggagttgtgtcacaaccatggcaaagaataaacccactctagatatcgaactcctgaagacagaggtgacctcccctgccattcttagaaaactgtgcatcgaagctaagatatctaacacgaccacagacagtaggtgtccaactcagggagaggccaccttggtggaagaacaggatgcaaatttcgtctgccggcgcacatttgttgaccgaggctggggtaacgggtgtggactcttcggcaaaggctccctgttaacttgcgctaagtttaagtgcgtgaccaaactggaggggaagattgtacagtacgaaaatctcaaatattcagtgatcgtcacagtgcacaccggagatcaacatcaggttggtaacgagactacggaacacggcacaattgccaccatcactccccaggcgcctaccagtgagatccagcttacagactacggggccctgaccttggactgtagcccaagaactggactagatttcaatgaaatggtgctgctcacaatgaaggagaaatcttggctggtccataagcaatggtttcttgacctgccgttgccctggacgtccggcgcatcaaccagccaggagacttggaacaggcaggatctcctggtgacattcaaaaccgctcacgccaagaagcaagaagtagttgtgttaggtagtcaggagggggctatgcacacagccctgactggcgcaaccgaaattcagacgtctggaaccacaactatatttgccggccatctaaaatgccggctcaagatggacaaactgacccttaaggggacatcctatgtcatgtgtactggcagcttcaaattggagaaggaagtggctgagacccagcacggtacggtcctggtgcaagttaagtacgagggcacagatgcgccttgcaaaatcccattctcgacccaggacgaaaagggggtgactcagaatggacgtctcattacagcaaaccccatcgtaaccgataaagagaagcctgtcaatatagaaactgagccaccctttggcgagtcttatattgtggttggtgccggggaaaaagctctgaaactttcctggttcaagaaaggctcaagtatcggaaagatgtttgaggccaccgcacgcggcgccagaaggatggctatcctgggggacacagcctgggatttcggaagcattggtggcgtgtttacgtccgtcgggaaattggtgcatcaggtattcggaaccgcatacggcgtgctcttttctggtgttagctggactatgaagatcgggattggcatactgttaacatggctgggactaaactcacggagtacctccctcagcatgacatgtatcgcggtcggcatggtgactctgtaccttggggtgatggtccaagctgactctggatgcgttattaattggaaaggccgagaattgaagtgtggttcagggatcttcgtgaccaacgaggtgcacacgtggacagaacagtataagtttcaggccgatagtccgaaacgcctgagcgcagccatcggaaaggcttgggaggagggcgtatgcggtattagatccgccaccaggctcgaaaacataatgtggaaacagatctctaatgagctgaaccatattttactggaaaatgacatgaagttcactgtcgtggttggcgacgcaaacgggatccttgctcaaggcaagaaaatgattcggcctcagcccatggagcacaaatactcgtggaaaagctggggcaaggccaagatcataggggcggatatccagaataccacatttattatcgacggaccagatactcctgaatgtcccgacaaccagcgcgcctggaatatttgggaggtggaggattatggcttcggtatctttaccacaaacatatggttgaagctcagagactcctacacgcaaatgtgcgatcacaggctgatgtcagctgcaattaaagacagtaaggccgtccatgctgatatggggtattggatcgaatctgagaaaaatgaaacctggaagctagcccgtgccagcttcattgaggtgaagacttgtacatggccaaaatcccacaccctgtggtcaaacggagttctcgaaagcgagatgatcatacccaagacttacggcggtcctatctctcagcataattatcggccaggctacttcacacagaccgcggggccgtggcacctgggaaaacttgagttggactttgatctgtgcgaaggcacgactgtggtagtcgacgagcactgcgggaaccgaggaccctccttaagaaccacaaccgtgactggcaagattatccatgaatggtgttgcaggagttgtacactccctccactgcgcttccggggtgaggatgggtgctggtacggaatggagattagacccgtgaaagaaaaggaggaaaatcttgtcaggagcatggtttctgccggctccggtgaggtggactcatttagtctgggcatcttgtgtgctagcataatgattgaagaggtaatgcgctcgcgatggtcccggaagatgctcatgaccgggacactggccgtgttcctactgctcatcatgggacaactgacttggaacgaccttatccgtttgtgcattatggtcggcgcaaatgcttctgatagaatggggatgggaaccacgtatctggccttaatggcaacatttaaaatgaggcctatgttcgccgtgggcctcctgtttcgccggcttaccagcagagaggttctgctactcactatcggtctgtcattggtggctagtgtcgaactgccaaactccttagaggaactcggggacggactggcgatgggcattatgatgcttaagctgttgaccgagttccagccccaccagctctggacaactctgctatctctgacctttataaaaacgacacttagcctcgattacgcctggaagaccactgcaatggctctgtccatcgtgtcattgttcccgctgtgtttaagcacaaccagtcagaaaactacatggctccctgttctgcttggctcttttgggtgcaagccactgaccatgttcttgattacggaaaacaagatctggggaaggaaatcctggcccctcaatgagggtattatggccatcggcatagtgagcatcctgctatcgtcactgcttaagaacgacgtccctctcgccgggcccctgattgctggaggcatgttgatcgcatgttatgtaatttctggtagttccgccgatttaagcctggagaaagcggctgaagtgtcttgggagcaagaagccgagcatagcgggacttcccacaatatcctcgttgaagtgcaggacgatggaaccatgaagataaaagacgaggagcgagatgacacactgaccattcttctgaaggcaacattgctagccgtctcaggcgtgtacccaatgagtatccctgctactctgtttgtatggtatttctggcagaaaaagaagcagcgcagcggcgtgctctgggataccccctctccaccggaagtcgagcgggcagttctggacgatgggatctacaggattcttcaacgaggattactgggtcgttcccaggtgggcgtgggggtcttccaggacggagtgtttcatacgatgtggcacgttacacgcggcgccgtactcatgtatcagggtaaacggttggaaccttcatgggcgagtgtgaagaaagacctgataagctacgggggaggctggagattccaaggctcctggaacactggggaggaggtccaggtgatcgctgttgaacccggaaagaatcccaagaacgtgcagaccacacccggtacctttaagactcctgagggcgaagtcggggccattgcactcgatttcaagccaggaacctctggctcgcccatcgtgaatagggagggtaaaattgtagggctgtacggaaacggcgtcgtgacaacgagcggcacttatgtttcagccatcgctcaagccaaggcatcccaggaagggcctcttccggagatagaggacgaagtgtttaaaaagcgaaatctgaccatcatggatttgcacccaggaagtggtaaaacacggcgctacctacccgctattgtcagagaggccatcaagaggaagctgcggaccctcattttagcgcctactcgagtggttgcctctgaaatggcagaggctctgaaaggcatgccaatcagatatcagacaaccgccgtaaagagcgaacatacggggcgcgagatagtcgaccttatgtgccacgctactttcacaatgaggctgctctcccccgtgcgtgtacctaactacaatatgattatcatggatgaggcacattttaccgacccggcctcaatcgccgctcggggatatatttctaccagagtgggcatgggtgaagcggcagccatcttcatgactgctacacccccagggagcgttgaggcctttcctcagagtaacgcagtcatacaagatgaagagagggacattcccgaacgctcctggaatagcggatacgattggatcaccgacttcccaggcaaaacagtgtggtttgtgccttctattaagtcaggcaacgatatcgccaattgtttgagaaagaacgggaagagagtcatacagctgtcccggaagactttcgacacggagtatcagaaaaccaagaacaatgactgggattacgtagtgacaactgacattagtgagatgggagctaacttcagggcggatcgcgttatcgacccccgtagatgcctcaaaccagtgatcctgaaggatggtccggaacgggtcattcttgccggccctatgcccgtgaccgttgcaagcgctgcccagaggcgcgggcgaatcggaagaaatcaaaacaaagagggcgaccagtacgtgtatatgggtcagccactaaataacgatgaagaccacgcacattggacagaggccaagatgctgttggataatattaacacccccgaggggataatccctgctttatttgaaccagagcgggaaaagtcggccgcgattgacggcgagtacaggctgcgcggagaagcaagaaaaactttcgtcgagctcatgaggcggggcgatctgcccgtgtggctttcttataaggtagcctccgaggggtttcagtacagcgaccgtcgctggtgcttcgatggagaacgaaataaccaagtgctggaggaaaatatggacgttgagatctggacgaaagaaggtgagagaaagaaactcaggcctcggtggttggacgctcgcacctattcagatccgctggccctaagagagtttaaggagttcgctgcaggcaggcggagtgtctctggggacctgatcctcgagattggaaaacttccacagcacctgacattacgagcccagaacgctttggataatctggtgatgctccacaactccgaacagggcggtaaggcctacagacatgcaatggaggaactgcccgacactatagagacccttatgctgctcgcgttgatcgccgtgctgacagggggcgtcaccttatttttcctaagcggaaagggcctggggaaaacttcaattggactcctttgtgttacagctagtagcgccctgttgtggatggcatccgtggagcctcactggatcgctgcctctattatcctggaatttttcctcatggtactgcttatacccgagccagatcgccaaaggacgcctcaggacaatcagctcgcatatgtggtcatcggtctgttgtttatgattctgaccgtggccgctaacgaaatgggcttactagagactacaaagaaagatctggggatcggacatgttgcggccgagaaccaccaacacgcaaccatgctcgacgtggatcttcggcccgctagcgcctggaccctgtacgccgtcgcaacaactgtaattacgccaatgatgcgtcataccatcgaaaatacaactgctaacatatccttgaccgccattgcgaatcaggctgccatcctgatgggcctcgacaagggttggcctatttcaaaaatggatatcggggtgccgctgcttgcattaggctgctactctcaggttaaccccctgacactcaccgccgctgtgttgatgctggtcgcacactatgccataatcggaccaggcctacaggcgaaggctactagagaggcccaaaagaggacggcagccgggattatgaaaaatcctacagtggacggaatcgtcgctattgatctggaccccgtggtttacgacgccaagttcgaaaaacagctcggccagatcatgcttctgatattgtgtaccagtcagattctgctcatgcgcactacctgggcactgtgcgagtcgatcacattagctactggtccacttaccacactgtgggaagggagccctggaaagttttggaacacgaccatcgccgtgtccatggcgaatattttccggggctcttatctcgccggtgcaggcctagctttctcactgatgaaaagcctagggggaggccgaagagggactggagcccaaggcgagacactgggtgagaagtggaagaggcagctcaaccagctttccaagagtgaatttaatacctacaagcgctctgggatcatggaggtagatcggagcgaagcaaaagagggactgaagagaggcgaaactacaaaacatgctgtgtcacgtggtaccgccaagttgaggtggttcgtcgagcggaacctggttaagcccgagggcaaagtgatagacctcgggtgtggacgcggcgggtggtcctattactgcgccggattaaagaaagtcacggaagtgaagggctataccaaaggtgggccgggacacgaggaaccaattcctatggcgacatacggctggaatctggtaaaacttcatagtggcaaagatgtgtttttcatgcccccagagaagtgtgacactctgctatgcgatatcggggaaagctctcccaaccctaccattgaggagggacgaacactcagagttctgaagatggtggaaccgtggttgaggggtaatcagttttgtatcaaaatactgaacccctacatgccatccgtcgtggagatcctcgaacaaatgcagcggaagcacggcgggatgcttgtccgcaatcctctgtcaagaaacagcactcacgagatgtattgggtgtcgtgcggaaccggcaatattgtttctgctgtaaacatgacaagtaggatgttactgaaccgattcaccatggcacatcggaaacccacttacgagcgtgacgtggatttgggtgccgggacgagacacgtcgctgtggaacctgaggttgccaatctcgacatcattggacagcgcatcgaaaacattaagaatgagcataaatccacatggcactatgatgaagacaacccatacaagacctgggcatatcacggcagctacgaggtgaagccctcaggctccgcctctagcatggtcaatggggtggtaaggctgctaactaaaccttgggatgtgatcccaatggttacccaaatagctatgacagacacgaccccctttggacagcagcgggtcttcaaggagaaagtggacactagaacaccgcgcgcgaagaggggtaccactcagattatggaagtgacagccaaatggctttggggctttctgagtcgaaacaagaagcctcggatctgtaccagagaggagttcacaaggaaagtccgctccaatgcagctatcggggccgtttttgtggatgagaaccaatggaatagcgcaaaggaagccgtagaggacgagcgtttctgggatctcgtgcatcgggaaagagagctgcacaaacagggaaagtgcgctacttgcgtctataacatgatgggcaaaagggaaaagaagttgggtgagtttgggaaagccaagggatctcgcgcgatttggtacatgtggctgggcgcacgattcctcgagttcgaggcccttggctttatgaatgaggaccattggttctcacgggaaaacagtctgtccggggtggagggagaaggtttacacaaactgggctacatattgagagatatcagcaagattccagggggaaatatgtatgctgacgataccgccggctgggacacgaggatcaccgaggatgacctccagaacgaggcaaaaattacagatatcatggaacccgagcatgctctgctagccacttctatatttaaacttacctaccagaataaagttgtgcgcgtccaaagacctgctaagaacggtacagtgatggacgtaatctcgcggagggatcagcgtgggtcaggacaggttggcacttatggcctgaacaccttcacgaatatggaagtgcagctcattcgacaaatggagagcgaagggatctttctgccatccgagttggagacacccaacttagccgaacgcgtcctggactggctcgagaagcacggagcagaaagacttaaacggatggcgattagtggtgacgattgtgtggtgaagccgatcgacgataggttcgccaccgctctgactgccctaaatgacatgggcaaagtccgcaaggatatacctcagtgggagccctctaaagggtggaacgactggcagcaggttccattttgcagccaccatttccaccaactgattatgaaggatggaagagaaatcgtggtaccttgtcggaatcaggacgagctcgtgggcagggcacgagtctcccagggtgctgggtggtcattgcgtgagacagcctgcctgggaaagagttacgcacaaatgtggcagcttatgtattttcatagacgcgatctgcggctcgccgcgaacgctatctgttctgccgtgcccgttgactgggtgccaaccagcaggactacctggtccattcacgcacaccatcagtggatgacaacggaagatatgttatcagtctggaatagagtgtggatagaggaaaacccctggatggaggacaaaacccacgtaagctcttgggaagaggttccttacctgggcaagcgcgaggaccagtggtgcggctccttgatcgggctgactgcccgggctacatgggccaccaatattcaagtggcaatcaaccaggtcaggcgactcattggaaatgaaaactatcttgattacatgatcagtatgaaaagattcaagaatgagagcgacccagaaggtgctctgtggtga

SEQ ID NO: 13408 - RNA, 9879 nt, synthetic construct
  misc_feature 1..9879: note = derived and/or modified CDS sequence (opt3) from DENV-1__JN819402__SS-prME
  source 1..9879: mol_type = other RNA
agcgtgaccatgctgctcatgcttctgcccacagccttggctttccacttaactacgagaggcggggagcctcatatgatcgtctccaagcaggaaaggggaaaatctctgctatttaagacctcagcaggtgttaacatgtgcacactcattgccatggacctgggcgagctttgtgaagatactatgacctacaaatgcccacaaataacagaggcggaaccggacgatgtggactgttggtgcaatgctaccgatacttgggtaacatatgggacctgtagtcagacgggagagcaccggcgcgacaagcgaagcgtggccctggcaccccatgtcggcttgggtctcgagactcgtaccgaaacatggatgtcctctgagggggcctggaaacagatccagagagtggaaacttgggctctgaggcaccctggattcaccgttattgcactgtttctcgcccatgctatcggcacatcgattacccaaaagggcatcatattcatcttactgatgcttgtgacgccatcaatggccatgcggtgcgtcgggattggaaaccgcgattttgtggagggtttgagcggcgcgacttgggtagacgttgtgctggagcacgggagttgtgtcacaaccatggcaaagaataaacccactctagatatcgaactcctgaagacagaggtgaccaaccctgccattcttagaaaactgtgcatcgaagctaagatatccaatacgaccacagactctaggtgtccaactcagggagaggccaccttggtggaagagcaggatgcaaacttcgtctgccggcgcacatttgttgaccgaggctggggtaatgggtgtggactcttcggcaaaggcagcctgttaacttgcgctaagtttaagtgcgtgaccaaactggaggggaagattgtacagtacgaaaacctcaaatattccgtgatcgtcacagtgcacaccggagatcaacatcaggttggtaatgagactacggaacacggcacaattgccaccatcactccccaggcgcctacctcagagatccagcttacagactacggggccctgaccttggactgtagtccaagaactggactagatttcaacgaaatggtgctgctcacaatgaaggagaaaagctggctggtccataagcaatggtttcttgacctgccgttgccctggacgtctggcgcatccacctcacaggagacttggaataggcaggatctcctggtgacattcaaaaccgctcacgccaagaagcaagaagtagttgtgttaggtagccaggagggggctatgcacacagccctgactggcgcaaccgaaattcagacgagtggaaccacaactatatttgccggccatctaaaatgccggctcaagatggacaaactgacccttaaggggacatcttatgtcatgtgtactggatccttcaaattggagaaggaagtggctgagacccagcacggtacggtcctggtgcaagttaagtacgagggcacagatgcgccttgcaaaatcccattcagcacccaggacgaaaagggggtgactcagaacggacgtctcattacagcaaatcccatcgtaaccgataaagagaagcctgtcaacatagaaactgagccaccctttggcgagtcgtatattgtggttggtgccggggaaaaagctctgaagctttcttggttcaagaaaggctcctcaatcggaaagatgtttgaggccaccgcacgcggcgccagaaggatggctatcctgggggacacagcctgggatttcggaagtattggtggcgtgtttacgagcgtcgggaaattggtgcatcaggtattcggaaccgcatacggcgtgctcttttccggtgtttcttggactatgaagatcgggattggcatactgttaacatggctgggactaaatagccggtcaaccagtctctccatgacatgtatcgcggtcggcatggtgactctgtaccttggggtgatggtccaagctgacagcggatgcgttattaactggaaaggccgagaattgaagtgtggttctgggatcttcgtgaccaacgaggtgcacacgtggacagaacagtataagtttcaggccgattcaccgaaacgcctgagtgcagccatcggaaaggcttgggaggagggcgtatgcggtattagaagcgccaccaggctcgaaaatataatgtggaaacagatctccaacgagctgaatcatattttactggaaaacgacatgaagttcactgtcgtggttggcgacgcaaatgggatccttgctcaaggaaaaaagatgattcggcctcagcccatggagcacaaatactcttggaagtcgtggggcaaggccaaaatcataggggcggatatccagaacaccacatttattatcgacggaccagatactcctgaatgtcccgacaatcagcgcgcctggaacatttgggaggtggaggattatggcttcggtatctttaccacaaatatatggttgaagctcagagacagctacacgcaaatgtgcgatcacaggctgatgtccgctgcaattaaagactcaaaggccgtccatgctgatatggggtattggatcgaaagtgagaaaaacgaaacctggaagctagcccgtgcatctttcattgaggtgaagacttgtacatggccaaaaagccacaccctgtggtccaatggagttctcgaatcagagatgatcatacccaagatctacggcggtcctattagccagcataactatcggccaggctacttcactcagacagcggggccgtggcacctgggaaaacttgagttggactttgatctgtgcgaaggcaccacggtggtagtcgacgagcactgcgggaatcgaggaccctctttaagaactaccacagtgaccggcaagatcattcatgaatggtgttgcaggtcctgtactctccctccactgcgcttccggggtgaggatgggtgctggtacggaatggagatcagacccgtgaaagaaaaggaggaaaaccttgtcaggagtatggttagcgccggctctggtgaggtggactccttttcactgggcatattgtgtgctagtattatgatcgaagaggtaatgcgcagccgatggtcgcggaagatgctcatgacagggaccctggccgtgttcctactgctcatcatgggacaactgacatggaatgaccttattcgtttgtgcatcatggtcggcgcaaacgcttccgatagaatggggatgggaactacctatctggccttaatggcaacgtttaaaatgaggcctatgttcgccgtgggcctcctgtttcgccggcttacatctagagaggttctgctactcaccattggtctgagcttggtggcttcagtcgaactgccaaacagtttagaggaactcggggacggactggcgatgggcataatgatgcttaagctgttgactgagttccagccccaccagctctggaccacactgctatccctgacttttatcaaaaccacgctttctctcgattacgcctggaagacaaccgcaatggctctgagcattgtgtccttgttcccgctgtgtttatcaactacaagccagaaaaccacttggctccctgttctgcttggcagttttgggtgcaagccactgacaatgttcttgatcaccgaaaataagatttggggaaggaaatcttggcccctcaacgagggtatcatggccataggcatcgtgtccattctgctaagctcgctgcttaagaatgacgtccctctcgccgggcccctgatcgctggaggcatgttgattgcatgttatgtaatctcaggttctagtgccgatttatccctggagaaagcggctgaagtgagctgggagcaagaagccgagcattctgggacgagccacaacatactcgttgaagtgcaggacgatggaactatgaagattaaagacgaggagcgagatgacaccctgacaatccttctgaaggcaaccttgctagccgtctccggcgtgtacccaatgtcaatccctgctacactgtttgtatggtatttctggcagaaaaagaagcagcgcagtggcgtgctctgggatactcccagcccaccggaagtcgagcgggcagttctggacgatgggatttacagaatacttcaaaggggattactgggtcgttctcaggtgggcgtgggggtcttccaggacggagtgtttcataccatgtggcacgttacgcgcggcgccgtactcatgtatcagggtaaacggttggaaccttcctgggcgtcagtgaagaaagacctgatcagttacgggggaggctggagattccaaggcagctggaatacaggggaggaggtccaggtgattgctgttgaacccggaaagaacccaaaaaatgtgcagactacccccggtacatttaagacccctgagggcgaagtcggggccatcgcactcgatttcaagccaggaacttccggctctcccattgtgaacagggagggtaaaatcgtagggctgtacggaaatggcgtcgtgaccacatcgggcacgtatgttagcgccatagctcaagccaaggcatcacaggaagggcctcttccggagatcgaggacgaagtgtttaaaaagcgaaacctgactattatggatttgcacccaggatccggtaaaacccggcgctacctacccgctatcgtcagagaggccattaagaggaagctgcggacactcatcttagcgcctacccgagtggttgccagtgaaatggcagaggctctgaaaggcatgccaataagatatcagactacagccgtgaagtctgaacataccgggcgcgagattgtcgaccttatgtgccacgctacgttcactatgaggctgctcagccccgtgcgtgtacctaattacaacatgatcatcatggatgaggcacattttacagacccggcctccattgccgctcggggatatatctcaaccagagtgggcatgggtgaagcggcagccatattcatgaccgctactcccccagggtctgttgaggcctttcctcagagcaatgcagtcattcaagatgaagagagggacatccccgaacgcagttggaactccggatacgattggattacagacttcccaggcaaaaccgtgtggtttgtgcctagcatcaagtctggcaatgatatagccaactgtttgcgaaaaaacgggaagagagtcattcagctgtcacggaagacattcgacactgagtatcagaaaacgaagaataacgactgggattacgtagtgaccacagacatctccgagatgggagctaatttcagggcggatcgcgttatcgacccccgtagatgcctcaaaccagtgattctgaaggatggtccggaacgggtcatccttgccggccctatgcccgtgactgttgcaagtgctgcccagaggcgcgggcgaattggaagaaaccaaaataaagagggcgaccagtacgtgtatatgggtcagccactaaacaatgatgaagaccacgcacattggaccgaggccaagatgctgttggataacataaatacacccgaggggatcattcctgctttatttgaaccagagcgggaaaagagcgccgcgatcgacggcgagtacaggctgcgcggagaagcaagaaaaaccttcgtcgagctcatgaggcggggcgatctgcccgtgtggctttcgtataaggtagcctctgaggggtttcagtactccgaccgtcgctggtgcttcgatggagaacgaaacaatcaagtgctggaggaaaacatggacgttgagatctggactaaagaaggtgagagaaagaaactcaggcctcggtggttggacgctcgcacgtatagcgatccgctggccctaagagagtttaaggaattcgctgcaggcaggcggtcagtcagtggggacctgattctcgagataggaaaacttccacagcacctgaccttacgagcccagaatgctttggataacctggtgatgctccacaattctgaacagggcggtaaggcctacagacatgcaatggaggaactgcccgacacaatcgagactcttatgctgctcgcgttgattgccgtgctgaccgggggcgtcacattatttttcctatccggaaagggcctggggaaaaccagcatcggactcctttgtgttactgcttcaagtgccctgttgtggatggcaagcgtggagcctcactggattgctgcctccatcatactggaatttttcctcatggtactgcttatccccgagccagatcgccaaaggacacctcaggacaaccagctcgcatatgtggtcattggtctgttgtttatgatcctgacggtggccgctaacgaaatgggcttactagagaccactaagaaagatctggggattggacatgttgcggccgagaatcaccaacacgcaacaatgctcgacgtggatcttcggcccgcttctgcctggaccctgtacgccgtcgcaaccacagtaatcactccaatgatgcgtcatacgatagaaaacaccacagctaatattagcttgactgccatcgcgaaccaggctgccattctgatgggcctcgacaagggttggcctatctccaaaatggatataggggtgccgctgcttgcattaggctgctactcacaggttaatcccctgaccctcacagccgctgtgttgatgctggtcgcacactatgccatcattggaccaggcctacaggcgaaggctaccagagaggcccaaaagaggactgcagccgggatcatgaaaaaccctacggtggacggaattgtcgctatcgatctggaccccgtggtttacgacgccaagttcgaaaaacagctcggccagataatgcttctgattttgtgtacatctcagatcctgctcatgcgcaccacttgggcactgtgcgagagtatcaccttagctacaggtccacttactaccctgtgggaagggtcgcctggaaagttttggaatacaacgattgccgtgagcatgaccaacatcttccggggctcctatctcgcgggtgccggcctagcattctctctgatgaaatcattggggggaggccgaagagggactggagctcaaggcgagacactgggtgagaagtggaagaggcagctcaatcagcttagcaaatccgaatttaacacctacaagcgcagtgggataatggaggtagatcggtctgaagccaaagagggactgaagagaggcgaaactacaaaacatgcagtgagccgtggtaccgctaagttgaggtggttcgtcgagcggaatctggttaagcccgagggcaaagtgattgacctcgggtgtggacgcggcgggtggtcatattactgcgccggattaaagaaagtcacggaagtgaagggctataccaaaggtgggccgggacacgaggaaccaatccctatggccacatacggctggaacctggtaaagcttcattccggcaaagatgtgtttttcatgcccccagagaagtgtgacactctgctatgcgatattggggaaagtagccccaatcctaccatcgaggagggacgaacactcagagttctgaagatggtggaaccgtggttgaggggtaaccagttttgtataaaaatcctgaatccctacatgccatctgtcgtggagactctcgaacaaatgcagcggaagcacggcgggatgcttgtccgcaaccctctgtccagaaattcaacccacgagatgtattgggtgagctgcggaacaggcaacattgtttcggcggtaaacatgacctctaggatgttactgaatcgattcactatggctcatcggaaacccacgtacgagcgtgacgtggatttgggtgcagggacaagacacgtcgccgtggaacctgaggttgctaacctcgacatcattggacagcgcatcgaaaatattaagaacgagcataaaagtacctggcactatgatgaagacaatccatacaagacttgggcctatcacggctcctacgaggtgaagcccagcggctcagcatcctctatggtcaacggggtggtaaggctgctaaccaaaccttgggatgtgatcccaatggttacacaaatagccatgacggacaccactccctttggacagcagcgggtcttcaaggagaaagtggacacaagaaccccgcgcgctaagaggggtactacacagattatggaagtgaccgcgaaatggctttggggctttctgagccgaaataagaagcctcggatctgtacaagagaggaattcactaggaaagtccgcagtaacgccgcaatcggggctgtttttgtggatgagaatcaatggaactccgccaaggaagcagtagaggacgagcgtttctgggatctcgtgcatcgggaaagagagctgcacaaacagggaaagtgcgccacctgcgtctataatatgatgggcaaaagggaaaagaagttgggtgagtttgggaaagctaagggaagccgcgccatttggtacatgtggctgggcgcgcgattcctcgaattcgaggcacttggctttatgaacgaggaccattggttctctcgggaaaattcactgagtggggtggagggagaaggtttacacaaactgggctacatattgagagatatctccaagattccagggggaaacatgtatgccgacgatacggctggctgggacaccaggatcacagaggatgacctccagaatgaggccaaaattactgatatcatggaacccgagcatgcactgctagctaccagcatatttaagcttacataccagaacaaagttgtgcgcgtccaaagacctgccaagaacggtactgtgatggacgtaatctctcggagggatcagcgtgggtcgggacaggttggcacctatggcctgaatacgttcacaaacatggaagtgcagctcattcgactgatggagtcagaagggatctttttgccaagcgagttagagacccccaatctggctgaacgcgtcctcgactggcttgagaagcacggagccgaaagactgaaacggatggcaatttccggtgacgattgtgtggtgaagccgatcgacgataggttcgcgactgccctaacagctctgaacgacatgggcaaagtccgcaaggatatacctcaatgggagcccagtaaagggtggaatgactggcagcaggttccattttgctctcaccatttccaccagctcattatgaaggatggaagagaaatcgtggtaccttgtcggaaccaagacgagttggtgggcagggcccgagtcagccagggtgcagggtggtccctgcgtgagaccgcttgccttggaaagtcatacgcccagatgtggcaactgatgtattttcatagacgcgatctccggttagcagccaatgcgatctgtagtgctgtgcccgttgactgggtgccaacttctaggaccacatggagcattcacgcccaccatcagtggatgacgaccgaagatatgctgtccgtctggaacagagtgtggatagaggaaaatccctggatggaggacaaaactcacgtatcaagctgggaagaggttccttacttgggcaagcgcgaggaccagtggtgcggctctctgatcgggctcacagcacgggccacctgggctactaacattcaggtggccatcaatcaagtcaggcgacttattggaaacgaaaattatctggattacatgacatccatgaaaagattcaagagtgagagcgacccagaaggtgcactatggtga

SEQ ID NO: 13409 - RNA, 9879 nt, synthetic construct
  misc_feature 1..9879: note = derived and/or modified CDS sequence (opt3) from DENV-1__FJ850113__SS-prME
  source 1..9879: mol_type = other RNA
agcgtgaccatgctgctcatgcttctgcccacagccttggctttccacttaactacgagaggcggggagcctcatatgatcgtctccaagcaggaaaggggaaaatctctgctatttaagacctcagcaggtgttaacatgtgcacactcattgccatggacctgggcgagctttgtgaagatactatgacctacaaatgcccacaaataacagaggcggaaccggacgatgtggactgttggtgcaatgctaccgatacttgggtaacatatgggacctgtagtcagacgggagagcaccggcgcgacaagcgaagcgtggccctggcaccccatgtcggcttgggtctcgagactcgtaccgaaacatggatgtcctctgagggggcctggaaacagatccagagagtggaaacttgggctctgaggcaccctggattcaccgttattgcactgtttctcgcccatgctatcggcacatcgattacccaaaagggcatcatattcatcttactgatgcttgtgacgccatcaatggccatgcggtgcgtcgggattggaaaccgcgattttgtggagggtttgagcggcgcgacttgggtagacgttgtgctggagcacgggagttgtgtcacaaccatggcaaagaataaacccactctagatatcgaactcctgaagacagaggtgaccaaccctgccattcttagaaaactgtgcatcgaagctaagatatccaatacgaccacagactctaggtgtccaactcagggagaggccaccttggtggaagagcaggatgcaaacttcgtctgccggcgcacatttgttgaccgaggctggggtaatgggtgtggactcttcggcaaaggcagcctgttaacttgcgctaagtttaagtgcgtgaccaaactggaggggaagattgtacagtacgaaaacctcaaatattccgtgatcgtcacagtgcacaccggagatcaacatcaggttggtaatgagactacggaacacggcacaattgccaccatcactccccaggcgcctacctcagagatccagcttacagactacggggccctgaccttggactgtagtccaagaactggactagatttcaacgaaatggtgctgctcacaatgaaggagaaaagctggctggtccataagcaatggtttcttgacctgccgttgccctggacgtctggcgcatccacctcacaggagacttggaataggcaggatctcctggtgacattcaaaaccgctcacgccaagaagcaagaagtagttgtgttaggtagccaggagggggctatgcacacagccctgactggcgcaaccgaaattcagacgagtggaaccacaactatatttgccggccatctaaaatgccggctcaagatggacaaactgacccttaaggggacatcttatgtcatgtgtactggatccttcaaattggagaaggaagtggctgagacccagcacggtacggtcctggtgcaagttaagtacgagggcacagatgcgccttgcaaaatcccattcagcacccaggacgaaaagggggtgactcagaacggacgtctcattacagcaaatcccatcgtaaccgataaagagaagcctgtcaacatagaaactgagccaccctttggcgagtcgtatattgtggttggtgccggggaaaaagctctgaagctttcttggttcaagaaaggctcctcaatcggaaagatgtttgaggccaccgcacgcggcgccagaaggatggctatcctgggggacacagcctgggatttcggaagtattggtggcgtgtttacgagcgtcgggaaattggtgcatcaggtattcggaaccgcatacggcgtgctcttttccggtgtttcttggactatgaagatcgggattggcatactgttaacatggctgggactaaatagccggtcaaccagtctctccatgacatgtatcgcggtcggcatggtgactctgtaccttggggtgatggtccaagctgacagcggatgcgttattaactggaaaggccgagaattgaagtgtggttctgggatcttcgtgaccaacgaggtgcacacgtggacagaacagtataagtttcaggccgattcaccgaaacgcctgagtgcagccatcggaaaggcttgggaggagggcgtatgcggtattagaagcgccaccaggctcgaaaatataatgtggaaacagatctccaacgagctgaatcatattttactggaaaacgacatgaagttcactgtcgtggttggcgacgcaaatgggatccttgctcaaggaaaaaagatgattcggcctcagcccatggagcacaaatactcttggaagtcgtggggcaaggccaaaatcataggggcggatatccagaacaccacatttattatcgacggaccagatactcctgaatgtcccgacaatcagcgcgcctggaacatttgggaggtggaggattatggcttcggtatctttaccacaaatatatggttgaagctcagagacagctacacgcaaatgtgcgatcacaggctgatgtccgctgcaattaaagactcaaaggccgtccatgctgatatggggtattggatcgaaagtgagaaaaacgaaacctggaagctagcccgtgcatctttcattgaggtgaagacttgtacatggccaaaaagccacaccctgtggtccaatggagttctcgaatcagagatgatcatacccaagatctacggcggtcctattagccagcataactatcggccaggctacttcactcagacagcggggccgtggcacctgggaaaacttgagttggactttgatctgtgcgaaggcaccacggtggtagtcgacgagcactgcgggaatcgaggaccctctttaagaactaccacagtgaccggcaagatcattcatgaatggtgttgcaggtcctgtactctccctccactgcgcttccggggtgaggatgggtgctggtacggaatggagatcagacccgtgaaagaaaaggaggaaaaccttgtcaggagtatggttagcgccggctctggtgaggtggactccttttcactgggcatattgtgtgctagtattatgatcgaagaggtaatgcgcagccgatggtcgcggaagatgctcatgacagggaccctggccgtgttcctactgctcatcatgggacaactgacatggaatgaccttattcgtttgtgcatcatggtcggcgcaaacgcttccgatagaatggggatgggaactacctatctggccttaatggcaacgtttaaaatgaggcctatgttcgccgtgggcctcctgtttcgccggcttacatctagagaggttctgctactcaccattggtctgagcttggtggcttcagtcgaactgccaaacagtttagaggaactcggggacggactggcgatgggcataatgatgcttaagctgttgactgagttccagccccaccagctctggaccacactgctatccctgacttttatcaaaaccacgctttctctcgattacgcctggaagacaaccgcaatggtgctgagcattgtttccttgttcccgctgtgtttatcaactacaagccagaaaaccacttggctccctgtgctgcttggcagttttgggtgcaagccactgacaatgttcttgatcaccgaaaataagatttggggaaggaaatcttggcccctcaacgagggtatcatggctataggcatcgtctccattctgctaagctcgctgcttaagaatgacgtacctctcgccgggcccctgatcgccggaggcatgttgattgcttgttatgtgatctcaggttctagtgcagatttatccctggagaaagccgcggaagttagctgggagcaagaagctgagcattctgggacgagccacaacatactcgtggaagtccaggacgatggaactatgaagattaaagacgaggagcgagatgacaccctgacaatccttctgaaggccaccttgctagcagtgtccggcgtatacccaatgtcaatccctgccacactgtttgtgtggtatttctggcagaaaaagaagcagcgcagtggcgtcctctgggatactcccagcccaccggaagttgagcgggctgtgctggacgatgggatttacagaatacttcaaaggggattactgggtcgttctcaggtgggcgtcggggtgttccaggacggagtttttcataccatgtggcacgtaacgcgcggcgcagtgctcatgtatcagggtaaacggttggaaccttcctgggcctcagtcaagaaagacctgatcagttacgggggaggctggagattccaaggcagctggaatacaggggaggaggtgcaggttattgcggtggaacccggaaagaacccaaaaaatgtccagactacccccggtacatttaagacccctgagggcgaagtgggggctatcgccctcgatttcaagccaggaacttccggctctcccattgtaaacagggagggtaaaatcgtcgggctgtacggaaatggcgtggttaccacatcgggcacgtatgtgagcgcaatagcccaagctaaggcctcacaggaagggcctcttccggagatcgaggacgaagtctttaaaaagcgaaacctgactattatggatttgcacccaggatccggtaaaacccggcgctacctacccgcaatcgtgagagaggctattaagaggaagctgcggacactcatcttagcccctacccgagttgtggcgagtgaaatggccgaggcactgaaaggcatgccaataagatatcagactacagctgtcaagtctgaacataccgggcgcgagattgtggaccttatgtgccacgccacgttcactatgaggctgctcagccccgtacgtgtgcctaattacaacatgatcatcatggatgaggctcattttacagacccggcatccattgccgcccggggatatatctcaaccagagttggcatgggtgaagctgcggcaatattcatgaccgccactcccccagggtctgtcgaggcttttcctcagagcaatgccgtgattcaagatgaagagagggacatccccgaacgcagttggaactccggatacgattggattacagacttcccaggcaaaaccgtgtggtttgtccctagcatcaagtctggcaatgatatagcaaactgtttgcgaaaaaacgggaagagagtaattcagctgtcacggaagacattcgacactgagtatcagaaaacgaagaataacgactgggattacgtggttaccacagacatctccgagatgggagccaatttcagggctgatcgcgtgatcgacccccgtagatgcctcaaaccagtcattctgaaggatggtccggaacgggtgatccttgcgggccctatgcccgttactgtggccagtgcagctcagaggcgcgggcgaattggaagaaaccaaaataaagagggcgaccagtacgtctatatgggtcagccactaaacaatgatgaagaccacgcccattggaccgaggcaaagatgctgttggataacataaatacacccgaggggatcattcctgccttatttgaaccagagcgggaaaagagcgctgccatcgacggcgagtacaggctgcgcggagaagcgagaaaaaccttcgtggagctcatgaggcggggcgatctgcccgtatggctttcgtataaggtggcatctgaggggtttcagtactccgaccgtcgctggtgcttcgatggagaacgaaacaatcaagttctggaggaaaacatggacgtcgagatctggactaaagaaggtgagagaaagaaactcaggcctcggtggttggacgcccgcacgtatagcgatccgctggctctaagagagtttaaggaattcgccgctggcaggcggtcagtgagtggggacctgattctcgagataggaaaacttccacagcacctgaccttacgagcacagaatgccttggataacctggtgatgctccacaattctgaacagggcggtaaggcttacagacatgccatggaggaactgcccgacacaatcgagactcttatgctgctcgcattgattgcggtcctgaccgggggcgttacattatttttcctatccggaaagggcctggggaaaaccagcatcggactcctttgtgtgactgcctcaagtgctctgttgtggatggccagcgtagagcctcactggattgcagcttccatcatactggaatttttcctcatggtgctgcttatccccgagccagatcgccaaaggacacctcaggacaaccagctcgcctatgtcgtgattggtctgttgtttatgatcctgacggttgcagccaacgaaatgggcttactagagaccactaagaaagatctggggattggacatgtggctgcggagaatcaccaacacgccacaatgctcgacgtcgatcttcggcccgcatctgcttggaccctgtacgccgtagccaccacagtgatcactccaatgatgcgtcatacgatagaaaacaccacagcaaatattagcttgactgctatcgccaaccaggcggctattctgatgggcctcgacaagggttggcctatctccaaaatggatataggggttccgctgcttgccttaggctgctactcacaggtgaatcccctgaccctcacagcagccgtcttgatgctggtggctcactatgcaatcattggaccaggcctacaggccaaggcgaccagagaggctcaaaagaggactgccgcagggatcatgaaaaaccctacggtcgacggaattgtggccatcgatctggaccccgttgtgtacgacgctaagttcgaaaaacagctcggccagataatgcttctgattttgtgtacatctcagatcctgctcatgcgcaccacttgggccctgtgcgagagtatcaccttagcaacaggtccacttactaccctgtgggaagggtcgcctggaaagttttggaatacaacgattgctgtaagcatggccaacatcttccggggctcctatctcgcgggtgccggcctagcattctctctgatgaaatcattggggggaggccgaagagggaccggagctcaaggcgagactctgggtgagaagtggaagaggcagctcaatcagcttagcaaatccgaatttaacacatacaagcgcagtgggataatggaggtggatcggtctgaagccaaagagggactgaagagaggcgaaaccactaaacatgcagtcagccgtggtacagctaagttgaggtggttcgttgagcggaatctggtgaagcccgagggcaaagtcattgacctcgggtgtggacgcggcgggtggtcatattactgcgccggattaaagaaagtgaccgaagtaaagggctatacgaaaggtgggccgggacacgaggaaccaatccctatggccacctacggctggaacctggtgaagcttcattccggcaaagatgtttttttcatgcccccagagaagtgtgacacactgctatgcgatattggggaaagtagccccaatcctactatcgaggagggacgaaccctcagagtgctgaagatggtcgaaccgtggttgaggggtaaccagttttgtataaaaatcctgaatccctacatgccatctgtggtcgagacactcgaacaaatgcagcggaagcacggcgggatgcttgtgcgcaaccctctgtccagaaattcaactcacgagatgtattgggttagctgcggaaccggcaacattgtatcggcggtgaacatgacatctaggatgttactgaatcgattcaccatggctcatcggaaacccacttacgagcgtgacgtcgatttgggtgcagggacgagacacgtggccgttgaacctgaggtggctaacctcgacatcattggacagcgcatcgaaaatattaagaacgagcataaaagtacatggcactatgatgaagacaatccatacaagacctgggcctatcacggctcctacgaggtcaagcccagcggctcagcatcctctatggtgaacggggtagtgaggctgctaactaaaccttgggatgttatcccaatggtcacccaaatagccatgacagacacgaccccctttggacagcagcgggtgttcaaggagaaagtggacactagaacaccgcgcgctaagaggggtaccactcagattatggaagtcacagcgaaatggctttggggctttctgagccgaaataagaagcctcggatctgtaccagagaggaattcacaaggaaagttcgcagtaacgccgcaatcggggctgtgtttgtagatgagaatcaatggaactccgccaaggaagcagtggaggacgagcgtttctgggatctcgtccatcgggaaagagagctgcacaaacagggaaagtgcgccacttgcgtgtataatatgatgggcaaaagggaaaagaagttgggtgagtttgggaaagctaagggaagccgcgccatttggtacatgtggctgggcgcgcgattcctcgaattcgaggcacttggctttatgaacgaggaccattggttctctcgggaaaattcactgagtggggttgagggagaaggtttacacaaactgggctacatattgagagatatctccaagattccagggggaaacatgtatgccgacgataccgctggctgggacacgaggatcaccgaggatgacctccagaatgaggccaaaattacagatatcatggaacccgagcatgcactgctagctactagcatatttaagcttacctaccagaacaaagtggtccgcgtgcaaagacctgccaagaacggtacagtaatggacgttatctctcggagggatcagcgtgggtcgggacaggtgggcacttatggcctgaataccttcacgaacatggaagtccagctcattcgactgatggagtcagaagggatctttttgccaagcgagttagagacacccaatctggctgaacgcgtgctcgactggcttgagaagcacggagccgaaagactgaaacggatggcaatttccggtgacgattgtgtggtcaagccgatcgacgataggttcgcgaccgccctaactgctctgaacgacatgggcaaagttcgcaaggatatacctcaatgggagcccagtaaagggtggaatgactggcagcaggtgccattttgctctcaccatttccaccagctcattatgaaggatggaagagaaatcgtagtgccttgtcggaaccaagacgagttggtcggcagggcccgagtgagccagggtgcagggtggtccctgcgtgagacagcttgccttggaaagtcatacgcccagatgtggcaactgatgtattttcatagacgcgatctccggttagcagccaatgcgatctgtagtgctgttcccgtggactgggtcccaacctctaggactacctggagcattcacgcccaccatcagtggatgacaacggaagatatgctgtccgtgtggaacagagtatggatagaggaaaatccctggatggaggacaaaacccacgtttcaagctgggaagaggtgccttacttgggcaagcgcgaggaccagtggtgcggctctctgatcgggctcactgcacgggccacatgggctaccaacattcaggtcgccatcaatcaagtgaggcgacttattggaaacgaaaattatctggattacatgacttccatgaaaagattcaagagtgagagcgacccagaaggtgcactatggtga

SEQ ID NO: 13410 - RNA, 9879 nt, synthetic construct
  misc_feature 1..9879: note = derived and/or modified CDS sequence (opt3) from DENV-1__JF937635__SS-prME
  source 1..9879: mol_type = other RNA
agcgtgaccatgctgctcatgcttatgcccacagccctggctttccacttgactacgagaggcggggaacctcatatgatcgtctccaagcacgaaagaggaaaagcattactgtttaagacctctaccggtgttaacatgtgcactctgattgccatggacctcggcgaactgtgtgaagataccatgacatacaaatgcccacggataaccgaggcggaaccggacgatgtggactgttggtgcaatgctactgatacatgggtaacctatgggacgtgttcacagactggagagcatcgccgagacaagcgtagtgtggcccttgcaccccacgtcggcctgggtttggagaccagaacagaaacttggatgagctccgagggggcctggaaacaaatccaaagggtggaaacctgggctctccggcatcctggattcacagttattgcactgtttctggcccacgctatcggcacctctattacgcagaagggcatcatattcatcctcttaatgctggtgactccatcgatggccatgcgctgcgtcgggattggaaacagagattttgtggagggtctttcaggcgcgacatgggtagacgttgtgttggagcacgggagctgtgtcaccactatggcaaagaataaacccacactggatatcgaactgctcaagaccgaggtgacgaaccctgccgtgctgaggaaactttgcattgaagctaagatcagtaataccacaactgactcccggtgtccaacccagggagaggccacactggtcgaagaacaagatgcaaacttcgtttgccgccgaacttttgtggacagaggctggggtaatgggtgtggattgttcggcaaaggctctctcctgacctgcgctaagtttaagtgcgtaacaaaattagaggggaagatagtgcagtacgaaaacctgaaatatagcgtcattgtgaccgttcatactggagatcagcaccaggtgggtaatgagacgacagaacatggcaccatcgccactattaccccacaagcgcctacatccgagatccagctcaccgactacggggcccttactctggactgttcaccaaggacaggattggatttcaacgaaatggtcctactgacgatgaaggagaaaagttggctcgtgcacaagcagtggtttctggaccttccgctgccctggaccagcggcgcatctacttcccaggagacatggaatcggcaagatttgctcgtaaccttcaaaacagctcacgccaagaagcaggaagttgtggtcctgggttcacaggagggggctatgcatactgccttaaccggcgcaacggaaatccaaaccagcggaacaactaccatttttgccggccacctgaaatgccgtctaaagatggacaaactcacactgaaggggacaagttatgtgatgtgtaccggatctttcaaacttgagaaggaagtcgctgagacgcagcatggtacagtgttggttcaggtgaagtacgagggcaccgatgcgccttgcaaaataccattctccactcaggacgaaaagggggtaacacaaaacggacgcctgatcaccgcaaatcccattgtcactgataaagagaagcctgtgaacatcgaaaccgagccaccctttggcgagagctatatagttgtgggtgccggggaaaaagctctcaagctgtcgtggttcaagaaaggatcttccattggaaagatgtttgaggccacagcaagaggcgccaggcggatggctatccttggggacacggcctgggatttcggatcaatcggtggcgtctttaccagtgtggggaaactggtacaccaggtgttcggaactgcatacggcgttttgtttagcggtgtctcctggacaatgaagattgggatcggcattctcctgacctggttaggactaaattctcgaagcacatcactaagtatgacttgtatagcggtgggcatggtgaccctctacctgggggtcatggttcaggctgactccggatgcgtgatcaactggaaaggccgcgaacttaagtgtggtagcgggattttcgtgacgaacgaggtacatacatggaccgaacagtataagtttcaagccgattctccgaaaagattgtcagcagccatcggaaaggcttgggaggagggcgtctgcggtatcaggagtgccactcggctggaaaatattatgtggaaacagataagcaacgagctcaatcacatcctgttagaaaacgacatgaagttcaccgtggttgtgggcgacgcaaatgggattctggctcagggcaagaagatgatccgccctcagcccatggagcacaaatactcctggaagtcttggggcaaggccaaaattatcggggcggatatacaaaacacaacttttatcattgacggaccagatacccctgaatgtcccgacgatcagagagcctggaatatctgggaggtcgaggactatggcttcggtatttttacaacgaacatctggcttaagttgagggattcgtacacccagatgtgcgaccatcgtctcatgagcgctgcaataaaagattccaaggccgtgcacgctgacatggggtattggattgaatcagagaaaaatgaaacttggaagctggcccgggcaagtttcatcgaggttaagacatgtacctggccaaaatctcatactctatggagcaacggagtgctggaatccgagatgattatccccaagatatacggcggtcctatctcacagcacaattatcgaccaggctacttcacacaaaccgcggggccgtggcacctcggaaaactggagcttgattttgacttgtgcgaaggcacgactgtagtcgtggatgagcattgcgggaacagaggacccagcctgaggaccacaaccgtgactggcaagattatccacgaatggtgttgccgctcttgtacattacctccactccggttcagaggtgaggacgggtgctggtacggaatggagattaggcccgtcaaagaaaaggaggaaaatctggttcgctccatggtgagtgccggcagcggtgaggtagactctttttcccttggcatcctgtgtgtgtcaataatgattgaagaggtcatgcgaagtcggtggagccgtaagatgttgatgaccgggacactcgctgtgttcctgctactgatcatgggacagctcacttggaacgatctgatcagactttgcattatggttggcgccaatgcatcggacaggatggggatgggaaccacgtatttggctctgatggccacatttaaaatgcgccctatgttcgcagtgggcatcttatttcggagactcacctccagggaggtcctgcttctgactattggtctatctctcgtggccagcgttgaactgccaaactcattggaggaactgggggatggattagctatgggcataatgatgctcaagctgcttaccgagttccagccccatcaactgtggacaactttgctcagtctgacctttatcaaaacgacactatccctggactacgcgtggaagaccactgccatggcactttctattgtgagcctcttcccgctgtgtttgtccacaacctcacagaaaactacatggctgcctgtcttactcggcagctttgggtgcaagccactgaccatgttccttatcacggaaaacaagatttggggacgaaaaagttggcccatcaatgagggtataatggctatcggcattgtatctatcctgttgtccagcctcctgaagaacgatgtgcctctagccgggcccctgattgccggaggcatgcttatcgcttgttatgttatatcgggttcatctgcagacctcagtctggagaaagccgcggaagtgtcctgggagcaggaagctgagcacagcgggacttctcataatattttggtcgaagtgcaggatgacggaaccatgcgcatcaaggatgaggagaaagacgatacattaaccatcctgctcaaggccacactgcttgcagtaagcggcgtgtacccaatgtccattcctgccactctgtttgtctggtatttctggcagaagaagaagcagcggtcaggcgttttgtgggacacccccagtccaccggaagtggagagagctgtgctagatgacgggatatacaggatcctgcagcgtggactcctgggtcgcagccaggtcggcgtgggggttttccaagacggagtatttcacacgatgtggcacgtgacacggggcgcagtccttatgtatcagggtaaaagattagaaccttcttgggcctccgtgaagaaagatctgatttcatacgggggaggctggaggttccagggcagttggaacactggggaggaggttcaggtgatcgcggtcgaacccggaaagaatcccaaaaacgtgcaaaccacacccggtacctttaagactagcgagggcgaagtaggggctattgccctcgacttcaagcctggaacctccggctctccaatcgtcaatcgagagggtaaaatagtggggttgtacggaaacggcgttgtgacaacgtcgggcacttatgtcagcgcaatcgcccaggctaagacctcacaggaagggccccctccggagattgaggatgaagtgtttaaaaagcggaatctgacaatcatggacctccatccaggatccggtaaaacccgcagatacctgcccgccattgttagggaggcaatcaagcggaaacttcgaactctgatattggctcctacaagagtggtcgccagtgaaatggcggaggccctaaaaggcatgccaattcgctatcaaaccacggcagtgaagtctgaacacactgggagggagatcgtagatctgatgtgccatgctacattcaccatgcgtctcttaagccccgtgcgggttcctaactacaatatgatcattatggacgaggcccactttaccgatccggcttccatcgcagccagaggatatatatcaactagggtcggcatgggtgaagccgctgcgattttcatgacagcaacacccccagggtctgtggaggcctttcctcagagcaacgctgtgatccaggacgaagaacgcgatattcccgaacgaagttggaactccggatacgactggatcacagatttcccaggcaaaactgtctggtttgtacctagcataaagtctggcaatgacattgccaattgtctgaggaaaaacgggaagcgggtgatccagctttcaaggaagacgttcgacaccgagtatcagaaaactaagaacaatgattgggactacgttgtgactaccgatatctccgagatgggagcaaacttccgcgccgaccgtgtcattgatcccagacggtgcctgaaaccagtgatcctcaaggacggtccggaaagggttattttggctggccctatgcccgtgacagtcgcgagtgccgcacaacgccgagggagaataggacggaatcagaacaaagagggcgatcagtacgtgtatatgggtcaaccactgaataacgacgaagatcatgctcactggaccgaggccaagatgctcctggacaatatcaacactcccgaggggattatccctgcactttttgaaccagagagggaaaagagcgccgctatcgatggcgagtaccgcctaagaggagaagccaggaaaacgttcgtagagctgatgcggcgtggcgacttgcccgtgtggttatcgtataaggttgcgtctgaggggtttcagtactccgatcgccgatggtgcttcgacggagaaagaaataaccaggtcctggaggaaaatatggacgtggagatttggaccaaagaaggtgagaggaagaaactccggcctcgctggctggatgcaagaacatatagcgacccgcttgccctgagggagtttaaggagttcgctgccggccggcgatcagtgagtggggatctcatattggagatcggaaaactgccacagcacctaactctgagagctcaaaacgcactcgacaatcttgtcatgctgcataactctgaacagggcggtaaggcctaccgccacgctatggaggaattacccgataccattgagacattgatgctgctcgccctgatcgcagttcttaccgggggcgtgactctgtttttcctctccggaaagggcttggggaaaacaagcattggactgttatgtgtaacggcgtcaagtgccctactgtggatggctagcgtggagcctcattggatcgccgcatccataatcctcgaatttttccttatggtcctgttgattcccgagccagacaggcagcggacccctcaggataatcaactggcttatgtggttatcggtctcctgtttatgattcttactgtggccgcaaacgaaatgggcctcctggagacaaccaagcgtgacttggggatcggacacgtcgccgctgagaaccaccagcatgcgaccatgctggatgtagacttaagacccgcctctgcatggacactatacgctgtggccactacggttataaccccaatgatgaggcacacaattgaaaatactaccgccaacatcagcctgacagcaattgctaatcaggccgcgatcctcatgggccttgataaaggttggcctatatccaagatggacatcggggtgccgctgttggctctgggctgctactcacaagtcaaccccctcaccctgactgccgcagtgcttatgttagtcgcccattatgctattatcggaccaggcctgcaggcaaaagccacgcgcgaggcgcagaagcggacagctgccgggattatgaagaatcctaccgtggatggaatcgttgcaatagacctcgaccccgtggtatacgatgccaaattcgaaaagcagttgggccaaattatgctgctaatcctgtgtacttctcagatcctccttatgcgaaccacatgggctctgtgcgagagtattactttggccaccggtccactgacaacgctctgggaagggtcgcctggaaaattttggaacaccactatcgcagtgagcatggctaatatattcagaggctcctatctggccggtgcgggcttagccttctctcttatgaagtcactagggggaggcaggcgcgggacaggagcacagggcgagaccctcggtgagaaatggaagcggcagctaaaccaactgagcaagcccgaatttaatacttacaaaagatccgggattatggaggtcgaccgtagtgaagctaaggagggattgaaaaggggcgaaacaaccaagcacgccgtttctcggggtacggcaaaactgcgctggttcgtggagcgaaacctcgtcaagccggagggcaaggtgatcgatcttgggtgtggaagaggcgggtggagctattactgcgctggactgaaaaaggtaaccgaagtgaaaggctatacaaagggtgggccaggacatgaggaacctattcccatggccacttacggctggaatttggttaaactgcactcaggcaaggacgtgtttttcatgccacccgagaaatgtgataccctcttatgcgacatcggggaatccagtcctaacccgacaatagaggagggaaggactctgcgggtccttaagatggtggaaccctggctgcgcggtaatcagttttgtatcaagattctaaacccatacatgcctagcgtcgtggagaccctcgaacagatgcagagaaaacacggcgggatgctggttaggaatcccttgtctcgaaactccacacatgagatgtattgggtatcatgcggaaccggcaatatcgtgagcgccgtcaacatgacttcgcggatgctgctcaaccgtttcacgatggcgcacagaaagcctacatacgagcgcgatgtggaccttggtgctgggaccaggcatgttgcagtggaaccagaggtcgccaatctggatattatcggacaacggattgaaaacatcaaaaatgagcacaagtctacttggcactatgacgaagataacccctacaaaacctgggcttatcatggcagttacgaggtgaagccttccggcagcgcctcatccatggtaaatggggtggttagattactgacaaagccatgggacgtcatacccatggtgacgcagattgcaatgaccgacactacaccgtttggacagcaacgcgtgttcaaagagaaggtcgataccaggactcctcgagccaaacggggtacaacccagatcatggaagttacagctaagtggttgtggggctttctctctagaaacaaaaagccaaggatctgtactcgcgaggagttcacccgtaaggtgcggagcaatgcggccattggggcagtatttgtggacgagaaccagtggaatagtgctaaagaagccgtcgaggatgagagattctgggacctggtgcacagggaacgcgagctacataagcagggaaaatgcgcaacgtgcgtttataacatgatgggcaagcgagagaagaaacttggtgagtttgggaaagccaaaggatcccgggctatatggtacatgtggctgggcgccagattcctcgagttcgaggcgctgggctttatgaatgaggatcactggttcagcagggaaaactctttgtcaggggtggagggagaaggtctgcataagctcggctacatccttcgcgacattagtaaaatccccgggggaaatatgtatgcagatgacaccgccggctgggatacaagaattactgaggacgatctgcaaaacgaggctaagatcaccgacataatggaacctgagcacgccttactggcaacatccatctttaaattgacttaccagaataaggtcgtgcgggtacagaggccagctaaaaacggtaccgttatggatgtgattagccgtcgagaccagcgcgggtctggacaagtcggcacgtatggcctcaacacattcaccaatatggaagtgcagctgatcagacagatggagtcggaagggatttttctaccctcagagcttgagactccgaacctggccgaacgggtgctcgactggctggagaagcacggagctgaaaggttgaagcgcatggccatcagcggtgatgactgtgtcgttaaacctatagatgacagattcgcaacagcgttaaccgccctgaatgatatgggcaaggtgcggaaagacattccccagtgggagccatccaaggggtggaacgattggcaacaggtacctttttgcagtcatcacttccatcagctcatcatgaaagacggaagggaaatcgtggtcccctgtcgaaatcaggatgagcttgtgggccgtgctagagtttctcaaggtgccgggtggagcctgcgcgagactgcatgcctaggaaagtcctacgctcagatgtggcagctgatgtattttcaccggagggacctcagattggccgcaaacgccatttgttcagcggtgccagtcgattgggtgcccaccagtcgcacaacgtggtctatacacgctcatcaccaatggatgaccactgaagacatgctgagcgtatggaatcgggtttggatcgaggaaaacccttggatggaggacaagacacatgtgtcctcatgggaagaggtcccataccttggcaaaagggaggatcagtggtgcggcagcctgattgggctcaccgcccgagcaacttgggccacaaatatccaggtggctattaaccaggttagacggttaatcggaaatgaaaactatctggactacatgacctctatgaagaggttcaaaaatgagtccgatccggaaggtgccttgtggtga

SEQ ID NO: 13411 - RNA, 9879 nt, synthetic construct
  misc_feature 1..9879: note = derived and/or modified CDS sequence (opt3) from DENV-1__FJ024483__SS-prME
  source 1..9879: mol_type = other RNA
agcgtgaccatgctgctcatgcttctgccaacagcattggctttccacttaactacgcgaggaggggaacctcatatgatcgtctccaagcaggaaaggggaaaatctctgttgtttaagacctcagccggtgttaacatgtgcacactcattgccatggacctgggcgaactttgtgaagatactatgacctacaaatgcccacaaataacagaggcggaaccggacgatgtggactgttggtgcaatgctaccgatacttgggtaacatatgggacctgtagtcagacgggagagcaccggcgcgacaagcgaagcgtggccctggcaccccatgtcggcttgggtctcgagactcgtaccgaaacatggatgtcctctgagggggcctggaaacagatccagagagtggaaacttgggctctgaggcaccctggattcaccgttattgcactgtttctcgcccatgctatcggcacatcgattacccaaaagggcatcatattcatcttactgatgcttgtgacgccatcaatggccatgcggtgcgtcgggattggaaaccgcgattttgtggagggtttgagcggcgcgacttgggtagacgttgtgctggagcacgggagttgtgtcacaaccatggcaaagaataaacccactctagatatcgaactcctgaagacagaggtgaccaaccctgccattcttagaaaactgtgcatcgaagctaagatatccaatacgaccacagactctaggtgtccaactcagggagaggccaccttggtggaagaacaggatgcaaacttcgtctgccggcgcacatttgttgaccgaggctggggtaatgggtgtggactcttcggcaaaggcagcctgttaacttgcgctaagtttaagtgcgtgaccaaactggaggggaagattgtacagtacgaaaacctcaaatattccgtgatcgtcacagtgcacaccggagatcaacatcaggttggtaatgagactacggaacacggcacaattgccaccatcactccccaggcgcctacctcagagatccagcttacagactacggggccctgaccttggactgtagtccaagaactggactagatttcaacgaaatggtgctgctcacaatgaaggagaaaagctggctggtccataagcaatggtttcttgacctgccgttgccctggacgtctggcgcatccacctcacaggagacttggaataggcaggatctcctggtgacattcaaaaccgctcacgccaagaagcaagaagtagttgtgttaggtagccaggagggggctatgcacacagccctgactggcgcaaccgaaattcagacgagtggaaccacaactatatttgccggccatctaaaatgccggctcaagatggacaaactgacccttaaggggacatcttatgtcatgtgtactggatccttcaaattggagaaggaagtggctgagacccagcacggtacggtcctggtgcaagttaagtacgagggcacagatgcgccttgcaaaatcccattcagcacccaggacgaaaagggggtgactcagaacggacgtctcattacagcaaatcccatcgtaaccgataaagagaagcctgtcaacatagaaactgagccaccctttggcgagtcgtatattgtggttggtgccggggaaaaagctctgaaactttcttggttcaagaaaggctcctcaatcggaaagatgtttgaggccaccgcacgcggcgccagaaggatggctatcctgggggacacagcctgggatttcggaagtattggtggcgtgtttacgagcgtcgggaaattggtgcatcaggtattcggaaccgcatacggcgtgctcttttccggtgtttcttggactatgaagatcgggattggcatactgttaacatggctgggactaaatagccggtcaaccagtctctccatgacatgtatcgcggtcggcatggtgactctgtaccttggggtgatggtccaagctgacagcggatgcgttattaactggaaaggccgagaattgaagtgtggttctgggatcttcgtgaccaacgaggtgcacacgtggacagaacagtataagtttcaggccgattcaccgaaacgcctgagtgcagccatcggaaaggcttgggaggagggcgtatgcggtattagaagcgccaccaggctcgaaaatataatgtggaaacagatctccaacgagctgaatcatattttactggaaaacgacatgaagttcactgtcgtggttggcgacgcaaatgggatccttgctcaaggcaagaagatgattcggcctcagcccatggagcacaaatactcttggaagtcgtggggcaaggccaaaatcataggggcggatatccagaacaccacatttattatcgacggaccagatactcctgaatgtcccgacaatcagcgcgcctggaacatttgggaggtggaggattatggcttcggtatctttaccacaaatatatggttgaagctcagagacagctacacgcaaatgtgcgatcacaggctgatgtccgctgcaattaaagactcaaaggccgtccatgctgatatggggtattggatcgaaagtgagaaaaacgaaacctggaagctagcccgtgcatctttcattgaggtgaagacttgtacatggccaaaaagccacaccctgtggtccaatggagttctcgaatcagagatgatcatacccaagatctacggcggtcctattagccagcataactatcggccaggctactacactcagacagcggggccgtggcacctgggaaaacttgagttggacttcgatctgtgcgaaggcaccacggtggtagtcgacgagcactgcgggaatcgaggaccctctttaagaactaccacagtgaccggcaagatcattcatgaatggtgttgcaggtcctgtactctccctccactgcgctttcggggtgaggatgggtgctggtatggaatggagatcagacccgtgaaagaaaaggaggaaaaccttgtcaggagtatggttagcgccggctctggtgaggtggactccttctcactgggcatattgtgtgctagtattatgatcgaagaggtaatgcgcagccgatggtcgcggaagatgctcatgacagggaccctggccgtgtttctactgctcatcatgggacaactgacatggaatgaccttattcgtttgtgcatcatggtcggcgcaaacgcttccgatagaatggggatgggaactacctacctggccttaatggcaacgttcaaaatgaggcctatgtttgccgtgggcctcctgttccgccggcttacatctagagaggttctgctactcaccattggtctgagcttggtggcttcagtcgaactgccaaacagtttagaggaactcggggacggactggcgatgggcataatgatgcttaagctgttgactgagtttcagccccaccagctctggaccacactgctatccctgactttcatcaaaaccacgctttctctcgattatgcctggaagacaaccgcaatggctctgagcattgtgtccttgtttccgctgtgtttatcaactacaagccagaaaaccacttggctccctgttctgcttggcagtttcgggtgcaagccactgacaatgtttttgatcaccgaaaataagatttggggaaggaaatcttggcccctcaacgagggtatcatggccataggcatcgtgtccattctgctaagctcgctgcttaagaatgacgtccctctcgccgggcccctgatcgctggaggcatgttgattgcatgttacgtaatctcaggttctagtgccgatttatccctggagaaagcggctgaagtgagctgggagcaagaagccgagcattctgggacgagccacaacatactcgttgaagtgcaggacgatggaactatgaagattaaagacgaggagcgagatgacaccctgacaatccttctgaaggcaaccttgctagccgtctccggcgtgtatccaatgtcaatccctgctacactgttcgtatggtacttttggcagaaaaagaagcagcgcagtggcgtgctctgggatactcccagcccaccggaagtcgagcgggcagttctggacgatgggatttatagaatacttcaaaggggattactgggtcgttctcaggtgggcgtgggggtcttccaggacggagtgttccataccatgtggcacgttacgcgcggcgccgtactcatgtaccagggtaaacggttggaaccttcctgggcgtcagtgaagaaagacctgatcagttacgggggaggctggagatttcaaggcagctggaatacaggggaggaggtccaggtgattgctgttgaacccggaaagaaccccaagaatgtgcagactacccccggtacattcaagacccctgagggcgaagtcggggccatcgcactcgattttaagccaggaacttccggctctcccattgtgaacagggagggtaaaatcgtagggctgtatggaaatggcgtcgtgaccacatcgggcacgtacgttagcgccatagctcaagccaaggcatcacaggaagggcctcttccggagatcgaggacgaagtgttcaaaaagcgaaacctgactattatggatttgcacccaggatccggtaaaacccggcgctatctacccgctatcgtcagagaggccattaagaggaagctgcggacactcatcttagcgcctacccgagtggttgccagtgaaatggcagaggctctgaaaggcatgccaataagataccagactacagccgtgaagtctgaacataccgggcgcgagattgtcgaccttatgtgccacgctacgtttactatgaggctgctcagccccgtgcgtgtacctaattataacatgatcatcatggatgaggcacatttcacagacccggcctccattgccgctcggggatacatctcaaccagagtgggcatgggtgaagcggcagccatatttatgaccgctactcccccagggtctgttgaggccttccctcagagcaatgcagtcattcaagatgaagagagggacatccccgaacgcagttggaactccggatatgattggattacagactttccaggcaaaaccgtgtggttcgtgcctagcatcaagtctggcaatgatatagccaactgtttgcggaaaaacgggaagagagtcattcagctgtcaagaaagacatttgacactgagtaccagaaaacgaagaataacgactgggattacgtagtgaccacagacatctccgagatgggagctaatttcagggcggatcgcgttatcgacccccgtagatgcctcaaaccagtgattctgaaggatggtccggaacgggtcatccttgccggccctatgcccgtgactgttgcaagtgctgcccagaggcgcgggcgaattggaagaaaccaaaataaagagggcgaccagtatgtgtacatgggtcagccactaaacaatgatgaagaccacgcacattggaccgaggccaagatgctgttggataacataaatacacccgaggggatcattcctgctttattcgaaccagagcgggaaaagagcgccgcgatcgacggcgagtataggctgcgcggagaagcaagaaaaacctttgtcgagctcatgaggcggggcgatctgcccgtgtggctttcgtacaaggtagcctctgaggggttccagtattccgaccgtcgctggtgctttgatggagaacgaaacaatcaagtgctggaggaaaacatggacgttgagatctggactaaagaaggtgagagaaagaaactcaggcctcggtggttggacgctcgcacgtacagcgatccgctggccctaagagagttcaaggaatttgctgcaggcaggcggtcagtcagtggggacctgattctcgagataggaaaacttccacagcacctgaccttacgagcccagaatgctttggataacctggtgatgctccacaattctgaacagggcggtaaggcctatagacatgcaatggaggaactgcccgacacaatcgagactcttatgctgctcgcgttgattgccgtgctgaccgggggcgtcacattattctttctatccggaaagggcctggggaaaaccagcatcggactcctttgtgttactgcttcaagtgccctgttgtggatggcaagcgtggagcctcactggattgctgcctccatcatactggagttctttctcatggtactgcttatccccgagccagatcgccaaaggacacctcaggacaaccagctcgcatacgtggtcattggtctgttgttcatgatcctgacggtggccgctaacgaaatgggcttactagagaccactaagaaagatctggggattggacatgttgcggccgagaatcaccaacacgcaacaatgctcgacgtggatcttcggcccgcttctgcctggaccctgtacgccgtcgcaaccacagtaatcactccaatgatgcgtcatacgatagaaaacaccacagctaatattagcttgactgccatcgcgaaccaggctgccattctgatgggcctcgacaagggttggcctatctccaaaatggatataggggtgccgctgcttgcattaggctgctattcacaggttaatcccctgaccctcacagccgctgtgttgatgctggtcgcacactacgccatcattggaccaggcctacaggcgaaggctaccagagaggcccaaaagaggactgcagccgggatcatgaaaaaccctacggtggacggaattgtcgctatcgatctggaccccgtggtttatgacgccaagtttgaaaaacagctcggccagataatgcttctgattttgtgtacatctcagatcctgctcatgcgcaccacttgggcactgtgcgagagtatcaccttagctacaggtccacttactaccctgtgggaagggtcgcctggaaagttctggaatacaacgattgccgtgagcatggcgaacatctttcggggctcctacctcgccggtgcaggcctagctttctctctgatgaaatcactagggggaggccgaagagggaccggagcccaaggcgagactctgggtgagaagtggaagaggcagctcaatcagcttagcaaatccgagttcaacacatataagcgcagtgggataatggaggtagatcggtctgaagcaaaagagggactgaagagaggcgaaaccactaaacatgctgtgagccgtggtacagccaagttgaggtggtttgtcgagcggaatctggttaagcccgagggcaaagtgattgacctcgggtgtggacgcggcgggtggtcatactattgcgccggattaaagaaagtcaccgaagtgaagggctacacgaaaggtgggccgggacacgaggaaccaatccctatggcgacctacggctggaacctggtaaaacttcattccggcaaagatgtgttctttatgcccccagagaagtgtgacacactgctatgcgatattggggaaagtagccccaatcctactatcgaggagggacgaaccctcagagttctgaagatggtggaaccgtggttgaggggtaaccagttctgtataaaaatcctgaatccctatatgccatctgtcgtggagacactcgaacaaatgcagcggaagcacggcgggatgcttgtccgcaaccctctgtccagaaattcaactcacgagatgtactgggtgagctgcggaaccggcaacattgtttcggctgtaaacatgacatctaggatgttactgaatcgatttaccatggcacatcggaaacccacttatgagcgtgacgtggatttgggtgccgggacgagacacgtcgctgtggaacctgaggttgccaacctcgacatcattggacagcgcatcgaaaatattaagaacgagcataaaagtacatggcactacgatgaagacaatccatataagacctgggcataccacggctcctatgaggtgaagcccagcggctcagcctcctctatggtcaacggggtggtaaggctgctaactaaaccttgggatgtgatcccaatggttacccaaatagctatgacagacacgacccccttcggacagcagcgggtctttaaggagaaagtggacactagaacaccgcgcgcgaagaggggtaccactcagattatggaagtgacagccaaatggctttggggcttcctgagccgaaataagaagcctcggatctgtaccagagaggaatttacaaggaaagtccgcagtaacgcagctatcggggccgttttcgtggatgagaatcaatggaactccgcaaaggaagccgtagaggacgagcgtttttgggatctcgtgcatcgggaaagagagctgcacaaacagggaaagtgcgctacttgcgtctacaatatgatgggcaaaagggaaaagaagttgggtgagttcgggaaagccaagggaagccgcgcgatttggtacatgtggctgggcgcacgatttctcgagttcgaggcccttggcttcatgaacgaggaccattggttttctcgggaaaattcattcagtggggtggagggagaaggtctgcacaaattaggctatatactgagagatatctccaagattccagggggaaacatgtacgctgacgataccgccggctgggacacgaggatcaccgaggatgacttgcagaatgaggcaaaaattacagatatcatggaacccgagcatgctctcctggccactagcatatttaagctaacctatcagaacaaagttgtgcgcgtccaaagacctgctaagaacggtacagtgatggacgtaatctctcggagggatcagcgtgggtcgggacaggttggcacttacggccttaataccttcacgaacatggaagtgcagctgattcgacaaatggagtcagaagggatctttctcccaagcgagctggagacacccaatttggccgaacgcgtcttagactggctggagaagcacggagcagaaagactcaaacggatggcgatttccggtgacgattgtgtggtgaagccgatcgacgataggttcgccaccgctcttactgccctgaacgacatgggcaaagtccgcaaggatatacctcagtgggagcccagtaaagggtggaatgactggcagcaggttccattttgctctcaccatttccaccaactaattatgaaggatggaagagaaatcgtggtaccttgtcggaaccaggacgagctggtgggcagggcacgagtcagccagggtgctgggtggtccctccgtgagacagcctgcttgggaaagtcatatgcacaaatgtggcagctgatgtactttcatagacgcgatcttcggctggccgcgaatgctatctgtagtgccgtgcccgttgactgggtgccaacctctaggactacctggagcattcacgcacaccatcagtggatgacaacggaagatatgctctccgtctggaacagagtgtggatagaggaaaatccctggatggaggacaaaacccacgtatcaagctgggaagaggttccttatttaggcaagcgcgaggaccagtggtgcggctctctgatcgggttgactgcccgggctacatgggccaccaacattcaagtggcaatcaatcaggtcaggcgactgattggaaacgaaaattacctcgattacatgacttccatgaaaagattcaagaacgagagtgacccagaaggtgctctttggtga

SEQ ID NO: 13412 - RNA, 9879 nt, synthetic construct
  misc_feature 1..9879: note = derived and/or modified CDS sequence (opt3) from DENV-1__EU596504__SS-prME
  source 1..9879: mol_type = other RNA
agcgtgaccatgctgctcatgcttctgccaacagcattggctttccacttaactacgagaggaggggaacctcatatgatagtctccaagcaggaaaggggaaaatctctgttgtttaagacctcagccggtgttaacatgtgcacactcattgccatggacctgggcgagctttgtgaagatactatgacctacaaatgcccacaaataacagaggcggaaccggacgatgtggactgttggtgcaatgctaccgatacttgggtaacatatgggacctgtagtcagacgggagagcaccggcgcgacaagcgaagcgtggccctggcaccccatgtcggcttgggtctcgagactcgtaccgaaacatggatgtcctctgagggggcctggaaacagatccagagagtggaaacttgggctctgaggcaccctggattcaccgttattgcactgtttctcgcccatgctatcggcacatcgattacccaaaagggcatcatattcatcttactgatgcttgtgacgccatcaatggccatgcggtgcgtcgggattggaaaccgcgattttgtggagggtttgagcggcgcgacttgggtagacgttgtgctggagcacgggagttgtgtcacaaccatggcaaagaataaacccactctagatatcgaactcctgaagacagaggtgaccaaccctgccattcttagaaaactgtgcatcgaagctaagatatccaatacgaccacagactctaggtgtccaactcagggagaggccaccttggtggaagaacaggatgcaaacttcgtctgccggcgcacatttgttgaccgaggctggggtaatgggtgtggactcttcggcaaaggcagcctgttaacttgcgctaagtttaagtgcgtgaccaaactggaggggaagattgtacagtacgaaaacctcaaatattccgtgatcgtcacagtgcacaccggagatcaacatcaggttggtaatgagactacggaacacggcacaattgccaccatcactccccaggcgcctacctcagagatccagcttacagactacggggccctgaccttggactgtagtccaagaactggactagatttcaacgaaatggtgctgctcacaatgaaggagaaaagctggctggtccataagcaatggtttcttgacctgccgttgccctggacgtctggcgcatccacctcacaggagacttggaataggcaggatctcctggtgacattcaaaaccgctcacgccaagaagcaagaagtagttgtgttaggtagccaggagggggctatgcacacagccctgactggcgcaaccgaaattcagacgagtggaaccacaactatatttgccggccatctaaaatgccggctcaagatggacaaactgacccttaaggggacatcttatgtcatgtgtactggatccttcaaattggagaaggaagtggctgagacccagcacggtacggtcctggtgcaagttaagtacgagggcacagatgcgccttgcaaaatcccattcagcacccaggacgaaaagggggtgactcagaacggacgtctcattacagcaaatcccatcgtaaccgataaagagaagcctgtcaacatagaaactgagccaccctttggcgagtcgtatattgtggttggtgccggggaaaaagctctgaaactttcttggttcaagaaaggctcctcaatcggaaagatgtttgaggccaccgcacgcggcgccagaaggatggctatcctgggggacacagcctgggatttcggaagtattggtggcgtgtttacgagcgtcgggaaattggtgcatcaggtattcggaaccgcatacggcgtgctcttttccggtgtttcttggactatgaagatcgggattggcatactgttaacatggctgggactaaatagccggtcaaccagtctctccatgacatgtttcgcggtcggcatggtgactctgtaccttggggtgatggtccaagctgacagcggatgcgttatcaactggaaaggccgagaattgaagtgtggttctgggatttttgtgaccaacgaggtgcacacgtggacagaacagtataagttccaggccgattcaccgaaacgcctgagtgcagccatcggaaaggcttgggaggagggcgtatgcggtatcagaagcgccaccaggctcgaaaatattatgtggaaacagatatccaacgagctgaatcatatcttactggaaaacgacatgaagtttactgtcgtggttggcgacgcaaatgggattcttgctcaaggcaagaagatgatccggcctcagcccatggagcacaaatactcttggaagtcgtggggcaaggccaaaattatcggggcggatatacagaacaccacattcatcattgacggaccagatactcctgaatgtcccgacaatcagcgcgcctggaacatctgggaggtggaggattatggctttggtattttcaccacaaatatctggttgaagctcagagacagctacacgcaaatgtgcgatcacaggctgatgtccgctgcaataaaagactcaaaggccgtccatgctgatatggggtattggattgaaagtgagaaaaacgaaacctggaagctagcccgtgcatctttcatcgaggtgaagacttgtacatggccaaaaagccacaccctgtggtccaatggagttctcgaatcagagatgattatccccaagatatacggcggtcctatcagccagcataactatcggccaggctactttactcagacagcggggccgtggcacctgggaaaacttgagttggacttcgatctgtgcgaaggcaccacggtggtagtcgacgagcactgcgggaatcgaggaccctctttaagaactaccacagtgaccggcaagattatccatgaatggtgttgcaggtcctgtactctccctccactgcgctttcggggtgaggatgggtgctggtacggaatggagattagacccgtgaaagaaaaggaggaaaaccttgtcaggagtatggttagcgccggctctggtgaggtggactccttctcactgggcatcttgtgtgctagtataatgattgaagaggtaatgcgcagccgatggtcgcggaagatgctcatgacagggaccctggccgtgtttctactgctcatcatgggacaactgacatggaatgaccttatccgtttgtgcattatggtcggcgcaaacgcttccgatagaatggggatgggaactacctatctggccttaatggcaacgttcaaaatgaggcctatgtttgccgtgggcctcctgttccgccggcttacatctagagaggttctgctactcaccatcggtctgagcttggtggcttcagtcgaactgccaaacagtttagaggaactcggggacggactggcgatgggcattatgatgcttaagctgttgactgagtttcagccccaccagctctggaccacactgctatccctgactttcataaaaaccacgctttctctcgattacgcctggaagacaaccgcaatggctctgagcatcgtgtccttgtttccgctgtgtttatcaactacaagccagaaaaccacttggctccctgttctgcttggcagtttcgggtgcaagccactgacaatgtttttgattaccgaaaataagatctggggaaggaaatcttggcccctcaacgagggtattatggccatcggcatagtgtccatcctgctaagctcgctgcttaagaatgacgtccctctcgccgggcccctgattgctggaggcatgttgatcgcatgttatgtaatttcaggttctagtgccgatttatccctggagaaagcggctgaagtgagctgggagcaagaagccgagcattctgggacgagccacaacatcctcgttgaagtgcaggacgatggaactatgaagataaaagacgaggagcgagatgacaccctgacaattcttctgaaggcaaccttgctagccgtctccggcgtgtacccaatgtcaatccctgctacactgttcgtatggtatttctggcagaaaaagaagcagcgcagtggcgtgctctgggatactcccagcccaccggaagtcgagcgggcagttctggacgatgggatctacaggattcttcaacgaggattactgggtcgttctcaggtgggcgtgggggtctttcaggacggagtgttccataccatgtggcacgttacgcgcggcgccgtactcatgtatcagggtaaacggttggaaccttcctgggcgtcagtgaagaaagacctgataagttacgggggaggctggagatttcaaggcagctggaatacaggggaggaggtccaggtgatcgctgttgaacccggaaagaaccccaagaatgtgcagactacccccggtacattcaagacccctgagggcgaagtcggggccattgcactcgattttaagccaggaacttccggctctcccatcgtgaacagggagggtaaaattgtagggctgtacggaaatggcgtcgtgaccacatcgggcacgtatgttagcgccatcgctcaagccaaggcatcacaggaagggcctcttccggagatagaggacgaagtgttcaaaaagcgaaacctgactatcatggatttgcacccaggatccggtaaaacccggcgctacctacccgctattgtcagagaggccatcaagaggaagctgcggacactcattttagcgcctacccgagtggttgccagtgaaatggcagaggctctgaaaggcatgccaatcagatatcagactacagccgtgaagtctgaacataccgggcgcgagatagtcgaccttatgtgccacgctacgtttactatgaggctgctcagccccgtgcgtgtacctaattacaacatgattatcatggatgaggcacatttcacagacccggcctccatcgccgctcggggatatatttcaaccagagtgggcatgggtgaagcggcagccatctttatgaccgctactcccccagggtctgttgaggccttccctcagagcaatgcagtcatacaagatgaagagagggacattcccgaacgcagttggaactccggatacgattggatcacagactttccaggcaaaaccgtgtggttcgtgcctagcattaagtctggcaatgatatcgccaactgtttgagaaagaacgggaagagagtcatacagctgtcacggaagacattcgacactgagtatcagaaaacgaagaataacgactgggattacgtagtgaccacagacatttccgagatgggagctaattttagggcggatcgcgttatcgacccccgtagatgcctcaaaccagtgatcctgaaggatggtccggaacgggtcattcttgccggccctatgcccgtgactgttgcaagtgctgcccagaggcgcgggcgaatcggaagaaaccaaaataaagagggcgaccagtacgtgtatatgggtcagccactaaacaatgatgaagaccacgcacattggaccgaggccaagatgctgttggataacattaatacacccgaggggataatccctgctttattcgaaccagagcgggaaaagagcgccgcgattgacggcgagtacaggctgcgcggagaagcaagaaaaacctttgtcgagctcatgaggcggggcgatctgcccgtgtggctttcgtataaggtagcctctgaggggttccagtactccgaccgtcgctggtgctttgatggagaacgaaacaatcaagtgctggaggaaaacatggacgttgagatctggactaaagaaggtgagagaaagaaactcaggcctcggtggttggacgctcgcacgtatagcgatccgctggccctaagagagttcaaggaatttgctgcaggcaggcggtcagtcagtggggacctgatcctcgagattggaaaacttccacagcacctgaccttacgagcccagaatgctttggataacctggtgatgctccacaattctgaacagggcggtaaggcctacagacatgcaatggaggaactgcccgacacaatagagactcttatgctgctcgcgttgatcgccgtgctgaccgggggcgtcacattattctttctatccggaaagggcctggggaaaaccagcattggactcctttgtgttactgcttcaagtgccctgttgtggatggcaagcgtggagcctcactggatcgctgcctccattatcctggagttctttctcatggtactgcttatacccgagccagatcgccaaaggacacctcaggacaaccagctcgcatatgtggtcatcggtctgttgttcatgattctgacggtggccgctaacgaaatgggcttactagagaccactaagaaagatctggggatcggacatgttgcggccgagaatcaccaacacgcaacaatgctcgacgtggatcttcggcccgcttctgcctggaccctgtacgccgtcgcaaccacagtaattactccaatgatgcgtcatacgatcgaaaacaccacagctaatatcagcttgactgccattgcgaaccaggctgccatcctgatgggcctcgacaagggttggcctatttccaaaatggatatcggggtgccgctgcttgcattaggctgctactcacaggttaatcccctgaccctcacagccgctgtgttgatgctggtcgcacactatgccataatcggaccaggcctacaggcgaaggctaccagagaggcccaaaagaggactgcagccgggattatgaaaaaccctacggtggacggaatcgtcgctattgatctggaccccgtggtttacgacgccaagtttgaaaaacagctcggccagatcatgcttctgatattgtgtacatctcagattctgctcatgcgcaccacttgggcactgtgcgagagtatcaccttagctacaggtccacttactaccctgtgggaagggtcgcctggaaagttctggaatacaacgatcgccgtgagcatggcgaacattttccggggctcctatctcgccggtgcaggcctagctttttctctgatgaaatcactagggggaggccgaagagggaccggagcccaaggcgagactctgggtgagaagtggaagaggcagctcaatcagcttagcaaatccgagttcaacacatacaagcgcagtgggatcatggaggtagatcggtctgaagcaaaagagggactgaagagaggcgaaaccactaaacatgctgtgagccgtggtacagccaagttgaggtggtttgtcgagcggaatctggttaagcccgagggcaaagtgatagacctcgggtgtggacgcggcgggtggtcatattactgcgccggattaaagaaagtcaccgaagtgaagggctatacgaaaggtgggccgggacacgaggaaccaattcctatggcgacctacggctggaacctggtaaaactttactccggcaaagatgtgttctttatgcccccagagaagtgtgacacactgctatgcgatatcggggaaagtagccccaatcctactattgaggagggacgaaccctcagaatcctgaagatggttgaaccgtggttgaggggtaaccagttctgtataaaaatcctgaatccctatatgccatctgtggtcgagacactcgaacaaatgcagcggaagcatggcgggatgcttgtgcgcaaccctctgtccagaaattcaactcacgagatgtactgggtcagctgcggaaccggcaacattgtgtcggctgttaacatgacatctaggatgttactgaatcgatttaccatggcacaccggaaacccacttatgagcgtgacgtagatttgggtgccgggacgagacatgtggctgtcgaacctgaggtggccaacctcgacatcattggacagcgcatcgaaaatattaagaacgagcacaaaagtacatggcattacgatgaagacaatccatataagacctgggcataccacggctcctatgaggttaagcccagcggctcagcctcctctatggtgaacggggtcgtgaggctgctaactaaaccttgggatgtaatcccaatggtgacccaaatagctatgacagacacgacccccttcggacagcagcgggtttttaaggagaaagtcgacactagaacaccgcgcgcgaagaggggtaccactcagattatggaagtgacagccaaatggctttggggcttcctgagccgaaataagaagcctcggatctgtaccagagaggaatttacaaggaaagtgcgcagtaacgcagctatcggggccgtcttcgttgatgagaatcaatggaactccgcaaaggaagccgtggaggacgagcgtttttgggatctcgtacaccgggaaagagagctgcataaacagggaaagtgcgctacttgcgtgtacaatatgatgggcaaaagggaaaagaagttgggtgagttcgggaaagccaagggaagccgcgcgatttggtacatgtggctgggcgcacgattcctcgaatttgaggcccttggcttcatgaacgaggaccactggttttctcgggaaaattcactgagtggggtcgagggagaaggtttacataaactgggctatatattgagagatatctccaagattccagggggaaacatgtacgctgacgataccgccggctgggacacgaggatcaccgaggatgacctccagaatgaggcaaaaattacagatatcatggaacccgagcacgctctgctagccactagcatattcaaacttacctatcagaacaaagtggttcgcgtgcaaagacctgctaagaacggtacagtcatggacgtgatctctcggagggatcagcgtgggtcgggacaggtaggcacttacggcctgaatacctttacgaacatggaagttcagctcattcgacaaatggagtcagaagggatcttcctgccaagcgagttggagacacccaatttagccgaacgcgtgctggactggctcgagaagcatggagcagaaagacttaaacggatggcgatttccggtgacgattgtgtcgtgaagccgatcgacgataggtttgccaccgctctgactgccctaaacgacatgggcaaagtgcgcaaggatatacctcagtgggagcccagtaaagggtggaatgactggcagcaggtcccattctgctctcaccactttcatcaactgattatgaaggatggaagagaaatcgttgtgccttgtcggaaccaggacgagctcgtaggcagggcacgagtgagccagggtgctgggtggtccttgcgtgagacagcctgcctgggaaagtcatatgcacaaatgtggcagcttatgtacttccacagacgcgatctgcggctcgccgcgaatgctatctgtagtgccgtccccgtggactgggttccaacctctaggactacctggagcattcatgcacaccaccagtggatgacaacggaagatatgttatccgtgtggaacagagtctggatagaggaaaatccctggatggaggacaaaacccatgtgtcaagctgggaagaggtaccttatctgggcaagcgcgaggaccagtggtgcggctctttgatcgggctgactgcccgggctacatgggccaccaacattcaagttgcaatcaatcaggtgaggcgactcattggaaacgaaaattaccttgattacatgacttccatgaaaagatttaagaacgagagtgacccagaaggtgctctgtggtga

SEQ ID NO: 13413 - RNA, 9879 nt, synthetic construct
  misc_feature 1..9879: note = derived and/or modified CDS sequence (opt3) from DENV-1__FJ024481__SS-prME
  source 1..9879: mol_type = other RNA
agcgtgaccatgctgctcatgcttctgcccacagccttggctttccacttaactacgagaggcggggagcctcatatgatcgtctccaagcaggaaaggggaaaatctctgctatttaagacctcagcaggtgttaacatgtgcacactcattgccatggacctgggcgagctttgtgaagatactatgacctacaaatgcccacaaataacagaggcggaaccggacgatgtggactgttggtgcaatgctaccgatacttgggtaacatatgggacctgtagtcagacgggagagcaccggcgcgacaagcgaagcgtggccctggcaccccatgtcggcttgggtctcgagactcgtaccgaaacatggatgtcctctgagggggcctggaaacagatccagagagtggaaacttgggctctgaggcaccctggattcaccgttattgcactgtttctcgcccatgctatcggcacatcgattacccaaaagggcatcatattcatcttactgatgcttgtgacgccatcaatggccatgcggtgcgtcgggattggaaaccgcgattttgtggagggtttgagcggcgcgacttgggtagacgttgtgctggagcacgggagttgtgtcacaaccatggcaaagaataaacccactctagatatcgaactcctgaagacagaggtgaccaaccctgccattcttagaaaactgtgcatcgaagctaagatatccaatacgaccacagactctaggtgtccaactcagggagaggccaccttggtggaagagcaggatgcaaacttcgtctgccggcgcacatttgttgaccgaggctggggtaatgggtgtggactcttcggcaaaggcagcctgttaacttgcgctaagtttaagtgcgtgaccaaactggaggggaagattgtacagtacgaaaacctcaaatattccgtgatcgtcacagtgcacaccggagatcaacatcaggttggtaatgagactacggaacacggcacaattgccaccatcactccccaggcgcctacctcagagatccagcttacagactacggggccctgaccttggactgtagtccaagaactggactagatttcaacgaaatggtgctgctcacaatgaaggagaaaagctggctggtccataagcaatggtttcttgacctgccgttgccctggacgtctggcgcatccacctcacaggagacttggaataggcaggatctcctggtgacattcaaaaccgctcacgccaagaagcaagaagtagttgtgttaggtagccaggagggggctatgcacacagccctgactggcgcaaccgaaattcagacgagtggaaccacaactatatttgccggccatctaaaatgccggctcaagatggacaaactgacccttaaggggacatcttatgtcatgtgtactggatccttcaaattggagaaggaagtggctgagacccagcacggtacggtcctggtgcaagttaagtacgagggcacagatgcgccttgcaaaatcccattcagcacccaggacgaaaagggggtgactcagaacggacgtctcattacagcaaatcccatcgtaaccgataaagagaagcctgtcaacatagaaactgagccaccctttggcgagtcgtatattgtggttggtgccggggaaaaagctctgaagctttcttggttcaagaaaggctcctcaatcggaaagatgtttgaggccaccgcacgcggcgccagaaggatggctatcctgggggacacagcctgggatttcggaagtattggtggcgtgtttacgagcgtcgggaaattggtgcatcaggtattcggaaccgcatacggcgtgctcttttccggtgtttcttggactatgaagatcgggattggcatactgttaacatggctgggactaaatagccggtcaaccagtctctccatgacatgtatcgcggtcggcatggtgactctgtaccttggggtgatggtccaagctgacagcggatgcgttattaactggaaaggccgagaattgaagtgtggttctgggatcttcgtgaccaacgaggtgcacacgtggacagaacagtataagtttcaggccgattcaccgaaacgcctgagtgcagccatcggaaaggcttgggaggagggcgtatgcggtattagaagcgccaccaggctcgaaaatataatgtggaaacagatctccaacgagctgaatcatattttactggaaaacgacatgaagttcactgtcgtggttggcgacgcaaatgggatccttgctcaaggaaaaaagatgattcggcctcagcccatggagcacaaatactcttggaagtcgtggggcaaggccaaaatcataggggcggatatccagaacaccacatttattatcgacggaccagatactcctgaatgtcccgacaatcagcgcgcctggaacatttgggaggtggaggattatggcttcggtatctttaccacaaatatatggttgaagctcagagacagctacacgcaaatgtgcgatcacaggctgatgtccgctgcaattaaagactcaaaggccgtccatgctgatatggggtattggatcgaaagtgagaaaaacgaaacctggaagctagcccgtgcatctttcattgaggtgaagacttgtacatggccaaaaagccacaccctgtggtccaatggagttctcgaatcagagatgatcatacccaagatctacggcggtcctattagccagcataactatcggccaggctacttcactcagacagcggggccgtggcacctgggaaaacttgagttggactttgatctgtgcgaaggcaccacggtggtagtcgacgagcactgcgggaatcgaggaccctctttaagaactaccacagtgaccggcaagatcattcatgaatggtgttgcaggtcctgtactctccctccactgcgcttccggggtgaggatgggtgctggtacggaatggagatcagacccgtgaaagaaaaggaggaaaaccttgtcaggagtatggttagcgccggctctggtgaggtggactccttttcactgggcatattgtgtgctagtattatgatcgaagaggtaatgcgcagccgatggtcgcggaagatgctcatgacagggaccctggccgtgttcctactgctcatcatgggacaactgacatggaatgaccttattcgtttgtgcatcatggtcggcgcaaacgcttccgatagaatggggatgggaactacctatctggccttaatggcaacgtttaaaatgaggcctatgttcgccgtgggcctcctgtttcgccggcttacatctagagaggttctgctactcaccattggtctgagcttggtggcttcagtcgaactgccaaacagtttagaggaactcggggacggactggcgatgggcataatgatgcttaagctgttgactgagttccagccccaccagctctggaccacactgctatccctgacttttatcaaaaccacgctttctctcgattacgcctggaagacaaccgcaatggctctgagcattgtgtccttgttcccgctgtgtttatcaactacaagccagaaaaccacttggctccctgttctgcttggcagttttgggtgcaagccactgacaatgttcttgatcaccgaaaataagatttggggaaggaaatcttggcccctcaacgagggtatcatggccataggcatcgtgtccattctgctaagctcgctgcttaagaatgacgtccctctcgccgggcccctgatcgctggaggcatgttgattgcatgttatgtaatctcaggttctagtgccgatttatccctggagaaagcggctgaagtgagctgggagcaagaagccgagcattctgggacgagccacaacatactcgttgaagtgcaggacgatggaactatgaagattaaagacgaggagcgagatgacaccctgacaatccttctgaaggcaaccttgctagccgtctccggcgtgtacccaatgtcaatccctgctacactgtttgtatggtatttctggcagaaaaagaagcagcgcagtggcgtgctctgggatactcccagcccaccggaagtcgagcgggcagttctggacgatgggatttacagaatacttcaaaggggattactgggtcgttctcaggtgggcgtgggggtcttccaggacggagtgtttcataccatgtggcacgttacgcgcggcgccgtactcatgtatcagggtaaacggttggaaccttcctgggcgtcagtgaagaaagacctgatcagttacgggggaggctggagattccaaggcagctggaatacaggggaggaggtccaggtgattgctgttgaacccggaaagaacccaaaaaatgtgcagactacccccggtacatttaagacccctgagggcgaagtcggggccatcgcactcgatttcaagccaggaacttccggctctcccattgtgaacagggagggtaaaatcgtagggctgtacggaaatggcgtcgtgaccacatcgggcacgtatgttagcgccatagctcaagccaaggcatcacaggaagggcctcttccggagatcgaggacgaagtgtttaaaaagcgaaacctgactattatggatttgcacccaggatccggtaaaacccggcgctacctacccgctatcgtcagagaggccattaagaggaagctgcggacactcatcttagcgcctacccgagtggttgccagtgaaatggcagaggctctgaaaggcatgccaataagatatcagactacagccgtgaagtctgaacataccgggcgcgagattgtcgaccttatgtgccacgctacgttcactatgaggctgctcagccccgtgcgtgtacctaattacaacatgatcatcatggatgaggcacattttacagacccggcctccattgccgctcggggatatatctcaaccagagtgggcatgggtgaagcggcagccatattcatgaccgctactcccccagggtctgttgaggcctttcctcagagcaatgcagtcattcaagatgaagagagggacatccccgaacgcagttggaactccggatacgattggattacagacttcccaggcaaaaccgtgtggtttgtgcctagcatcaagtctggcaatgatatagccaactgtttgcgaaaaaacgggaagagagtcattcagctgtcacggaagacattcgacactgagtatcagaaaacgaagaataacgactgggattacgtagtgaccacagacatctccgagatgggagctaatttcagggcggatcgcgttatcgacccccgtagatgcctcaaaccagtgattctgaaggatggtccggaacgggtcatccttgccggccctatgcccgtgactgttgcaagtgctgcccagaggcgcgggcgaattggaagaaaccaaaataaagagggcgaccagtacgtgtatatgggtcagccactaaacaatgatgaagaccacgcacattggaccgaggccaagatgctgttggataacataaatacacccgaggggatcattcctgctttatttgaaccagagcgggaaaagagcgccgcgatcgacggcgagtacaggctgcgcggagaagcaagaaaaaccttcgtcgagctcatgaggcggggcgatctgcccgtgtggctttcgtataaggtagcctctgaggggtttcagtactccgaccgtcgctggtgcttcgatggagaacgaaacaatcaagtgctggaggaaaacatggacgttgagatctggactaaagaaggtgagagaaagaaactcaggcctcggtggttggacgctcgcacgtatagcgatccgctggccctaagagagtttaaggaattcgctgcaggcaggcggtcagtcagtggggacctgattctcgagataggaaaacttccacagcacctgaccttacgagcccagaatgctttggataacctggtgatgctccacaattctgaacagggcggtaaggcctacagacatgcaatggaggaactgcccgacacaatcgagactcttatgctgctcgcgttgattgccgtgctgaccgggggcgtcacattatttttcctatccggaaagggcctggggaaaaccagcatcggactcctttgtgttactgcttcaagtgccctgttgtggatggcaagcgtggagcctcactggattgctgcctccatcatactggaatttttcctcatggtactgcttatccccgagccagatcgccaaaggacacctcaggacaaccagctcgcatatgtggtcattggtctgttgtttatgatcctgacggtggccgctaacgaaatgggcttactagagaccactaagaaagatctggggattggacatgttgcggccgagaatcaccaacacgcaacaatgctcgacgtggatcttcggcccgcttctgcctggaccctgtacgccgtcgcaaccacagtaatcactccaatgatgcgtcatacgatagaaaacaccacagctaatattagcttgactgccatcgcgaaccaggctgccattctgatgggcctcgacaagggttggcctatctccaaaatggatataggggtgccgctgcttgcattaggctgctactcacaggttaatcccctgaccctcacagccgctgtgttgatgctggtcgcacactatgccatcattggaccaggcctacaggcgaaggctaccagagaggcccaaaagaggactgcagccgggatcatgaaaaaccctacggtggacggaattgtcgctatcgatctggaccccgtggtttacgacgccaagttcgaaaaacagctcggccagataatgcttctgattttgtgtacatctcagatcctgctcatgcgcaccacttgggcactgtgcgagagtatcaccttagctacaggtccacttactaccctgtgggaagggtcgcctggaaagttttggaatacaacgattgccgtgagcatggcgaacatcttccggggctcctatctcgccggtgcaggcctagctttctctctgatgaaatcattggggggaggccgaagagggaccggagcccaaggcgagactctgggtgagaagtggaagaggcagctcaatcagcttagcaaatccgaatttaacacatacaagcgcagtgggataatggaggtagatcggtctgaagcaaaagagggactgaagagaggcgaaaccactaaacatgctgtgagccgtggtacagccaagttgaggtggttcgtcgagcggaatctggttaagcccgagggcaaagtgattgacctcgggtgtggacgcggcgggtggtcatattactgcgccggattaaagaaagtcaccgaagtgaagggctatacgaaaggtgggccgggacacgaggaaccaatccctatggcgacctacggctggaacctggtaaagctttactccggcaaagatgtgtttttcatgcccccagagaagtgtgacacactgctatgcgatattggggaaagtagccccaatcctactatcgaggagggacgaaccctcagaatactgaagatggttgaaccgtggttgaggggtaaccagttttgtatcaaaattctgaatccctatatgccatctgtggtcgagacactcgaacaaatgcagcggaagcatggcgggatgcttgtgcgcaaccctctgtccagaaattcaactcacgagatgtactgggtcagctgcggaaccggcaacatcgtgtcggctgttaacatgacatctaggatgttactgaatcgattcaccatggcacaccggaaacccacttatgagcgtgacgtagatttgggtgccgggacgagacatgtggctgtcgaacctgaggtggccaacctcgacattatcggacagcgcattgaaaatatcaagaacgagcacaaaagtacatggcattacgatgaagacaatccatataagacctgggcataccacggctcctatgaggttaagcccagcggctcagcctcctctatggtgaacggggtcgtgaggctgctaactaaaccttgggatgtaataccaatggtgacccaaattgctatgacagacacgaccccctttggacagcagcgggttttcaaggagaaagtcgacactagaacaccgcgcgcgaagaggggtaccactcagatcatggaagtgacagccaaatggctttggggctttctgagccgaaataagaagcctcggatctgtaccagagaggaattcacaaggaaagtgcgcagtaacgcagctattggggccgtctttgttgatgagaatcaatggaactccgcaaaggaagccgtggaggacgagcgtttctgggatctcgtacaccgggaaagagagctgcataaacagggaaagtgcgctacttgcgtgtacaatatgatgggcaaaagggaaaagaagttgggtgagtttgggaaagccaagggaagccgcgcgatatggtacatgtggctgggcgcacgattcctcgaattcgaggcccttggctttatgaacgaggaccactggttctctcgggaaaattcactgagtggggtcgagggagaaggtttacataaactgggctatatcttgagagatatttccaagatcccagggggaaacatgtacgctgacgataccgccggctgggacacgaggattaccgaggatgacctccagaatgaggcaaaaatcacagatataatggaacccgagcacgctctgctagccactagcatctttaagcttacctatcagaacaaagtggttcgcgtgcaaagacctgctaagaacggtacagtcatggacgtgatttctcggagggatcagcgtgggtcgggacaggtaggcacttacggcctgaataccttcacgaacatggaagttcagctcatccgacaaatggagtcagaagggatttttctgccaagcgagttggagacacccaatttagccgaacgcgtgctggactggctcgagaagcatggagcagaaagacttaaacggatggcgatctccggtgacgattgtgtcgtgaagccgatagacgataggttcgccaccgctctgactgccctaaacgacatgggcaaagtgcgcaaggatattcctcagtgggagcccagtaaagggtggaatgactggcagcaggtcccattttgctctcaccacttccatcaactgatcatgaaggatggaagagaaatcgttgtgccttgtcggaaccaggacgagctcgtaggcagggcacgagtgagccagggtgctgggtggtccttgcgtgagacagcctgcctgggaaagtcatatgcacaaatgtggcagcttatgtactttcacagacgcgatctgcggctcgccgcgaatgctatttgtagtgccgtccccgtggactgggttccaacctctaggactacctggagcatacatgcacaccaccagtggatgacaacggaagatatgttatccgtgtggaacagagtctggatcgaggaaaatccctggatggaggacaaaacccatgtgtcaagctgggaagaggtaccttatctgggcaagcgcgaggaccagtggtgcggctctttgattgggctgactgcccgggctacatgggccaccaacatccaagttgcaattaatcaggtgaggcgactcatcggaaacgaaaattaccttgattacatgacttccatgaaaagattcaagaacgagagtgacccagaaggtgctctgtggtga

SEQ ID NO: 13414 - RNA, 9879 nt, synthetic construct
  misc_feature 1..9879: note = derived and/or modified CDS sequence (opt3) from DENV-1__GQ199872__SS-prME
  source 1..9879: mol_type = other RNA
agcgtgaccatgctgctcatgcttctgcccacagccttggctttccacttaactacgagaggcggggagcctcatatgatcgtctccaagcaggaaaggggaaaatctctgctatttaagacctcagcaggtgttaacatgtgcacactcattgccatggacctgggcgagctttgtgaagatactatgacctacaaatgcccacaaataacagaggcggaaccggacgatgtggactgttggtgcaatgctaccgatacttgggtaacatatgggacctgtagtcagacgggagagcaccggcgcgacaagcgaagcgtggccctggcaccccatgtcggcttgggtctcgagactcgtaccgaaacatggatgtcctctgagggggcctggaaacagatccagagagtggaaacttgggctctgaggcaccctggattcaccgttattgcactgtttctcgcccatgctatcggcacatcgattacccaaaagggcatcatattcatcttactgatgcttgtgacgccatcaatggccatgcggtgcgtcgggattggaaaccgcgattttgtggagggtttgagcggcgcgacttgggtagacgttgtgctggagcacgggagttgtgtcacaaccatggcaaagaataaacccactctagatatcgaactcctgaagacagaggtgaccaaccctgccattcttagaaaactgtgcatcgaagctaagatatccaatacgaccacagactctaggtgtccaactcagggagaggccaccttggtggaagagcaggatgcaaacttcgtctgccggcgcacatttgttgaccgaggctggggtaatgggtgtggactcttcggcaaaggcagcctgttaacttgcgctaagtttaagtgcgtgaccaaactggaggggaagattgtacagtacgaaaacctcaaatattccgtgatcgtcacagtgcacaccggagatcaacatcaggttggtaatgagactacggaacacggcacaattgccaccatcactccccaggcgcctacctcagagatccagcttacagactacggggccctgaccttggactgtagtccaagaactggactagatttcaacgaaatggtgctgctcacaatgaaggagaaaagctggctggtccataagcaatggtttcttgacctgccgttgccctggacgtctggcgcatccacctcacaggagacttggaataggcaggatctcctggtgacattcaaaaccgctcacgccaagaagcaagaagtagttgtgttaggtagccaggagggggctatgcacacagccctgactggcgcaaccgaaattcagacgagtggaaccacaactatatttgccggccatctaaaatgccggctcaagatggacaaactgacccttaaggggacatcttatgtcatgtgtactggatccttcaaattggagaaggaagtggctgagacccagcacggtacggtcctggtgcaagttaagtacgagggcacagatgcgccttgcaaaatcccattcagcacccaggacgaaaagggggtgactcagaacggacgtctcattacagcaaatcccatcgtaaccgataaagagaagcctgtcaacatagaaactgagccaccctttggcgagtcgtatattgtggttggtgccggggaaaaagctctgaagctttcttggttcaagaaaggctcctcaatcggaaagatgtttgaggccaccgcacgcggcgccagaaggatggctatcctgggggacacagcctgggatttcggaagtattggtggcgtgtttacgagcgtcgggaaattggtgcatcaggtattcggaaccgcatacggcgtgctcttttccggtgtttcttggactatgaagatcgggattggcatactgttaacatggctgggactaaatagccggtcaaccagtctctccatgacatgtatcgcggtcggcatggtgactctgtaccttggggtgatggtccaagctgacagcggatgcgttattaactggaaaggccgagaattgaagtgtggttctgggatcttcgtgaccaacgaggtgcacacgtggacagaacagtataagtttcaggccgattcaccgaaacgcctgagtgcagccatcggaaaggcttgggaggagggcgtatgcggtattagaagcgccaccaggctcgaaaatataatgtggaaacagatctccaacgagctgaatcatattttactggaaaacgacatgaagttcactgtcgtggttggcgacgcaaatgggatccttgctcaaggaaaaaagatgattcggcctcagcccatggagcacaaatactcttggaagtcgtggggcaaggccaaaatcataggggcggatatccagaacaccacatttattatcgacggaccagatactcctgaatgtcccgacaatcagcgcgcctggaacatttgggaggtggaggattatggcttcggtatctttaccacaaatatatggttgaagctcagagacagctacacgcaaatgtgcgatcacaggctgatgtccgctgcaattaaagactcaaaggccgtccatgctgatatggggtattggatcgaaagtgagaaaaacgaaacctggaagctagcccgtgcatctttcattgaggtgaagacttgtacatggccaaaaagccacaccctgtggtccaatggagttctcgaatcagagatgatcatacccaagatctacggcggtcctattagccagcataactatcggccaggctacttcactcagacagcggggccgtggcacctgggaaaacttgagttggactttgatctgtgcgaaggcaccacggtggtagtcgacgagcactgcgggaatcgaggaccctctttaagaactaccacagtgaccggcaagatcattcatgaatggtgttgcaggtcctgtactctccctccactgcgcttccggggtgaggatgggtgctggtacggaatggagatcagacccgtgaaagaaaaggaggaaaaccttgtcaggagtatggttagcgccggctctggtgaggtggactccttttcactgggcatattgtgtgctagtattatgatcgaagaggtaatgcgcagccgatggtcgcggaagatgctcatgacagggaccctggccgtgttcctactgctcatcatgggacaactgacatggaatgaccttattcgtttgtgcatcatggtcggcgcaaacgcttccgatagaatggggatgggaactacctatctggccttaatggcaacgtttaaaatgaggcctatgttcgccgtgggcctcctgtttcgccggcttacatctagagaggttctgctactcaccattggtctgagcttggtggcttcagtcgaactgccaaacagtttagaggaactcggggacggactggcgatgggcataatgatgcttaagctgttgactgagttccagccccaccagctctggaccacactgctatccctgacttttatcaaaaccacgctttctctcgattacgcctggaagacaaccgcaatggctctgagcattgtgtccttgttcccgctgtgtttatcaactacaagccagaaaaccacttggctccctgttctgcttggcagttttgggtgcaagccactgacaatgttcttgatcaccgaaaataagatttggggaaggaaatcttggcccctcaacgagggtatcatggccataggcatcgtgtccattctgctaagctcgctgcttaagaatgacgtccctctcgccgggcccctgatcgctggaggcatgttgattgcatgttatgtaatctcaggttctagtgccgatttatccctggagaaagcggctgaagtgagctgggagcaagaagccgagcattctgggacgagccacaacatactcgttgaagtgcaggacgatggaactatgaagattaaagacgaggagcgagatgacaccctgacaatccttctgaaggcaaccttgctagccgtctccggcgtgtacccaatgtcaatccctgctacactgtttgtatggtatttctggcagaaaaagaagcagcgcagtggcgtgctctgggatactcccagcccaccggaagtcgagcgggcagttctggacgatgggatttacagaatacttcaaaggggattactgggtcgttctcaggtgggcgtgggggtcttccaggacggagtgtttcataccatgtggcacgttacgcgcggcgccgtactcatgtatcagggtaaacggttggaaccttcctgggcgtcagtgaagaaagacctgatcagttacgggggaggctggagattccaaggcagctggaatacaggggaggaggtccaggtgattgctgttgaacccggaaagaacccaaaaaatgtgcagactacccccggtacatttaagacccctgagggcgaagtcggggccatcgcactcgatttcaagccaggaacttccggctctcccattgtgaacagggagggtaaaatcgtagggctgtacggaaatggcgtcgtgaccacatcgggcacgtatgttagcgccatagctcaagccaaggcatcacaggaagggcctcttccggagatcgaggacgaagtgtttaaaaagcgaaacctgactattatggatttgcacccaggatccggtaaaacccggcgctacctacccgctatcgtcagagaggccattaagaggaagctgcggacactcatcttagcgcctacccgagtggttgccagtgaaatggcagaggctctgaaaggcatgccaataagatatcagactacagccgtgaagtctgaacataccgggcgcgagattgtcgaccttatgtgccacgctacgttcactatgaggctgctcagccccgtgcgtgtacctaattacaacatgatcatcatggatgaggcacattttacagacccggcctccattgccgctcggggatatatctcaaccagagtgggcatgggtgaagcggcagccatattcatgaccgctactcccccagggtctgttgaggcctttcctcagagcaatgcagtcattcaagatgaagagagggacatccccgaacgcagttggaactccggatacgattggattacagacttcccaggcaaaaccgtgtggtttgtgcctagcatcaagtctggcaatgatatagccaactgtttgcgaaaaaacgggaagagagtcattcagctgtcacggaagacattcgacactgagtatcagaaaacgaagaataacgactgggattacgtagtgaccacagacatctccgagatgggagctaatttcagggcggatcgcgttatcgacccccgtagatgcctcaaaccagtgattctgaaggatggtccggaacgggtcatccttgccggccctatgcccgtgactgttgcaagtgctgcccagaggcgcgggcgaattggaagaaaccaaaataaagagggcgaccagtacgtgtatatgggtcagccactaaacaatgatgaagaccacgcacattggaccgaggccaagatgctgttggataacataaatacacccgaggggatcattcctgctttatttgaaccagagcgggaaaagagcgccgcgatcgacggcgagtacaggctgcgcggagaagcaagaaaaaccttcgtcgagctcatgaggcggggcgatctgcccgtgtggctttcgtataaggtagcctctgaggggtttcagtactccgaccgtcgctggtgcttcgatggagaacgaaacaatcaagtgctggaggaaaacatggacgttgagatctggactaaagaaggtgagagaaagaaactcaggcctcggtggttggacgctcgcacgtatagcgatccgctggccctaagagagtttaaggaattcgctgcaggcaggcggtcagtcagtggggacctgattctcgagataggaaaacttccacagcacctgaccttacgagcccagaatgctttggataacctggtgatgctccacaattctgaacagggcggtaaggcctacagacatgcaatggaggaactgcccgacacaatcgagactcttatgctgctcgcgttgattgccgtgctgaccgggggcgtcacattatttttcctatccggaaagggcctggggaaaaccagcatcggactcctttgtgttactgcttcaagtgccctgttgtggatggcaagcgtggagcctcactggattgctgcctccatcatactggaatttttcctcatggtactgcttatccccgagccagatcgccaaaggacacctcaggacaaccagctcgcatatgtggtcattggtctgttgtttatgatcctgacggtggccgctaacgaaatgggcttactagagaccactaagaaagatctggggattggacatgttgcggccgagaatcaccaacacgcaacaatgctcgacgtggatcttcggcccgcttctgcctggaccctgtacgccgtcgcaaccacagtaatcactccaatgatgcgtcatacgatagaaaacaccacagctaatattagcttgactgccatcgcgaaccaggctgccattctgatgggcctcgacaagggttggcctatctccaaaatggatataggggtgccgctgcttgcattaggctgctactcacaggttaatcccctgaccctcacagccgctgtgttgatgctggtcgcacactatgccatcattggaccaggcctacaggcgaaggctaccagagaggcccaaaagaggactgcagccgggatcatgaaaaaccctacggtggacggaattgtcgctatcgatctggaccccgtggtttacgacgccaagttcgaaaaacagctcggccagataatgcttctgattttgtgtacatctcagatcctgctcatgcgcaccacttgggcactgtgcgagagtatcaccttagctacaggtccacttactaccctgtgggaagggtcgcctggaaagttttggaatacaacgattgccgtgagcatggcgaacatcttccggggctcctatctcgccggtgcaggcctagctttctctctgatgaaatcattggggggaggccgaagagggaccggagcccaaggcgagactctgggtgagaagtggaagaggcagctcaatcagcttagcaaatccgaatttaacacatacaagcgcagtgggataatggaggtagatcggtctgaagcaaaagagggactgaagagaggcgaaaccactaaacatgctgtgagccgtggtacagccaagttgaggtggttcgtcgagcggaatctggttaagcccgagggcaaagtgattgacctcgggtgtggacgcggcgggtggtcatattactgcgccggattaaagaaagtcaccgaagtgaagggctatacgaaaggtgggccgggacacgaggaaccaatccctatggcgacctacggctggaacctggtaaagcttcattccggcaaagatgtgtttttcatgcccccagagaagtgtgacacactgctatgcgatattggggaaagtagccccaatcctactatcgaggagggacgaaccctcagagttctgaagatggtggaaccgtggttgaggggtaaccagttttgtataaaaatcctgaatccctacatgccatctgtcgtggagacactcgaacaaatgcagcggaagcacggcgggatgcttgtccgcaaccctctgtccagaaattcaactcacgagatgtattgggtgagctgcggaaccggcaacattgtttcggctgtaaacatgacatctaggatgttactgaatcgattcaccatggcacatcggaaacccacttacgagcgtgacgtggatttgggtgccgggacgagacacgtcgctgtggaacctgaggttgccaacctcgacatcattggacagcgcatcgaaaatattaagaacgagcataaaagtacatggcactatgatgaagacaatccatacaagacctgggcatatcacggctcctacgaggtgaagcccagcggctcagcctcctctatggtcaacggggtggtaaggctgctaactaaaccttgggatgtgatcccaatggttacccaaatagctatgacagacacgaccccctttggacagcagcgggtcttcaaggagaaagtggacactagaacaccgcgcgcgaagaggggtaccactcagattatggaagtgacagccaaatggctttggggctttctgagccgaaataagaagcctcggatctgtaccagagaggaattcacaaggaaagtccgcagtaacgcagctatcggggccgtttttgtggatgagaatcaatggaactccgcaaaggaagccgtagaggacgagcgtttctgggatctcgtgcatcgggaaagagagctgcacaaacagggaaagtgcgctacttgcgtctataatatgatgggcaaaagggaaaagaagttgggtgagtttgggaaagccaagggaagccgcgcgatttggtacatgtggctgggcgcacgattcctcgaattcgaggcccttggctttatgaacgaggaccattggttctctcgggaaaattcactgagtggggtggagggagaaggtttacacaaactgggctacatattgagagatatctccaagattccagggggaaacatgtatgctgacgataccgccggctgggacacgaggatcaccgaggatgacctccagaatgaggcaaaaattacagatatcatggaacccgagcatgctctgctagccactagcatatttaagcttacctaccagaacaaagttgtgcgcgtccaaagacctgctaagaacggtacagtgatggacgtaatctctcggagggatcagcgtgggtcgggacaggttggcacttatggcctgaataccttcacgaacatggaagtgcagctcattcgacaaatggagtcagaagggatctttctgccaagcgagttggagacacccaatttagccgaacgcgtcctggactggctcgagaagcacggagcagaaagacttaaacggatggcgatttccggtgacgattgtgtggtgaagccgatcgacgataggttcgccaccgctctgactgccctaaacgacatgggcaaagtccgcaaggatatacctcagtgggagcccagtaaagggtggaatgactggcagcaggttccattttgctctcaccatttccaccaactgattatgaaggatggaagagaaatcgtggtaccttgtcggaaccaggacgagctcgtgggcagggcacgagtcagccagggtgctgggtggtccttgcgtgagacagcctgcctgggaaagtcatacgcacaaatgtggcagcttatgtattttcatagacgcgatctgcggctcgccgcgaatgctatctgtagtgccgtgcccgttgactgggtgccaacctctaggactacctggagcattcacgcacaccatcagtggatgacaacggaagatatgttatccgtctggaacagagtgtggatagaggaaaatccctggatggaggacaaaacccacgtatcaagctgggaagaggttccttacctgggcaagcgcgaggaccagtggtgcggctctttgatcgggctgactgcccgggctacatgggccaccaacattcaagtggcaatcaatcaggtcaggcgactcattggaaacgaaaattatcttgatcatatgacttccatgaaaagattcaagaacgagagtgacccagaaggtgctctgtggtga

SEQ ID NO: 13415 - RNA, 9879 nt, synthetic construct
  misc_feature 1..9879: note = derived and/or modified CDS sequence (opt3) from DENV-1__FJ410290__SS-prME
  source 1..9879: mol_type = other RNA
agcgtgaccatgctgctcatgcttctgcccacagcattggctttccacttaactacgagaggaggggagcctcatatgatcgtctccaagcaagaaaggggaaaatctctgttatttaagacctcagccggtgttaacatgtgcacactcattgcaatggacctgggagagctttgtgaagatactatgacctacaaatgcccacaaataacagaggcggaaccggacgatgtggactgttggtgcaatgctaccgatacttgggtaacatatgggacctgtagtcagacgggagagcaccggcgcgagaagcgaagcgtggccctggcaccccatgtcggattgggtctcgaaactcgtaccgagacatggatgtcctctgaaggggcctggaaacagatccagagagtggagacttgggctctgaggcaccctggattcaccgttattgcactgtttctcgcccatgctatcggcacatcgattacccaaaagggcatcatattcatcttactgatgcttgtgacgccatcaatggccatgcggtgcgtcgggattggaaaccgcgactttgtggagggtttgagcggcgcgacttgggtagatgttgtgctggaacacgggagttgtgtcacaaccatggcaaagaataaacccactttggacatcgagctcctgaagacagaagtgacctcccctgccattcttagaaaactgtgcatcgaggctaagatatctaacacgaccacagatagcagatgtccaactcagggagaagccaccttggtggaggagcaggacgcaaatttcgtctgccggcgcacatttgttgatcgaggctggggtaacgggtgtggactcttcggcaaaggctccctgttaacttgcgctaagtttaagtgcgtgaccaaactggaagggaagattgtacagtacgagaatctcaaatattcagtgatcgtcacagtgcacaccggagaccaacatcaggttggtaacgaaactacggagcacggcacaattgccaccatcactccccaggcgcctaccagtgaaatccagcttacagattacggggccctgaccttggactgtagcccaagaactggactagacttcaatgagatggtgctgctcacaatgaaggagaaatcttggctggtccataagcaatggtttcttgatctgccgttgccctggacgtccggcgcatcaaccagccaggaaacttggaacaggcaggacctcctggtgacattcaaaaccgctcacgccaagaagcaagaggtagttgtgttaggtagtcaggaaggggctatgcacacagccctgactggcgcaaccgagattcagacgtctggaaccacaactatatttgccggccatctaaaatgccggctcaagatggataaactgacccttaaggggacatcctatgtcatgtgtactggcagcttcaaattggaaaaggaggtggctgagacccagcacggtacggtcctggtgcaagttaagtacgaaggcacagacgcgccttgcaaaatcccattctcgacccaggatgagaagggggtgactcagaatggacgtctcattacagcaaaccccatcgtaaccgacaaagaaaagcctgtcaatatagagactgagccaccctttggcgaatcttatattgtggttggtgccggggagaaagctctgaaactttcctggttcaagaaaggctcaagtatcggaaagatgtttgaagccaccgcacgcggcgccagaaggatggctatcctgggggatacagcctgggacttcggaagcattggtggcgtgtttacgtccgtcgggaaattggtgcatcaggtattcggaaccgcatacggcgtgctcttttctggtgttagctggactatgaagatcgggattggcatactgttaacatggctgggactaaactcacggagtacctccctcagcatgacatgtatcgcggtcggcatggtgactctgtaccttggggtgatggtccaagctgattctggatgcgttattaattggaaaggccgagagttgaagtgtggttcagggatcttcgtgaccaacgaagtgcacacgtggacagagcagtataagtttcaggccgacagtccgaaacgcctgagcgcagccatcggaaaggcttgggaggaaggcgtatgcggtattagatccgccaccaggctcgagaacataatgtggaaacagatctctaatgaactgaaccatattttactggagaatgatatgaagttcactgtcgtggttggcgacgcaaacgggatccttgctcaaggcaagaaaatgattcggcctcagcccatggaacacaaatactcgtggaaaagctggggcaaggccaaaatcataggggcggacatccagaataccacatttattatcgatggaccagacactcctgagtgtcccgataaccagcgcgcctggaatatttgggaggtggaagactatggcttcggtatctttaccacaaacatatggttgaagctcagagattcctacacgcaaatgtgcgaccacaggctgatgtcagctgcaattaaagatagtaaggccgtccatgctgacatggggtattggatcgagtctgagaagaatgagacctggaagctagcccgtgccagcttcattgaagtgaagacttgtacatggccaaaatcccacaccctgtggtcaaacggagttctcgagagcgagatgatcatacccaagatctacggcggtcctatttctcagcataattatcggccaggctacttcactcagacagcggggccgtggcacctgggaaaacttgaattggattttgacctgtgcgagggcaccacggtggtagtcgatgaacactgcgggaaccgaggaccctccttaagaactaccacagtgaccggcaagatcattcatgagtggtgttgcaggagttgtactctccctccactgcgcttccggggtgaggacgggtgctggtacggaatggaaatcagacccgtgaaagagaaggaagagaatcttgtcaggagcatggtttctgccggctccggtgaagtggattcatttagtctgggcatattgtgtgtaagcattatgatcgaggaggtgatgcgctcgcgatggtcccggaagatgctcatgacagggaccctggtcgtgttcctactgctcatcatgggacaactgacatggaaagaccttattcgtttgtgcatcatggttggcgctaacgcctctgacagaatggggatgggaactacctatctggcattaatggctacgtttaagatgaggcctatgttcgccgtgggcctcctgtttcgccggcttacaagcagagaagtcctgctactcaccattggtctgtcattggtggcaagtgttgagctgccaaattccttagaggaactcggggatggactggccatgggcataatgatgcttaaactgttgactgagttccagccccaccagctctggaccacactgctatctctgacttttatcaagaccacgcttagcctcgactacgcttggaaaacaaccgcgatggccctgtccattgtgtcattgttcccgctgtgtttaagcactacaagtcagaagaccacttggctccctgtcctgcttggctcttttgggtgcaagccactgacaatgttcttgatcaccgagaacaaaatttggggaaggaagtcctggcccctcaacgagggtatcatggcaataggcatcgtaagcattctgctatcgtcactgcttaaaaatgatgtgcctctcgctgggcccctgatcgccggaggcatgttgattgcctgttatgttatctctggtagttccgctgacttaagcctggaaaaggcagccgaggtgtcttgggaacaagaggcggaacatagcgggacgtcccacaacatactcgtcgaggtgcaggatgacggaactatgaaaattaaggatgaggaacgagacgataccctgacaatccttctgaaagctaccttgctagccgtatcaggcgtgtacccaatgagtatccctgcaacactgtttgtctggtatttctggcagaagaagaaacagcgcagcggcgttctctgggacactccctctccaccggaggtggaacgggccgtgctggatgacgggatttacagaatacttcaaaggggattactgggtcgttcccaggtcggcgtgggggttttccaggatggagtatttcataccatgtggcacgtgacgcgcggcgctgtcctcatgtatcagggtaagcggttggagccttcatgggcaagtgtgaaaaaggacctgatcagctacgggggaggctggagattccaaggctcctggaatacaggggaggaagttcaggtgattgccgtcgagcccggcaagaacccaaagaatgtgcagactacccccggtacatttaagacccctgaaggcgaggtaggggcgatcgctctcgacttcaaaccaggaacttctggctcgcccattgtcaacagggaaggtaagatcgtggggctgtacggaaatggcgttgtgaccacaagcggcacgtatgtctcagccatagcacaagccaaggcttcccaggaggggcctcttccggagatcgaagatgaggtgtttaagaaacgaaacctgactattatggacttgcacccaggaagtggtaagacccggcgctacctacccgccatcgttagagaagcaattaagaggaaactgcggacactcatcttagctcctacccgagtggtcgcctctgagatggcggaagccctgaagggcatgccaataagatatcagactacagcagtgaaaagcgagcataccgggcgcgagattgtagatcttatgtgccacgctacgttcactatgaggctgctctcccccgtgcgtgttcctaattacaacatgatcatcatggacgaagcccattttacagatccggcttcaattgcagcccggggatatatctctaccagagtcggcatgggtgaggccgctgcgatattcatgaccgcaactcccccagggagcgtggaagcctttcctcagagtaatgctgtgattcaagacgaggaaagggatatccccgagcgctcctggaacagcggatacgactggattacagatttcccaggcaagaccgtctggtttgtaccttctatcaaatcaggcaatgacatagccaactgtttgcgaaagaatgggaagagagtgattcagctgtcccggaaaacattcgatactgagtatcagaagacgaaaaacaacgactgggactacgttgtgaccacagatatcagtgaaatgggagcaaatttcagggccgaccgcgtcatcgatccccgtagatgcctcaagccagtgattctgaaagacggtccggagcgggttatccttgctggccctatgcccgtgactgtcgcgagcgccgcacagaggcgcgggcgaattggaagaaaccaaaataaggaaggcgatcagtacgtgtatatgggtcagccactaaacaatgacgaggatcacgctcattggaccgaggccaagatgctgttggacaacataaatacacccgaagggatcattcctgcattatttgagccagaacgggagaaatcggccgctatcgatggcgaatacaggctgcgcggagaggccagaaagaccttcgtagagctcatgaggcggggcgacctgcccgtgtggctttcttataaagttgcgtccgaagggtttcagtacagcgatcgtcgctggtgcttcgacggagagcgaaacaatcaagtcctggaagagaacatggatgtggaaatctggactaaggagggtgagaggaagaagctcaggcctcggtggttggacgcacgcacgtattcagacccgctggccctaagagaatttaaagagttcgctgccggcaggcggagtgtgtctggggatctgattctcgaaataggaaaacttccacagcacctgaccttacgagctcagaatgcattggacaacctggtcatgctccacaattccgagcagggcggtaaggcctacagacatgctatggaagaactgcccgatacaatcgagactcttatgctgctcgccttgattgcagttctgaccgggggcgtgacattatttttcctaagcggaaaaggcctggggaagacctcaatcggactcctttgtgtaactgcgagtagcgccctgttgtggatggcttccgtggaacctcactggattgccgcatctatcatactggagtttttcctcatggtcctgcttatccccgaaccagaccgccaaaggacacctcaggataaccagctcgcttatgtggttattggtctgttgtttatgatcctgacggtggccgcaaatgagatgggcttactagagaccactaaaaaggacctggggattggacatgtcgccgctgaaaaccaccaacacgcgacaatgctcgatgtagaccttcggcccgccagcgcatggaccctgtacgctgtggccaccacagttatcactccaatgatgcgtcatacgatagagaacaccacagccaatatttccttgactgcaatcgctaaccaggccgcgattctgatgggcctcgataaaggttggcctatctcaaagatggacataggggtgccgctgcttgctttaggctgctactctcaggtcaatcccctgaccctcacagccgcagtgttgatgctggtcgcccactatgctatcattggaccaggcctacaggcaaaggccaccagagaagcgcagaagaggactgctgccgggatcatgaagaaccctacggtggatggaattgttgcaatcgacctggatcccgtggtatacgacgccaaattcgagaagcagctcggccagataatgcttctgattttgtgtacaagtcagatcctgctcatgcgcaccacttgggctctgtgcgaatcgatcaccttagccacaggtccacttactaccctgtgggaggggagccctggaaaattttggaatacaacgattgcagtgtccatggctaacatcttccggggctcttatctcgccggtgcgggcctagccttctcactgatgaaaagcctagggggaggccgaagagggaccggagcacaaggcgagactctgggtgaaaagtggaaaaggcagctcaatcagctttccaagagtgagtttaacacatacaaacgctctgggataatggaagtcgaccggttcgaggctaaggaaggactgaaaagaggcgagaccactaagcatgccgttagccgtggtacagcaaagttgaggtggtttgtggagcggaatctggtcaaacccgaaggcaaggtgattgatctcgggtgtggacgcggcgggtggtcatattactgcgctggactgaaaaaggtaaccgaggtgaaaggctatacgaagggtgggccgggacacgaagaaccaatccctatggccacctacggctggaacctagttaaacttcattccggcaaggacgtgttctttatgcccccagaaaagtgtgatacactgctatgcgacattggggagagtagccccaatcctactatcgaggaaggacgaaccctcagagtcctgaaaatggtggagccgtggttgaggggtaaccagttctgtataaagatcctgaatccctacatgccatctgtcgtggaaacactcgagcaaatgcagcggaaacacggcgggatgcttgttcgcaaccctctgtccagaaattcaactcacgagatgtattgggtaagctgcggaaccggcaacattgtgtcggccgtcaatatgacatctaggatgttactgaaccgatttaccatggcgcatcggaagcccacttacgaacgtgatgtggacttgggtgctgggacgagacacgttgcagtggagcctgaagtcgccaacctcgatatcattggacagcgcatcgagaatattaaaaacgaacataagagtacatggcactatgacgaggataatccatacaagacctgggcttatcacggctcctacgaggtgaaacccagcggctcagcctcctctatggtaaacggggtggttaagctgctaactaaaccttgggacgtcatcccaatggtgacccaaatagcaatgacagatacgacccccttcggacagcagagggtgtttaaggaaaaagtcgacactcggacaccgagagccaagcgcggtaccactcagattatggaggttacagctaagtggctttggggcttcctgagcaggaataaaaagcctcgaatctgtacccgggaagagtttacaagaaaagtgaggagtaacgcggccatcggggcagtattcgtggacgaaaatcaatggaactccgctaaggaggccgtcgaggatgaacgcttttgggacctcgtgcatcgtgagcgggaactgcacaaacagggaaagtgcgcaacttgcgtttataatatgatgggcaagagagagaaaaagttgggtgagttcgggaaagccaagggaagcagggctatttggtacatgtggctgggcgcccgcttcctcgagtttgaggcgcttggcttcatgaacgaagatcattggttttctcgagaaaattcactgagtggggtggaaggagagggtttacacaaactgggctacatattgcgggacatctccaagattccagggggaaacatgtatgcagatgacaccgccggctgggatacgagaatcaccgaggacgatctccagaatgaagctaaaattacagacatcatggagcccgaacatgccctgctagcaactagcatattcaaacttacctaccagaacaaggtcgtgagggtacaacgccctgctaaaaatggtacagttatggatgtgatctctagacgggaccagagggggtcgggacaggtcggcacttatggcctgaacacctttacgaacatggaggtgcagctcattcgtcaaatggaatcagaggggatcttcctgccaagcgagttggaaacacccaatttagccgagcgagtgctggattggctcggaaagcacggtgctgaacgccttaaaagaatggccatttccggcgacgactgtgtcgttaagccgatcgatgaccggtttgcaaccgcgctgactgccctaaacgatatggggaaagtgaggaaggacatacctcagtgggagcccagtaagggatggaatgattggcagcaggtaccattctgctctcaccattttcaccaactgattatgaaagacggccgcgaaatcgtggtcccttgtagaaaccaggatgagctcgtgggtcgggctagggttagccagggggccggatggtccttgcgagagacagcatgcctgggcaagtcatacgctcaaatgtggcagcttatgtatttccatcgtagagacctgcgcctcgccaccaatgcaaaatgtagtgccgtgcccgtcgattgggtgccaacttctcggaccacatggagcatccacgcgcaccatcagtggatgacgaccgaagacatgttatccgtatggaacagggtttggattgaggaaaatccctggatggaggataagactcacgtgtcaagctgggaagaggtcccttacctgggcaaaagagaggaccagtggtgcgggtctttgataggactgacagctcgcgccacctgggcaactaacatccaagtggccattaatcaggttcggaggctcatcggtaacgaaaattatcttgactacatgacatccatgcgaagatttaagaacgagagtgatccagaaggcgctctgtggtga

SEQ ID NO: 13416 - RNA, 9879 nt, synthetic construct
  misc_feature 1..9879: note = derived and/or modified CDS sequence (opt3) from DENV-1__FJ024423__SS-prME
  source 1..9879: mol_type = other RNA
agcgtgaccatgctgctcatgcttctgcccaccgcattggctttccacttaactacgagaggaggggaacctcatatgatcgtctccaagcaggaaaggggaaaatctctgctgtttaagacctcagccggtgttaatatgtgcacactcattgccatggacctgggagaactttgtgaagatactatgacctacaaatgcccacaaataaccgaggcggaaccggacgatgtggactgttggtgcaatgctaccgatacttgggtaacatatgggacctgtagtcagacgggagagcaccggcgcgacaagcgaagcgtggccctggcaccccatgtcggcttgggtctcgagactcgtaccgaaacatggatgtcctctgagggggcctggaaacagatccagagagtggaaacttgggctctgaggcaccctggattcaccgttgtggcatttttcctggcccatgctattggcacatcgatcacccaaaagggcattatctttatactcttaatgctggtcacgccatcaatggccatgcggtgcgtggggatcggaaatcgcgatttcgtagagggtcttagcggcgcgacttgggttgacgtggtcttggagcacgggagttgtgtgacaaccatggcaaagaataaacccactctggatattgaactactcaagacagaggtgaccaaccctgccatcctgagaaaactttgcattgaagctaagatctccaatacgaccacagactctaggtgtccaactcagggagaggccaccctggtcgaagaacaggatgcaaactttgtttgccggcgcacattcgtggaccgaggctggggtaatgggtgtggattgtttggcaaaggcagcctcctgacttgcgctaagttcaagtgcgtaaccaaattagaggggaagatagtgcagtacgaaaacctgaaatattccgtcattgtgacagttcacaccggagatcaacatcaggtgggtaatgagactacggaacacggcacaatcgccattatcacaccccaggcgcctacttcagagatccagctcaccgactacggggcccttacactggactgtagtccaagaaccggattggattttaacgaaatggtcctactgactatgaaggagaaaagctggctcgtgcataagcaatggttcctggaccttccgctgccctggacatctggcgcatccacgtcacaggagacctggaataggcaggatttgctcgtaacttttaaaacagctcacgccaagaagcaagaagttgtggtcctgggtagccaggagggggctatgcacaccgccttaacaggcgcaactgaaattcagaccagtggaacgaccacaatattcgccggccatctgaaatgccggctaaagatggacaaactcactctgaaggggacctcttatgtgatgtgtacaggatccttcaaacttgagaaggaagtcgctgagactcagcacggtaccgtgttggttcaagtgaagtacgagggcacggatgcgccttgcaaaatcccatttagcacacaggacgaaaagggggtaacccagaacggacgtctgattactgcaaatcccatcgtcacagataaagagaagcctgtgaacatagaaaccgagccacccttcggcgagtcgtatattgttatcggtgccggggaaaaagctctcaagctgtcttggtttaagaaaggctcctcaatcggaaagatgttcgaggccactgcacgcggcgccagaaggatggctattcttggggacaccgcctgggattttggaagtatcggtggcgtgttcacaagcgtcgggaaactggtgcatcaggtatttggaacggcatacggcgtgttgttctccggtgtttcttggaccatgaagattgggataggcatcctcctgacttggttaggactgaatagccggtcaacaagtctatccatgacctgtattgcggtcggcatggtgacactctacctgggggtgatggtccaagctgacagcggatgcgttatcaactggaaaggccgagaacttaagtgtggttctgggatctttgtgactaacgaggtgcacacctggacggaacagtataagttccaggccgattcaccgaaacgcttgagtgcagccattggaaaggcttgggaggagggcgtatgcggtataagaagcgccacaaggctggaaaatatcatgtggaaacagatttccaacgagctcaatcatatcctgttagaaaacgacatgaagtttaccgtcgtggttggcgacgcaaatgggattctggctcaaggcaagaagatgatccggcctcagcccatggagcacaaatactcttggaagtcgtggggcaaggccaaaataatcggggcggatattcagaacactaccttcatcattgacggaccagatacacctgaatgtcccgacgatcagcgcgcctggaatatctgggaggtggaggactatggctttggtatattcactaccaacatttggcttaagttgagagatagctacacacaaatgtgcgaccacaggctcatgtccgctgcaatcaaagattcaaaggccgtccatgctgacatggggtattggattgaaagtgagaaaaatgaaacgtggaagctggcccgtgcatctttcatcgaggtgaagacctgtacttggccaaaaagccacacactatggtccaacggagttctggaatcagagatgataatccccaagatttacggcggtcctatcagccagcataattatcggccaggctactttacccagactgcggggccgtggcacctcggaaaactggagcttgatttcgacttgtgcgaaggcacaaccgtggtagtcgatgagcactgcgggaaccgaggaccctctctgagaacgactaccgtgacaggcaagattatccatgaatggtgttgcaggtcctgtaccttacctccactccgctttcggggtgaggacgggtgctggtacggaatggagataagacccgtgaaagaaaaggaggaaaatctggtcaggagtatggttagcgccggctctggtgaggtggactccttctcacttggcattctgtgtgctagtatcatgatcgaagaggtaatgcgcagccgatggtcgcggaagatgttgatgactgggacactcgccgtgtttctgctactgattatgggacaactcacctggaacgatctgatccgtctttgcattatggtcggcgcaaatgcttccgacagaatggggatgggaacaacttatttggccctgatggcaaccttcaaaatgaggcctatgtttgccgtgggcttactcttccgccggctgacgtctagagaggttcttctgctaacaataggtctcagcctggtggcttcagtcgaattgccaaacagtctggaggaattaggggatggactcgcgatgggcatcatgatgctgaaacttctgaccgagtttcagccccaccagttgtggactaccctcctgtccctaacattcattaaaactaccctgtctcttgactacgcctggaagacgacagcaatggctctcagcatcgtgtccctgtttccgttgtgtctgtcaaccactagccagaaaacaacctggttacctgttctcctgggcagtttcgggtgcaagccacttactatgtttctgattacagaaaacaagatctggggaaggaaatcttggcccttgaatgagggtataatggccatcggcattgtgtccatcctcctgagctcgctactgaagaacgatgtccctcttgccgggcccctcattgctggaggcatgctgatcgcatgttatgtaatatcaggttctagtgccgacttgtccttagagaaagcggctgaagtgagctgggagcaagaagccgagcattctgggaccagccacaatattctggttgaagtgcaggatgacggaacgatgaagatcaaagatgaggagaaggacgatactctcaccatcctgcttaaagcaacactgttggccgtctccggcgtgtacccaatgtcaattcctgctaccctattcgtatggtatttctggcagaagaagaaacagcgaagtggcgtgctgtgggacacacccagcccaccggaagtcgagcgcgcagttctcgatgacgggatataccggatcctgcaaagaggacttttaggtaggtctcaggtgggcgtgggggtctttcaggacggagtgttccatactatgtggcacgttacccgtggcgccgtactgatgtatcagggtaagcgcctcgaaccttcctgggcgtcagtgaaaaaggatttgattagttacgggggaggctggcggtttcaaggcagctggaacacgggggaggaggtccaggtgatcgctgttgaacccggcaaaaatccaaagaacgtgcagacaactcccggtaccttcaagacacctgagggcgaagtcggggccattgcactggactttaaaccaggaacctccggctctcccatcgtgaatagagagggtaagatagtagggctctacggaaacggcgtcgtgactacctcgggcacatatgttagcgccatcgctcaagccaaagcatcacaggaagggcctctgccggagattgaggatgaagtgttcaagaaaaggaatcttacgatcatggacctgcacccaggatccggtaagactcgacggtacttgcccgctattgtccgcgaggccatcaagagaaaactaaggaccctgatactcgcgcctacacgggtggttgccagtgaaatggcagaggctttaaagggcatgccaattcgatatcagaccactgccgtgaaatctgaacatacagggagagagatcgtcgatctgatgtgccacgctacctttacgatgcgccttctgagccccgtgagggtacctaactacaatatgatcattatggacgaggcacatttcactgatccggcctccatcgccgctcgtggatatatatcaacacgggtgggcatgggtgaagcggcagccatttttatgaccgctacacccccagggtctgttgaggccttccctcagagcaacgcagtcatccaagacgaagagagagatattcccgaaaggagttggaactccggatacgactggatcactgattttccaggcaagacagtgtggttcgtgcctagcataaaatctggcaacgacattgccaattgtctccgcaagaacgggaagcgagtcatccagttgtcaagaaaaaccttcgacacagagtatcagaagactaaaaacaatgattgggactacgtagtgacgaccgatatctccgagatgggagctaactttcgggcggacagggttattgatccccgccgttgcctgaagccagtgatcctcaaagacggtccggaaagagtcattctggccggccctatgcccgtgacagttgcaagtgctgcccagcggagggggcgcataggacgaaatcaaaacaaggagggcgatcagtacgtgtatatgggtcagccacttaataacgacgaagatcacgcacattggactgaggccaagatgctactggacaatatcaacacccccgaggggattatccctgctttgttcgaaccagagagagagaaaagcgccgcgatcgatggcgagtaccggttaaggggagaagcacgcaagacatttgtcgagctgatgagaaggggcgacctccccgtgtggctgtcgtataaagtagcctctgaggggttccagtactccgatcggcgttggtgctttgacggagaacgcaataaccaagtgcttgaggaaaatatggacgttgagatttggaccaaggaaggtgagaggaaaaagctgagacctagatggctcgatgctcggacttatagcgacccgttggccctgcgcgagttcaaagaatttgctgcaggcagaaggtcagtcagtggggatctaatactggagatcggaaagctcccacagcaccttacgctgcgggcccagaacgctttagacaatttggtgatgctgcacaactctgaacagggcggtaaggcctaccgacatgcaatggaggaactccccgataccattgagacactgatgcttctggcgctcatcgccgtgttgactgggggcgtcaccctgttctttttatccggaaaaggcctagggaagacaagcattggactgctctgtgttaccgcttcaagtgcccttctgtggatggcaagcgtggagcctcactggatcgctgcctccataatcttggagttctttctgatggtactcctgattcccgagccagacagacaacgcactcctcaggataatcagcttgcatatgtggtcatcggtctcctgttcatgattttgacagtggccgctaacgaaatgggcctgttagagacgaccaaaaaggacctagggatcggacatgttgcggccgagaaccaccaacacgcaactatgctggatgtggacctcaggcccgcttctgcctggacactttacgccgtcgcaaccaccgtaataacaccaatgatgcggcatactattgaaaatacgaccgctaacatcagcctgacagccattgcgaatcaggctgccatcttgatgggcctggataaaggttggcctatatccaagatggacatcggggtgccgctcctggcacttggctgctactcacaggttaaccccttaactctgaccgccgctgtgctcatgttggtcgcacactatgccattatcggaccaggcctgcaggcgaaggctacacgtgaggcccaaaaacgaaccgcagccgggattatgaagaatcctactgtggatggaatcgtcgctatagacctagaccccgtggtttacgatgccaaatttgaaaagcagctgggccagattatgctccttatcctgtgtacgtctcagatcttgctgatgaggacaacctgggcactctgcgagagtattactctggctaccggtccattaacaactctttgggaagggtcgcctggaaaattctggaacaccacaatcgccgtgagcatggcgaatatattccgcggctcctatctggccggtgcaggcctcgctttttctctaatgaagtcactagggggaggccggcgagggacgggagcccaaggcgagaccttgggtgagaagtggaaaagacagctgaaccagctcagcaagtccgagttcaatacttacaaaaggagtgggattatggaggtagaccgctctgaagcaaaggagggacttaaacggggcgaaacaaccaagcatgctgtgagcagaggtactgccaagctgcgttggtttgtcgagaggaacttggttaaacccgagggcaaggtgatcgatctggggtgtggacggggcgggtggtcatattactgcgccggactcaaaaaggtcacagaagtgaaaggctataccaagggtgggccgggacacgaggaaccaattcctatggcgacgtacggctggaatttagtaaaactgcattccggcaaggacgtgttctttatgcccccagagaagtgtgatacccttctgtgcgacatcggggaaagtagccccaaccctacaatagaggagggacgcactctacgagttctcaaaatggtggaaccgtggctgagaggtaatcagttctgtatcaagattttgaacccctacatgccatctgtcgtggagaccctggaacaaatgcagaggaaacacggcgggatgctcgtccggaatcctctttcccgcaactcaacacacgagatgtattgggtgagctgcggaactggcaatatcgtttcggctgtaaacatgacctctagaatgctgttaaacaggtttacaatggcacatcgaaagcccacctacgagcgggatgtggacctgggtgccgggactcgtcacgtcgctgtggaacctgaggttgccaatttggatattatcggacagagaattgaaaacatcaaaaatgagcataagagtacgtggcactatgacgaagataacccatacaagacatgggcatatcacggctcctacgaggtgaaacccagcggctcagcctcctctatggtcaatggggtggtacgcctcctgaccaagccttgggacgtgataccaatggttactcaaattgctatgaccgacacaacgcccttcggacagcagagggtctttaaagagaaggtggatacccggactccgagagcgaaacgcggtacaacccagatcatggaagtgactgccaagtggctatggggcttccttagcaggaacaagaaacctcgaatctgtacacgggaggaatttaccagaaaggtcaggagtaatgcagctattggggccgttttcgtggacgagaaccaatggaactccgcaaaagaagccgtagaggatgagcgcttttgggacctggtgcatcgtgaacgggagctccacaagcagggaaaatgcgctacatgcgtctataacatgatgggcaagagagaaaagaaactgggtgagttcgggaaggccaaaggaagcagggcgatatggtacatgtggttgggcgcacgcttcctggaatttgaggccctcggcttcatgaatgaggatcattggttttctcgagaaaactcacttagtggggtggagggagaaggtctgcacaagttaggctacatcctgcgggacatttccaaaatcccagggggaaatatgtatgctgatgacactgccggctgggataccagaattacggaggacgatttgcagaacgaggcaaagatcaccgacataatggaacccgagcatgctctcctggccacaagcatcttcaaactaacttaccagaataaggttgtgagggtccaacgccctgctaagaacggtaccgtgatggatgtaatttctagacgggaccagagggggtcgggacaggttggcacatatggccttaacacttttaccaatatggaagtgcagctgatccgtcaaatggagtcagaagggattttcctcccaagcgagctggagacgcccaacttggccaaacgagtcttagactggctggaaaagcacggagcagagcgcctcaaaagaatggcgatctccggtgatgactgtgtggtgaagccgatagatgaccggtttgccacagctcttaccgccctgaatgatatgggcaaagtcaggaaggacattcctcagtgggaacccagtaaggggtggaacgattggcagcaggttccattctgctctcaccattttcaccaactaatcatgaaagacggacgcgagatcgtggtaccttgtagaaatcaggatgaactggtgggccgggcaagggtcagccagggtgctgggtggtccctccgagagactgcctgcttgggaaagtcatacgcacaaatgtggcagctgatgtatttccatcgtagagaccttcgcctggccgcgaacgctatttgtagtgccgtgcccgttgattgggtgccaacatctcggaccacttggagcatacacgcacaccatcagtggatgaccacagaggacatgctctccgtctggaatagggtgtggatcgaagagaacccctggatggaagacaaaacgcacgtatcaagctgggaggaagttccttacttaggcaagagagaggatcagtggtgcggctctctgattgggttgaccgcccgcgctacttgggccacaaatatccaagtggcaattaaccaggtccggaggctgatcggaaatgagaactatctcgactacatgacctccatgaaacgatttaagaatgaaagtgatccagagggtgctctttggtga

SEQ ID NO: 13417 - RNA, 9879 nt, synthetic construct
  misc_feature 1..9879: note = derived and/or modified CDS sequence (opt3) from DENV-1__FJ547089__SS-prME
  source 1..9879: mol_type = other RNA
agcgtgaccatgctgctcatgcttctgccaacagccttggctttccacttaactacgaggggaggggaacctcatatgatagtctccaagcaggaaaggggaaaatctctgttgtttaagacctcagccggtgttaacatgtgcacactcattgccatggacctgggcgaactttgtgaagatactatgacctacaaatgcccacagataacagaggcggaaccggacgatgtggactgttggtgcaatgctaccgatacttgggtaacatatgggacctgtagtcagacgggagagcaccggcgcgacaagcgaagcgtggccctggcaccccatgtcggcttgggtctcgagactcgtaccgaaacatggatgtcctctgagggggcctggaaacagatccagagagtggaaacttgggctctgaggcaccctggattcaccgttattgcactgtttctcgcccatgctatcggcacatcgattacccaaaagggcatcatattcatcttactgatgcttgtgacgccatcaatggccatgcggtgcgtcgggattggaaaccgcgattttgtggagggtttgagcggcgcgacttgggttgacgttgtgctggagcacgggagttgtgtcacaaccatggcaaagaataaacccactctagatatcgaactcctgaagacagaggtgaccaaccctgccattcttagaaaactgtgcatcgaagctaagatatccaatacgaccacagactctaggtgtccaactcagggagaggccaccttggtggaagaacaggatgcaaacttcgtctgccggcgcacatttgttgaccgaggctggggtaatgggtgtggactcttcggcaaaggcagcctgttaacttgcgctaagtttaagtgcgtgaccaaactggaggggaagattgtacagtacgaaaacctcaaatattccgtgatcgtcacagtgcacaccggagatcaacatcaggttggtaatgagactacggaacacggcacaattgccaccatcactccccaggcgcctacctcagagatccagcttacagactacggggccctgaccttggactgtagtccaagaactggactagatttcaacgaaatggtgctgctcacaatgaaggagaaaagctggctggtccataagcaatggtttcttgacctgccgttgccctggacgtctggcgcatccacctcacaggagacttggaataggcaggatctcctggtgacattcaaaaccgctcacgccaagaagcaagaagtagttgtgttaggtagccaggagggggctatgcacacagccctgactggcgcaaccgaaattcagacgagtggaaccacaactatatttgccggccatctaaaatgccggctcaagatggacaaactgacccttaaggggacatcttatgtcatgtgtactggatccttcaaattggagaaggaagtggctgagacccagcacggtacggtcctggtgcaagttaagtacgagggcacagatgcgccttgcaaaatcccattcagcacccaggacgaaaagggggtgactcagaacggacgtctcattacagcaaatcccatcgtaaccgataaagagaagcctgtcaacatagaaactgagccaccctttggcgagtcgtatattgtggttggtgccggggaaaaagctctgaaactttcttggttcaagaaaggctcctcaatcggaaagatgtttgaggccaccgcacgcggcgccagaaggatggctatcctgggggacacagcctgggatttcggaagtattggtggcgtgtttacgagcgtcgggaaattggtgcatcaggtattcggaaccgcatacggcgtgctcttttccggtgtttcttggactatgaagatcgggattggcatactgttaacatggctgggactaaatagccggtcaaccagtctctccatgacatgtatcgcggtcggcatggtgactctgtaccttggggtgatggtccaagctgacagcggatgcgttattaactggaaaggccgagaattgaagtgtggttctgggatcttcgtgaccaacgaggtgcacacgtggacagaacagtataagtttcaggccgattcaccgaaacgcctgagtgcagccatcggaaaggcttgggaggagggcgtatgcggtattagaagcgccaccaggctcgaaaatataatgtggaaacagatctccaacgagctgaatcatattttactggaaaacgacatgaagttcactgtcgtggttggcgacgcaaatgggatccttgctcaaggcaagaagatgattcggcctcagcccatggagcacaaatactcttggaagtcgtggggcaaggccaaaatcataggggcggatatccagaacaccacatttattatcgacggaccagatactcctgaatgtcccgacaatcagcgcgcctggaacatttgggaggtggaggattatggcttcggtatctttaccacaaatatatggttgaagctcagagacagctacacgcaaatgtgcgatcacaggctgatgtccgctgcaattaaagactcaaaggccgtccatgctgatatggggtattggatcgaaagtgagaaaaacgaaacctggaagctagcccgtgcatctttcattgaggtgaagacttgtacatggccaaaaagccacaccctgtggtccaatggagttctcgaatcagagatgatcatacccaagatctacggcggtcctattagccagcataactatcggccaggctacttcactcagacagcggggccgtggcacctgggaaaacttgagttggactttgatctgtgcgaaggcaccacggtggtagtcgacgagcactgcgggaatcgaggaccctctttaagaactaccacagtgaccggcaagactatccatgaatggtgttgcaggtcctgtacactccctccactgcgcttccggggtgaggatgggtgctggtacggaatggagattagacccgtgaaagaaaaggaggaaaaccttgtcaggagtatggttagcgccggctctggtgaggtggactccttttcactgggcatcttgtgtgctagtataatgattgaagaggtaatgcgcagccgatggtcgcggaagatgctcatgaccgggacactggccgtgttcctactgctcatcatgggacaactgacttggaatgaccttatccgtttgtgcattatggtcggcgcaaacgcttccgatagaatggggatgggaaccacgtatctggccttaatggcaacatttaaaatgaggcctatgttcgccgtgggcctcctgtttcgccggcttacctctagagaggttctgctactcactatcggtctgagcttggtggcttcagtcgaactgccaaacagtttagaggaactcggggacggactggcgatgggcattatgatgcttaagctgttgaccgagttccagccccaccagctctggacaactctgctatccctgacctttataaaaacgacactttctctcgattacgcctggaagaccactgcaatggctctgagcatcgtgtccttgttcccgctgtgtttatcaacaaccagccagaaaactacatggctccctgttctgcttggcagttttgggtgcaagccactgaccatgttcttgattacggaaaataagatctggggaaggaaatcttggcccctcaacgagggtattatggccatcggcatagtgtccatcctgctaagctcgctgcttaagaatgacgtccctctcgccgggcccctgattgctggaggcatgttgatcgcatgttatgtaatttcaggttctagtgccgatttatccctggagaaagcggctgaagtgagctgggagcaagaagccgagcattctgggactagccacaacatcctcgttgaagtgcaggacgatggaaccatgaagataaaagacgaggagcgagatgacacactgaccattcttctgaaggcaacattgctagccgtctccggcgtgtacccaatgtcaatccctgctactctgtttgtatggtatttctggcagaaaaagaagcagcgcagtggcgtgctctgggatacccccagcccaccggaagtcgagcgggcagttctggacgatgggatctacaggattcttcaacgaggattactgggtcgttctcaggtgggcgtgggggtcttccaggacggagtgtttcatacgatgtggcacgttacacgcggcgccgtactcatgtatcagggtaaacggttggaaccttcctgggcgtcagtgaagaaagacctgataagttacgggggaggctggagattccaaggcagctggaatactggggaggaggtccaggtgatcgctgttgaacccggaaagaaccccaagaatgtgcagaccacacccggtacctttaagactcctgagggcgaagtcggggccattgcactcgatttcaagccaggaacctccggctctcccatcgtgaacagggagggtaaaattgtagggctgtacggaaatggcgtcgtgacaacgtcgggcacttatgttagcgccatcgctcaagccaaggcatcacaggaagggcctcttccggagatagaggacgaagtgtttaaaaagcgaaacctgaccatcatggatttgcacccaggatccggtaaaacacggcgctacctacccgctattgtcagagaggccatcaagaggaagctgcggaccctcattttagcgcctactcgagtggttgccagtgaaatggcagaggctctgaaaggcatgccaatcagatatcagacaaccgccgtgaagtctgaacatacggggcgcgagatagtcgaccttatgtgccacgctactttcacaatgaggctgctcagccccgtgcgtgtacctaattacaacatgattatcatggatgaggcacattttaccgacccggcctccatcgccgctcggggatatatttcaaccagagtgggcatgggtgaagcggcagccatcttcatgactgctacacccccagggtctgttgaggcctttcctcagagcaatgcagtcatacaagatgaagagagggacattcccgaacgcagttggaactccggatacgattggatcaccgacttcccaggcaaaacagtgtggtttgtgcctagcattaagtctggcaatgatatcgccaactgtttgagaaagaacgggaagagagtcatacagctgtcacggaagactttcgacacggagtatcagaaaaccaagaataacgactgggattacgtagtgacaactgacatttccgagatgggagctaatttcagggcggatcgcgttatcgacccccgtagatgcctcaaaccagtgatcctgaaggatggtccggaacgggtcattcttgccggccctatgcccgtgaccgttgcaagtgctgcccagaggcgcgggcgaatcggaagaaaccaaaataaagagggcgaccagtacgtgtatatgggtcagccactaaacaatgatgaagaccacgcacattggacagaggccaagatgctgttggataacattaatacccccgaggggataatccctgctttatttgaaccagagcgggaaaagagcgccgcgattgacggcgagtacaggctgcgcggagaagcaagaaaaactttcgtcgagctcatgaggcggggcgatctgcccgtgtggctttcgtataaggtagcctctgaggggtttcagtactccgaccgtcgctggtgcttcgatggagaacgaaacaatcaagtgctggaggaaaacatggacgttgagatctggacgaaagaaggtgagagaaagaaactcaggcctcggtggttggacgctcgcacctatagcgatccgctggccctaagagagtttaaggagttcgctgcaggcaggcggtcagtcagtggggacctgatcctcgagattggaaaacttccacagcacctgacattacgagcccagaatgctttggataacctggtgatgctccacaattctgaacagggcggtaaggcctacagacatgcaatggaggaactgcccgacactatagagacccttatgctgctcgcgttgatcgccgtgctgacagggggcgtcaccttatttttcctatccggaaagggcctggggaaaactagcattggactcctttgtgttacagcttcaagtgccctgttgtggatggcaagcgtggagcctcactggatcgctgcctccattatcctggaatttttcctcatggtactgcttatacccgagccagatcgccaaaggacgcctcaggacaaccagctcgcatatgtggtcatcggtctgttgtttatgattctgaccgtggccgctaacgaaatgggcttactagagactacaaagaaagatctggggatcggacatgttgcggccgagaatcaccaacacgcaaccatgctcgacgtggatcttcggcccgcttctgcctggaccctgtacgccgtcgcaacaactgtaattacgccaatgatgcgtcataccatcgaaaacacaactgctaatatcagcttgaccgccattgcgaaccaggctgccatcctgatgggcctcgacaagggttggcctatttccaaaatggatatcggggtgccgctgcttgcattaggctgctactcacaggttaatcccctgacactcaccgccgctgtgttgatgctggtcgcacactatgccataatcggaccaggcctacaggcgaaggctactagagaggcccaaaagaggacggcagccgggattatgaaaaaccctacagtggacggaatcgtcgctattgatctggaccccgtggtttacgacgccaagttcgaaaaacagctcggccagatcatgcttctgatattgtgtacctctcagattctgctcatgcgcactacctgggcactgtgcgagagtatcacattagctactggtccacttaccacactgtgggaagggtcgcctggaaagttttggaatacgaccatcgccgtgagcatggcgaacattttccggggctcctatctcgccggtgcaggcctagctttctctctgatgaaatcactagggggaggccgaagagggactggagcccaaggcgagacactgggtgagaagtggaagaggcagctcaatcagcttagcaaatccgaatttaacacctacaagcgcagtgggatcatggaggtagatcggtctgaagcaaaagagggactgaagagaggcgaaactacaaaacatgctgtgagccgtggtaccgccaagttgaggtggttcgtcgagcggaatctggttaagcccgagggcaaagtgatagacctcgggtgtggacgcggcgggtggtcatattactgcgccggattaaagaaagtcacggaagtgaagggctataccaaaggtgtaccggcgcgagaggaaccaattcctatggctacatacgggtggaacctggtgaaacttcactccggaaaagatgtatttttcatgcccccagagaagtgtgacactctgctatgcgatatcggcgaaagtagccccaatcctaccattgaggagggcagaacactcagggtgctgaagatggtcgaaccgtggttgcgggggaaccagttttgtatcaaaatactgaatccctacatgccatctgtggtcgagactctcgaacaaatgcagcgcaagcatggaggtatgcttgtgagaaaccctctgtccagaaattcaacccacgagatgtattgggttagctgcggcacagggaacatcgtatcggcagtgaacatgacctctcgaatgttactgaatcggttcactatggcccaccgtaaacccacgtacgagagagacgtcgatttgggagctggcacacgccatgtggccgttgaacctgaggtggcaaacctcgacattatcggtcagaggattgaaaatatcaagaacgagcacaaaagtacctggcattatgatgaagacaatccatacaagacttgggcctatcacgggtcctacgaggtcaagcccagcggatcagcttcctctatggtgaacggcgtagtgcggctgctaaccaaaccttgggatgttattccaatggtcacacaaatcgcgatgacggacaccactccctttggccagcagagagtgttcaaggagaaagtggacacacgcaccccgagggccaagcgagggactacacagataatggaagtcaccgcaaaatggctttggggatttctgagccggaataagaagcctagaatttgtacaagggaggagttcactcgcaaagttcgtagtaacgctgccatcggtgcagtgtttatcgatgagaatcaatggaactccgccaaggaagctgtagaggacgagcggttctgggatctcgtgcacagagaaagggagctgcataaacagggcaagtgcgcaacctgcgtctataatatgatggggaaacgcgaaaagaagttgggagagtttggcaaagcgaagggtagccgagcaatttggtacatgtggctgggggcccggttcctcgagttcgaggctcttggatttatgaacgaggaccactggttctctagagaaaattcactgagtggcgtggagggcgaagggttacataaactgggatacatattgagggatatctccaagattccaggtggcaacatgtatgccgacgatacggcagggtgggacacccgcgttacagaggatgacctccagaatgaggctaaaatcactgatattatggaacccgagcacgccctgctagctaccagcatctttaaacttacataccagaacaaagtggtcagagtgcaacggcctgccaagaacggaactgtaatggacgttatatctaggcgtgatcagcgaggctcgggtcaggtggggacctatggactgaatacgttcacaaacatggaagtccagctcatccgccaaatggagtcagaaggcatttttctgccaagcgagttggagacccccaatttagcagaaagagtgctggactggctcgagaagcatggcgcggaacggcttaggcgcatggccatctccggggacgattgtgtggtcaaaccgattgacgatagattcgctactgccctgacagcactaaacgacatgggaaaggttcggaaagatatccctcagtgggagcccagtaagggttggaatgactggcaacaggtgccattttgctctcaccacttccatcaactgataatgaaagatggcagggaaattgtagtgccttgtcgaaaccaggacgagctcgtcgggcgtgctagagtgagccagggagccggctggtccttgcgcgagaccgcatgcctgggtaagtcatacgcccaaatgtggcagcttatgtattttcaccggagggatctgagactcgcggctaatgccatctgtagtgcagttcccgtggactgggtcccaacttctcgcaccacatggagcatccatgcccaccaccagtggatgacgaccgaagatatgttatccgtgtggaaccgggtatggattgaggaaaatccctggatggaggacaagactcatgtttcaagctgggaagaggtgccttacctggggaaaagggaggaccagtggtgcggatctttgataggcctgacagctcgagccacctgggcaactaacatccaagtcgctattaatcaggtgagacggctcatcggcaacgaaaattatcttgattacatgacatccatgaagaggttcaaaaacgagagtgacccagaaggggccctgtggtga

SEQ ID NO: 13418 - RNA, 9879 nt, synthetic construct
  misc_feature 1..9879: note = derived and/or modified CDS sequence (opt3) from DENV-1__FJ024484__SS-prME
  source 1..9879: mol_type = other RNA
agcgtgaccatgctgctcatgcttctgcccactgcattggctttccacttaactacgagaggaggggaacctcatatgatcgtctccaagcaggaaaggggaaaatctctgctgtttaagacctcagccggtgttaatatgtgcacactcattgccatggacctgggagaactttgtgaagatactatgacctacaaatgcccacaaataacagaggcggaaccggacgatgtggactgttggtgcaatgctaccgatacttgggtaacatatgggacctgtagtcagacgggagagcaccggcgcgacaagcgaagcgtggccctggcaccccatgtcggcttgggtctcgagactcgtaccgaaacatggatgtcctctgagggggcctggaaacagatccagagagtggaaacttgggctctgaggcaccctggattcaccgttgtggcatttttcctggcccatgctattggcacatcgatcacccaaaagggcattatctttatactcttaatgctggtcacgccatcaatggccatgcggtgcgtggggatcggaaaccgcgatttcgtagagggtcttagcggcgcgacttgggttgacgtggtcttggagcacgggagttgtgtgacaaccatggcaaagaataaacccactctggatattgaactactcaagacagaggtgaccaaccctgccatcctgagaaaactttgcattgaagctaagatctccaatacgaccacagactctaggtgtccaactcagggagaggccaccctggtcgaagaacaggatgcaaactttgtttgccggcgcacattcgtggaccgaggctggggtaatgggtgtggattgtttggcaaaggcagcctcctgacttgcgctaagttcaagtgcgtaaccaaattagaggggaagatagtgcagtacgaaaacctgaaatattccgtcattgtgacagttcacaccggagatcaacatcaggtgggtaatgagactacggaacacggcacaatcgccaccattactccccaggcgcctacctcagagatccagctcacagactacggggcccttaccctggactgtagtccaagaactggattggattttaacgaaatggtcctactgacaatgaaggagaaaagctggctcgtgcataagcaatggttcctggaccttccgctgccctggacgtctggcgcatccacctcacaggagacttggaataggcaggatttgctcgtaacatttaaaaccgctcacgccaagaagcaagaagttgtggtcctgggtagccaggagggggctatgcacacagccttaactggcgcaaccgaaatccagacgagtggaaccacaactattttcgccggccatctgaaatgccggctaaagatggacaaactcaccctgaaggggacatcttatgtgatgtgtactggatccttcaaacttgagaaggaagtcgctgagacccagcacggtacggtgttggttcaagtgaagtacgagggcacagatgcgccttgcaaaataccatttagcacccaggacgaaaagggggtaactcagaacggacgtctgatcacagcaaatcccattgtcaccgataaagagaagcctgtgaacatcgaaactgagccacccttcggcgagtcgtatatagttattggtgccggggaaaaagctctcaagctgtcttggtttaagaaaggctcctcaatcggaaagatgttcgaggccaccgcacgcggcgccagaaggatggctatccttggggacacagcctgggattttggaagtattggtggcgtgttcacgagcgtcgggaaactggtgcatcaggtatttggaaccgcatacggcgtgttgttctccggtgtttcttggactatgaagatcgggattggcatactcctgacatggttaggactgaatagccggtcaaccagtctatccatgacatgtatcgcggtcggcatggtgactctctacctgggggtgatggtccaagctgacagcggatgcgttattaactggaaaggccgagaacttaagtgtggttctgggatctttgtgaccaacgaggtgcacacgtggacagaacagtataagttccaggccgattcaccgaaacgcttgagtgcagccatcggaaaggcttgggaggagggcgtatgcggtattagaagcgccaccaggctggaaaatataatgtggaaacagatctccaacgagctcaatcatattctgttagaaaacgacatgaagtttactgtcgtggttggcgacgcaaatgggatcctggctcaaggcaagaagatgattcggcctcagcccatggagcacaaatactcttggaagtcgtggggcaaggccaaaatcataggggcggatatccagaacaccacattcattatcgacggaccagatactcctgaatgtcccgacgatcagcgcgcctggaatatttgggaggtggaggactatggctttggtatcttcaccacaaacatatggcttaagttgagagatagctacacgcaaatgtgcgaccacaggctcatgtccgctgcaattaaagattcaaaggccgtccatgctgacatggggtattggatcgaaagtgagaaaaatgaaacctggaagctggcccgtgcatctttcattgaggtgaagacttgtacatggccaaaaagccacaccctatggtccaacggagttctggaatcagagatgatcatacccaagatctacggcggtcctattagccagcataattatcggccaggctactttactcagacagcggggccgtggcacctcggaaaactggagcttgatttcgacttgtgcgaaggcaccacggtggtagtcgatgagcactgcgggaaccgaggaccctctctgagaactaccacagtgaccggcaagatcattcatgaatggtgttgcaggtcctgtactttacctccactccgctttcggggtgaggacgggtgctggtacggaatggagatcagacccgtgaaagaaaaggaggaaaatctggtcaggagtatggttagcgccggctctggtgaggtggactccttctcacttggcatactgtgtgctagtattatgatcgaagaggtaatgcgcagccgatggtcgcggaagatgttgatgacagggaccctcgccgtgtttctgctactgatcatgggacaactcacatggaacgatctgattcgtctttgcatcatggtcggcgcaaatgcttccgacagaatggggatgggaactacctatttggccctgatggcaacgttcaaaatgaggcctatgtttgccgtgggcttactcttccgccggctgacatctagagaggttcttctgctaaccattggtctcagcctggtggcttcagtcgaattgccaaacagtctggaggaattaggggatggactcgcgatgggcataatgatgctgaaacttctgactgagtttcagccccaccagttgtggaccacactcctgtccctaactttcatcaaaaccacgctgtctcttgactacgcctggaagacaaccgcaatggctctcagcattgtgtccctgtttccgttgtgtctgtcaactacaagccagaaaaccacttggttacctgttctcctgggcagtttcgggtgcaagccacttacaatgtttctgatcaccgaaaacaagatttggggaaggaaatcttggcccttgaatgagggtatcatggccataggcatcgtgtccattctcctgagctcgctactgaagaacgatgtccctcttgccgggcccctcatcgctggaggcatgctgattgcatgttatgtaatctcaggttctagtgccgacttgtccttagagaaagcggctgaagtgagctgggagcaagaagccgagcattctgggacgagccacaatatactggttgaagtgcaggatgacggaactatgaagattaaagatgaggagaaggacgataccctcacaatcctgcttaaagcaaccctgttggccgtctccggcgtgtacccaatgtcaatccctgctacactattcgtatggtatttctggcagaagaagaaacagcgaagtggcgtgctgtgggacactcccagcccaccggaagtcgagcgcgcagttctcgatgacgggatttaccggatactgcaaagaggacttttaggtaggtctcaggtgggcgtgggggtctttcaggacggagtgttccataccatgtggcacgttacgcgtggcgccgtactgatgtatcagggtaagcgcctcgaaccttcctgggcgtcagtgaaaaaggatttgatcagttacgggggaggctggcggtttcaaggcagctggaacacaggggaggaggtccaggtgattgctgttgaacccggcaaaaatccaaagaacgtgcagactacccccggtacattcaagacccctgagggcgaagtcggggccatcgcactggactttaaaccaggaacttccggctctcccattgtgaatagagagggtaagatcgtagggctctacggaaacggcgtcgtgaccacatcgggcacgtatgttagcgccatagctcaagccaaagcatcacaggaagggcctctgccggagatcgaggatgaagtgttcaagaaaaggaatcttactattatggacctgcacccaggatccggtaagacccgacggtacttgcccgctatcgtccgcgaggccattaagagaaaactaaggacactgatcctcgcgcctacccgggtggttgccagtgaaatggcagaggctttaaagggcatgccaatacgatatcagactacagccgtgaaatctgaacataccgggagagagattgtcgatctgatgtgccacgctacgtttactatgcgccttctgagccccgtgagggtacctaactacaatatgatcatcatggacgaggcacatttcacagatccggcctccattgccgctcgtggatatatctcaacccgggtgggcatgggtgaagcggcagccatatttatgaccgctactcccccagggtctgttgaggccttccctcagagcaacgcagtcattcaagacgaagagagagatatccccgaaaggagttggaactccggatacgactggattacagattttccaggcaagaccgtgtggttcgtgcctagcatcaaatctggcaacgacatagccaattgtctccgcaagaacgggaagcgagtcattcagttgtcaagaaaaacattcgacactgagtatcagaagacgaaaaacaatgattgggactacgtagtgaccacagatatctccgagatgggagctaactttcgggcggccagggttatcgacccccgccgttgcctgaagccagtgattctcaaagatggtccggaaagagtcatcctggcaggccctatgcccgtgactgttgctagtgccgcacagcggagggggcgcattggacgaaatcaaaacaaggagggcgaccagtacgtgtatatgggtcagccacttaataacgatgaagaccacgcccattggaccgaggctaagatgctactggataatataaacacacccgaggggatcattcctgccttgttcgaaccagagagagagaaaagcgcggcaatcgacggcgagtaccggttaaggggagaagcccgcaagacctttgtcgagctgatgagaaggggcgatctccccgtgtggctgtcgtataaagtagcttctgaggggttccagtactccgaccggcgttggtgctttgatggagaacgcaataaccaagtgcttgaggaaaatatggacgttgagatctggactaaggaaggtgagaggaaaaagctgagacctagatggctcgacgcccggacgtatagcgatccgttggctctgcgcgagttcaaagaatttgcagccggcagaaggtcagtcagtggggacctaattctggagataggaaagctcccacagcaccttaccctgcgggctcagaacgccttagataatttggtgatgctgcacaactctgaacagggcggtaaggcataccgacatgcgatggaggaactccccgacacaatcgagactctgatgcttctggccctcattgctgtgttgaccgggggcgtcacactgttctttttatccggaaaaggcctagggaagaccagcatcggactgctctgtgttactgcctcaagtgcacttctgtggatggctagcgtggagcctcactggattgccgcatccatcatattggagttctttctgatggtactcctgatccccgagccagatagacaacgcacacctcaggacaatcagcttgcctatgtggtcattggtctcctgttcatgatcttgacggtggctgcgaacgaaatgggcctgttagagaccactaaaaaggatctagggattggacatgttgccgcagagaaccaccaacacgctacaatgctggacgtggatctcaggcccgcctctgcctggaccctttacgcagtcgctaccacagtaatcactccaatgatgcggcatacgatagaaaataccacagccaacattagcctgactgcgatcgctaatcaggccgcaattttgatgggcctggacaaaggttggcctatctccaagatggatataggggtgccgctcctggcccttggctgctactcacaggttaaccccttaaccctgacagctgcagtgctcatgttggtcgcccactatgcgatcattggaccaggcctgcaggctaaggccacccgtgaggcacaaaaacgaactgccgctgggatcatgaagaatcctacggtggacggaattgtcgccatcgatctagaccccgtggtttacgacgcaaaatttgaaaagcagctgggccagataatgctccttattctgtgtacatctcagatcttgctgatgaggaccacttgggctctctgcgagagtatcaccctggccacaggtccattaactaccctttgggaagggtcgcctggaaaattctggaacacaacgattgcggtgagcatggccaatatcttccgcggctcctatctggccggtgctggcctcgccttttctctaatgaagtcactagggggaggccggcgagggaccggagcacaaggcgagactttgggtgagaagtggaaaagacagctgaaccagctcacaaagagcgagttcaatacctacaaaaggtccgggataatggaggtagatcgcagtgaagctaaggagggacttaaacggggcgaaactacaaagcatgccgtgtctagaggtaccgccaagctgcgttggtttgtcgagaggaacttggttaaacccgagggcaaggtgattgacctggggtgtggacggggcgggtggagctattactgcgcgggactcaaaaaggtcacggaagtgaaaggctataccaagggtgggccgggacacgaggaaccaatccctatggctacatacggctggaatttagtaaaactgcattcaggcaaggatgggttctttatgcccccagagaagtgtggaactcttctgtgcgacattggtgaatccagtcccaaccctaccatcgaggagggccgcacactacgagtgctcaaaatggttgaaccgtggctgagagggaatcagttctgtataaagatcttgaacccctacatgccaagcgtggtcgagactctggaacaaatgcagaggaaacacggaggcatgctcgtgcggaatcctctttctcgcaactccacccacgagatgtattgggtctcatgcggtacagggaatattgtgagcgcagttaacatgacctcgagaatgctgttaaacaggtttactatggcccatcgaaagcccacgtacgagcgggatgtagacctgggagctggcacacgtcacgtggccgtcgaacctgaggtggcaaatttggatatcattggccagagaatcgaaaacattaaaaatgagcataagtctacctggcactatgacgaagataacccatacaagacttgggcctatcacgggagttacgaggttaaaccctccggaagcgcttcatccatggtgaatggtgtcgtgcgcctcctgaccaagccttgggacgtaatcccaatggtgacacaaatagcgatgacggataccactcccttcggccagcagagggtttttaaagagaaggtcgacacacggaccccgagagccaaacgcgggactacacagattatggaagtgaccgcaaagtggctatggggattcctttctaggaacaagaaacctcgaatctgtacacgggaggaatttactagaaaggtgaggagcaatgctgccatcggcgcagtcttcgttgacgagaaccaatggaatagtgccaaagaagctgtggaggatgagcgcttttgggacctggtacatcgtgaacgggagctccacaagcagggtaaatgcgcaacctgcgtgtataacatgatggggaagagagaaaagaaactgggagagttcggcaaggcgaaaggctccagggcaatttggtacatgtggttgggggcccgcttcctggaatttgaggctctcggattcatgaatgaggatcattggtttagccgagaaaactctctttcaggtgtcgagggcgaagggctgcacaagttaggatacatactgcgggacatcagtaaaattccaggcggtaatatgtatgccgatgacacggcagggtgggataccagaatcacagaggacgatttgcagaacgaggctaagattactgacatcatggaacccgagcatgccctcctggctacctccatattcaaactaacataccagaataaggtggttagggtgcaacgccctgccaagaacggaactgtcatggatgtgatcagcagacgggaccagaggggctctggccaggtagggacctatggacttaacacgtttacaaatatggaagttcagctgattcgtcaaatggagtcggaaggtatcttcctcccatcagagctggagacccccaacttggcaaaacgagtgttagattggctggaaaagcacggcgcggagcgcctcaaaagaatggccattagcggggacgactgtgtcgtgaagccgatcgatgaccggtttgctactgcccttacagcactgaatgatatgggaaaagtgaggaaggacatacctcagtgggaaccctccaagggctggaacgattggcagcaggtcccattctgcagtcaccattttcaccaactaattatgaaagacggtcgcgagatcgttgtgccttgtagaaatcaggatgaactggtagggcgggctagggtgtctcagggagccggctggagcctccgagagaccgcatgcttgggcaagtcctacgcccaaatgtggcagctgatgtatttccatcgtagagaccttcgcctggcggctaacgccatctgttcagcagtccccgtggattgggttccaacaagtcggaccacatggtctattcacgcccaccatcagtggatgacgaccgaggacatgctcagcgtgtggaatagggtctggatagaagagaacccctggatggaagataaaactcacgtgtcctcatgggaggaagtaccttacttagggaagagagaggaccagtggtgcggaagcctgatcggtttgacagctcgcgccacctgggcaactaatattcaagttgctatcaaccaggtgcggaggctgattggcaatgagaactatctcgactacatgacatctatgaaacgatttaagaatgaatccgatccagagggggccctttggtga

SEQ ID NO: 13419 - RNA, 9879 nt, synthetic construct
  misc_feature 1..9879: note = derived and/or modified CDS sequence (opt3) from DENV-1__EU596503__SS-prME
  source 1..9879: mol_type = other RNA
agcgtgaccatgctgctcatgcttctgcccacagccttggctttccacttaactacgagaggcggggagcctcatatgatcgtctccaagcaggaaaggggaaaatctctgctatttaagacctcagcaggtgttaacatgtgcacactcattgccatggacctgggcgagctttgtgaagatactatgacctacaaatgcccacaaataacagaggcggaaccggacgatgtggactgttggtgcaatgctaccgatacttgggtaacatatgggacctgtagtcagacgggagagcaccggcgcgacaagcgaagcgtggccctggcaccccatgtcggcttgggtctcgagactcgtaccgaaacatggatgtcctctgagggggcctggaaacagatccagagagtggaaacttgggctctgaggcaccctggattcaccgttattgcactgtttctcgcccatgctatcggcacatcgattacccaaaagggcatcatattcatcttactgatgcttgtgacgccatcaatggccatgcggtgcgtcgggattggaaaccgcgattttgtggagggtttgagcggcgcgacttgggtagacgttgtgctggagcacgggagttgtgtcacaaccatggcaaagaataaacccactctagatatcgaactcctgaagacagaggtgaccaaccctgccattcttagaaaactgtgcatcgaagctaagatatccaatacgaccacagactctaggtgtccaactcagggagaggccaccttggtggaagagcaggatgcaaacttcgtctgccggcgcacatttgttgaccgaggctggggtaatgggtgtggactcttcggcaaaggcagcctgttaacttgcgctaagtttaagtgcgtgaccaaactggaggggaagattgtacagtacgaaaacctcaaatattccgtgatcgtcacagtgcacaccggagatcaacatcaggttggtaatgagactacggaacacggcacaattgccaccatcactccccaggcgcctacctcagagatccagcttacagactacggggccctgaccttggactgtagtccaagaactggactagatttcaacgaaatggtgctgctcacaatgaaggagaaaagctggctggtccataagcaatggtttcttgacctgccgttgccctggacgtctggcgcatccacctcacaggagacttggaataggcaggatctcctggtgacattcaaaaccgctcacgccaagaagcaagaagtagttgtgttaggtagccaggagggggctatgcacacagccctgactggcgcaaccgaaattcagacgagtggaaccacaactatatttgccggccatctaaaatgccggctcaagatggacaaactgacccttaaggggacatcttatgtcatgtgtatcggatccttcaaattggagaaggaagtggctgagactcagcacggtaccgtcctggtgcaagttaagtacgagggcacggatgcgccttgcaaaattccattcagcacacaggacgaaaagggggtgacccagaacggacgtctcatcactgcaaatcccatagtaacagataaagagaagcctgtcaacattgaaaccgagccaccctttggcgagtcgtatatcgtggttggtgccggggaaaaagctctgaagctttcttggttcaagaaaggctcctcaatcggaaagatgtttgaggccactgcacgcggcgccagaaggatggctattctgggggacaccgcctgggatttcggaagtatcggtggcatgtttacaagcgtggggaaattggtccatcaggtgttcggaacggcatacggcgtactcttttccggtgtgtcttggaccatgaagattgggataggcatcctgttaacttggctgggactaaatagccggtcaacaagtctctccatgacctgtattgcggttggcatggtcacactgtaccttggggtgatggtgcaagctgacagcggatgcgtcatcaactggaaaggccgagaattgaagtgtggttctgggatcttcgttactaacgaggtgcacacctggacggaacagtataagtttcaggccgattcaccgaaacgcctgagtgcagccattggaaaggcttgggaggagggcgtgtgcggtataagaagcgccacaaggctcgaaaatatcatgtggaaacagatttccaacgagctgaatcatatcttactggaaaacgacatgaagttcaccgtagtcgtgggcgacgcaaatgggattcttgctcaaggaaaaaagatgatccggcctcagcccatggagcacaaatactcttggaagtcgtggggcaaggccaaaataatcggggcggatattcagaacactacctttatcattgacggaccagatacacctgaatgtcccgacaatcagcgcgcctggaacatctgggaggttgaggattatggcttcggtatatttactaccaatatttggttgaagctcagagacagctacacacaaatgtgcgatcacaggctgatgtccgctgcaatcaaagactcaaaggccgtgcatgctgatatggggtattggattgaaagtgagaaaaacgaaacgtggaagctagcccgtgcatctttcatcgaggtcaagacctgtacttggccaaaaagccacacactgtggtccaatggagtgctcgaatcagagatgataatccccaagatttacggcggtcctatcagccagcataactatcggccaggctacttcacccagactgcggggccgtggcacctgggaaaacttgagttggactttgatctgtgcgaaggcacaaccgttgtggtagacgagcactgcgggaatcgaggaccctctttaagaacgactaccgtcacaggcaagattatccatgaatggtgttgcaggtcctgtaccctccctccactgcgcttccggggtgaggatgggtgctggtacggaatggagataagacccgtgaaagaaaaggaggaaaaccttgtgaggagtatggtcagcgccggctctggtgaggttgactccttttcactgggcattttgtgtgctagtatcatgatcgaagaggtgatgcgcagccgatggtcgcggaagatgctcatgactgggacactggccgtattcctactgctcattaccggacaactgacatggaatgaccttatccgtttgtgcattatggtgggcgcaaacgcttccgatagaatggggatgggaactacctatctggccttaatggcaacgtttaaaatgaggcctatgttcgccgtcggcctcctgtttcgccggcttacatctagagaggtgctgctactcaccataggtctgagcttggttgcttcagtggaactgccaaacagtttagaggaactcggggacggactggcgatgggcatcatgatgcttaagctgttgactgagttccagccccaccagctctggaccacactgctatccctgacttttattaaaaccacgctttctctcgattacgcctggaagacaaccgcaatggctctgagcatcgtctccttgttcccgctgtgtttatcaactacaagccagaaaaccacttggctccctgtgctgcttggcagttttgggtgcaagccactgacaatgttcttgattaccgaaaataagatctggggaaggaaatcttggcccctcaacgagggtataatggccatcggcattgtttccatcctgctaagctcgctgcttaagaatgacgtgcctctcgccgggcccctgattgctggaggcatgttgatcgcatgttatgtcatatcaggttctagtgccgatttatccctggagaaagcggctgaagtaagctgggagcaagaagccgagcattctgggacgagccacaacattctcgtggaagttcaggacgatggaactatgaagatcaaagacgaggagcgagatgacaccctgacaatccttctgaaggcaaccttgctagccgtgtccggcgtctacccaatgtcaattcctgctacactgtttgtgtggtatttctggcagaaaaagaagcagcgcagtggcgtactctgggatactcccagcccaccggaagtggagcgggcagtcctggacgatgggatatacagaatccttcaaaggggattactgggtcgttctcaggttggcgtgggggtgttccaggacggagtctttcataccatgtggcacgtgacgcgcggcgccgttctcatgtatcagggtaaacggttggaaccttcctgggcgtcagtaaagaaagacctgattagttacgggggaggctggagattccaaggcagctggaatacaggggaggaggtgcaggtcatcgctgtggaacccggaaagaacccaaaaaatgttcagactacccccggtacatttaagacccctgagggcgaagtgggggccattgcactcgatttcaagccaggaacttccggctctcccatcgtcaacagggagggtaaaatagtggggctgtacggaaatggcgtagtcaccacatcgggcacgtatgtgagcgccatcgctcaagccaaggcatcacaggaagggcctcttccggagattgaggacgaagtttttaaaaagcgaaacctgactatcatggatttgcacccaggatccggtaaaacccggcgctacctacccgctattgtgagagaggccatcaagaggaagctgcggacactcatattagcgcctacccgagtcgtggccagtgaaatggcagaggctctgaaaggcatgccaattagatatcagactacagccgttaagtctgaacataccgggcgcgagatcgtggaccttatgtgccacgctacgttcactatgaggctgctcagccccgtccgtgtgcctaattacaacatgatcattatggatgaggcacattttacagacccggcctccatcgccgctcggggatatatatcaaccagagtaggcatgggtgaagcggcagccattttcatgaccgctactcccccagggtctgtggaggcctttcctcagagcaatgcagttatccaagatgaagagagggacattcccgaacgcagttggaactccggatacgattggatcacagacttcccaggcaaaaccgtctggtttgtgcctagcataaagtctggcaatgatattgccaactgtttgcgaaaaaacgggaagagagtgatccagctgtcacggaagacattcgacactgagtatcagaaaacgaagaataacgactgggattacgtcgtaaccacagacatctccgagatgggagctaatttcagggcggatcgcgtgattgacccccgtagatgcctcaaaccagttatcctgaaggatggtccggaacgggtgattcttgccggccctatgcccgtcactgtggcaagtgctgcccagaggcgcgggcgaataggaagaaaccaaaataaagagggcgaccagtacgtttatatgggtcagccactaaacaatgatgaagaccacgcacattggaccgaggccaagatgctgttggataacatcaatacacccgaggggattatccctgctttatttgaaccagagcgggaaaagagcgccgcgatcgacggcgagtacaggctgcgcggagaagcaagaaaaaccttcgtggagctcatgaggcggggcgatctgcccgtctggctttcgtataaggtggcctctgaggggtttcagtactccgaccgtcgctggtgcttcgatggagaacgaaacaatcaagtactggaggaaaacatggacgtggagatttggactaaagaaggtgagagaaagaaactcaggcctcggtggttggacgctcgcacgtatagcgatccgctggccctaagagagtttaaggaattcgctgcaggcaggcggtcagttagtggggacctgatactcgagatcggaaaacttccacagcacctgaccttacgagcccagaatgctttggataacctggtcatgctccacaattctgaacagggcggtaaggcctacagacatgcaatggaggaactgcccgacacaattgagactcttatgctgctcgcgttgatcgccgtgctgaccgggggcgtgacattatttttcctatccggaaagggcctggggaaaaccagcattggactcctttgtgtcactgcttcaagtgccctgttgtggatggcaagcgttgagcctcactggatcgctgcctccataatcctggaatttttcctcatggtgctgcttattcccgagccagatcgccaaaggacacctcaggacaaccagctcgcatatgtagtgatcggtctgttgtttatgattctgacggtcgccgctaacgaaatgggcttactagagaccactaagaaagatctggggatcggacatgtggcggccgagaatcaccaacacgcaacaatgctcgacgttgatcttcggcccgcttctgcctggaccctgtacgccgtggcaaccacagtcataactccaatgatgcgtcatacgattgaaaacaccacagctaatatcagcttgactgccattgcgaaccaggctgccatcctgatgggcctcgacaagggttggcctatatccaaaatggatatcggggtaccgctgcttgcattaggctgctactcacaggtgaatcccctgaccctcacagccgctgttttgatgctggtggcacactatgccattatcggaccaggcctacaggcgaaggctaccagagaggcccaaaagaggactgcagccgggattatgaaaaaccctacggtcgacggaatcgtggctatagatctggaccccgtcgtgtacgacgccaagttcgaaaaacagctcggccagattatgcttctgatcttgtgtacatctcagatcctgctcatgcgcaccacttgggcactgtgcgagagtattaccttagctacaggtccacttactaccctgtgggaagggtcgcctggaaagttttggaatacaacgatcgccgttagcatggcgaacatattccggggctcctatctcgccggtgcaggcctagctttctctctgatgaaatcattggggggaggccgaagagggaccggagcccaaggcgagactctgggtgagaagtggaagaggcagctcaatcagcttagcaaatccgaatttaacacatacaagcgcagtgggattatggaggtggatcggtctgaagcaaaagagggactgaagagaggcgaaaccactaaacatgctgtaagccgtggtacagccaagttgaggtggttcgtggagcggaatctggtcaagcccgagggcaaagttatcgacctcgggtgtggacgcggcgggtggtcatattactgcgccggattaaagaaagtgaccgaagtcaagggctatacgaaaggtgggccgggacacgaggaaccaattcctatggcgacctacggctggaacctggtgaagcttcattccggcaaagatgtatttttcatgcccccagagaagtgtgacacactgctatgcgatatcggggaaagtagccccaatcctactatagaggagggacgaaccctcagagtgctgaagatggttgaaccgtggttgaggggtaaccagttttgtatcaaaattctgaatccctacatgccatctgtggtcgagacactcgaacaaatgcagcggaagcacggcgggatgcttgtgcgcaaccctctgtccagaaattcaactcacgagatgtattgggtcagctgcggaaccggcaacatcgtgtcggctgttaacatgacatctaggatgttactgaatcgattcaccatggcacatcggaaacccacttacgagcgtgacgtagatttgggtgccgggacgagacacgtggctgtcgaacctgaggtggccaacctcgacattatcggacagcgcattgaaaatatcaagaacgagcataaaagtacatggcactatgatgaagacaatccatacaagacctgggcatatcacggctcctacgaggttaagcccagcggctcagcctcctctatggtgaacggggtcgtgaggctgctaactaaaccttgggatgtaataccaatggtgacccaaattgctatgacagacacgaccccctttggacagcagcgggttttcaaggagaaagtcgacactagaacaccgcgcgcgaagaggggtaccactcagatcatggaagtgacagccaaatggctttggggctttctgagccgaaataagaagcctcggatctgtaccagagaggaattcacaaggaaagtgcgcagtaacgcagctattggggccgtctttgttgatgagaatcaatggaactccgcaaaggaagccgtggaggacgagcgtttctgggatctcgtacatcgggaaagagagctgcacaaacagggaaagtgcgctacttgcgtgtataatatgatgggcaaaagggaaaagaagttgggtgagtttgggaaagccaagggaagccgcgcgatatggtacatgtggctgggcgcacgattcctcgaattcgaggcccttggctttatgaacgaggaccattggttctctcgggaaaattcactgagtggggtcgagggagaaggtttacacaaactgggctacatcttgagagatatttccaagatcccagggggaaacatgtatgctgacgataccgccggctgggacacgaggattaccgaggatgacctccagaatgaggcaaaaatcacagatataatggaacccgagcatgctctgctagccactagcatctttaagcttacctaccagaacaaagtggttcgcgtgcaaagacctgctaagaacggtacagtcatggacgtgatttctcggagggatcagcgtgggtcgggacaggtaggcacttatggcctgaataccttcacgaacatggaagttcagctcatccgacaaatggagtcagaagggatttttctgccaagcgagttggagacacccaatttagccgaacgcgtgctggactggctcgagaagcacggagcagaaagacttaaacggatggcgatctccggtgacgattgtgtcgtgaagccgatagacgataggttcgccaccgctctgactgccctaaacgacatgggcaaagtgcgcaaggatattcctcagtgggagcccagtaaagggtggaatgactggcagcaggtcccattttgctctcaccatttccaccaactgatcatgaaggatggaagagaaatcgttgtgccttgtcggaaccaggacgagctcgtaggcagggcacgagtgagccagggtgctgggtggtccttgcgtgagacagcctgcctgggaaagtcatacgcacaaatgtggcagcttatgtattttcatagacgcgatctgcggctcgccgcgaatgctatttgtagtgccgtccccgtggactgggttccaacctctaggactacctggagcatacacgcacaccatcagtggatgacaacggaagatatgttatccgtgtggaacagagtctggatcgaggaaaatccctggatggaggacaaaacccacgtgtcaagctgggaagaggtaccttacctgggcaagcgcgaggaccagtggtgcggctctttgattgggctgactgcccgggctacatgggccaccaacatccaagttgcaattaatcaggtgaggcgactcatcggaaacgaaaattatcttgattacatgacttccatgaaaagattcaagaacgagagtgacccagaaggtgctctgtggtga

SEQ ID NO: 13420 - RNA, 9879 nt, synthetic construct
  misc_feature 1..9879: note = derived and/or modified CDS sequence (opt3) from DENV-1__FJ024479__SS-prME
  source 1..9879: mol_type = other RNA
agcgtgaccatgctgctcatgcttctgcccactgcattggctttccacttaactacgagaggaggggaacctcatatgatcgtctccaagcaggaaaggggaaaatctctgctatttaagacctcagccggtgttaacatgtgcacactcattgccatggacctgggcgaactttgtgaagatactatgacctacaaatgcccacagataaccgaagcggaaccggacgatgtggactgttggtgcaatgctaccgatacttgggtaacatatgggacctgtagtcagacgggagagcaccggcgcgacaagcgaagcgtggccctggcaccccatgtcggcttgggtctcgagactcgtaccgaaacatggatgtcctctgagggggcctggaaacagatccagcgggtggaaacttgggctctgaggcaccctggattcaccgttattgcactgtttctcgcccatgctatcggcacatcgattacccaaaagggcatcatattcatcttactgatgcttgtgacgccatcaatggccatgcggtgcgtcgggattggaaaccgcgattttgtggagggtttgagcggcgcgacttgggtagacgttgtgctggagcacgggagttgtgtcacaaccatggcaaagaataaacccactctagatatcgaactcctgaagacagaggtgaccaaccctgccattcttagaaaactgtgcatcgaagctaagatatccaatacgaccacagactctaggtgtccaactcagggagaggccaccttggtggaagaacaggatgcaaacttcgtctgccggcgcacatttgttgaccgaggctggggtaatgggtgtggactcttcggcaaaggcagcctgttaacttgcgctaagtttaagtgcgtgaccaaactggaggggaagattgtacagtacgaaaacctcaaatattccgtgatcgtcacagtgcacaccggagatcaacatcaggttggtaatgagactacggaacacggcacaattgccaccatcactccccaggcgcctacctcagagatccagcttacagactacggggccctgaccttggactgtagtccaagaactggactagatttcaacgaaatggtgctgctcacaatgaaggagaaaagctggctggtccataagcaatggtttcttgacctgccgttgccctggacgtctggcgcatccacctcacaggagacttggaataggcaggatctcctggtgacattcaaaaccgctcacgccaagaagcaagaagtagttgtgttaggtagccaggagggggctatgcacacagccctgactggcgcaaccgaaattcagacgagtggaaccacaactatatttgccggccatctaaaatgccggctcaagatggacaaactgacccttaaggggacatcttatgtcatgtgtactggatccttcaaattggagaaggaagtggctgagacccagcacggtacggtcctggtgcaagttaagtacgagggcacagatgcgccttgcaaaatcccattcagcacccaggacgaaaagggggtgactcagaacggacgtctcattacagcaaatcccatcgtaaccgataaagagaagcctgtcaacatagaaactgagccaccctttggcgagtcgtatattgtggttggtgccggggaaaaagctctgaaactttcttggttcaagaaaggctcctcaatcggaaagatgtttgaggccaccgcacgcggcgccagaaggatggctatcctgggggacacagcctgggatttcggaagtattggtggcgtgtttacgagcgtcgggaaattggtgcatcaggtattcggaaccgcatacggcgtgctcttttccggtgtttcttggactatgaagatcgggattggcatactgttaacatggctgggactaaatagccggtcaaccagtctctccatgacatgtatcgcggtcggcatggtgactctgtaccttggggtgatggtccaagctgacagcggatgcgttattaactggaaaggccgagaattgaagtgtggttctgggatcttcgtgaccaacgaggtgcacacgtggacagaacagtataagtttcaggccgattcaccgaaacgcctgagtgcagccatcggaaaggcttgggaggagggcgtatgcggtattagaagcgccaccaggctcgaaaatataatgtggaaacagatctccaacgagctgaatcatattttactggaaaacgacatgaagttcactgtcgtggttggcgacgcaaatgggatccttgctcaaggcaagaagatgattcggcctcagcccatggagcacaaatactcttggaagtcgtggggcaaggccaaaatcataggggcggatatccagaacaccacatttattatcgacggaccagatactcctgaatgtcccgacaatcagcgcgcctggaacatttgggaggtggaggattatggcttcggatttttcaccacaaatatctggttgaagctcagagacagctacacgcaaatgtgcgatcacaggctgatgtccgctgcaataaaagactcaaaggccgtccatgctgatatggggtattggattgaaagtgagaaaaacgaaacctggaagctagcccgtgcatctttcatcgaggtgaagacttgtacatggccaaaaagccacaccctgtggtccaatggagttctcgaatcagagatgattatccccaagatatacggcggtcctatcagccagcataactatcggccaggctactttactcagacagcggggccgtggcacctgggaaaacttgagttggacttcgatctgtgcgaaggcaccacggtggtagtcgacgagcactgcgggaatcgaggaccctctttaagaactaccacagtgaccggcaagattatccatgaatggtgttgcaggtcctgtactctccctccactgcgctttcggggtgaggatgggtgctggtacggaatggagattagacccgtgaaagaaaaggaggaaaaccttgtcaggagtatggttagcgccggctctggtgaggtggactccttctcactgggcatcttgtgtgctagtataatgattgaagaggtaatgcgcagccgatggtcgcggaagatgctcatgacagggaccctggccgtgtttctactgctcatcatgggacaactgacatggaatgaccttatccgtttgtgcattatggtcggcgcaaacgcttccgatagaatggggatgggaactacctatctggccttaatggcaacgttcaaaatgaggcctatgtttgccgtgggcctcctgttccgccggcttacatctagagaggttctgctactcaccatcggtctgagcttggtggcttcagtcgaactgccaaacagtttagaggaactcggggacggactggcgatgggcattatgatgcttaagctgttgactgagtttcagccccaccagctctggaccacactgctatccctgactttcataaaaaccacgctttctctcgattacgcctggaagacagcagctatggccctgagcatcgtgtccttgtttccgctgtgtttatcaaccactagccagaaaacaacctggctccctgttctgcttggcagtttcgggtgcaagccactgactatgtttttgattacagaaaataagatctggggaaggaaatcttggcccctcaacgagggtattatggccatcggcatagtgtccatcctgctaagctcgctgcttaagaatgacgtccctctcgctgggcccctgattgcaggaggcatgttgatcgcctgttatgtaatttcaggttctagtgcggatttatccctggagaaagctgccgaagtgagctgggagcaagaagcagagcattctgggaccagccacaacatcctcgttgaagtgcaggacgatggaacgatgaagataaaagacgaggagcgagatgacactctgaccattcttctgaaggccacattgctagctgtctccggcgtgtacccaatgtcaatccctgcaaccctgttcgtatggtatttctggcagaaaaagaagcagcgcagtggcgtgctctgggatacacccagcccaccggaagtcgagcgggccgttctggacgatgggatctacaggattcttcaacgaggattactgggtcgttctcaggtgggcgtgggggtctttcaggacggagtgttccatactatgtggcacgttacccgcggcgcggtactcatgtatcagggtaaacggttggaaccttcctgggcttcagtgaagaaagacctgataagttacgggggaggctggagatttcaaggcagctggaatacgggggaggaggtccaggtgatcgccgttgaacccggaaagaaccccaagaatgtgcagacaactcccggtaccttcaagacacctgagggcgaagtcggggcaattgccctcgattttaagccaggaacctccggctctcccatcgtgaacagggagggtaaaattgtagggctgtacggaaatggcgtcgtgactacctcgggcacatatgttagcgctatcgcccaagcaaaggcttcacaggaagggcctcttccggagatagaggacgaagtgttcaaaaagcgaaacctgacgatcatggatttgcacccaggatccggtaaaactcggcgctacctacccgccattgtcagagaggcgatcaagaggaagctgcggaccctcattttagcccctacacgagtggttgcaagtgaaatggctgaggccctgaaaggcatgccaatcagatatcagaccactgctgtgaagtctgaacatacagggcgcgagatagtcgaccttatgtgccacgcaacctttacgatgaggctgctcagccccgtgcgtgtacctaattacaacatgattatcatggatgaggcccatttcactgacccggcctccatcgctgcgcggggatatatttcaacaagagtgggcatgggtgaagcagccgctatctttatgaccgccacacccccagggtctgttgaggcattccctcagagcaatgccgtcatacaagatgaagagagggacattcccgaacgcagttggaactccggatacgattggatcactgactttccaggcaaaacagtgtggttcgtgcctagcattaagtctggcaatgatatcgctaactgtttgagaaagaacgggaaaagagtcatacagctgtcacggaagaccttcgacacagagtatcagaaaactaagaataacgactgggattacgtagtgacgaccgacatttccgagatgggagcgaattttagggccgcacgcgttatcgatccccgtagatgcctcaaaccagtgatcctgaaggacggtccggaacgggtcattcttgctggccctatgcccgtgacagttgccagtgcagcccagaggcgcgggcgaatcggaagaaaccaaaataaagagggcgatcagtacgtgtatatgggtcagccactaaacaatgacgaagatcacgctcattggactgaggccaagatgctgttggacaacattaccacacccgaggggataatccctgcgttattcgaaccagagcgggaaaagagcgcagccattgatggcgagtcgaggctgcgcggagaacccagaaaaacctttgtcgagctcatgaggcggggcgacctgcctgtgtggctttcttacaaggtagcttccgaggggttccagtatagcgatcgtcgctggtgctttgacggagaacgaaataaccaagtgctggaggaaaatatggatgttgagatctggccgaaagaaggtgagagaaagaaactcaggccacggtggttggacgcccgcacttactcagaccccctggctctaggcgagttcaaggaatttggggcaggaagaaggagtggctctggtgccctgatcctcgagattgggaaacttcctcagcatctgccattacgggctcagaacggcttggataatctggtcatggtgcacaactccgaacagggaggcaaggcctatcgacacgcaatggaggaactcccagacacgatagagaccctgatgcttctggcgctcatcgccgtgttgacagggggagtcactctgttctttttaagcggtaagggcctagggaaaacctcaattggactgctctgtgttacagctagtagcgcccttctgtggatggcatccgtggagcctcactggatcgctgcctctattatcttggagttctttctgatggtactcctgatacccgagccagatagacaacgcacccctcaggacaatcagcttgcatacgtggtcatcggcctcctgttcatgattttgactgtggccgctaacgaaatgggtctgttagagacaacgaagaaagatctagggatcggccatgttgcggccgagaaccaccaacacgcaaccatgctggacgtggatctcaggccggctagcgcctggactctttatgccgtcgcaacaaccgtaattacccccatgatgcggcatacaatcgaaaatactacggctaacatatccctgaccgccattgcgaatcaggctgccatcttgatgggactggcaaagggctggccaatttcaaaaatggacatcggggtgcctctcctggcccttggatgctactctcaggttaaccccttaacactgactgctgcagtgctcatgttggtcgcccactacgcgataatcggcccaggtctgcaggctaaggccacccgtgaggcacaaaagagaacagccgctgggattatgaaaaatcctaccgtggatggaatcgtcgccattgacctagatcccgtggtttatgacgcaaagtttgaaaaacagctgggccagatcatgctccttatactgtggacgagtcagattttgctgatgaggactacatgggctctcggtgagtcgatcaccctggccactggcccgttaaccacactttgggaagggagcccaggaaagttctggaacactaccatcgcggtgtccatggccaatattttccgcggctcttacctggcaggggctggactcgccttttcactaatgaaaagcctgggcggtgggcggcgaggaacaggcgcacaaggtgagacgttgggcgagaagtggaagagacagctgaaccagctctccaaaagtgagttcaatacctataagaggtctgggatcatggaggtagatcgcagcgaagctaaagagggacttaagcggggcgaaactacaaaacatgccgtgtcaagagggaccgccaagctgcgttggtttgtcgagaggaacttggttaatcctgagggaaaggtgatagacctgggctgtggtagagggggttggtcctactattgcgcgggcctcaaaaaggtcactgaagtgaaaggctacacaaaagggggacccggtcacgaggaaccaattcccatggctacctatggctggaacttagtaaaactgcatagtgggaaggacgtgttctttatccctccggagaaatgtgatacgcttctgtgcgacattggagaaagctctcccaatccaaccatcgaggagggccgcacactacgaggtctcaagatggttgaaccttggctgagagggaaccagttctgtataaagatcttgaatccctacatgccttccgtggtcgagactctggaacaaatgcagaggaaacacggaggcatgctcgtgcggaacccactttcacgcaatagcacccacgagatggattgggtctcgtgcggcacagggaacattgtgtctgcagttaacatgacaagtagaatgctgttaaataggtttaccatggcccatcgaaagcccacatacgagcgggacgtagatctgggagctggtacccgtcacgtggccgtcgaacctgaggtggcaaacttggacatcattggccagagaatcgaaaatattaaaaacgagcataagtccacttggcactatgatgaagacaatccatacaaaacgtgggcctatcacgggagctacgaggttaagccctcaggatccgcttctagcatggtgaacggcgtcgtgcgcctcctgacaaagccgtgggatgtaatccctatggtgacccaaatagcgatgactgacaccacaccattcggtcagcagagggtttttaaagagaaggtcgatacgcggacccccagagccaaacgcgggactacacagattatggaagtgaccgcaaagtggctatggggattccttagtaggaataaaaagcctcgaatctgtactcgggaggaatttacaagaaaggtgaggtccaacgctgccatcggcgcagtcgttgtggacgagaatcaatggaacagcgccaaagaagctggcgaggacgagcgcgtatgggatctgggggaccgtgaacgggagctccataagcagggaaaatgcgccacctgtggttataatatgatgggcaagagagagaaaaagctgggggagttcggaaaggcgaaaggctctagggcaatttggtacatgtggttgggtgcccgctttctggagttcgaggctctcgggttcatgaacgaggatcactggttttcacgagaaaatagtctttccggagtggagggcgaaggcctgcataagttagggtatatactgcgggacatcagcaaaattccaggaggtaacatgtacgccgatgacacagcaggctgggatactagaatcaccgaggacgatttgcagaatgaggctaagattacggacatcatggaacccgagcacgccctcctggctacctctatattcaaactaacataccagaacaaggtcgtgagggttcaacgcccggccaaaaacgggactgtgatggatgtcatctcgagacgggcacagaggggatcaggccaggtgggtacctatgggcttaatacatttactaacatggaagtacagctgattcgtcaaatggagagcgaaggaatcttcctcccttccgagctggagacccccaatttggcggaacgagttttagactggctggagaagcatggcgccgaacgcctcaagagaatggctattagtggcgatgactgcgtggtcaaaccaatcgacgatcggtttgccacggcacttacagctctgaacgacatggggaaggtgaggaaagatatacctcagtgggagccctctaagggatggaatgactggcaacaggtggccttctggagccaccactttcatcaactaattatgaaagatggtcgcgaaatcgtcgttccatgcagaaaccaggacgagctgggcgggcgggcaagggtgtcccagggagccggctggtcactccgagagaccgcgtgtttgggtaagagttacgctcaaatgtggcagctgatgtatttccaccgtagagatcttcgcctggccgcaaatgccatctgctctgctgtacccgtggactgggtccctactagccggacaacctggtccattcatgcccaccaccagtggatgactaccgaagatatgctctcagtgtggaacagggtttggatagaggaaaatccatggatggaggacaagacacatgtgagctcttgggaagaggtcccgtacttagggaaaagagaggatcagtggtgtggatccctgatcggcttgacggcacgcgctacctgggccactaacattcaagtggcgatcaatcaggtacggaggctgattggcaacgaaaattatctcgactacatgacaagtatgaagcgatttaaaaacgagagcgaccccgaaggggctctttggtga

SEQ ID NO: 13421 - RNA, 9879 nt, synthetic construct
  misc_feature 1..9879: note = derived and/or modified CDS sequence (opt3) from DENV-1__FJ182002__SS-prME
  source 1..9879: mol_type = other RNA
agcgtgaccatgctgctcatgcttctgccaacagcattggctttccacttaactacgcgaggaggggaacctcatatgatcgtctccaagcaggaaaggggaaaatctctgctatttaagacctcagccggtgttaacatgtgcacactcattgccatggacctgggcgaactttgtgaagatactatgacctacaaatgcccacaaataacagaggcggaaccggacgatgtggactgttggtgcaatgctaccgatacttgggtaacatatgggacctgtagtcagacgggagagcaccggcgcgacaagcgaagcgtggccctggcaccccatgtcggcttgggtctcgagactcgtaccgaaacatggatgtcctctgagggggcctggaaacagatccagagagtggaaacttgggctctgaggcaccctggattcaccgttattgcactgtttctcgcccatgctatcggcacatcgattacccaaaagggcatcatattcatcttactgatgcttgtgacgccatcaatggccatgcggtgcgtcgggattggaaaccgcgattttgtggagggtttgagcggcgcgacttgggtagacgttgtgctggagcacgggagttgtgtcacaaccatggcaaagaataaacccactctagatatcgaactcctgaagacagaggtgaccaaccctgccattcttagaaaactgtgcatcgaagctaagatatccaatacgaccacagactctaggtgtccaactcagggagaggccaccttggtggaagaacaggatgcaaacttcgtctgccggcgcacatttgttgaccgaggctggggtaatgggtgtggactcttcggcaaaggcagcctgttaacttgcgctaagtttaagtgcgtgaccaaactggaggggaagattgtacagtacgaaaacctcaaatattccgtgatcgtcacagtgcacaccggagatcaacatcaggttggtaatgagactacggaacacggcacaattgccaccatcactccccaggcgcctacctcagagatccagcttacagactacggggccctgaccttggactgtagtccaagaactggactagatttcaacgaaatggtgctgctcacaatgaaggagaaaagctggctggtccataagcaatggtttcttgacctgccgttgccctggacgtctggcgcatccacctcacaggagacttggaataggcaggatctcctggtgacattcaaaaccgctcacgccaagaagcaagaagtagttgtgttaggtagccaggagggggctatgcacacagccctgactggcgcaaccgaaattcagacgagtggaaccacaactatatttgccggccatctaaaatgccggctcaagatggacaaactgacccttaaggggacatcttatgtcatgtgtactggatccttcaaattggagaaggaagtggctgagacccagcacggtacggtcctggtgcaagttaagtacgagggcacagatgcgccttgcaaaatcccattcagcacccaggacgaaaagggggtgactcagaacggacgtctcattacagcaaatcccatcgtaaccgataaagagaagcctgtcaacatagaaactgagccaccctttggcgagtcgtatattgtggttggtgccggggaaaaagctctgaaactttcttggttcaagaaaggctcctcaatcggaaagatgtttgaggccaccgcacgcggcgccagaaggatggctatcctgggggacacagcctgggatttcggaagtattggtggcgtgtttacgagcgtcgggaaattggtgcatcaggtattcggaaccgcatacggcgtgctcttttccggtgtttcttggactatgaagatcgggattggcatactgttaacatggctgggactaaatagccggtcaaccagtctctccatgacatgtatcgcggtcggcatggtgactctgtaccttggggtgatggtccaagctgacagcggatgcgttattaactggaaaggccgagaattgaagtgtggttctgggatcttcgtgaccaacgaggtgcacacgtggacagaacagtataagtttcaggccgattcaccgaaacgcctgagtgcagccatcggaaaggcttgggaggagggcgtatgcggtattagaagcgccaccaggctcgaaaatataatgtggaaacagatctccaacgagctgaatcatattttactggaaaacgacatgaagttcactgtcgtggttggcgacgcaaatgggatccttgctcaaggcaagaagatgattcggcctcagcccatggagcacaaatactcttggaagtcgtggggcaaggccaaaatcataggggcggatatccagaacaccacatttattatcgacggaccagatactcctgaatgtcccgacaatcagcgcgcctggaacatttgggaggtggaggattatggcttcggtatctttaccacaaatatatggttgaagctcagagacagctacacgcaaatgtgcgatcacaggctgatgtccgctgcaattaaagactcaaaggccgtccatgctgatatggggtattggatcgaaagtgagaaaaacgaaacctggaagctagcccgtgcatctttcattgaggtgaagacttgtacatggccaaaaagccacaccctgtggtccaatggagttctcgaatcagagatgatcatacccaagatctacggcggtcctattagccagcataactatcggccaggctacttcactcagacagcggggccgtggcacctgggaaaacttgagttggactttgatctgtgcgaaggcaccacggtggtagtcgacgagcactgcgggaatcgaggaccctctttaagaactaccacagtgaccggcaagatcattcatgaatggtgttgcaggtcctgtactctccctccactgcgcttccggggtgaggatgggtgctggtacggaatggagatcagacccgtgaaagaaaaggaggaaaaccttgtcaggagtatggttagcgccggctctggtgaggtggactccttttcactgggcatattgtgtgctagtattatgatcgaagaggtaatgcgcagccgatggtcgcggaagatgctcatgacagggaccctggccgtgttcctactgctcatcacaggacaactgacttggaatgaccttattcgtttgtgcatcatggtcggcgcaaacgcttccgatagaatggggatgggaaccacgtatctggccttaatggcaacatttaaaatgaggcctatgttcgccgtgggcctcctgtttcgccggcttacctctagagaggttctgctactcactattggtctgagcttggtggcttcagtcgaactgccaaacagtttagaggaactcggggacggactggcgatgggcataatgatgcttaagctgttgaccgagttccagccccaccagctctggacaactctgctatccctgacctttatcaaaacgacactttctctcgattacgcctggaagaccactgcaatggctctgagcattgtgtccttgttcccgctgtgtttatcaacaaccagccagaaaactacatggctccctgttctgcttggcagttttgggtgcaagccactgaccatgttcttgatcacggaaaataagatttggggaaggaaatcttggcccctcaacgagggtatcatggccataggcatcgtgtccattctgctaagctcgctgcttaagaatgacgtccctctcgccgggcccctgatcgctggaggcatgttgattgcatgttatgtaatctcaggttctagtgccgatttatccctggagaaagcggctgaagtgagctgggagcaagaagccgagcattctgggactagccacaacatactcgttgaagtgcaggacgatggaaccatgaagattaaagacgaggagcgagatgacacactgaccatccttctgaaggcaacattgctagccgtctccggcgtgtacccaatgtcaatccctgctactctgtttgtatggtatttctggcagaaaaagaagcagcgcagtggcgtgctctgggatacccccagcccaccggaagtcgagcgggcagttctggacgatgggatttacagaatacttcaaaggggattactgggtcgttctcaggtgggcgtgggggtcttccaggacggagtgtttcatacgatgtggcacgttacacgcggcgccgtactcatgtatcagggtaaacggttggaaccttcctgggcgtcagtgaagaaagacctgatcagttacgggggaggctggagattccaaggcagctggaatactggggaggaggtccaggtgattgctgttgaacccggaaagaaccccaaaaatgtgcagaccacacccggtacctttaagactcctgagggcgaagtcggggccatcgcactcgatttcaagccaggaacctccggctctcccattgtgaacagggagggtaaaatcgtagggctgtacggaaatggcgtcgtgacaacgtcgggcacttatgttagcgccatagctcaagccaaggcatcacaggaagggcctcttccggagatcgaggacgaagtgtttaaaaagcgaaacctgaccattatggatttgcacccaggatccggtaaaacacggcgctacctacccgctatcgtcagagaggccattaagaggaagctgcggaccctcatcttagcgcctactcgagtggttgccagtgaaatggcagaggctctgaaaggcatgccaataagatatcagacaaccgccgtgaagtctgaacatacggggcgcgagattgtcgaccttatgtgccacgctactttcacaatgaggctgctcagccccgtgcgtgtacctaattacaacatgatcatcatggatgaggcacattttaccgacccggcctccattgccgctcggggatatatctcaaccagagtgggcatgggtgaagcggcagccatattcatgactgctacacccccagggtctgttgaggcctttcctcagagcaatgcagtcattcaagatgaagagagggacatccccgaacgcagttggaactccggatacgattggattaccgacttcccaggcaaaacagtgtggtttgtgcctagcatcaagtctggcaatgatatagccaactgtttgcggaaaaacgggaagagagtcattcagctgtcaagaaagactttcgacacggagtatcagaaaaccaagaataacgactgggattacgtagtgacaactgacatctccgagatgggagctaatttcagggcggatcgcgttatcgacccccgtagatgcctcaaaccagtgattctgaaggatggtccggaacgggtcatccttgccggccctatgcccgtgaccgttgcaagtgctgcccagaggcgcgggcgaattggaagaacacaaaccaaagagggcgaccagtacgtgtatatgggtcagccactaaacaatgatgaagaccacgcacattggactgaggccaagatgctgttggctaacataaatacgcccgaggggatcattcctgccttatttgaaccagagcgggaaaagagccccgcgatcgatggcgagtacaggctgcgcggagaagcaagaaaaaccttcgtcgagctcatgaggcggggcgacctgcctgtgtggctttcgtataaggtagcctctgaggggtttcagtactccgatcgtcgctggtggttcgacggagaacgaaacaatcaagtgctggaggaaaacatggatgttgagatctggacaaaagaaggtgagagaaagaaactcaggccgcggtggttggacgctcgcacttatagcgacccactggccctaggcgagtttaaggagttcggggctggaagaaggtcaggcagtggtgatctgattctcgagatagggaaacttccccagcacctgaccttacgggcacagaatggcttggacaacctggtcatggtgcacaattctgaacagggaggcaaggcctaccgacatgctatggaggaactccctgatacaatcgagaccctgatgcttctggccctcattgcagtgttgactgggggagtcacactgtttttcttatccggtaagggcctagggaaaacgagcatcggactgctctgcgttaccgcgtcaagtgcccttctgtggatggctagcgtggagccccactggattgccgcatccatcatattggaatttttcctgatggtactcctgatcccagagcctgacagacaacgcactccccaggataaccagcttgcttatgtggtcattggcctcctgtttatgatcttgacagtggccgcaaatgaaatgggtctgttagagaccaccaagaaagacctagggattggccatgttgccgctgagaaccaccaacacgcgacaatgctggatgtggacctcaggccagcctctgcatggactctttacgctgtcgccacgaccgtaatcacacctatgatgcggcatactatagaaaacaccacagccaatattagcctgaccgcaatcgctaaccaggccgcgattttgatgggactggataagggctggccgatctccaaaatggacataggggtgcccctcctggctcttggatgttactcacaggttaatccattaactctgacggccgcagtgctcatgttggtcgcccactatgctatcattggccctggtctgcaggcaaaggccacacgtgaggcgcaaaagagaaccgctgccgggatcatgaaaaaccccactgtggatggaattgtcgcaatcgacctagatccagtggtttacgacgccaagttcgaaaaacagctgggccagataatgctccttattctgtgcacctctcagatcttgctgatgaggacaacttgggctctctgtgagagtatcaccctggccacaggtcctttaacgaccctttgggaaggctcgcccgggaagttttggaatactacaattgcagtgagcatggctaacatcttccgcggatcctatctggccggcgcggggctcgccttctctctaatgaaatcactgggaggcggtcggcgagggaccggagcacaaggcgagactttgggtgagaagtggaagagacagctgaatcagctcagcaaatccgaatttaacacatacaagaggagtggcataatggaggtagaccgctctgaagctaaagaggggcttaagcggggagaaaccacgaaacatgccgtgagcagaggcaccgcaaagctgcgttggttcgtcgagaggaatttggttaagccggaggggaaagtgattgatctgggatgcggccggggtgggtggtcatattactgtgctggactcaagaaagtcacagaagtgaagggctatactaaaggcgggccaggacacgaggaacctatccccatggccacctacggttggaacttagtaaagctgcattccggcaaagacgtgtttttcatgccacccgagaagtgcgatacacttctgtgtgacattggggaaagtagccctaatccgactatcgaggagggacgcaccctacgagttctcaagatggtggaaccctggctgagaggcaaccagttttgcataaaaatcttgaatccatacatgccttctgtcgtggagacactggaacaaatgcagaggaagcacggtgggatgctcgtccggaaccccctttcccgcaattcaacccacgagatgtattgggtgagctgtggaactggcaacattgtttcggccgtaaatatgacgtctagaatgctgttaaacaggttcacaatggcgcatcgaaaacctacctacgagcgggatgtggacctgggcgctgggactcgtcacgtcgcagtggaaccagaggttgccaacttggatatcattggacagagaatcgaaaatattaagaacgagcataaaagtacctggcactatgacgaagataatccctacaagacatgggcttatcacggttcctacgaggtgaagcctagcggctcagcctcctctatggtcaacggggtggtacgcctcctgacgaaaccatgggacgtgatccccatggttacccaaatagcaatgactgatacaaccccgtttggacagcagagggtcttcaaggagaaagtggacactcggacacctagagccaagcgcggcaccacacagattatggaagtgactgctaaatggctatggggttttcttagcaggaataagaagccacgaatctgcacccgggaggagttcacgagaaaagtcaggagtaacgcggccatcggggcagtttttgtggacgagaatcaatggaactccgctaaggaagccggagaggatgagcgcgtatgggacctggtggatcgtgaacgggagctccataaacagggcaagtggggcaccgggggatataatatgatgggtaaaagagaaaagaagctgggcgagttcgggaaagcaaagggaagcaggggcatttggtacatgtggttgggtgcccgctttctggagttcgaggctctcgggttcatgaacgaggaccactggttttctcgagaaaattcacttagtggagtcgagggcgaaggcctgcataaattagggtacatactgcgggatatctccaagattcccggaggtaacatgtatgccgacgatacagcgggctgggacactagaatcaccgaggatgacttgcagaatgaggcaaaaattacagatatcatggaacctgagcacgccctcctggctactagcatattcaagctaacctaccagaacaaagtggttagggtgcaacgcccagccaagaatgggacggtcatggacgtgatctctagacgggatcagaggggatcgggccaggtaggtacatatgggcttaacacctttactaacatggaagttcagctgattcgtcaaatggagtcagaaggaatcttcctccccagcgagctggagacaccgaatttggcagaacgagtgttagactggctggagaagcatggcgctgaacgcctcaaaagaatgcctatttccggcgacgattgtgtcgtgaagcccatcgacgatcggtttgccaccgctcttactgccctgaacgacatggggaaagtgaggaaggatataccacagtgggagcctagtaaaggatggaatgactggcagcaggtccccttctggtctcaccactttcatcaactaattatgaaggatggtcgcgaaatcgttgtgccatgcagaaaccaggacgagctggtaggccgggcaagggtgagccagggggcgggatggtccctccgagagaccgcctggttgggcaagtcatacgctcaaatgggtcagctgatgtatttccaccgtagagatcttcgcctggccgcaaatgctatctggagtgccgggcccggagactgggtccctacatctcggacgacctggagcattcatgcacaccaccagtggatgactacagaagatatgctctccgtgtggaacagggtttggatagaggaaaatccatggatggaggacaaaacccatgtgtcaagctgggaagaggtcccgtacttaggcaagagagaggaccagtggtgcggctctctgatcgggttgactgcccgcgcgacatgggctaccaacattcaagtggccatcaatcaggtacggaggctgattggaaacgaaaattatctcgattacatgacgtccatgaaacgatttaagaacgagagtgaccccgaaggtgcactttggtga

SEQ ID NO: 13422 - RNA, 9879 nt, synthetic construct
  misc_feature 1..9879: note = derived and/or modified CDS sequence (opt3) from DENV-1__FJ024482__SS-prME
  source 1..9879: mol_type = other RNA
agcgtgaccatgctgctcatgcttctgccaacagcattggctttccacttaactacgcgaggcggggaacctcatatgatcgtctccaagcaggaaaggggaaaatctctgctgtttaagacctcagccggtgttaacatgtgcacactcattgccatggacctgggcgaactttgtgaagatactatgacctacaaatgcccacagataacagaggcggaaccggacgatgtggactgttggtgcaatgctaccgatacttgggtaacatatgggacctgtagtcagacgggagagcaccggcgcgacaagcgaagcgtggccctggcaccccatgtcggcttgggtctcgagactcgtaccgaaacatggatgtcctctgagggggcctggaaacagatccagagagtggaaacttgggctctgaggcaccctggattcaccgttattgcactgtttctcgcccatgctatcggcacatcgattacccaaaagggcatcatattcatcttactgatgcttgtgacgccatcaatggccatgcggtgcgtcgggattggaaaccgcgattttgtggagggtttgagcggcgcgacttgggttgacgttgtgctggagcacgggagttgtgtcacaaccatggcaaagaataaacccactctagatatcgaactcctgaagacagaggtgaccaaccctgccattcttagaaaactgtgcatcgaagctaagatatccaatacgaccacagactctaggtgtccaactcagggagaggccaccttggtggaagaacaggatgcaaacttcgtctgccggcgcacatttgttgaccgaggctggggtaatgggtgtggactcttcggcaaaggcagcctgttaacttgcgctaagtttaagtgcgtgaccaaactggaggggaagattgtacagtacgaaaacctcaaatattccgtgatcgtcacagtgcacaccggagatcaacatcaggttggtaatgagactacggaacacggcacaattgccaccatcactccccaggcgcctacctcagagatccagcttacagactacggggccctgaccttggactgtagtccaagaactggactagatttcaacgaaatggtgctgctcacaatgaaggagaaaagctggctggtccataagcaatggtttcttgacctgccgttgccctggacgtctggcgcatccacctcacaggagacttggaataggcaggatctcctggtgacattcaaaaccgctcacgccaagaagcaagaagtagttgtgttaggtagccaggagggggctatgcacacagccctgactggcgcaaccgaaattcagacgagtggaaccacaactatatttgccggccatctaaaatgccggctcaagatggacaaactgacccttaaggggacatcttatgtcatgtgtactggatccttcaaattggagaaggaagtggctgagacccagcacggtacggtcctggtgcaagttaagtacgagggcacagatgcgccttgcaaaatcccattcctcacccaggacgaaaagggggtgactcagaacggacgtctgattacagcaaatcccatcgtaaccgataaagagaagcctgtcaacatagaaactgagccaccctttggcgagagctatattgtggttggtgccggggaaaaagctcttaagctgtcgtggttcaagaaaggatcttccatcggaaagatgtttgaggccaccgcacgcggcgccagaaggatggctatcttgggggacacagcctgggatttcggatcaattggtggcgtgtttacgagtgtcgggaaactcgtgcatcaggtattcggaaccgcatacggcgtgctgtttagcggtgtttcctggactatgaagatcgggattggcatattactgacatggctaggactcaattctcggagcacctcactgagtatgacatgtatcgcggtcggcatggtgactctttacttgggggtgatggtccaagctgactccggatgcgttattaactggaaaggccgagaactgaagtgtggtagcgggatcttcgtgaccaacgaggtgcacacgtggacagaacagtataagtttcaggccgattctccgaaacgcctctcagcagccatcggaaaggcttgggaggagggcgtatgcggtattagaagtgccaccaggctggaaaatataatgtggaaacagatcagcaacgagttaaatcatattctgcttgaaaacgacatgaagttcactgtcgtggttggcgacgcaaatgggatcttggctcaaggcaagaagatgattcggcctcagcccatggagcacaaatactcctggaagtcttggggcaaggccaaaatcataggggcggatatccagaacaccacatttattatcgacggaccagatactcctgaatgtcccgacaatcagcgcgcctggaacatttgggaggtggaggattatggcttcggtatctttaccacaaatatatggctcaagctgagagactcgtacacgcaaatgtgcgatcacaggctaatgagcgctgcaattaaagactccaaggccgtccatgctgatatggggtattggatcgaatcagagaaaaacgaaacctggaagctggcccgtgcaagtttcattgaggtgaagacttgtacatggccaaaatctcacaccctctggagcaatggagttctggaatccgagatgatcatacccaagatctacggcggtcctatttcacagcataactatcggccaggctacttcactcagacagcggggccgtggcaccttggaaaattggagctggactttgatttatgcgaaggcaccacggtggtagtcgacgagcactgcgggaatcgaggacccagcctcagaactaccacagtgaccggcaagatcattcatgaatggtgttgcaggtcttgtactctgcctccacttcgcttccggggtgaggatgggtgctggtacggaatggagatcagacccgtgaaagaaaaggaggaaaacctggtcaggtccatggttagtgccggcagcggtgaggtggactctttttccttgggcatactctgtgcttcaattatgatcgaagaggtaatgcgcagtcgatggagccggaagatgctgatgacagggaccctagccgtgttcctgctcctgatcatgggacaacttacatggaatgacttgattcgtctgtgcatcatggtcggcgcaaacgcttcggatagaatggggatgggaactacctatttagccctcatggcaacgtttaaaatgaggcctatgttcgccgtgggcctgctttttcgccggctgacatccagagaggttctactcctgaccattggtttgtctctggtggctagcgtcgaattaccaaactcactcgaggaactgggggacggacttgcgatgggcataatgatgctgaagttgctcactgagttccagccccaccagctgtggaccacactactgagtcttacttttatcaaaaccacgctctccctggattacgcctggaagacaaccgcaatggctttgtctattgtgagcctgttcccgttatgtctctccactacatcacagaaaaccacttggctgcctgttcttctgggcagctttgggtgcaagccattgacaatgttcctcatcaccgaaaataagatttggggaaggaaaagttggcccctgaacgagggtatcatggccataggcatcgtgtctattctactgtccagccttctcaagaatgacgtccctctggccgggcccttgatcgctggaggcatgttaattgcatgttatgtaatctcgggttcatctgccgatctgagtctcgagaaagcggctgaagtgtcctgggagcaagaagccgagcatagcgggacgtctcacaacatactggttgaagtgcaggacgatggaactatgaagattaaagacgaggagcgagatgacacccttacaatcctgttgaaggcaaccctactggccgtcagcggcgtgtacccaatgtccatccctgctacactctttgtatggtatttctggcagaaaaagaagcagcgctcaggcgtgctgtgggatactcccagtccaccggaagtcgagcgggcagttcttgacgatgggatttacagaatattacaaaggggactgctcggtcgtagccaggtgggcgtgggggtcttccaggacggagtgtttcataccatgtggcacgttacgcgcggcgccgtattgatgtatcagggtaaacggctggaaccttcttgggcgtccgtgaagaaagacctcatctcatacgggggaggctggagattccaaggcagttggaatacaggggaggaggtccaggtgattgctgttgaacccggaaagaaccccaaaaatgtgcagactacccccggtacatttaagacccctgagggcgaagtcggggccatcgcactggatttcaagccaggaactagcggctcccccattgtgaacagggagggtaaaatcgtagggctttacggaaatggcgtcgtgaccacatctggcacgtatgtttcggccatagctcaagccaaggcaagccaggaagggcctctgccggagatcgaggacgaagtgtttaaaaagcgaaacttgactattatggatctacacccaggatcaggtaaaacccggcgctacctgcccgctatcgtcagagaggccattaagaggaagctccggacattaatcctggcgcctacccgagtggttgcctccgaaatggcagaggctcttaaaggcatgccaataagatatcagactacagccgtgaagagtgaacataccgggcgcgagattgtcgacctgatgtgccacgctacgttcactatgaggctcttgtctcccgtgcgtgtacctaattacaacatgatcatcatggatgaggcacattttacagacccggccagcattgccgctcggggatatatctccaccagagtgggcatgggtgaagcggcagccatattcatgaccgctactcccccagggtcagttgaggcctttcctcagtctaatgcagtcattcaagatgaagagagggacatccccgaacgcagctggaacagtggatacgattggattacagacttcccaggcaaaaccgtgtggtttgtgccttccatcaagagcggcaatgatatagccaactgtctgcggaaaaacgggaagagagtcattcagctctctagaaagacattcgacactgagtatcagaaaacgaagaataacgactgggattacgtagtgaccacagacatctcagagatgggagctaatttcagggcggatcgcgttatcgacccccgtagatgcctgaaaccagtgattcttaaggatggtccggaacgggtcatcctagccggccctatgcccgtgactgttgcatccgctgcccagaggcgcgggcgaattggaagaaaccaaaataaagagggcgaccagtacgtgtatatgggtcagccactgaacaatgatgaagaccacgcacattggaccgaggccaagatgttgttagataacataaatacacccgaggggatcattcctgctctgtttgaaccagagcgggaaaagagtgccgcgatcgacggcgagtacaggctccgcggagaagcaagaaaaaccttcgtcgagctgatgaggcggggcgatcttcccgtgtggctgagctataaggtagcctcggaggggtttcagtactctgaccgtcgctggtgcttcgatggagaacgaaacaatcaagtgctcgaggaaaacatggacgttgagatctggcctaaagaaggtgagagaaagaaattgaggccgcggtggctggacgctcgcacttattccgatccactagccctgagagagtttaaggagttcgctgcaggcaggcggagcgtctcaggggacctcattcttgagataggaaaactgccccagcacttaacgttgcgagcccagaatgctctggataacctcgtgatggtgcacaatagtgaacagggcggtaaggcctacagacatgcaatggaggaactgcctgacaccatcgagacacttatgctgctcgcgttgattgccgtcctgactgggggcgttaccttatttttcctatctggaaagggcctggggaaaacatccatcggactcctttgtgtgaccgctagctcagccctgttgtggatggcaagtgtagagccccactggattgctgccagcatcatactggaatttttcctcatggtgctgcttatcccagagcctgatcgccaaaggactccccaggacaaccagctcgcatatgtcgtgattggtctgttgtttctgatcttaacagttgccgctaacgaaatgggcctactggagacgaccaagaaagatctcgggattggacatgtggcggccgagaatcaccaacacgcaactatgcttgacgtcgatctgcggccagcttccgcctggacattgtacgccgtagcaaccaccgtgatcacacctatgatgcgtcatactatagaaaacacgaccgctaatatttctctgacagccatcgcgaaccaggctgccattctcatgggcctggacaagggttggccgatcagcaaaatggatataggggttccccttttagcactgggctgctactcccaggtgaatccactcactttgaccgccgctgtcctgatgctagtggcacactatgccatcattggacctggcctgcaggcgaaggctacaagagaggcccaaaagaggaccgcagccgggatcatgaaaaaccccactgtcgacggaattgtggctatcgatctcgacccagttgtgtacgacacgaagttcgaaaaacagcttggccagataatgctgttgattctgtgtacatcacagatcctcctgatgcgcaccacttgggccttatgcgagtctatcacccttgcaacaggtcctctgactaccctctgggaagggagtcccggaaagttttggaatacaacgattgctgtatcgatggccaacatcttccggggcagctatctagcgggtgccggcctggcattctccttgatgaaatctctagggggaggccgaagagggaccggagctcaaggcgagactctcggtgagaagtggaagaggcagcttaatcagctgtcaaaaagcgaatttaacacatacaagcgctccgggataatggaggtggatcggagtgaagccaaagagggattgaagagaggcgaaaccactaaacatgcagtctctcgtggtacagctaagctgaggtggttcgttgagcggaatctcgtgaagccggagggcaaagtcattgacttagggtgtggacgcggcgggtggagctattactgcgccggactgaagaaagtgaccgaagtaaagggctatacgaaaggtgggccaggacacgaggaacctatccccatggccacctacggctggaaccttgtgaagctgcattcaggcaaagatgtatttttcatgccacccgagaagtgtgacacactactctgcgatattggggaatccagtcctaatccgactatcgaggagggacgaaccctgagagtgttgaagatggtcgaaccctggctgaggggtaaccagttttgtataaaaatcctcaatccatacatgcctagcgtggtcgagacacttgaacaaatgcagcggaagcacggcgggatgctggtgcgcaaccccttatctagaaattccactcacgagatgtattgggtttcatgcggaaccggcaacattgtaagcgcggtgaacatgacatcgaggatgctgttgaatcgattcaccatggctcatcggaaacctacttacgagcgtgacgtcgatctcggtgcagggacgagacacgtggccgttgaaccagaggtggctaacctggacatcattggacagcgcatcgaaaatattaagaacgagcataaatctacatggcactatgatgaagacaatccctacaagacctgggcctatcacggcagttacgaggtcaagccttccggcagcgcatcatccatggtgaacggggtagtgaggctacttactaaaccatgggatgttatccccatggtcacccaaatagccatgacagacacgaccccgtttggacagcagcgggtgttcaaggagaaagtggacactagaacacctcgcgctaagaggggtaccactcagattatggaagtcacagcgaaatggctgtggggctttctctctcgaaataagaagccacggatctgtaccagagaggagttcacaaggaaagttcgcagcaacgccgcaatcggggctgtgtttgtagatgagaatcaatggaacagtgccaaggaagcagtggaggacgagcgtttctgggatctggtccatcgggaaagagagttgcacaaacagggaaagtgcgccacttgcgtgtataatatgatgggcaaaagggaaaagaagctgggtgagtttgggaaagctaagggatcccgcgccatttggtacatgtggctcggcgcgcgattccttgagttcgaggcactgggctttatgaacgaggaccattggttcagccgggaaaattctttttcaggggttgagggagaaggtttacacaaactgggctacatattgagagatatcagtaagattcccgggggaaacatgtatgccgacgataccgctggctgggacacgaggatcaccgaggatgacctccagaatgaggccaaaattacagatatcatggaacctgagcatgcactgctagctacttccatattcaaacttacctaccagaacaaagtggtccgcgtgcaaagaccagccaagaacggtacagtaatggacgttatcagccggagggctcagcgtgggtctggacaggtgggcacttatggcctgaatacctttacgaacatggaagtccagctcattcgacaaatggagtcggaagggatcttcctgccctcagagttggagacaccgaatttagccgaacgcgtgctggattggctcgagaagcacggagcagaaagacttaaacggatggcgattagcggtgacgactgtgtggtcaagcctatcgatgacaggtttgccaccgctctgactgccctaaacgcaatgggcaaagttcgcaaggatataccccagtgggagccatccaaagggtggaatgactggcaacaggtgcctttctgcagtcaccattttcaccaactgattatgaaggatggaagagaaatcgtagtgccctgtcggaaccaggacgagctcgtcggcagggctcgagtgtctcagggtgccgggtggagcttgcgtgagacagcatgcctgggaaagtcctacgcccaaatgtggcagcttatgtatttccatagacgcgatctgcggctcgcggctaatgccatctgttcagcagttccagtggactgggtccccaccagtaggactacctggtctattcacgcccaccatcagtggatgacaacggaagatatgttaagcgtgtggaacagagtatggatagaggaaaatccttggatggaggacaaaacccacgtttcctcatgggaagaggtgccatacctgggcaagcgcgaggatcagtggtgcggcagcttgatcgggctgactgctcgggccacatgggcaaccaacattcaagtcgctatcaatcaggtgaggcgactcattggaaacgaaaattatcttgactacatgacttctatgaaaagatttaagaacgagtccgacccggaaggtgccctgtggtga

SEQ ID NO: 13423 - RNA, 9879 nt, synthetic construct
  misc_feature 1..9879: note = derived and/or modified CDS sequence (opt3) from DENV-1__EU596501__SS-prME
  source 1..9879: mol_type = other RNA
agcgtgaccatgctgctcatgcttctgccaacagcattggctttccacttaactacgcgaggaggggaacctcatatgatcgtctccaagcaggaaaggggaaaatctctgctgtttaagacctcagccggtgttaacatgtgcacactcattgccatggacctgggcgaactttgtgaagatactatgacctacaaatgcccacaaataacagaggcggaaccggacgatgtggactgttggtgcaatgctaccgatacttgggtaacatatgggacctgtagtcagacgggagagcaccggcgcgacaagcgaagcgtggccctggcaccccatgtcggcttgggtctcgagactcgtaccgaaacatggatgtcctctgagggggcctggaaacagatccagagagtggaaacttgggctctgaggcaccctggattcaccgttattgcactgtttctcgcccatgctatcggcacatcgattacccaaaagggcatcatattcatcttactgatgcttgtgacgccatcaatggccatgcggtgcgtcgggattggaaaccgcgattttgtggagggtttgagcggcgcgacttgggtagacgttgtgctggagcacgggagttgtgtcacaaccatggcaaagaataaacccactctagatatcgaactcctgaagacagaggtgaccaaccctgccattcttagaaaactgtgcatcgaagctaagatatccaatacgaccacagactctaggtgtccaactcagggagaggccaccttggtggaagaacaggatgcaaacttcgtctgccggcgcacatttgttgaccgaggctggggtaatgggtgtggactcttcggcaaaggcagcctgttaacttgcgctaagtttaagtgcgtgaccaaactggaggggaagattgtacagtacgaaaacctcaaatattccgtgatcgtcacagtgcacaccggagatcaacatcaggttggtaatgagactacggaacacggcacaattgccaccatcactccccaggcgcctacctcagagatccagcttacagactacggggccctgaccttggactgtagtccaagaactggactagatttcaacgaaatggtgctgctcacaatgaaggagaaaagctggctggtccataagcaatggtttcttgacctgccgttgccctggacgtctggcgcatccacctcacaggagacttggaataggcaggatctcctggtgacattcaaaaccgctcacgccaagaagcaagaagtagttgtgttaggtagccaggagggggctatgcacacagccctgactggcgcaaccgaaattcagacgagtggaaccacaactatatttgccggccatctaaaatgccggctcaagatggacaaactgacccttaaggggacatcttatgtcatgtgtactggatccttcaaattggagaaggaagtggctgagacccagcacggtacggtcctggtgcaagttaagtacgagggcacagatgcgccttgcaaaatcccattcagcacccaggacgaaaagggggtgactcagaacggacgtctcattacagcaaatcccatcgtaaccgataaagagaagcctgtcaacatagaaactgagccaccctttggcgagtcgtatattgtggttggtgccggggaaaaagctctgaaactttcttggttcaagaaaggctcctcaatcggaaagatgtttgaggccaccgcacgcggcgccagaaggatggctatcctgggggacacagcctgggatttcggaagtattggtggcgtgtttacgagcgtcgggaaattggtgcatcaggtattcggaaccgcatacggcgtgctcttttccggtgtttcttggactatgaagatcgggattggcatactgttaacatggctgggactaaatagccggtcaaccagtctctccatgacatgtatcgcggtcggcatggtgactctgtaccttggggtgatggtccaagctgacagcggatgcgttattaactggaaaggccgagaattgaagtgtggttctgggatcttcgtgaccaacgaggtgcacacgtggacagaacagtataagtttcaggccgattcaccgaaacgcctgagtgcagccatcggaaaggcttgggaggagggcgtatgcggtattagaagcgccaccaggctcgaaaatataatgtggaaacagatctccaacgagctgaatcatattttactggaaaacgacatgaagttcactgtcgtggttggcgacgcaaatgggatccttgctcaaggcaagaagatgattcggcctcagcccatggagcacaaatactcttggaagtcgtggggcaaggccaaaatcataggggcggatatccagaacaccacatttattatcgacggaccagatactcctgaatgtcccgacaatcagcgcgcctggaacatttgggaggtggaggattatggcttcggtatctttaccacaaatatatggttgaagctcagagacagctacacgcaaatgtgcgatcacaggctgatgtccgctgcaattaaagactcaaaggccgtccatgctgatatggggtattggatcgaaagtgagaaaaacgaaacctggaagctagcccgtgcatctttcattgaggtgaagacttgtacatggccaaaaagccacaccctgtggtccaatggagttctcgaatcagagatgatcatacccaagatctacggcggtcctattagccagcataactatcggccaggctacttcactcagacagcggggccgtggcacctgggaaaacttgagttggactttgatctgtgcgaaggcaccacggtggtagtcgacgagcactgcgggaatcgaggaccctctttaagaactaccacagtgaccggcaagatcattcatgaatggtgttgcaggtcctgtactctccctccactgcgcttccggggtgaggatgggtgctggtacggaatggagatcagacccgtgaaagaaaaggaggaaaaccttgtcaggagtatggttagcgccggctctggtgaggtggactccttttcactgggcatattgtgtgctagtattatgatcgaagaggtaatgcgcagccgatggtcgcggaagatgctcatgacagggaccctggccgtgttcctactgctcatcatgggacaactgacatggaatgaccttattcgtttgtgcatcatggtcggcgcaaacgcttccgatagaatggggatgggaactacctatctggccttaatggcaacgtttaaaatgaggcctatgttcgccgtgggcctcctgtttcgccggcttacatctagagaggttctgctactcaccattggtctgagcttggtggcttcagtcgaactgccaaacagtttagaggaactcggggacggactggcgatgggcataatgatgcttaagctgttgactgagttccagccccaccagctctggaccacactgctatccctgacttttatcaaaaccacgctttctctcgattacgcctggaagacaaccgcaatggctctgagcattgtgtccttgctgccgttatgtctctcaactacaagccagaaaaccacttggctgcctgttcttctgggcagtttcgggtgcaagccattgacaatgtttctcatcaccgaaaataagatttggggaaggaaatcttggcccctgaacgagggtatcatggccataggcatcgtgtccattctactgagctcgcttctcaagaatgacgtccctctggccgggcccttgatcgctggaggcatgttaattgcatgttatgtaatctcaggttctagtgccgatctgtccctcgagaaagcggctgaagtgagctgggagcaagaagccgagcattctgggacgagccacaacatactggttgaagtgcaggacgatggaactatgaagattaaagacgaggagcgagatgacacccttacaatcctgttgaaggcaaccctactggccgtctccggcgtgtacccaatgtcaatccctgctacactcttcgtatggtatttttggcagaaaaagaagcagcgcagtggcgtgctgtgggatactcccagcccaccggaagtcgagcgggcagttcttgacgatgggatttacagaataatgcaaaggggattactgggtcgttctcaggtgggcgtgggggtcttccaggacggagtgttccataccatgtggcacgttacgcgcggcgccgtactcatgtatcagggtaaacggttggaaccttcctgggcgtcagtgaagaaagacctgatcagttacgggggaggctggagatttcaaggcagctggaatacaggggaggaggtccaggtgattgctgttgaacccggaaagaaccccaaaaatgtgcagactacccccggtacattcaagaccctcgagggcgaagtcggggccatcgcactggattttaagcctggaacttccggctctccaattgtgaacagggagggtaaaatcgtagggctttacggaaatggcgtcgtgaccacatcgggcacgtatgttagcgccatagctcaagccaaggcatcacaggaagggcccctgcctgagatcgaggacgaagtgttcaaaaagcgaaacttgactattatggatctacacccgggatccggtaaaacccggcgctacctgccagctatcgtcagagaggccattaagaggaagctccggacattaatcctggcgcccacccgagtggttgccagtgaaatggcagaggctcttaaaggcatgcctataagatatcagactacagccgtgaagtctgaacataccgggcgcgagattgtcgacctgatgtgccacgctacgtttactatgaggctcttgagcccagtgcgtgtacccaattacaacatgatcatcatggatgaggcacatttcacagaccctgcctccattgccgctcggggatatatctcaaccagagtgggcatgggtgaagcggcagccatatttatgaccgctactccgcccgggtctgttgaggccttcccacagagcaatgcagtcattcaagatgaagagagggacatccctgaacgcagttggaactccggatacgattggattacagactttcccggcaaaaccgtgtggttcgtgccaagcatcaagtctggcaatgatatagccaactgtctgcggaaaaacgggaagagagtcattcagctctcaagaaagacatttgacactgagtatcagaaaacgaagaataacgactgggattacgtagtgaccacagacatctccgagatgggagctaatttcagggcggatcgcgttatcgaccctcgtagatgcctgaaacccgtgattcttaaggatggtccagaacgggtcatcctagccggcccgatgcctgtgactgttgcaagtgctgcccagaggcgcgggcgaattggaagaaaccaaaataaagagggcgaccagtacgtgtatatgggtcagcccctgaacaatgatgaagaccacgcacattggaccgaggccaagatgttgttagataacataaatacaccagaggggatcattcccgctctgttcgaacctgagcgggaaaagagcgccgcgatcgacggcgagtacaggctccgcggagaagcaagaaaaacctttgtcgagctgatgaggcggggcgatcttccagtgtggctgtcgtataaggtagcctctgaggggttccagtactccgaccgtcgctggtgctttgatggagaacgaaacaatcaagtgctcgaggaaaacatggacgttgagatctggactaaagaaggtgagagaaagaaattgaggccccggtggctggacgctcgcacgtatagcgatcctctagccctgagagagttcaaggaatttgctgcaggcaggcggtcagtcagtggggacctcattcttgagataggaaaactgccgcagcacttaaccttgcgagcccagaatgctctggataacctcgtgatgctgcacaattctgaacagggcggtaaggcctacagacatgcaatggaggaacttccagacacaatcgagactctgatgctcttggcgctgattgccgtgttaaccgggggcgtcacactattctttctgtccggaaagggcctcgggaaaaccagcatcggacttctgtgtgttactgcttcaagtgccttgctgtggatggcaagcgtggagccccactggattgctgcctccatcatactcgagttctttctgatggtacttctcatccctgagcccgatcgccaaaggacaccacaggacaaccagctggcatatgtggtcattggtttgctgttcatgatcttaacggtggccgctaacgaaatgggcctactggagaccactaagaaagatctcgggattggacatgttgcggccgagaatcaccaacacgcaacaatgcttgacgtggatctgcggcctgcttctgcctggaccttgtacgccgtcgcaaccacagtaatcactcccatgatgcgtcatacgatagaaaacaccacagctaatattagcctgactgccatcgcgaaccaggctgccattctcatgggcctggacaagggttggccaatctccaaaatggatataggggtgcctcttttagcactgggctgctactcacaggttaatccgctcaccttgacagccgctgtgctgatgctagtcgcacactatgccatcattggacccggcctgcaggcgaaggctaccagagaggcccaaaagaggactgcagccgggatcatgaaaaacccaacggtggacggaattgtcgctatcgatctcgaccctgtggtttacgacgccaagtttgaaaaacagcttggccagataatgctgttgattctgtgtacatctcagatcctcctgatgcgcaccacttgggcattatgcgagagtatcacccttgctacaggtcccctgactaccctctgggaagggtcgccaggaaagttctggaatacaacgattgccgtgagcatggcgaacatctttcggggctcctatctagccggtgcaggcctggctttctctttgatgaaatcactagggggaggccgaagagggaccggagcccaaggcgagactctcggtgagaagtggaagaggcagcttaatcagctgagcaaatccgagttcaacacatacaagcgcagtgggataatggaggtagatcggtctgaagcaaaagagggattgaagagaggcgaaaccactaaacatgctgtgagccgtggtacagccaagctgaggtggtttgtcgagcggaatctcgttaagcctgagggcaaagtgattgacttagggtgtggacgcggcgggtggtcatattactgcgccggactgaagaaagtcaccgaagtgaagggctatacgaaaggtgggcccggacacgaggaaccgatcccaatggcgacctacggctggaaccttgtaaagctgcattccggcaaagatgtgttctttatgcctcccgagaagtgtgacacactactctgcgatattggggaaagtagcccaaatcccactatcgaggagggacgaaccctgagagttttgaagatggtggaaccttggctgaggggtaaccagttctgtataaaaatcctcaatccgtacatgccctctgtcgtggagacacttgaacaaatgcagcggaagcacggcgggatgctggtccgcaacccattatccagaaattcaagccacgagatgtattgggtgtcgtgcggaactggcaacattgtttctgctgtaaacatgaccagtaggatgctgttgaatcgatttacaatggcacatcggaaacctacctacgagcgtgacgtggatctcggtgccgggactagacacgtcgctgtggaacccgaggttgccaacctggacatcattggacagcgcatcgaaaatattaagaacgagcataaatccacgtggcactatgatgaagacaatccttacaagacatgggcatatcacggcagctacgaggtgaagccatcaggctccgcctctagcatggtcaacggggtggtaaggctacttaccaaaccctgggatgtgatccctatggttactcaaatagctatgaccgacacaacgccattcggacagcagcgggtctttaaggagaaagtggacaccagaactccccgcgcgaagaggggtacaacccagattatggaagtgactgccaaatggctgtggggcttcctcagtcgaaataagaagccgcggatctgtacaagagaggaatttaccaggaaagtccgctccaacgcagctatcggggccgttttcgtggatgagaatcaatggaacagcgcaaaggaagccgtagaggacgagcgtttttgggatctggtgcatcgggaaagagagttgcacaaacagggaaagtgcgctacatgcgtctataatatgatgggcaaaagggaaaagaagctgggtgagttcgggaaagccaagggatctcgcgcgatttggtacatgtggctcggcgcacgatttcttgagttcgaggccctgggcttcatgaacgaggaccattggttttcacgggaaaatagtttatccggggtggagggagaaggtctgcacaaattgggctacatactcagagatatcagcaagattcctgggggaaacatgtatgctgacgatactgccggctgggacaccaggatcacggaggatgacctgcagaatgaggcaaaaattaccgatatcatggaaccagagcatgctctacttgccacatctatattcaagctgacttaccagaacaaagttgtgcgcgtccaaagacccgctaagaacggtaccgtgatggacgtaatctcgcggagggatcagcgtgggtcaggacaggttggcacatatggcctcaatacttttaccaacatggaagtgcagctgattcgacaaatggagagcgaagggatcttcttgccttccgagttagagacgccaaatctggccgaacgcgtcctcgactggcttgagaagcacggagcagaaagactgaaacggatggcgattagtggtgacgattgtgtggtgaagcccatcgacgataggtttgccacagctctaaccgccctgaacgacatgggcaaagtccgcaaggatataccgcagtgggagccttctaaagggtggaatgactggcagcaggttcccttctgcagccaccattttcaccaactcattatgaaggatggaagagaaatcgtggtaccatgtcggaaccaggacgagttggtgggcagggcacgagtctcccagggtgctgggtggtcactgcgtgagactgcctgccttggaaagagttacgcacaaatgtggcagctgatgtatttccatagacgcgatctccggttagccgcgaatgctatctgttctgccgtgcctgttgactgggtgcccacaagcaggaccacttggtccattcacgcacaccatcagtggatgaccacagaagatatgctgtcagtctggaacagagtgtggatagaggaaaatccatggatggaggacaaaacgcacgtaagctcttgggaagaggttccctacttgggcaagcgcgaggaccagtggtgcggctccctgatcgggctcaccgcccgggctacttgggccacaaacattcaagtggcaatcaatcaggtcaggcgacttattggaaacgaaaattatctggattacatgaccagtatgaaaagatttaagaacgagagcgaccctgaaggtgctctatggtga

SEQ ID NO: 13424 - RNA, 9879 nt, synthetic construct
  misc_feature 1..9879: note = derived and/or modified CDS sequence (opt3) from DENV-1__FJ898437__SS-prME
  source 1..9879: mol_type = other RNA
agcgtgaccatgctgctcatgcttctgcccacagccttggctttccacttaactacgagaggcggggagcctcatatgatcgtctccaagcaggaaaggggaaaatctctgctatttaagacctcagcaggtgttaacatgtgcacactcattgccatggacctgggcgagctttgtgaagatactatgacctacaaatgcccacaaataacagaggcggaaccggacgatgtggactgttggtgcaatgctaccgatacttgggtaacatatgggacctgtagtcagacgggagagcaccggcgcgacaagcgaagcgtggccctggcaccccatgtcggcttgggtctcgagactcgtaccgaaacatggatgtcctctgagggggcctggaaacagatccagagagtggaaacttgggctctgaggcaccctggattcaccgttattgcactgtttctcgcccatgctatcggcacatcgattacccaaaagggcatcatattcatcttactgatgcttgtgacgccatcaatggccatgcggtgcgtcgggattggaaaccgcgattttgtggagggtttgagcggcgcgacttgggtagacgttgtgctggagcacgggagttgtgtcacaaccatggcaaagaataaacccactctagatatcgaactcctgaagacagaggtgaccaaccctgccattcttagaaaactgtgcatcgaagctaagatatccaatacgaccacagactctaggtgtccaactcagggagaggccaccttggtggaagagcaggatgcaaacttcgtctgccggcgcacatttgttgaccgaggctggggtaatgggtgtggactcttcggcaaaggcagcctgttaacttgcgctaagtttaagtgcgtgaccaaactggaggggaagattgtacagtacgaaaacctcaaatattccgtgatcgtcacagtgcacaccggagatcaacatcaggttggtaatgagactacggaacacggcacaattgccaccatcactccccaggcgcctacctcagagatccagcttacagactacggggccctgaccttggactgtagtccaagaactggactagatttcaacgaaatggtgctgctcacaatgaaggagaaaagctggctggtccataagcaatggtttcttgacctgccgttgccctggacgtctggcgcatccacctcacaggagacttggaataggcaggatctcctggtgacattcaaaaccgctcacgccaagaagcaagaagtagttgtgttaggtagccaggagggggctatgcacacagccctgactggcgcaaccgaaattcagacgagtggaaccacaactatatttgccggccatctaaaatgccggctcaagatggacaaactgacccttaaggggacatcttatgtcatgtgtactggatccttcaaattggagaaggaagtggctgagacccagcacggtacggtcctggtgcaagttaagtacgagggcacagatgcgccttgcaaaatcccattcagcacccaggacgaaaagggggtgactcagaacggacgtctcattacagcaaatcccatcgtaaccgataaagagaagcctgtcaacatagaaactgagccaccctttggcgagtcgtatattgtggttggtgccggggaaaaagctctgaagctttcttggttcaagaaaggctcctcaatcggaaagatgtttgaggccaccgcacgcggcgccagaaggatggctatcctgggggacacagcctgggatttcggaagtattggtggcgtgtttacgagcgtcgggaaattggtgcatcaggtattcggaaccgcatacggcgtgctcttttccggtgtttcttggactatgaagatcgggattggcatactgttaacatggctgggactaaatagccggtcaaccagtctctccatgacatgtatcgcggtcggcatggtgactctgtaccttggggtgatggtccaagctgacagcggatgcgttattaactggaaaggccgagaattgaagtgtggttctgggatcttcgtgaccaacgaggtgcacacgtggacagaacagtataagtttcaggccgattcaccgaaacgcctgagtgcagccatcggaaaggcttgggaggagggcgtatgcggtattagaagcgccaccaggctcgaaaatataatgtggaaacagatctccaacgagctgaatcatattttactggaaaacgacatgaagttcactgtcgtggttggcgacgcaaatgggatccttgctcaaggaaaaaagatgattcggcctcagcccatggagcacaaatactcttggaagtcgtggggcaaggccaaaatcataggggcggatatccagaacaccacatttattatcgacggaccagatactcctgaatgtcccgacaatcagcgcgcctggaacatttgggaggtggaggattatggcttcggtatctttaccacaaatatatggttgaagctcagagacagctacacgcaaatgtgcgatcacaggctgatgtccgctgcaattaaagactcaaaggccgtccatgctgatatggggtattggatcgaaagtgagaaaaacgaaacctggaagctagcccgtgcatctttcattgaggtgaagacttgtacatggccaaaaagccacaccctgtggtccaatggagttctcgaatcagagatgatcatacccaagatctacggcggtcctattagccagcataactatcggccaggctacttcactcagacagcggggccgtggcacctgggaaaacttgagttggactttgatctgtgcgaaggcaccacggtggtagtcgacgagcactgcgggaatcgaggaccctctttaagaactaccacagtgaccggcaagatcattcatgaatggtgttgcaggtcctgtactctccctccactgcgcttccggggtgaggatgggtgctggtacggaatggagatcagacccgtgaaagaaaaggaggaaaaccttgtcaggagtatggttagcgccggctctggtgaggtggactccttttcactgggcatattgtgtgctagtattatgatcgaagaggtaatgcgcagccgatggtcgcggaagatgctcatgacagggaccctggccgtgttcctactgctcatcatgggacaactgacatggaatgaccttattcgtttgtgcatcatggtcggcgcaaacgcttccgatagaatggggatgggaactacctatctggccttaatggcaacgtttaaaatgaggcctatgttcgccgtgggcctcctgtttcgccggcttacatctagagaggttctgctactcaccattggtctgagcttggtggcttcagtcgaactgccaaacagtttagaggaactcggggacggactggcgatgggcataatgatgcttaagctgttgactgagttccagccccaccagctctggaccacactgctatccctgacttttatcaaaaccacgctttctctcgattacgcctggaagacaaccgcaatggctctgagcattgtgtccttgttcccgctgtgtttatcaactacaagccagaaaaccacttggctccctgttctgcttggcagttttgggtgcaagccactgacaatgttcttgatcaccgaaaataagatttggggaaggaaatcttggcccctcaacgagggtatcatggccataggcatcgtgtccattctgctaagctcgctgcttaagaatgacgtccctctcgccgggcccctgatcgctggaggcatgttgattgcatgttatgtaatctcaggttctagtgccgatttatccctggagaaagcggctgaagtgagctgggagcaagaagccgagcattctgggacgagccacaacatactcgttgaagtgcaggacgatggaactatgaagattaaagacgaggagcgagatgacaccctgacaatccttctgaaggcaaccttgctagccgtctccggcgtgtacccaatgtcaatccctgctacactgtttgtatggtatttctggcagaaaaagaagcagcgcagtggcgtgctctgggatactcccagcccaccggaagtcgagcgggcagttctggacgatgggatttacagaatacttcaaaggggattactgggtcgttctcaggtgggcgtgggggtcttccaggacggagtgtttcataccatgtggcacgttacgcgcggcgccgtactcatgtatcagggtaaacggttggaaccttcctgggcgtcagtgaagaaagacctgatcagttacgggggaggctggagattccaaggcagctggaatacaggggaggaggtccaggtgattgctgttgaacccggaaagaacccaaaaaatgtgcagactacccccggtacatttaagacccctgagggcgaagtcggggccatcgcactcgatttcaagccaggaacttccggctctcccattgtgaacagggagggtaaaatcgtagggctgtacggaaatggcgtcgtgaccacatcgggcacgtatgttagcgccatagctcaagccaaggcatcacaggaagggcctcttccggagatcgaggacgaagtgtttaaaaagcgaaacctgactattatggatttgcacccaggatccggtaaaacccggcgctacctacccgctatcgtcagagaggccattaagaggaagctgcggacactcatcttagcgcctacccgagtggttgccagtgaaatggcagaggctctgaaaggcatgccaataagatatcagactacagccgtgaagtctgaacataccgggcgcgagattgtcgaccttatgtgccacgctacgttcactatgaggctgctcagccccgtgcgtgtacctaattacaacatgatcatcatggatgaggcacattttacagacccggcctccattgccgctcggggatatatctcaaccagagtgggcatgggtgaagcggcagccatattcatgaccgctactcccccagggtctgttgaggcctttcctcagagcaatgcagtcattcaagatgaagagagggacatccccgaacgcagttggaactccggatacgattggattacagacttcccaggcaaaaccgtgtggtttgtgcctagcatcaagtctggcaatgatatagccaactgtttgcgaaaaaacgggaagagagtcattcagctgtcacggaagacattcgacactgagtatcagaaaacgaagaataacgactgggattacgtagtgaccacagacatctccgagatgggagctaatttcagggcggatcgcgttatcgacccccgtagatgcctcaaaccagtgattctgaaggatggtccggaacgggtcatccttgccggccctatgcccgtgactgttgcaagtgctgcccagaggcgcgggcgaattggaagaaaccaaaataaagagggcgaccagtacgtgtatatgggtcagccactaaacaatgatgaagaccacgcacattggaccgaggccaagatgctgttggataacataaatacacccgaggggatcattcctgctttatttgaaccagagcgggaaaagagcgccgcgatcgacggcgagtacaggctgcgcggagaagcaagaaaaaccttcgtcgagctcatgaggcggggcgatctgcccgtgtggctttcgtataaggtagcctctgaggggtttcagtactccgaccgtcgctggtgcttcgatggagaacgaaacaatcaagtgctggaggaaaacatggacgttgagatctggactaaagaaggtgagagaaagaaactcaggcctcggtggttggacgctcgcacgtatagcgatccgctggccctaagagagtttaaggaattcgctgcaggcaggcggtcagtcagtggggacctgattctcgagataggaaaacttccacagcacctgaccttacgagcccagaatgctttggataacctggtgatgctccacaattctgaacagggcggtaaggcctacagacatgcaatggaggaactgcccgacacaatcgagactcttatgctgctcgcgttgattgccgtgctgaccgggggcgtcacattatttttcctatccggaaagggcctggggaaaaccagcatcggactcctttgtgttactgcttcaagtgccctgttgtggatggcaagcgtggagcctcactggattgctgcctccatcatactggaatttttcctcatggtactgcttatccccgagccagatcgccaaaggacacctcaggacaaccagctcgcatatgtggtcattggtctgttgtttatgatcctgacggtggccgctaacgaaatgggcttactagagaccactaagaaagatctggggattggacatgttgcggccgagaatcaccaacacgtgacaatgctcgacgtcgatcttcggcccgcatctgcttggaccctgtacgccgtagccaccacagtgatcactccaatgatgcgtcatacgatagaaaacaccacagcaaatattagcttgactgctatcgccaaccaggcggctattctgatgggcctcgacaagggttggcctatctccaaaatggatataggggttccgctgcttgccttaggctgctactcacaggtgaatcccctgaccctcacagcagccgtcttgatgctggtggctcactatgcaatcattggaccaggcctacaggccaaggcgaccagagaggctcaaaagaggactgccgcagggatcatgaaaaaccctacggtcgacggaattgtggccatcgatctggaccccgttgtgtacgacgctaagttcgaaaaacagctcggccagataatgcttctgattttgtgtacatctcagatcctgctcatgcgcaccacttgggccctgtgcgagagtatcaccttagcaacaggtccacttactaccctgtgggaagggtcgcctggaaagttttggaatacaacgattgctgtaagcatggccaacatcttccggggctcctatctcgcgggtgccggcctagcattctctctgatgaaatcattggggggaggccgaagagggaccggagctcaaggcgagactctgggtgagaagtggaagaggcagctcaatcagcttagcaaatccgaatttaacacatacaagcgcagtgggataatggaggtggatcggtctgaagccaaagagggactgaagagaggcgaaaccactaaacatgcagtcagccgtggtacagctaagttgaggtggttcgttgagcggaatctggtgaagcccgagggcaaagtcattgacctcgggtgtggacgcggcgggtggtcatattactgcgccggattaaagaaagtgaccgaagtaaagggctatacgaaaggtgggccgggacacgaggaaccaatccctatggccacctacggctggaacctggtgaagcttcattccggcaaagatgtttttttcatgcccccagagaagtgtgacacactgctatgcgatattggggaaagtagccccaatcctactatcgaggagggacgaaccctcagagtgctgaagatggtcgaaccgtggttgaggggtaaccagttttgtataaaaatcctgaatccctacatgccatctgtggtcgagacactcgaacaaatgcagcggaagcacggcgggatgcttgtgcgcaaccctctgtccagaaattcaactcacgagatgtattgggttagctgcggaaccggcaacattgtatcggcggtgaacatgacatctaggatgttactgaatcgattcaccatggctcatcggaaacccacttacgagcgtgacgtcgatttgggtgcagggacgagacacgtggccgttgaacctgaggtggctaacctcgacatcattggacagcgcatcgaaaatattaagaacgagcataaaagtacatggcactatgatgaagacaatccatacaagacctgggcctatcacggctcctacgaggtcaagcccagcggctcagcatcctctatggtgaacggggtagtgaggctgctaactaaaccttgggatgttatcccaatggtcacccaaatagccatgacagacacgaccccctttggacagcagcgggtgttcaaggagaaagtggacactagaacaccgcgcgctaagaggggtaccactcagattatggaagtcacagcgaaatggctttggggctttctgagccgaaataagaagcctcggatctgtaccagagaggaattcacaaggaaagttcgcagtaacgccgcaatcggggctgtgtttattgatgagaatcaatggaactccgccaaggaagcagtagaggacgagcgtttctgggatctcgtgcatcgggaaagagagctgcacaaacagggaaagtgcgccacttgcgtctataatatgatgggcaaaagggaaaagaagttgggtgagtttgggaaagctaagggaagccgcgccatatggtacatgtggctgggcgcgcgattcctcgaattcgaggcacttggctttatgaacgaggaccattggttctctcgggaaaattcactgagtggggtggagggagaaggtttacacaaactgggctacatcttgagagatatttccaagatcccagggggaaacatgtatgccgacgataccgctggctgggacacgagggttaccgaggatgacctccagaatgaggccaaaattacagatatcatggaacccgagcatgcactgctagctactagcatatttaagcttacctaccagaacaaagtggtccgcgtgcaaagacctgccaagaacggtacagtaatggacgttatctctcggagggatcagcgtgggtcgggacaggtgggcacttatggcctgaataccttcacgaacatggaagtccagctcattcgacaaatggagtcagaagggatctttctgccaagcgagttggagacacccaatttagctgaacgcgtgctggactggctcgagaagcacggagccgaaagacttcggaggatggcaatttccggtgacgattgtgtggtcaaaccgatcgacgatcgcttcgcgaccgccctgactgctctaaacgacatgggcaaggttagaaaagatatacctcagtgggagcccagtaaggggtggaatgactggcagcaggtgccattttgctctcaccatttccaccaactgattatgaaagatggacgggaaatcgtagtgccttgtaggaaccaggacgagctcgtcggccgagcccgtgtgagccagggtgcagggtggtccttgagagagacagcttgcctgggaaagtcatacgcccaaatgtggcagcttatgtattttcatcgccgggatctgaggctcgcagccaatgcgatctgtagtgctgttcccgtggactgggtcccaacctctagaactacctggagcattcacgcccaccatcagtggatgacaacggaagatatgttatccgtgtggaaccgcgtatggatagaggaaaatccctggatggaggacaagacccacgtttcaagctgggaagaggtgccttacctgggcaaacgggaggaccagtggtgcggctctttgatcgggctgactgcaagggccacatgggctaccaacattcaagtcgccatcaatcaggtgcgaagactcattggaaacgaaaattatcttgattacatgacttccatgaagcggttcaaaaacgagagtgacccagaaggtgcactgtggtga

SEQ ID NO: 13425 - RNA, 9879 nt, synthetic construct
  misc_feature 1..9879: note = derived and/or modified CDS sequence (opt3) from DENV-1__FJ024480__SS-prME
  source 1..9879: mol_type = other RNA
agcgtgaccatgctgctcatgcttctgccaacagcattggctttccacttaactacgcgaggaggggaacctcatatgatcgtctccaagcaggaaaggggaaaatctctgttgtttaagacctcagccggtgttaacatgtgcacactcattgccatggacctgggcgaactttgtgaagatactatgacctacaaatgcccacaaataacagaggcggaaccggacgatgtggactgttggtgcaatgctaccgatacttgggtaacatatgggacctgtagtcagacgggagagcaccggcgcgacaagcgaagcgtggccctggcaccccatgtcggcttgggtctcgagactcgtaccgaaacatggatgtcctctgagggggcctggaaacagatccagagagtggaaacttgggctctgaggcaccctggattcaccgttattgcactgtttctcgcccatgctatcggcacatcgattacccaaaagggcatcatattcatcttactgatgcttgtgacgccatcaatggccatgcggtgcgtcgggattggaaaccgcgattttgtggagggtttgagcggcgcgacttgggtagacgttgtgctggagcacgggagttgtgtcacaaccatggcaaagaataaacccactctagatatcgaactcctgaagacagaggtgaccaaccctgccattcttagaaaactgtgcatcgaagctaagatatccaatacgaccacagactctaggtgtccaactcagggagaggccaccttggtggaagaacaggatgcaaacttcgtctgccggcgcacatttgttgaccgaggctggggtaatgggtgtggactcttcggcaaaggcagcctgttaacttgcgctaagtttaagtgcgtgaccaaactggaggggaagattgtacagtacgaaaacctcaaatattccgtgatcgtcacagtgcacaccggagatcaacatcaggttggtaatgagactacggaacacggcacaattgccaccatcactccccaggcgcctacctcagagatccagcttacagactacggggccctgaccttggactgtagtccaagaactggactagatttcaacgaaatggtgctgctcacaatgaaggagaaaagctggctggtccataagcaatggtttcttgacctgccgttgccctggacgtctggcgcatccacctcacaggagacttggaataggcaggatctcctggtgacattcaaaaccgctcacgccaagaagcaagaagtagttgtgttaggtagccaggagggggctatgcacacagccctgactggcgcaaccgaaattcagacgagtggaaccacaactatatttgccggccatctaaaatgccggctcaagatggacaaactgacccttaaggggacatcttatgtcatgtgtactggatccttcaaattggagaaggaagtggctgagacccagcacggtacggtcctggtgcaagttaagtacgagggcacagatgcgccttgcaaaatcccattcagcacccaggacgaaaagggggtgactcagaacggacgtctcattacagcaaatcccatcgtaaccgataaagagaagcctgtcaacatagaaactgagccaccctttggcgagtcgtatattgtggttggtgccggggaaaaagctctgaaactttcttggttcaagaaaggctcctcaatcggaaagatgtttgaggccaccgcacgcggcgccagaaggatggctatcctgggggacacagcctgggatttcggaagtattggtggcgtgtttacgagcgtcgggaaattggtgcatcaggtattcggaaccgcatacggcgtgctcttttccggtgtttcttggactatgaagatcgggattggcatactgttaacatggctgggactaaatagccggtcaaccagtctctccatgacatgtatcgcggtcggcatggtgactctgtaccttggggtgatggtccaagctgacagcggatgcgttattaactggaaaggccgagaattgaagtgtggttctgggatcttcgtgaccaacgaggtgcacacgtggacagaacagtataagtttcaggccgattcaccgaaacgcctgagtgcagccatcggaaaggcttgggaggagggcgtatgcggtattagaagcgccaccaggctcgaaaatataatgtggaaacagatctccaacgagctgaatcatattttactggaaaacgacatgaagttcactgtcgtggttggcgacgcaaatgggatccttgctcaaggcaagaagatgattcggcctcagcccatggagcacaaatactcttggaagtcgtggggcaaggccaaaatcataggggcggatatccagaacaccacatttattatcgacggaccagatactcctgaatgtcccgacaatcagcgcgcctggaacatttgggaggtggaggattatggcttcggtatctttaccacaaatatatggttgaagctcagagacagctacacgcaaatgtgcgatcacaggctgatgtccgctgcaattaaagactcaaaggccgtccatgctgatatggggtattggatcgaaagtgagaaaaacgaaacctggaagctagcccgtgcatctttcattgaggtgaagacttgtacatggccaaaaagccacaccctgtggtccaatggagttctcgaatcagagatgatcatacccaagatctacggcggtcctattagccagcataactatcggccaggctacttcactcagacagcggggccgtggcacctgggaaaacttgagttggactttgatctgtgcgaaggcaccacggtggtagtcgacgagcactgcgggaatcgaggaccctctttaagaactaccacagtgaccggcaagatcattcatgaatggtgttgcaggtcctgtactctccctccactgcgcttccggggtgaggatgggtgctggtacggaatggagatcagacccgtgaaagaaaaggaggaaaaccttgtcaggagtatggttagcgccggctctggtgaggtggactccttttcactgggcatattgtgtgctagtattatgatcgaagaggtaatgcgcagccgatggtcgcggaagatgctcatgacagggaccctggccgtgttcctactgctcatcatgggacaactgacatggaatgaccttattcgtttgtgcatcatggtcggcgcaaacgcttccgatagaatggggatgggaactacctatctggccttaatggcaacgtttaaaatgaggcctatgttcgccgtgggcctcctgtttcgccggcttacatctagagaggttctgctactcaccattggtctgagcttgatggcttcagtggaactgccaaacagtttagaggaactcggggacggactggcgatgggcataatgatgcttaagctgttgactgagttccagccccaccagctctggaccacactgctatccctgacttttatcaaaaccacgctttctctcgattacgcctggaagacaaccgcaatggctctgagcattgtctccttgttcccgctgtgtttatcaactacaagccagaaaaccacttggctccctgtgctgcttggcagttttgggtgcaagccactgacaatgttcttgatcaccgaaaataagatttggggaaggaaatcttggcccctcaacgagggtatcatggccataggcatcgtttccattctgctaagctcgctgcttaagaatgacgtgcctctcgccgggcccctgatcgctggaggcatgttgattgcatgttatgtcatctcaggttctagtgccgatttatccctggagaaagcggctgaagtaagctgggagcaagaagccgagcattctgggacgagccacaacatactcgtggaagttcaggacgatggaactatgaagattaaagacgaggagcgagatgacaccctgacaatccttctgaaggcaaccttgctagccgtgtccggcgtctacccaatgtcaatccctgctacactgtttgtgtggtatttctggcagaaaaagaagcagcgcagtggcgtactctgggatactcccagcccaccggaagtggagcgggcagtcctggacgatgggatttacagaatacttcaaaggggattactgggtcgttctcaggttggcgtgggggtgttccaggacggagtctttcataccatgtggcacgtgacgcgcggcgccgttctcatgtatcagggtaaacggttggaaccttcctgggcgtcagtaaagaaagacctgatcagttacgggggaggctggagattccaaggcagctggaatacaggggaggaggtgcaggtcattgctgtggaacccggaaagaaccccaagaatgttcagactacccccggtacatttaagacccctgagggcgaagtgggggccatcgcactcgatttcaagccaggaacttccggctctcccattgtcaacagggagggtaaaatcgtggggctgtacggaaatggcgtagtcaccacatcgggcacgtatgtgagcgccatagctcaagccaaggcatcacaggaagggcctcttccggagatcgaggacgaagtttttaaaaagcgaaacctgactattatggatttgcacccaggatccggtaaaacccggcgctacctacccgctatcgtgagagaggccattaagaggaagctgcggacactcatcttagcgcctacccgagtcgtggccagtgaaatggcagaggctctgaaaggcatgccaataagatatcagactacagccgttaagtctgaacataccgggcgcgagattgtggaccttatgtgccacgctacgttcactatgaggctgctcagccccgtccgtgtgcctaattacaacatgatcatcatggatgaggcacattttacagacccggcctccattgccgctcggggatatatctcaaccagagtaggcatgggtgaagcggcagccatattcatgaccgctactcccccagggtctgtggaggcctttcctcagagcaatgcagttattcaagatgaagagagggacatccccgaacgcagttggaactccggatacgattggattacagacttcccaggcaaaaccgtctggtttgtgcctagcatcaagtctggcaatgatatagccaactgtttgcggaaaaacgggaagagagtgattcagctgtcaagaaagacattcgacactgagtatcagaaaacgaagaataacgactgggattacgtcgtaaccacagacatctccgagatgggagctaatttcagggcggatcgcgtgatcgacccccgtagatgcctcaaaccagttattctgaaggatggtccggaacgggtgatccttgccggccctatgcccgtcactgtggcaagtgctgcccagaggcgcgggcgaattggaagaaaccaaaataaagagggcgaccagtacgtttatatgggtcagccactaaacaatgatgaagaccacgcacattggaccgaggccaagatgctgttggataacataaatacacccgaggggatcattcctgctttatttgaaccagagcgggaaaagagcgccgcgatcgacggcgagtacaggctgcgcggagaagcaagaaaaaccttcgtggagctcatgaggcggggcgatctgcccgtctggctttcgtataaggtggcctctgaggggtttcagtactccgaccgtcgctggtgcttcgatggagaacgaaacaatcaagtactggaggaaaacatggacgtggagatctggactaaagaaggtgagagaaagaaactcaggcctcggtggttggacgctcgcacgtatagcgatccgctggccctaagagagtttaaggagttcgctgcaggcaggcggtcagttagtggggacctgattctcgagataggaaaacttccacagcacctgaccttacgagcccagaatgctttggataacctggtcatgctccacaattctgaacagggcggtaaggcctacagacatgcaatggaggaactgcccgacacaatcgagactcttatgctgctcgcgttgattgccgtgctgaccgggggcgtgacattatttttcctatccggaaagggcctggggaaaaccagcatcggactcctttgtgtcactgcttcaagtgccctgttgtggatggcaagcgttgagcctcactggattgctgcctccatcatactggaatttttcctcatggtgctgcttatccccgagccagatcgccaaaggacacctcaggacaaccagctcgcatatgtagtgattggtctgttgtttatgatcctgacggtcgccgctaacgaaatgggcttactagagaccactaagaaagatctggggattggacatgtggcggccgagaatcaccaacacgcaacaatgctcgacgttgatcttcggcccgcttctgcctggaccctgtacgccgtggcaaccacagtcatcactccaatgatgcgtcatacgatagaaaacaccacagctaatattagcttgactgccatcgcgaaccaggctgccattctgatgggcctcgacaagggttggcctatctccaaaatggatataggggtaccgctgcttgcattaggctgctactcacaggtgaatcccctgaccctcacagccgctgttttgatgctggtggcacactatgccatcattggaccaggcctacaggcgaaggctaccagagaggcccaaaagaggactgcagccgggatcatgaaaaaccctacggtcgacggaattgtggctatcgatctggaccccgtcgtgtacgacgccaagttcgaaaaacagctcggccagataatgcttctgattttgtgtacatctcagatcctgctcatgcgcaccacttgggcactgtgcgagagtatcaccttagctacaggtccacttactaccctgtgggaagggtcgcctggaaagttttggaatacaacgattgccgttagcatggcgaacatcttccggggctcctatctcgccggtgcaggcctagctttctctctgatgaaatcactagggggaggccgaagagggaccggagcccaaggcgagactctgggtgagaagtggaagaggcagctcaatcagcttagcaaatccgaatttaacacatacaagcgcagtgggataatggaggtggatcggtctgaagcaaaagagggactgaagagaggcgaaaccactaaacatgctgtaagccgtggtacagccaagttgaggtggttcgtggagcggaatctggtcaagcccgagggcaaagttattgacctcgggtgtggacgcggcgggtggtcatattactgcgccggattaaagaaagtgaccgaagtcaagggctatacgaaaggtgggccgggacacgaggaaccaatccctatggcgacctacggctggaacctggtgaaacttcattccggcaaagatgtatttttcatgcccccagagaagtgtgacacactgctatgcgatattggggaaagtagccccaatcctactatcgaggagggacgaaccctcagagtgctgaagatggttgaaccgtggttgaggggtaaccagttttgtataaaaatcctgaatccctacatgccatctgtggtcgagacactcgaacaaatgcagcggaagcacggcgggatgcttgtgcgcaaccctctgtccagaaattcaactcacgagatgtattgggtcagctgcggaaccggcaacattgtgtcggctgttaacatgacatctaggatgttactgaatcgattcaccatggcacatcggaaacccacttacgagcgtgacgtagatttgggtgccgggacgagacacgtggctgtcgaacctgaggtggccaacctcgacatcattggacagcgcatcgaaaatattaagaacgagcataaaagtacatggcactatgatgaagacaatccatacaagacctgggcatatcacggctcctacgaggttaagcccagcggctcagcctcctctatggtgaacggggtcgtgaaactgctaactaagccttgggatgtaatcccaatggtgacccaaatagctatgacagacacgaccccctttggacagcagagggttttcaaagagaaggtcgacactcggacaccgagagcgaaacgcggtaccactcagattatggaagtgacagccaagtggctttggggctttctgagcaggaataagaaacctcgaatctgtacccgggaggagttcacaagaaaggtgaggagtaacgcagctatcggggccgtctttgttgatgagaatcaatggaactccgcaaaagaagccgtggaggacgagcgcttctgggatctcgtacatcgtgaacgggagctgcacaagcagggaaaatgcgctacttgcgtgtataatatgatgggcaagagagaaaagaaattgggtgagtttgggaaggccaaaggaagcagggcgatttggtacatgtggctgggcgcacgcttcctcgagttcgaggcccttggctttatgaacgaggaccattggttctctcgagaaaattcactgagtggggtcgagggagaaggtttacacaagctgggctacatattgcgggatatctccaaaattccagggggaaacatgtatgctgacgataccgccggctgggacacgagaatcaccgaggatgacctccagaatgaggcaaagattacagatatcatggaacccgagcatgctctgctagccactagcatatttaaacttacctaccagaacaaggtggttagggtgcaacgccctgctaagaacggtacagtcatggacgtgatctctagacgggatcagagggggtcgggacaggtaggcacttatggcctgaataccttcacgaacatggaagttcagctcattcgtcaaatggagtcagaagggatctttctgccaagcgagttggagacacccaatttagccgaacgagtgctggactggctcgagaaacacggagcagaacgccttaagagaatggcgatttccggtgacgattgtgtcgtgaaaccgatcgacgatcggttcgccaccgctctgactgccctaaacgacatgggcaaggtgaggaaagatatacctcagtgggagcccagtaaggggtggaatgactggcagcaggtcccattttgctctcaccatttccaccaactgattatgaaggatggacgcgaaatcgttgtgccttgtagaaaccaggacgagctcgtaggccgggcaagggtgagccagggtgctgggtggtccttgcgagagacagcctgcctgggaaaatcatacgcacaaatgtggcagcttatgtattttcatcgtagagatctgcgcctcgccgcgaatgctatctgtagtgccgtccccgtggactgggttccaacctctcggactacctggagcattcacgcacaccatcagtggatgacaacggaagatatgttatccgtgtggaacagggtctggatagaggaaaatccctggatggaggacaagacccacgtgtcaagctgggaagaggtaccttacctgggcaaaagagaggaccagtggtgcggctctttgatcgggctgactgcccgcgctacatgggccaccaacattcaagttgcaatcaatcaggtgcggaggctcattggaaacgaaaattatcttgattacatgacttccatgaagcgattcaaaaacgagagtgacccagaaggtgctctgtggtga

SEQ ID NO: 13426 - RNA, 9879 nt, synthetic construct
  misc_feature 1..9879: note = derived and/or modified CDS sequence (opt3) from DENV-1__FJ873814__SS-prME
  source 1..9879: mol_type = other RNA
agcgtgaccatgctgctcatgcttctgcccaccgcattggctttccacttaactacgagaggaggggaacctcatatgatcgtctccaagcaggaaaggggaaaatctctgctgtttaagacctcagccggtgttaatatgtgcacactcattgccatggacctgggagaactttgtgaagatactatgacctacaaatgcccacaaataaccgaggcggaaccggacgatgtggactgttggtgcaatgctaccgatacttgggtaacatatgggacctgtagtcagacgggagagcaccggcgcgacaagcgaagcgtggccctggcaccccatgtcggcttgggtctcgagactcgtaccgaaacatggatgtcctctgagggggcctggaaacagatccagagagtggaaacttgggctctgaggcaccctggattcaccgttgtggcatttttcctggcccatgctattggcacatcgatcacccaaaagggcattatctttatactcttaatgctggtcacgccatcaatggccatgcggtgcgtggggatcggaaaccgcgatttcgtagagggtcttagcggcgcgacttgggttgacgtggtcttggagcacgggagttgtgtgacaaccatggcaaagaataaacccactctggatattgaactactcaagacagaggtgaccaaccctgccatcctgagaaaactttgcattgaagctaagatctccaatacgaccacagactctaggtgtccaactcagggagaggccaccctggtcgaagaacaggatgcaaactttgtttgccggcgcacattcgtggaccgaggctggggtaatgggtgtggattgtttggcaaaggcagcctcctgacttgcgctaagttcaagtgcgtaaccaaattagaggggaagatagtgcagtacgaaaacctgaaatattccgtcattgtgacagttcacaccggagatcaacatcaggtgggtaatgagactacggaacacggcacaatcgccattatcacaccccaggcgcctacttcagagatccagctcaccgactacggggcccttacactggactgtagtccaagaaccggattggattttaacgaaatggtcctactgactatgaaggagaaaagctggctcgtgcataagcaatggttcctggaccttccgctgccctggacatctggcgcatccacgtcacaggagacctggaataggcaggatttgctcgtaacttttaaaacagctcacgccaagaagcaagaagttgtggtcctgggtagccaggagggggctatgcacaccgccttaacaggcgcaactgaaattcagaccagtggaacgaccacaatattcgccggccatctgaaatgccggctaaagatggacaaactcactctgaaggggacctcttatgtgatgtgtacaggatccttcaaacttgagaaggaagtcgctgagactcagcacggtaccgtgttggttcaagtgaagtacgagggcacggatgcgccttgcaaaatcccatttagcacacaggacgaaaagggggtaacccagaacggacgtctgattactgcaaatcccatcgtcacagataaagagaagcctgtgaacatagaaaccgagccacccttcggcgagtcgtatattgttatcggtgccggggaaaaagctctcaagctgtcttggtttaagaaaggctcctcaatcggaaagatgttcgaggccactgcacgcggcgccagaaggatggctattcttggggacaccgcctgggattttggaagtatcggtggcgtgttcacaagcgtcgggaaactggtgcatcaggtatttggaacggcatacggcgtgttgttctccggtgtttcttggaccatgaagattgggataggcatcctcctgacttggttaggactgaatagccggtcaacaagtctatccatgacctgtattgcggtcggcatggtgacactctacctgggggtgatggtccaagctgacagcggatgcgttatcaactggaaaggccgagaacttaagtgtggttctgggatctttgtgactaacgaggtgcacacctggacggaacagtataagttccaggccgattcaccgaaacgcttgagtgcagccattggaaaggcttgggaggagggcgtatgcggtataagaagcgccacaaggctggaaaatatcatgtggaaacagatttccaacgagctcaatcatatcctgttagaaaacgacatgaagtttaccgtcgtggttggcgacgcaaatgggattctggctcaaggcaagaagatgatccggcctcagcccatggagcacaaatactcttggaagtcgtggggcaaggccaaaataatcggggcggatattcagaacactaccttcatcattgacggaccagatacacctgaatgtcccgacgatcagcgcgcctggaatatctgggaggtggaggactatggctttggtatattcactaccaacatttggcttaagttgagagatagctacacacaaatgtgcgaccacaggctcatgtccgctgcaatcaaagattcaaaggccgtccatgctgacatggggtattggattgaaagtgagaaaaatgaaacgtggaagctggcccgtgcatctttcatcgaggtgaagacctgtacttggccaaaaagccacacactatggtccaacggagttctggaatcagagatgataatccccaagatttacggcggtcctatcagccagcataattatcggccaggctactttacccagactgcggggccgtggcacctcggaaaactggagcttgatttcgacttgtgcgaaggcacaaccgtggtagtcgatgagcactgcgggaaccgaggaccctctctgagaacgactaccgtgacaggcaagattatccatgaatggtgttgcaggtcctgtaccttacctccactccgctttcggggtgaggacgggtgctggtacggaatggagataagacccgtgaaagaaaaggaggaaaatctggtcaggagtatggttagcgccggctctggtgaggtggactccttctcacttggcattctgtgtgctagtatcatgatcgaagaggtaatgcgcagccgatggtcgcggaagatgttgatgactgggacactcgccgtgtttctgctactgattatgggacaactcacctggaacgatctgatccgtctttgcattatggtcggcgcaaatgcttccgacagaatggggatgggaacaacttatttggccctgatggcaaccttcaaaatgaggcctatgtttgccgtgggcttactcttccgccggctgacgtctagagaggttcttctgctaacaataggtctcagcctggtggcttcagtcgaattgccaaacagtctggaggaattaggggatggactcgcgatgggcatcatgatgctgaaacttctgaccgagtttcagccccaccagttgtggactaccctcctgtccctaacattcattaaaactaccctgtctcttgactacgcctggaagacgacagcaatggctctcagcatcgtgtccctgtttccgttgtgtctgtcaaccactagccagaaaacaacctggttacctgttctcctgggcagtttcgggtgcaagccacttactatgtttctgattacagaaaacaagatctggggaaggaaatcttggcccttgaatgagggtataatggccatcggcattgtgtccatcctcctgagctcgctactgaagaacgatgtccctcttgccgggcccctcattgctggaggcatgctgatcgcatgttatgtaatatcaggttctagtgccgacttgtccttagagaaagcggctgaagtgagctgggagcaagaagccgagcattctgggaccagccacaatattctggttgaagtgcaggatgacggaacgatgaagatcaaagatgaggagaaggacgatactctcaccatcctgcttaaagcaacactgttggccgtctccggcgtgtacccaatgtcaattcctgctaccctattcgtatggtatttctggcagaagaagaaacagcgaagtggcgtgctgtgggacacacccagcccaccggaagtcgagcgcgcagttctcgatgacgggatataccggatcctgcaaagaggacttttaggtaggtctcaggtgggcgtgggggtctttcaggacggagtgttccatactatgtggcacgttacccgtggcgccgtactgatgtatcagggtaagcgcctcgaaccttcctgggcgtcagtgaaaaaggatttgattagttacgggggaggctggcggtttcaaggcagctggaacacgggggaggaggtccaggtgatcgctgttgaacccggcaaaaatccaaagaacgtgcagacaactcccggtaccttcaagacacctgagggcgaagtcggggccattgcactggactttaaaccaggaacctccggctctcccatcgtgaatagagagggtaagatagtagggctctacggaaacggcgtcgtgactacctcgggcacatatgttagcgccatcgctcaagccaaagcatcacaggaagggcctctgccggagattgaggatgaagtgttcaagaaaaggaatcttacgatcatggacctgcacccaggatccggtaagactcgacggtacttgcccgctattgtccgcgaggccatcaagagaaaactaaggaccctgatactcgcgcctacacgggtggttgccagtgaaatggcagaggctttaaagggcatgccaattcgatatcagaccactgccgtgaaatctgaacatacagggagagagatcgtcgatctgatgtgccacgctacctttacgatgcgccttctgagccccgtgagggtacctaactacaatatgatcattatggacgaggcacatttcactgatccggcctccatcgccgctcgtggatatatatcaacacgggtgggcatgggtgaagcggcagccatttttatgaccgctacacccccagggtctgttgaggccttccctcagagcaacgcagtcatccaagacgaagagagagatattcccgaaaggagttggaactccggatacgactggatcactgattttccaggcaagacagtgtggttcgtgcctagcataaaatctggcaacgacattgccaattgtctccgcaagaacgggaagcgagtcatccagttgtcaagaaaaaccttcgacacagagtatcagaagactaaaaacaatgattgggactacgtagtgacgaccgatatctccgagatgggagctaactttcgggcggacagggttattgatccccgccgttgcctgaagccagtgatcctcaaagacggtccggaaagagtcattctggccggccctatgcccgtgacagttgcaagtgctgcccagcggagggggcgcataggacgaaatcaaaacaaggagggcgatcagtacgtgtatatgggtcagccacttaataacgacgaagatcacgcacattggactgaggccaagatgctactggacaatatcaacacccccgaggggattatccctgctttgttcgaaccagagagagagaaaagcgccgcgatcgatggcgagtaccggttaaggggagaagcacgcaagacatttgtcgagctgatgagaaggggcgacctccccgtgtggctgtcgtataaagtagcctctgaggggttccagtactccgatcggcgttggtgctttgacggagaacgcaataaccaagtgcttgaggaaaatatggacgttgagatttggaccaaggaaggtgagaggaaaaagctgagacctagatggctcgatgctcggacttatagcgacccgttggccctgcgcgagttcaaagaatttgctgcaggcagaaggtcagtcagtggggatctaatactggagatcggaaagctcccacagcaccttacgctgcgggcccagaacgctttagacaatttggtgatgctgcacaactctgaacagggcggtaaggcctaccgacatgcaatggaggaactccccgataccattgagacactgatgcttctggcgctcatcgccgtgttgactgggggcgtcaccctgttctttttatccggaaaaggcctagggaagacaagcattggactgctctgtgttaccgcttcaagtgcccttctgtggatggcaagcgtggagcctcactggatcgctgcctccataatcttggagttctttctgatggtactcctgattcccgagccagacagacaacgcactcctcaggataatcagcttgcatatgtggtcatcggtctcctgttcatgattttgacagtggccgctaacgaaatgggcctgttagagacgaccaaaaaggacctagggatcggacatgttgcggccgagaaccaccaacacgcaactatgctggatgtggacctcaggcccgcttctgcctggacactttacgccgtcgcaaccaccgtaataacaccaatgatgcggcatactattgaaaatacgaccgctaacatcagcctgacagccattgcgaatcaggctgccatcttgatgggcctggataaaggttggcctatatccaagatggacatcggggtgccgctcctggcacttggctgctactcacaggttaaccccttaactctgaccgccgctgtgctcatgttggtcgcacactatgccattatcggaccaggcctgcaggcgaaggctacacgtgaggcccaaaaacgaaccgcagccgggattatgaagaatcctactgtggatggaatcgtcgctatagacctagaccccgtggtttacgatgccaaatttgaaaagcagctgggccagattatgctccttatcctgtgtacgtctcagatcttgctgatgaggacaacctgggcactctgcgagagtattactctggctaccggtccattaacaactctttgggaagggtcgcctggaaaattctggaacaccacaatcgccgtgagcatggcgaatatattccgcggctcctatctggccggtgcaggcctcgctttttctctaatgaagtcactagggggaggccggcgagggacgggagcccaaggcgagaccttgggtgagaagtggaaaagacagctgaaccagctcagcaagtccgagttcaatacttacaaaaggagtgggattatggaggtagaccgctctgaagcaaaggagggacttaaacggggcgaaacaaccaagcatgctgtgagcagaggtactgccaagctgcgttggtttgtcgagaggaacttggttaaacccgagggcaaggtgatcgatctggggtgtggacggggcgggtggtcatattactgcgccggactcaaaaaggtcacagaagtgaaaggctataccaagggtgggccgggacacgaggaatccattccaatggcgacgtacgcttggaatttagtaaaactgcatagtggcaaggacgtgttctttatgcctcccgagaagtgtgatacccttctgtgcgacatcggcgaaagctctccaaaccccacaatagaggaggggcgcactctacgagttctcaaaatggtggaaccttggctgagaggaaatcagttctgtatcaagattttgaacccgtacatgccctccgtcgtggagaccctggaacaaatgcagaggaaacacggtggcatgctcgtccggaatccactttcacgcaacagcacacacgagatgtattgggtgtcgtgcgggactggaaatatcgtttctgcagtaaacatgaccagtagaatgctgttaaacaggtttacaatggcccatcgaaagcctacctacgagcgggatgtggacctgggcgctggtactcgtcacgtcgccgtggaacccgaggttgcaaatttggatattatcgggcagagaattgaaaacatcaaaaatgagcataagtccacgtggcactatgacgaagataacccttacaagacatgggcctatcacggaagctacgaggtgaaaccatcaggctccgcttctagcatggtcaatggcgtggtacgcctcctgaccaagccctgggacgtgatacctatggttactcaaattgcgatgaccgacacaacgccattcgggcagcagagggtctttaaagagaaggtggatacccggactcccagagccaaacgcggaacaacccagatcatggaagtgactgcaaagtggctatggggtttccttagtaggaacaagaaaccgcgaatctgtacacgggaggaatttaccagaaaggtcaggtccaatgctgccattggcgcagttttcgtggacgagaaccaatggaatagcgccaaagaagctgtagaggatgagcgcttttgggacctggtgcatcgtgaacgggagctccacaagcaggggaaatgcgccacatgcgtctataacatgatgggaaagagagaaaagaaactgggcgagttcggtaaggcgaaagggtctagggcaatatggtacatgtggttgggagcccgcttcctggaatttgaggctctcggcttcatgaatgaggatcattggttttcacgagaaaacagtctttccggcgtggagggggaaggactgcacaagttaggttacatcctgcgggacattagcaaaatccctggcgggaatatgtatgccgatgacactgcaggatgggataccagaattacggaggacgatttgcagaacgaggctaagatcaccgacataatggaaccagagcatgccctcctggctacatctatcttcaaactaacttaccagaataaggttgtgagggtccaacgccccgccaagaacggcaccgtgatggatgtaatttcgagacgggaccagaggggttcagggcaggttggaacatatggccttaacacttttaccaatatggaagtgcagctgatccgtcaaatggagagcgaaggcattttcctcccttccgagctggagacgccaaacttggcaaaacgagtcttagactggctggaaaagcacggggcggagcgcctcaaaagaatggccatcagtggagatgactgtgtggtgaagcccatagatgaccggtttgctacagcccttaccgcactgaatgatatgggtaaagtcaggaaggacattccgcagtgggaaccttctaagggctggaacgattggcagcaggttcccttctgcagccaccattttcaccaactaatcatgaaagacgggcgcgagatcgtggtaccatgtagaaatcaggatgaactggtgggacgggctagggtctcccagggcgccggttggtcactccgagagactgcatgcttggggaagagttacgcccaaatgtggcagctgatgtatttccatcgtagagaccttcgcctggcggctaacgccatttgttctgcagtgcctgttgattgggtgcccacaagccggaccacttggtccatacacgcccaccatcagtggatgaccacagaggacatgctctcagtctggaatagggtgtggatcgaagagaacccatggatggaagacaaaacgcacgtaagctcttgggaggaagttccctacttaggaaagagagaggatcagtggtgcggctccctgattggcttgaccgctcgcgccacttgggcaacaaatatccaagtggctattaaccaggtccggaggctgatcgggaatgagaactatctcgactacatgaccagtatgaaacgatttaagaatgaaagcgatcctgagggagccctttggtga

SEQ ID NO: 13427 - RNA, 9879 nt, synthetic construct
  misc_feature 1..9879: note = derived and/or modified CDS sequence (opt3) from DENV-1__JN819403__SS-prME
  source 1..9879: mol_type = other RNA
agcgtgaccatgctgctcatgcttctgcccacagccttggctttccacttaactacgagaggcggggagcctcatatgatcgtctccaagcaggaaaggggaaaatctctgctatttaagacctcagcaggtgttaacatgtgcacactcattgccatggacctgggcgagctttgtgaagatactatgacctacaaatgcccacaaataacagaggcggaaccggacgatgtggactgttggtgcaatgctaccgatacttgggtaacatatgggacctgtagtcagacgggagagcaccggcgcgacaagcgaagcgtggccctggcaccccatgtcggcttgggtctcgagactcgtaccgaaacatggatgtcctctgagggggcctggaaacagatccagagagtggaaacttgggctctgaggcaccctggattcaccgttattgcactgtttctcgcccatgctatcggcacatcgattacccaaaagggcatcatattcatcttactgatgcttgtgacgccatcaatggccatgcggtgcgtcgggattggaaaccgcgattttgtggagggtttgagcggcgcgacttgggtagacgttgtgctggagcacgggagttgtgtcacaaccatggcaaagaataaacccactctagatatcgaactcctgaagacagaggtgaccaaccctgccattcttagaaaactgtgcatcgaagctaagatatccaatacgaccacagactctaggtgtccaactcagggagaggccaccttggtggaagagcaggatgcaaacttcgtctgccggcgcacatttgttgaccgaggctggggtaatgggtgtggactcttcggcaaaggcagcctgttaacttgcgctaagtttaagtgcgtgaccaaactggaggggaagattgtacagtacgaaaacctcaaatattccgtgatcgtcacagtgcacaccggagatcaacatcaggttggtaatgagactacggaacacggcacaattgccaccatcactccccaggcgcctacctcagagatccagcttacagactacggggccctgaccttggactgtagtccaagaactggactagatttcaacgaaatggtgctgctcacaatgaaggagaaaagctggctggtccataagcaatggtttcttgacctgccgttgccctggacgtctggcgcatccacctcacaggagacttggaataggcaggatctcctggtgacattcaaaaccgctcacgccaagaagcaagaagtagttgtgttaggtagccaggagggggctatgcacacagccctgactggcgcaaccgaaattcagacgagtggaaccacaactatatttgccggccatctaaaatgccggctcaagatggacaaactgacccttaaggggacatcttatgtcatgtgtactggatccttcaaattggagaaggaagtggctgagacccagcacggtacggtcctggtgcaagttaagtacgagggcacagatgcgccttgcaaaatcccattcagcacccaggacgaaaagggggtgactcagaacggacgtctcattacagcaaatcccatcgtaaccgataaagagaagcctgtcaacatagaaactgagccaccctttggcgagtcgtatattgtggttggtgccggggaaaaagctctgaagctttcttggttcaagaaaggctcctcaatcggaaagatgtttgaggccaccgcacgcggcgccagaaggatggctatcctgggggacacagcctgggatttcggaagtattggtggcgtgtttacgagcgtcgggaaattggtgcatcaggtattcggaaccgcatacggcgtgctcttttccggtgtttcttggactatgaagatcgggattggcatactgttaacatggctgggactaaatagccggtcaaccagtctctccatgacatgtatcgcggtcggcatggtgactctgtaccttggggtgatggtccaagctgacagcggatgcgttattaactggaaaggccgagaattgaagtgtggttctgggatcttcgtgaccaacgaggtgcacacgtggacagaacagtataagtttcaggccgattcaccgaaacgcctgagtgcagccatcggaaaggcttgggaggagggcgtatgcggtattagaagcgccaccaggctcgaaaatataatgtggaaacagatctccaacgagctgaatcatattttactggaaaacgacatgaagttcactgtcgtggttggcgacgcaaatgggatccttgctcaaggaaaaaagatgattcggcctcagcccatggagcacaaatactcttggaagtcgtggggcaaggccaaaatcataggggcggatatccagaacaccacatttattatcgacggaccagatactcctgaatgtcccgacaatcagcgcgcctggaacatttgggaggtggaggattatggcttcggtatctttaccacaaatatatggttgaagctcagagacagctacacgcaaatgtgcgatcacaggctgatgtccgctgcaattaaagactcaaaggccgtccatgctgatatggggtattggatcgaaagtgagaaaaacgaaacctggaagctagcccgtgcatctttcattgaggtgaagacttgtacatggccaaaaagccacaccctgtggtccaatggagttctcgaatcagagatgatcatacccaagatctacggcggtcctattagccagcataactatcggccaggctacttcactcagacagcggggccgtggcacctgggaaaacttgagttggactttgatctgtgcgaaggcaccacggtggtagtcgacgagcactgcgggaatcgaggaccctctttaagaactaccacagtgaccggcaagatcattcatgaatggtgttgcaggtcctgtactctccctccactgcgcttccggggtgaggatgggtgctggtacggaatggagatcagacccgtgaaagaaaaggaggaaaaccttgtcaggagtatggttagcgccggctctggtgaggtggactccttttcactgggcatattgtgtgctagtattatgatcgaagaggtaatgcgcagccgatggtcgcggaagatgctcatgacagggaccctggccgtgttcctactgctcatcatgggacaactgacatggaatgaccttattcgtttgtgcatcatggtcggcgcaaacgcttccgatagaatggggatgggaactacctatctggccttaatggcaacgtttaaaatgaggcctatgttcgccgtgggcctcctgtttcgccggcttacatctagagaggttctgctactcaccattggtctgagcttggtggcttcagtcgaactgccaaacagtttagaggaactcggggacggactggcgatgggcataatgatgcttaagctgttgactgagttccagccccaccagctctggaccacactgctatccctgacttttatcaaaaccacgctttctctcgattacgcctggaagacaaccgcaatggctctgagcattgtgtccttgttcccgctgtgtttatcaactacaagccagaaaaccacttggctccctgttctgcttggcagttttgggtgcaagccactgacaatgttcttgatcaccgaaaataagatttggggaaggaaatcttggcccctcaacgagggtatcatggccataggcatcgtgtccattctgctaagctcgctgcttaagaatgacgtccctctcgccgggcccctgatcgctggaggcatgttgattgcatgttatgtaatctcaggttctagtgccgatttatccctggagaaagcggctgaagtgagctgggagcaagaagccgagcattctgggacgagccacaacatactcgttgaagtgcaggacgatggaactatgaagattaaagacgaggagcgagatgacaccctgacaatccttctgaaggcaaccttgctagccgtctccggcgtgtacccaatgtcaatccctgctacactgtttgtatggtatttctggcagaaaaagaagcagcgcagtggcgtgctctgggatactcccagcccaccggaagtcgagcgggcagttctggacgatgggatttacagaatacttcaaaggggattactgggtcgttctcaggtgggcgtgggggtcttccaggacggagtgtttcataccatgtggcacgttacgcgcggcgccgtactcatgtatcagggtaaacggttggaaccttcctgggcgtcagtgaagaaagacctgatcagttacgggggaggctggagattccaaggcagctggaatacaggggaggaggtccaggtgattgctgttgaacccggaaagaacccaaaaaatgtgcagactacccccggtacatttaagacccctgagggcgaagtcggggccatcgcactcgatttcaagccaggaacttccggctctcccattgtgaacagggagggtaaaatcgtagggctgtacggaaatggcgtcgtgaccacatcgggcacgtatgttagcgccatagctcaagccaaggcatcacaggaagggcctcttccggagatcgaggacgaagtgtttaaaaagcgaaacctgactattatggatttgcacccaggatccggtaaaacccggcgctacctacccgctatcgtcagagaggccattaagaggaagctgcggacactcatcttagcgcctacccgagtggttgccagtgaaatggcagaggctctgaaaggcatgccaataagatatcagactacagccgtgaagtctgaacataccgggcgcgagattgtcgaccttatgtgccacgctacgttcactatgaggctgctcagccccgtgcgtgtacctaattacaacatgatcatcatggatgaggcacattttacagacccggcctccattgccgctcggggatatatctcaaccagagtgggcatgggtgaagcggcagccatattcatgaccgctactcccccagggtctgttgaggcctttcctcagagcaatgcagtcattcaagatgaagagagggacatccccgaacgcagttggaactccggatacgattggattacagacttcccaggcaaaaccgtgtggtttgtgcctagcatcaagtctggcaatgatatagccaactgtttgcgaaaaaacgggaagagagtcattcagctgtcacggaagacattcgacactgagtatcagaaaacgaagaataacgactgggattacgtagtgaccacagacatctccgagatgggagctaatttcagggcggatcgcgttatcgacccccgtagatgcctcaaaccagtgattctgaaggatggtccggaacgggtcatccttgccggccctatgcccgtgactgttgcaagtgctgcccagaggcgcgggcgaattggaagaaaccaaaataaagagggcgaccagtacgtgtatatgggtcagccactaaacaatgatgaagaccacgcacattggaccgaggccaagatgctgttggataacataaatacacccgaggggatcattcctgctttatttgaaccagagcgggaaaagagcgccgcgatcgacggcgagtacaggctgcgcggagaagcaagaaaaaccttcgtcgagctcatgaggcggggcgatctgcccgtgtggctttcgtataaggtagcctctgaggggtttcagtactccgaccgtcgctggtgcttcgatggagaacgaaacaatcaagtgctggaggaaaacatggacgttgagatctggactaaagaaggtgagagaaagaaactcaggcctcggtggttggacgctcgcacgtatagcgatccgctggccctaagagagtttaaggaattcgctgcaggcaggcggtcagtcagtggggacctgattctcgagataggaaaacttccacagcacctgaccttacgagcccagaatgctttggataacctggtgatgctccacaattctgaacagggcggtaaggcctacagacatgcaatggaggaactgcccgacacaatcgagactcttatgctgctcgcgttgattgccgtgctgaccgggggcgtcacattatttttcctatccggaaagggcctggggaaaaccagcatcggactcctttgtgttactgcttcaagtgccctgttgtggatggcaagcgtggagcctcactggattgctgcctccatcatactggaatttttcctcatggtactgcttatccccgagccagatcgccaaaggacacctcaggacaaccagctcgcatatgtggtcattggtctgttgtttatgatcctgacggtggccgctaacgaaatgggcttactagagaccactaagaaagatctggggattggacatgttgcggccgagaatcaccaacacgcaacaatgctcgacgtggatcttcggcccgcttctgcctggaccctgtacgccgtcgcaaccacagtaatcactccaatgatgcgtcatacgatagaaaacaccacagctaatattagcttgactgccatcgcgaaccaggctgccattctgatgggcctcgacaagggttggcctatctccaaaatggatataggggtgccgctgcttgcattaggctgctactcacaggttaatcccctgaccctcacagccgctgtgttgatgctggtcgcacactatgccatcattggaccaggcctacaggcgaaggctaccagagaggcccaaaagaggactgcagccgggatcatgaaaaaccctacggtggacggaattgtcgctatcgatctggaccccgtggtttacgacacaaagttcgaaaaacagctcggccagataatgcttctgattttgtgtacctctcagatcctgctcatgcgcactacctgggccctgtgcgagagtatcacattagcaactggtccacttaccacactgtgggaagggtcgcctggaaagttttggaatacgaccattgctgtgagcatggccaacatcttccggggctcctatctcgcgggtgccggcctagcattctctctgatgaaatcattggggggaggccgaagagggactggagctcaaggcgagacactgggtgagaagtggaagaggcagctcaatcagcttagcaaatccgaatttaacacctacaagcgcagtgggataatggaggtagatcggtctgaagccaaagagggactgaagagaggcgaaactacaaaacatgcagtgagccgtggtaccgctaagttgaggtggttcgtcgagcggaatctggttaagcccgagggcaaagtgattgacctcgggtgtggacgcggcgggtggtcatattactgcgccggattaaagaaagtcacggaagtgaagggctataccaaaggtgggccgggacacgagggcccaatccctatggccacatacggctggaacctggtaaagcttcattccgggaaagatgtgtttttcatgcccccagaaaagtgtgacactctgctatgcgatattggagagagtagccccaatcctaccatcgaagagggtcgaacactcagagttctgaagatggtggagccgtggttgaggggcaaccagttttgtataaaaatcctgaatccctacatgccatctgtcgtggaaactctcgagcaaatgcagcggaagtatgggggaatgcttgtccgcaaccctctgtccagaaattcaacccacgaaatgtactgggtgagctgcggcacaggtaacattgtttcggcggtaaacatgacctctaggatgttactgaatcgattcactatggctcaccggaaacccacgtatgagcgtgacgtggatttgggggcaggaacaagacatgtcgccgtggagcctgaagttgctaacctcgacatcattggccagcgcatcgagaatattaagaacgaacacaaaagtacctggcattacgatgaggacaatccatataagacttgggcctaccacggctcctatgaagtgaagcccagcgggtcagcatcctctatggtcaacggagtggtaaggctgctaaccaaaccttgggatgtgatcccaatggttacacaaatagccatgacggacaccactccctttggtcagcagcgggtcttcaaggagaaagtggacacaagaaccccgcgcgctaagaggggcactacacagattatggaggtgaccgcgaaatggctttgggggtttctgagccgaaataagaagcctcggatctgtacaagagaagagttcactaggaaagtccgcagtaacgccgcaatcggagctgtttttgtggatgaaaatcaatggaactccgccaaggaggcagtagaagacgagcgtttctgggatctcgtgcaccgggagagagaactgcataaacagggcaagtgcgccacctgcgtctacaatatgatgggtaaaagggagaagaagttgggggaatttggaaaagctaagggcagccgcgccatttggtacatgtggctgggcgcgcgattcctcgagttcgaagcacttgggtttatgaacgaggaccactggttctctcgggagaattcactgagtggagtggaaggtgagggcttacataaactggggtatatattgagagatatctccaagattccaggaggcaacatgtacgccgacgatacggctggttgggacaccaggatcacagaagatgacctccagaatgaggccaaaattactgatatcatggagcccgaacacgcactgctagctaccagcatatttaagcttacatatcagaacaaagttgtgcgcgtccaaagacctgccaagaacgggactgtgatggacgtaatctctcggagggatcagcgtggatcgggccaggttggcacctacgggctgaatacgttcacaaacatggaggtgcagctcattcgacaaatggaatcagagggaatctttctgccaagcgaattggagacccccaatttagctgagcgcgtcctggactggctcgaaaagcatggtgccgagagacttaaacggatggcaatttccggcgacgattgtgtggtgaagccgatcgacgataggttcgcgactgccctgacagctctaaacgacatggggaaagtccgcaaggatatacctcagtgggaacccagtaaaggatggaatgactggcagcaggttccattttgctctcaccacttccatcaactgattatgaaggatggcagagagatcgtggtaccttgtcggaaccaggacgaactcgtgggtagggcccgagtcagccagggggcaggatggtccttgcgtgagaccgcttgcctgggcaagtcatatgcccaaatgtggcagcttatgtactttcacagacgcgatctgcggctcgcagccaatgcgatctgtagtgctgtgcccgttgactgggtgccaacttctaggaccacatggagcattcatgcccaccaccagtggatgacgaccgaggatatgttatccgtctggaacagagtgtggatagaagagaatccctggatggaagacaaaactcatgtatcaagctgggaggaagttccttatctgggcaagcgcgaggaccagtggtgcgggtctttgatcggactgacagcacgggccacctgggctactaacattcaagtggccatcaatcaggtcaggcgactcattggtaacgagaattaccttgattacatgacatccatgaaaagattcaagaacgaaagtgacccagagggcgcactgtggtga

SEQ ID NO: 13428 - RNA, 9879 nt, synthetic construct
  misc_feature 1..9879: note = derived and/or modified CDS sequence (opt3) from DENV-1__KF973453__SS-prME
  source 1..9879: mol_type = other RNA
agcgtgaccatgctgctcatgcttctgcccacagccttggctttccacttaactacgagaggcggggagcctcatatgatcgtctccaagcaggaaaggggaaaatctctgctatttaagacctcagcaggtgttaacatgtgcacactcattgccatggacctgggcgagctttgtgaagatactatgacctacaaatgcccacaaataacagaggcggaaccggacgatgtggactgttggtgcaatgctaccgatacttgggtaacatatgggacctgtagtcagacgggagagcaccggcgcgacaagcgaagcgtggccctggcaccccatgtcggcttgggtctcgagactcgtaccgaaacatggatgtcctctgagggggcctggaaacagatccagagagtggaaacttgggctctgaggcaccctggattcaccgttattgcactgtttctcgcccatgctatcggcacatcgattacccaaaagggcatcatattcatcttactgatgcttgtgacgccatcaatggccatgcggtgcgtcgggattggaaaccgcgattttgtggagggtttgagcggcgcgacttgggtagacgttgtgctggagcacgggagttgtgtcacaaccatggcaaagaataaacccactctagatatcgaactcctgaagacagaggtgaccaaccctgccattcttagaaaactgtgcatcgaagctaagatatccaatacgaccacagactctaggtgtccaactcagggagaggccaccttggtggaagagcaggatgcaaacttcgtctgccggcgcacatttgttgaccgaggctggggtaatgggtgtggactcttcggcaaaggcagcctgttaacttgcgctaagtttaagtgcgtgaccaaactggaggggaagattgtacagtacgaaaacctcaaatattccgtgatcgtcacagtgcacaccggagatcaacatcaggttggtaatgagactacggaacacggcacaattgccaccatcactccccaggcgcctacctcagagatccagcttacagactacggggccctgaccttggactgtagtccaagaactggactagatttcaacgaaatggtgctgctcacaatgaaggagaaaagctggctggtccataagcaatggtttcttgacctgccgttgccctggacgtctggcgcatccacctcacaggagacttggaataggcaggatctcctggtgacattcaaaaccgctcacgccaagaagcaagaagtagttgtgttaggtagccaggagggggctatgcacacagccctgactggcgcaaccgaaattcagacgagtggaaccacaactatatttgccggccatctaaaatgccggctcaagatggacaaactgacccttaaggggacatcttatgtcatgtgtactggatccttcaaattggagaaggaagtggctgagacccagcacggtacggtcctggtgcaagttaagtacgagggcacagatgcgccttgcaaaatcccattcagcacccaggacgaaaagggggtgactcagaacggacgtctcattacagcaaatcccatcgtaaccgataaagagaagcctgtcaacatagaaactgagccaccctttggcgagtcgtatattgtggttggtgccggggaaaaagctctgaagctttcttggttcaagaaaggctcctcaatcggaaagatgtttgaggccaccgcacgcggcgccagaaggatggctatcctgggggacacagcctgggatttcggaagtattggtggcgtgtttacgagcgtcgggaaattggtgcatcaggtattcggaaccgcatacggcgtgctcttttccggtgtttcttggactatgaagatcgggattggcatactgttaacatggctgggactaaatagccggtcaaccagtctctccatgacatgtatcgcggtcggcatggtgactctgtaccttggggtgatggtccaagctgacagcggatgcgttattaactggaaaggccgagaattgaagtgtggttctgggatcttcgtgaccaacgaggtgcacacgtggacagaacagtataagtttcaggccgattcaccgaaacgcctgagtgcagccatcggaaaggcttgggaggagggcgtatgcggtattagaagcgccaccaggctcgaaaatataatgtggaaacagatctccaacgagctgaatcatattttactggaaaacgacatgaagttcactgtcgtggttggcgacgcaaatgggatccttgctcaaggaaaaaagatgattcggcctcagcccatggagcacaaatactcttggaagtcgtggggcaaggccaaaatcataggggcggatatccagaacaccacatttattatcgacggaccagatactcctgaatgtcccgacaatcagcgcgcctggaacatttgggaggtggaggattatggcttcggtatctttaccacaaatatatggttgaagctcagagacagctacacgcaaatgtgcgatcacaggctgatgtccgctgcaattaaagactcaaaggccgtccatgctgatatggggtattggatcgaaagtgagaaaaacgaaacctggaagctagcccgtgcatctttcattgaggtgaagacttgtacatggccaaaaagccacaccctgtggtccaatggagttctcgaatcagagatgatcatacccaagatctacggcggtcctattagccagcataactatcggccaggctacttcactcagacagcggggccgtggcacctgggaaaacttgagttggactttgatctgtgcgaaggcaccacggtggtagtcgacgagcactgcgggaatcgaggaccctctttaagaactaccacagtgaccggcaagatcattcatgaatggtgttgcaggtcctgtactctccctccactgcgcttccggggtgaggatgggtgctggtacggaatggagatcagacccgtgaaagaaaaggaggaaaaccttgtcaggagtatggttagcgccggctctggtgaggtggactccttttcactgggcatattgtgtgctagtattatgatcgaagaggtaatgcgcagccgatggtcgcggaagatgctcatgacagggaccctggccgtgttcctactgctcatcatgggacaactgacatggaatgaccttattcgtttgtgcatcatggtcggcgcaaacgcttccgatagaatggggatgggaactacctatctggccttaatggcaacgtttaaaatgaggcctatgttcgccgtgggcctcctgtttcgccggcttacatctagagaggttctgctactcaccattggtctgagcttggtggcttcagtcgaactgccaaacagtttagaggaactcggggacggactggcgatgggcataatgatgcttaagctgttgactgagttccagccccaccagctctggaccacactgctatccctgacttttatcaaaaccacgctttctctcgattacgcctggaagacaaccgcaatggctctgagcattatctccttgttcccgctgtgtttatcaactacaagccagaaaaccacttggctccctgtgctgcttggcagttttgggtgcaagccactgacaatgttcttgattaccgaaaataagatctggggaaggaaatcttggcccctcaacgagggtataatggccatcggcattgtttccatcctgctaagctcgctgcttaagaatgacgtgcctctcgccgggcccctgattgctggaggcatgttgatcgcatgttatgtcatatcaggttctagtgccgatttatccctggagaaagcggctgaagtaagctgggagcaagaagccgagcattctgggacgagccacaacattctcgtggaagttcaggacgatggaactatgaagatcaaagacgaggagcgagatgacaccctgacaatccttctgaaggcaaccttgctagccgtgtccggcgtctacccaatgtcaattcctgctacactgtttgtgtggtatttctggcagaaaaagaagcagcgcagtggcgtactctgggatactcccagcccaccggaagtggagcgggcagtcctggacgatgggatatacagaatccttcaaaggggattactgggtcgttctcaggttggcgtgggggtgttccaggacggagtctttcataccatgtggcacgtgacgcgcggcgccgttctcatgtatcagggtaaacggttggaaccttcctgggcgtcagtaaagaaagacctgattagttacgggggaggctggagattccaaggcagctggaatacaggggaggaggtgcaggtcatcgctgtggaacccggaaagaacccaaaaaatgttcagactacccccggtacatttaagacccctgagggcgaagtgggggccattgcactcgatttcaagccaggaacttccggctctcccatcgtcaacagggagggtaaaatagtggggctgtacggaaatggcgtagtcaccacatcgggcacgtatgtgagcgccatcgctcaagccaaggcatcacaggaagggcctcttccggagattgaggacgaagtttttaaaaagcgaaacctgactatcatggatttgcacccaggatccggtaaaacccggcgctacctacccgctattgtgagagaggccatcaagaggaagctgcggacactcatattagcgcctacccgagtcgtggccagtgaaatggcagaggctctgaaaggcatgccaattagatatcagactacagccgttaagtctgaacataccgggcgcgagatcgtggaccttatgtgccacgctacgttcactatgaggctgctcagccccgtccgtgtgcctaattacaacatgatcattatggatgaggcacattttacagacccggcctccatcgccgctcggggatatatatcaaccagagtaggcatgggtgaagcggcagccattttcatgaccgctactcccccagggtctgtggaggcctttcctcagagcaatgcagttatccaagatgaagagagggacattcccgaacgcagttggaactccggatacgattggatcacagacttcccaggcaaaaccgtctggtttgtgcctagcataaagtctggcaatgatattgccaactgtttgcgaaaaaacgggaagagagtgatccagctgtcacggaagacattcgacactgagtatcagaaaacgaagaataacgactgggattacgtcgtaaccacagacatctccgagatgggagctaatttcagggcggatcgcgtgattgacccccgtagatgcctcaaaccagttatcctgaaggatggtccggaacgggtgattcttgccggccctatgcccgtcactgtggcaagtgctgcccagaggcgcgggcgaataggaagaaaccaaaataaagagggcgaccagtacgtttatatgggtcagccactaaacaatgatgaagaccacgcacattggaccgaggccaagatgctgttggataacatcaatacacccgaggggattatccctgctttatttgaaccagagcgggaaaagagcgccgcgatcgacggcgagtacaggctgcgcggagaagcaagaaaaaccttcgtggagctcatgaggcggggcgatctgcccgtctggctttcgtataaggtggcctctgaggggtttcagtactccgaccgtcgctggtgcttcgatggagaacgaaacaatcaagtactggaggaaaacatggacgtggagatttggactaaagaaggtgagagaaagaaactcaggcctcggtggttggacgctcgcacgtatagcgatccgctggccctaagagagtttaaggaattcgctgcaggcaggcggtcagttagtggggacctgatactcgagatcggaaaacttccacagcacctgaccttacgagcccagaatgctttggataacctggtcatgctccacaattctgaacagggcggtaaggcctacagacatgcaatggaggaactgcccgacacaattgagactcttatgctgctcgcgttgatcgccgtgctgaccgggggcgtgacattatttttcctatccggaaagggcctggggaaaaccagcattggactcctttgtgtcactgcttcaagtgccctgttgtggatggcaagcgttgagcctcactggatcgctgcctccataatcctggaatttttcctcatggtgctgcttattcccgagccagatcgccaaaggacacctcaggacaaccagctcgcatatgtagtgatcggtctgttgtttatgattctgacggtcgccgctaacgaaatgggcttactagagaccactaagaaagatctggggatcggacatgtggcggccgagaatcaccaacacgcaacaatgctcgacgttgatcttcggcccgcttctgcctggaccctgtacgccgtggcaaccacagtcataactccaatgatgcgtcatacgattgaaaacaccacagctaatatcagcttgactgccattgcgaaccaggctgccatcctgatgggcctcgacaagggttggcctatatccaaaatggatatcggggtaccgctgcttgcattaggctgctactcacaggtgaatcccctgaccctcacagccgctgttttgatgctggtggcacactatgccattatcggaccaggcctacaggcgaaggctaccagagaggcccaaaagaggactgcagccgggattatgaaaaaccctacggtcgacggaatcgtggctatagatctggaccccgtcgtgtacgacacaaagttcgaaaaacagctcggccagattatgcttctgatcttgtgtacctctcagatcctgctcatgcgcactacctgggccctgtgcgagagtattacattagcaactggtccacttaccacactgtgggaagggtcgcctggaaagttttggaatacgaccatcgctgttagcatggccaacatattccggggctcctatctcgcgggtgccggcctagcattctctctgatgaaatcattggggggaggccgaagagggactggagctcaaggcgagacactgggtgagaagtggaagaggcagctcaatcagcttagcaaatccgaatttaacatttacaagcgcagtgggatcatggaggtggatcggtctgaagccaaagagggactgaagagaggcgaaaccactaaacatgcagtaagccgtggtacagctaagttgaggtggttcgtggagcggaatctggtcaagcccgagggcaaagttattgacctcgggtgtggacgcggcgggtggtcatattactgcgccggattaaagaaagtgaccgaagtcaagggctatacgaaaggtgggccgggacacgaggaaccaatccctatggccacctacggctggaacctggtgaagcttcattccggcaaagatgtatttttcatgcccccagagaagtgtgacacactgctatgcgatataggggaaagtagccccaatcctactatcgaggagggacgaaccctcagagtgctgaagatggttgaaccgtggttgaggggtaaccagttttgtattaaaatcctgaatccctacatgccatctgtggtcgagacactcgaacaaatgcagcggaagtatggcgggatgcttgtgcgcaaccctctgtccagaaattcaactcacgagatgtactgggtcagctgcggaaccggcaacattgtgtcggcggttaacatgacatctaggatgttactgaatcgattcaccatggctcaccggaaacccacttatgagcgtgacgtagatttgggtgcagggacgagacatgtggccgtcgaacctgaggtggctaacctcgacatcattggacagcgcatcgaaaatataaagaacgagcacaaaagtacatggcattacgatgaagacaatccatataagacctgggcctaccacggctcctatgaggttaagcccagcggctcagcatcctctatggtgaacggggtcgtgaggctgctaactaaaccttgggatgtaattccaatggtgacccaaatcgccatgacagacacgaccccctttggacagcagcgggttttcaaggagaaagtcgacactagaacaccgcgcgctaagaggggtaccactcagatcatggaagtgacagcgaaatggctttggggctttctgagccgaaataagaagcctcggatttgtaccagagaggaattcacaaggaaagtgcgcagtaacgccgcaataggggctgtctttgttgatgagaatcaatggaactccgccaaggaagcagtggaggacgagcgtttctgggatctcgtacaccgggaaagagagctgcataaacagggaaagtgcgccacttgcgtgtacaatatgatgggcaaaagggaaaagaagttgggtgagtttgggaaagctaagggaagccgcgccatctggtacatgtggctgggcgcgcgattcctcgaattcgaggcacttggctttatgaacgaggaccactggttctctcgggaaaattcactgagtggggtcgagggagaaggtttacataaactgggctatattttgagagatatctccaagattccagggggaaacatgtacgccgacgataccgctggctgggacacgaggatcaccgaggatgacctccagaatgaggccaaaataacagatatcatggaacccgagcacgcactgctagctactagcatttttaagcttacctatcagaacaaagtggttcgcgtgcaaagacctgccaagaacggtacagtcatggacgtgatctctcggagggatcagcgtgggtcgggacaggtaggcacttacggcctgaataccttcacgaacatggaagttcagctcattcgacaaatggagtcagaagggatctttctgccaagcgagttggagacacccaatttagctgaacgcgtgctggactggctcgagaagcatggagccgaaagacttaaacggatggcaatatccggtgacgattgtgtcgtgaagccgattgacgataggttcgcgaccgccctgactgctctaaacgacatgggcaaagtgcgcaaggatatccctcagtgggagcccagtaaagggtggaatgactggcagcaggtcccattttgctctcaccacttccatcaactgatcatgaaggatggaagagaaattgttgtgccttgtcggaaccaggacgagctcgtaggcagggcccgagtgagccagggtgcagggtggtccttgcgtgagacagcttgcctgggaaagtcatatgcccaaatgtggcagcttatgtactttcacagacgcgatctgcggctcgcagccaatgcgatatgtagtgctgtccccgtggactgggttccaacctctaggactacctggagcatccatgcccaccaccagtggatgacaacggaagatatgttatccgtgtggaacagagtctggattgaggaaaatccctggatggaggacaaaacccatgtgtcaagctgggaagaggtaccttatctgggcaagcgcgaggaccagtggtgcggctctttgatcgggctgactgcacgggccacatgggctaccaacattcaagttgccatcaatcaggtgaggcgactcataggaaacgaaaattaccttgattacatgacttccatgaaaagattcaagaacgagagtgacccagaaggtgcactgtggtga

SEQ ID NO: 13429 - RNA, 9879 nt, synthetic construct
  misc_feature 1..9879: note = derived and/or modified CDS sequence (opt3) from DENV-1__KF973454__SS-prME
  source 1..9879: mol_type = other RNA
agcgtgaccatgctgctcatgcttctgcccacagccttggctttccacttaactacgagaggcggggagcctcatatgatcgtctccaagcacgaaaggggaaaatctctgctatttaagacctcaacaggtgttaacatgtgcactctcattgcaatggacctgggcgagctttgtgaagataccatgacatacaaatgcccacggataaccgaggccgaaccggacgatgtggactgttggtgcaatgcgactgatacatgggtaacctatgggacgtgtagtcagactggagagcatcgccgagacaagcgtagcgtggctctggccccccacgtcggcttgggtctcgagaccagaacagaaacttggatgtcctctgagggggcatggaaacaaatccagagggtggaaacctgggccctgcggcatcctggattcacagttattgctctgtttctcgcacacgccatcggcacctcgattacgcagaagggcatcatattcatcttactgatgcttgtgactccatcaatggctatgcgctgcgtcgggattggaaacagagattttgtggagggtttgagcggcgccacatgggtagacgttgtgctggagcacgggagttgtgtcaccactatggcgaagaataaacccacactagatatcgaactcctgaagaccgaggtgacgaaccctgcagtgcttaggaaactgtgcattgaagccaagatctccaataccacaactgactctcggtgtccaacccagggagaggctacattggtcgaagagcaagatgccaacttcgtttgccgccgaactctcgtggacagaggctggggtaatgggtgtggactgtttggcaaaggcagcttactgacctgcgcaaagttcaagtgcgtaacaaaactcgaggggaagatagtgcagtacgaaaaccttaaatattccgtcattgtgaccgttcatactggagatcagcaccaggtgggtaatgagacgacagaacatggcaccatcgctactattaccccccaagcccctacatcagagatccagctgaccgactacggggcgttggccctagactgtagtccaaggactggactggattttaacgaaatggtcctcctgacaatgaaggagaaaagctggcttgtgcacaagcagtggttcctggacttgccgctcccctggacgtctggcgcatccacctcacaggagacttggaatcggcaagatctgttagtaacatttaaaaccgctcacgccaagaagcaggaagttgtggtcctgggtagccaggagggggctatgcatacagccctaactggcgcaaccgaaatccaaacgagtggaaccacaactattttcgccggccacctcaaatgccgtctgaagatggacaaacttaccttgaaggggacatcttatgtgatgtgtactggatcctttaaactggagaaggaagtcgctgagacccagcatggtacggtgctcgttcaggtgaagtacgagggcacagatgcgccttgcaaaataccattcagcacccaggacgaaaagggggtaactcaaaacggacgcctgatcacagcaaatcccattgtcaccgataaagagaagcctgtgaacatcgaaactgagccacccttcggcgagtcgtatatagttgtgggtgccggggaaaaagctcttaagctgtcttggtttaagaaaggctcctcaattggaaagatgttcgaggccaccgcaagaggcgccaggcggatggctatcttgggggacacagcctgggattttggaagtatcggtggcgtcttcacgagcgtggggaaactcgtacaccaggtgtttggaaccgcatacggcgttctgttctccggtgtctcttggactatgaagattgggatcggcattttactgacatggctaggactcaatagccgatcaaccagtctgtccatgacatgtatagcggtgggcatggtgactctttacttgggggtcatggttcaggctgacagcggatgcgtgatcaactggaaaggccgcgaactgaagtgtggttctgggatttttgtgaccaacgaggtacatacgtggacagaacagtataagttccaagccgattcaccgaaaagactcagtgcagccatcggaaaggcttgggaggagggcgtctgcggtatcaggagcgccacccggctggaaaatattatgtggaaacagatatccaacgagttaaatcacatcctgcttgaaaacgacatgaagtttactgtggttgtgggcgacgcaaatgggattttggctcagggaaaaaagatgatccgccctcagcccatggagcacaaatactcttggaagtcgtggggcaaggccaaaattatcggggcggatatacaaaacaccacattcatcattgacggaccagatactcctgaatgtcccgacgatcagagagcctggaatatctgggaggtcgaggactatggctttggtattttcaccacaaacatctggctcaagctgagggatagctacacgcagatgtgcgaccatcgtctaatgtccgctgcaataaaagattcaaaggccgtgcacgctgacatggggtattggattgaaagtgagaaaaatgaaacctggaagctggcccgggcatcttttatcgaggttaagacttgtacatggccaaaaagccataccctctggtccaacggagtgctggaatcagagatgattatccccaagatatacggcggtcctatcagccagcacaattatcgaccaggctacttcactcaaacagcggggccgtggcaccttggaaaattggagctggatttcgacttatgcgaaggcaccacggtagtcgtggatgagcattgcgggaacagaggaccctctctcaggactaccacagtgaccggcaagattatccacgaatggtgttgccgctcctgtactctgcctccacttcggtttagaggtgaggacgggtgctggtacggaatggagattaggcccgtcaaagaaaaggaggaaaatctggttcgcagtatggtgagcgccggctctggtgaggtagactccttctcattgggcatcctctgtgtgagtataatgattgaagaggtcatgcgaagccggtggtcgcgtaagatgctgatgacagggaccctagctgtgtttctgctcctgatcatgggacagcttacatggaacgatttgatcagactgtgcattatggttggcgccaatgcatccgacaggatggggatgggaactacctatttagctctcatggccacgttcaaactgcgccctatgtttgcagtgggcatccttttccggagactgacatctagggaggtcctactcctgaccattggtttgagcctggtggcctcagttgaattaccaaacagtctcgaggaactgggggatggacttgctatgggcataatgatgctgaagttgctcactgagtttcagccccatcaactgtggaccacactactgtcccttactttcatcaaaaccacgctctctctggactacgcgtggaagacaaccgccatggcattgagcattgtgtccctgtttccgatctgtttatcaactacaagccagaaaaccacttggctccctgtcctgcttggcagtttcgggtgcaagccactgacaatgtatttgattaccgaaaacaagatctggggacgaaaatcttggcccataaatgagggtatcatggctattggcatcgtatccattctcctgagctcgctactgaagaacgatgtgcctcttgccgggcccctcatcgccggaggcatgctgatagcttgttacgttatttcaggttctagtgcagacttgtccttagagaaagccgcggaagtgagctgggagcaggaagctgagcactctgggacgagccataatatcctggtcgaagtgcaggatgacggaactatgcgcatcaaggatgaggagaaagacgataccctcacaattctgcttaaggccaccctgttggcagtatccggcgtgtatccaatgtcaatacctgccacactatttgtctggtacttctggcaaaaaaagaagcagcggagtggcgttctgtgggacactcccagcccaccggaagtggagagagctgtgctcgatgacgggatctataggattctgcagcgtggacttttaggtcgctctcaggtcggcgtgggggtttttcaagacggagtattccacaccatgtggcacgtgacgcggggcgcagtcctgatgtaccagggtaaaagactcgaaccttcctgggcctcagtgaagaaagatttgatcagttacgggggaggctggaggttccagggcagctggaacacaggggaggaggttcaggtgattgcggtcgaacccggaaagaatccaaaaaacgtgcaaactacccccggtacatttaagacccctgagggcgaagtaggggctatcgccctggacttcaagccaggaacttccggctctcccatagtcaatcgagagggtaaaatcgtggggctctatggaaacggcgttgtgaccacatcgggcacgtacgtcagcgcaattgcccaggctaaggcctcacaggaagggcctctgccggagatcgaggatgaagtgtttaaaaagcggaatcttactattatggacctgcatccaggatccggtaaaacccgcagatatttgcccgcaatcgttagggaggctataaagcggaagctacgaacactgattctcgcccctaccagagtggtcgcgagtgaaatggccgaggcattaaaaggcatgccaatccgctaccaaactacagctgtgaagtctgaacacaccgggagggagatcgtagatctgatgtgccatgccacgttcactatgcgtcttctgagccccgtgcgggttcctaactataatatgattatcatggacgaggctcactttacagatccggcatccatagccgccagaggatacatttcaaccagggtcggcatgggtgaagctgcggcaatcttcatgaccgccactcccccagggtctgtggaggcttttcctcagagcaacgccgtgattcaggacgaagagcgcgatatccccgaacgaagttggaattccggatatgactggataacagatttcccaggcaaaaccgtctggtttgtacctagcattaagtctggcaacgacatcgcaaattgtctcagaaaaaacgggaagcgggtgatccagttgtcaaggaagacattcgacactgagtaccaaaaaacgaagaacaatgattgggactacgttgtgaccacagatatttccgagatgggagccaactttcgcgctgaccgtgtcatcgatcccagacggtgcctgaaaccagtgattctcaaggacggtccggaaagggttatactggcgggccctatgcccgtgactgtcgccagtgcagctcagcgccgagggagaatcggacggaatcagaacaaagagggcgatcagtatgtgtacatgggtcaaccacttaataacgacgaagatcatgcccactggaccgaggcaaagatgctactggacaatattaacacacccgaggggatcatccctgccttgttcgaaccagagagggaaaagagcgctgccattgatggcgagtatcgcttaagaggagaagcgaggaaaaccttcgtagagctgatgcggcgtggcgacctccccgtgtggctgtcgtacaaggttgcatctgaggggtttcagtattccgatcgccgatggtgcttcgacggagaaagaaataaccaggtccttgaggaaaatatggacgtggagatatggactaaagaaggtgagaggaagaaactgcggcctcgctggctcgatgccagaacgtacagcgacccgttggctctgagggagtttaaggaattcgccgctggccggcgatcagtgagtggggatctaatcctggagattggaaaactcccacagcaccttaccctgagagcacaatctgccttagacaacttggtcatgctgcataattccgaacagggcggtaaggcttatcgccacgccatggaggaactccccgatacaatcgagactctgatgcttctggcactcattgcggttttgaccgggggcgtgatgctgtttttcttaagcggaaagggcctagggaaaacatcaatcggactgctctgtgtaaccgccagtagcgctcttctgtggatggcctccgtggagcctcattggatagcagcttctatcattttggaatttttcctgatggtcctcctgatccccgagccagacaggcagcggactcctcaggataaccaacttgcctacgtggttattggtctcctgtttatgatcttgacagtggcagccaatgaaatgggcctgttagagacgaccaagcgtgacctagggataggacacgtcgctgcggagaaccaccagcatgccactatgctggatgtagacctcagacccgcaagcgcttggacactttacgccgtggccaccaccgttattacaccaatgatgaggcacactatcgaaaacacgaccgcaaatatttccctgacagctatcgccaaccaggcggctatattgatgggcctggataaaggttggcctatctcaaagatggacattggggtgccgctcctggcccttggctgctattctcaagtcaatcccttaactctgaccgcagccgtgctcatgttggtcgctcattacgcaatcattggaccaggcctgcaggccaaagcgacacgcgaggctcagaagcggaccgccgcagggatcatgaagaaccctactgtggatggaatagttgccattgacctagaccccgtggtatatgatgctaaattcgaaaagcagctgggccaaatcatgctccttatcctgtgtacgagtcagattttgctgatgcgaacaacctgggccctctgcgagtcgatcactctggcaaccggtccattaacaactctttgggaagggagccctggaaaattttggaataccacaatagctgtgtccatggccaacattttcagaggctcttacctggcgggtgccggcctcgcattttcactaatgaagagcctggggggaggcaggcgcgggacgggagctcagggcgagaccttgggtgagaaatggaagcggcagctgaatcaactctccaagcccgaattcaacacttataaaagaagtgggatcatggaggtcgaccgttctgaagccaaggagggacttaaaaggggcgaaacaaccaagcacgcagttagccggggtactgctaaactgcgctggttcgtggagcgaaatttggtcaagccggagggcaaggtgattgatctggggtgtggaagaggcgggtggtcatactattgcgccggactcaaaaaggtaacagaagtgaaaggctacaccaagggtgggccaggacatgaggaacctatccccatggccacgtacggctggaacttagttaaactgcactccggcaaggacgtgtttttcatgccacccgagaaatgtgatacccttctgtgcgacataggggaaagtagccctaatccgacaatcgaggagggaaggactctacgggtcctcaagatggtggaaccctggctgcgcggtaaccagttttgtattaagatcttgaatccatatatgccttctgtcgtggagaccctggaacagatgcagagaaaacacggcgggatgctcgttaggaaccccctttcccgaaattcaacacatgagatgtactgggtaagctgcggaactggcaacattgtgtcggcggtcaatatgacctctcggatgctgttaaaccgtttcacaatggctcacagaaagcctacctatgagcgcgatgtggacctgggtgcagggactaggcatgttacggtggaaccagaggtcgccaacttggatatcattggacaacggatcgaaaatataaaaaacgagcacaagagtacatggcactacgacgaagataatccctataaaacctgggcttaccatggctcctatgaggtgaagcctagcggctcagcctcctctatggtaaacggggtggttagactcctgactaagccatgggacgtcattcccatggtgacccagatcgcaatgacagacacgaccccgtttggacagcaacgcgtgttcaaagagaaggtcgatactaggacacctcgagccaaacggggtaccactcagatcatggaagttacagctaagtggctatggggctttcttagcagaaataaaaagccaaggatttgtacccgcgaggaattcacacgtaaggtgcggagtaacgcggccataggggcagtatttgtggacgagaatcagtggaactccgctaaagaagccgtcgaggatgagagattctgggacctggtgcacagggaacgcgagctccataagcagggaaaatgcgcaacttgcgtttacaatatgatgggcaagcgagaaaaaaagctgggtgagtttgggaaggccaaaggaagccgggctatctggtacatgtggttgggcgccagattcctggaatttgaggcgctcggcttcatgaacgaggatcactggttctctagggaaaattcacttagtggggtggagggagaaggtctgcataagttaggctatattctgcgcgacatctccaaaattcccgggggaaacatgtacgcagatgacaccgccggctgggatacgagaatcaccgaggacgatttgcaaaatgaggctaagataacagacatcatggaacctgagcacgccctcctggcaactagcatttttaaactaacctatcagaacaaggtcgtgcgggtacagaggccagctaaaaatggtacagttatggatgtgatctctcgtcgagaccagcgcgggtcgggacaagtcggcacttacggccttaacaccttcacgaacatggaagtgcagctgattagacagatggagtcagaagggatctttctccccagcgagctggagacaccgaatttggccgaacgggtgttagactggctggagaagcacggagctgaaaggctcaagcgcatggccatatccggtgatgactgtgtcgttaaacctattgatgacagattcgcaaccgcgcttactgccctgaacgatatgggcaaggtgcggaaagacatcccccagtgggagccaagtaaggggtggaatgattggcaacaggtacctttttgctctcatcacttccatcagctaatcatgaaagacggaagggaaattgtggtcccctgtcgaaaccaggatgagctggtgggccgtgctagagttagccaaggtgccgggtggtccctccgcgagacagcatgcttgggaaagtcatatgctcagatgtggcagctgatgtactttcaccggagggaccttagactggccgcaaatgccatatgtagtgcggtgccagtcgattgggtgcccacctctcgcactacctggagcatccacgctcatcaccaatggatgacaacggaagacatgctctccgtatggaaccgggtttggattgaggaaaatccttggatggaggacaagacccatgtgtcaagctgggaagaggtcccatatttaggcaaaagggaggatcagtggtgcggctctctgatcgggttgactgcccgagcaacatgggccaccaacattcaggtggctatcaatcaggttagacggctgataggaaacgaaaattacctcgactacatgacttccatgaagaggttcaaaaacgagagtgatccggaaggtgtgctttggtga

SEQ ID NO: 13430 - RNA, 9879 nt, synthetic construct
  misc_feature 1..9879: note = derived and/or modified CDS sequence (opt3) from DENV-1__KF973455__SS-prME
  source 1..9879: mol_type = other RNA
agcgtgaccatgctgctcatgcttctgcccacagccttggctttccacttaactacgagaggcggggagcctcatatgatcgtctccaagcacgaaaggggaaaatctctgctatttaagacctcaacaggtgttaacatgtgcactctcattgcaatggacctgggcgagctttgtgaagataccatgacatacaaatgcccacggataaccgaggccgaaccggacgatgtggactgttggtgcaatgcgactgatacatgggtaacctatgggacgtgtagtcagactggagagcatcgccgagacaagcgtagcgtggctctggccccccacgtcggcttgggtctcgagaccagaacagaaacttggatgtcctctgagggggcatggaaacaaatccagagggtggaaacctgggccctgcggcatcctggattcacagttattgctctgtttctcgcacacgccatcggcacctcgattacgcagaagggcatcatattcatcttactgatgcttgtgactccatcaatggctatgcgctgcgtcgggattggaaacagagattttgtggagggtttgagcggcgccacatgggtagacgttgtgctggagcacgggagttgtgtcaccactatggcgaagaataaacccacactagatatcgaactcctgaagaccgaggtgacgaaccctgcagtgcttaggaaactgtgcattgaagccaagatctccaataccacaactgactctcggtgtccaacccagggagaggctacattggtcgaagagcaagatgccaacttcgtttgccgccgaactctcgtggacagaggctggggtaatgggtgtggactgtttggcaaaggcagcttactgacctgcgcaaagttcaagtgcgtaacaaaactcgaggggaagatagtgcagtacgaaaaccttaaatattccgtcattgtgaccgttcatactggagatcagcaccaggtgggtaatgagacgacagaacatggcaccatcgctactattaccccccaagcccctacatcagagatccagctgaccgactacggggcgttggccctagactgtagtccaaggactggactggattttaacgaaatggtcctcctgacaatgaaggagaaaagctggcttgtgcacaagcagtggttcctggacttgccgctcccctggacgtctggcgcatccacctcacaggagacttggaatcggcaagatctgttagtaacatttaaaaccgctcacgccaagaagcaggaagttgtggtcctgggtagccaggagggggctatgcatacagccctaactggcgcaaccgaaatccaaacgagtggaaccacaactattttcgccggccacctcaaatgccgtctgaagatggacaaacttaccttgaaggggacatcttatgtgatgtgtactggatcctttaaactggagaaggaagtcgctgagacccagcatggtacggtgctcgttcaggtgaagtacgagggcacagatgcgccttgcaaaataccattcagcacccaggacgaaaagggggtaactcaaaacggacgcctgatcacagcaaatcccattgtcaccgataaagagaagcctgtgaacatcgaaactgagccacccttcggcgagtcgtatatagttgtgggtgccggggaaaaagctcttaagctgtcttggtttaagaaaggctcctcaattggaaagatgttcgaggccaccgcaagaggcgccaggcggatggctatcttgggggacacagcctgggattttggaagtatcggtggcgtcttcacgagcgtggggaaactcgtacaccaggtgtttggaaccgcatacggcgttctgttctccggtgtctcttggactatgaagattgggatcggcattttactgacatggctaggactcaatagccgatcaaccagtctgtccatgacatgtatagcggtgggcatggtgactctttacttgggggtcatggttcaggctgacagcggatgcgtgatcaactggaaaggccgcgaactgaagtgtggttctgggatttttgtgaccaacgaggtacatacgtggacagaacagtataagttccaagccgattcaccgaaaagactcagtgcagccatcggaaaggcttgggaggagggcgtctgcggtatcaggagcgccacccggctggaaaatattatgtggaaacagatatccaacgagttaaatcacatcctgcttgaaaacgacatgaagtttactgtggttgtgggcgacgcaaatgggattttggctcagggaaaaaagatgatccgccctcagcccatggagcacaaatactcttggaagtcgtggggcaaggccaaaattatcggggcggatatacaaaacaccacattcatcattgacggaccagatactcctgaatgtcccgacgatcagagagcctggaatatctgggaggtcgaggactatggctttggtattttcaccacaaacatctggctcaagctgagggatagctacacgcagatgtgcgaccatcgtctaatgtccgctgcaataaaagattcaaaggccgtgcacgctgacatggggtattggattgaaagtgagaaaaatgaaacctggaagctggcccgggcatcttttatcgaggttaagacttgtacatggccaaaaagccataccctctggtccaacggagtgctggaatcagagatgattatccccaagatatacggcggtcctatcagccagcacaattatcgaccaggctacttcactcaaacagcggggccgtggcaccttggaaaattggagctggatttcgacttatgcgaaggcaccacggtagtcgtggatgagcattgcgggaacagaggaccctctctcaggactaccacagtgaccggcaagattatccacgaatggtgttgccgctcctgtactctgcctccacttcggtttagaggtgaggacgggtgctggtacggaatggagattaggcccgtcaaagaaaaggaggaaaatctggttcgcagtatggtgagcgccggctctggtgaggtagactccttctcattgggcatcctctgtgtgagtataatgattgaagaggtcatgcgaagccggtggtcgcgtaagatgctgatgacagggaccctagctgtgtttctgctcctgatcatgggacagcttacatggaacgatttgatcagactgtgcattatggttggcgccaatgcatccgacaggatggggatgggaactacctatttagctctcatggccacgttcaaactgcgccctatgtttgcagtgggcatccttttccggagactgacatctagggaggtcctactcctgaccattggtttgagcctggtggcctcagttgaattaccaaacagtctcgaggaactgggggatggacttgctatgggcataatgatgctgaagttgctcactgagtttcagccccatcaactgtggaccacactactgtcccttactttcatcaaaaccacgctctctctggactacgcgtggaagacaaccgccatggcattgagcattgtgtccctgtttccgatctgtttatcaactacaagccagaaaaccacttggctccctgtcctgcttggcagtttcgggtgcaagccactgacaatgtatttgattaccgaaaacaagatctggggacgaaaatcttggcccataaatgagggtatcatggctattggcatcgtatccattctcctgagctcgctactgaagaacgatgtgcctcttgccgggcccctcatcgccggaggcatgctgatagcttgttacgttatttcaggttctagtgcagacttgtccttagagaaagccgcggaagtgagctgggagcaggaagctgagcactctgggacgagccataatatcctggtcgaagtgcaggatgacggaactatgcgcatcaaggatgaggagaaagacgataccctcacaattctgcttaaggccaccctgttggcagtatccggcgtgtatccaatgtcaatacctgccacactatttgtctggtacttctggcaaaaaaagaagcagcggagtggcgttctgtgggacactcccagcccaccggaagtggagagagctgtgctcgatgacgggatctataggattctgcagcgtggacttttaggtcgctctcaggtcggcgtgggggtttttcaagacggagtattccacaccatgtggcacgtgacgcggggcgcagtcctgatgtaccagggtaaaagactcgaaccttcctgggcctcagtgaagaaagatttgatcagttacgggggaggctggaggttccagggcagctggaacacaggggaggaggttcaggtgattgcggtcgaacccggaaagaatccaaaaaacgtgcaaactacccccggtacatttaagacccctgagggcgaagtaggggctatcgccctggacttcaagccaggaacttccggctctcccatagtcaatcgagagggtaaaatcgtggggctctatggaaacggcgttgtgaccacatcgggcacgtacgtcagcgcaattgcccaggctaaggcctcacaggaagggcctctgccggagatcgaggatgaagtgtttaaaaagcggaatcttactattatggacctgcatccaggatccggtaaaacccgcagatatttgcccgcaatcgttagggaggctataaagcggaagctacgaacactgattctcgcccctaccagagtggtcgcgagtgaaatggccgaggcattaaaaggcatgccaatccgctaccaaactacagctgtgaagtctgaacacaccgggagggagatcgtagatctgatgtgccatgccacgttcactatgcgtcttctgagccccgtgcgggttcctaactataatatgattatcatggacgaggctcactttacagatccggcatccatagccgccagaggatacatttcaaccagggtcggcatgggtgaagctgcggcaatcttcatgaccgccactcccccagggtctgtggaggcttttcctcagagcaacgccgtgattcaggacgaagagcgcgatatccccgaacgaagttggaattccggatatgactggataacagatttcccaggcaaaaccgtctggtttgtacctagcattaagtctggcaacgacatcgcaaattgtctcagaaaaaacgggaagcgggtgatccagttgtcaaggaagacattcgacactgagtaccaaaaaacgaagaacaatgattgggactacgttgtgaccacagatatttccgagatgggagccaactttcgcgctgaccgtgtcatcgatcccagacggtgcctgaaaccagtgattctcaaggacggtccggaaagggttatactggcgggccctatgcccgtgactgtcgccagtgcagctcagcgccgagggagaatcggacggaatcagaacaaagagggcgatcagtatgtgtacatgggtcaaccacttaataacgacgaagatcatgcccactggaccgaggcaaagatgctactggacaatattaacacacccgaggggatcatccctgccttgttcgaaccagagagggaaaagagcgctgccattgatggcgagtatcgcttaagaggagaagcgaggaaaaccttcgtagagctgatgcggcgtggcgacctccccgtgtggctgtcgtacaaggttgcatctgaggggtttcagtattccgatcgccgatggtgcttcgacggagaaagaaataaccaggtccttgaggaaaatatggacgtggagatatggactaaagaaggtgagaggaagaaactgcggcctcgctggctcgatgccagaacgtacagcgacccgttggctctgagggagtttaaggaattcgccgctggccggcgatcagtgagtggggatctaatcctggagattggaaaactcccacagcaccttaccctgagagcacaaaacgccttagacaatttggtcatgctgcataactctgaacagggcggtaaggcttatcgccacgccatggaggaactccccgatacaatcgagactctgatgcttctggcactcattgcggttttgaccgggggcgtgatgctgtttttcttatccggaaagggcctagggaaaacaagcatcggactgctctgtgtaaccgcctcaagtgctcttctgtggatggccagcgtggagcctcattggatagcagcttccatcattttggaatttttcctgatggtcctcctgatccccgagccagacaggcagcggactcctcaggataatcaacttgcctacgtggttattggtctcctgtttatgatcttgacagtggcagccaacgaaatgggcctgttagagacgaccaagcgtgacctagggataggacacgtcgctgcggagaaccaccagcatgccactatgctggatgtagacctccaccccgcatctgcttggacactttacgccgtggccaccaccgttattacaccaatgatgagacatactatcgaaaatacgaccgcaaacattagcctgacagctatcgccaatcaggcggctatattgatgggcctggataaaggttggcctatctccaagatggacattggggtgccgctcctggcccttggctgctattcacaagtcaaccccttaactctgaccgcagccgtgctcatgttggtcgctcactacgcaatcattggaccaggcctgcaggccaaagcgacaagggaggctcagaagcgcaccgccgcagggatcatgaagaatcctactgtggatggaatagttgccattgacctagaccccgtggtatatgatgctaaattcgaaaagcagctgggccaaatcatgctccttatcctgtgtacgtctcagattttgctgatgcggacaacctgggccctctgcgagagtatcactctggcaaccggtccattaacaactctttgggaagggtcgcctggaaaattttggaacaccacaatagctgtgagcatggccaatattttccgaggctcctacctggcgggtgccggcctcgcattttctctaatgaagtcactggggggaggcagaagggggacgggagctcagggcgagaccttgggtgagaaatggaagcgccagctgaaccaactcagcaagcccgaattcaatacttataaacggtccgggatcatggaggtcgacagaagtgaagccaaggagggacttaaacgtggcgaaacaaccaagcatgcagtttctaggggtactgctaaactgcggtggttcgtggagcgcaacttggtcaagccggagggcaaggtgattgatctggggtgtggacgaggcgggtggagctactattgcgccggactcaaaaaggtaacagaagtgaaaggctacaccaagggtgggccaggacacgaggaacctatccccatggccacgtacggctggaatttagttaaactgcactcaggcaaggacgtgtttttcatgccacccgagaaatgtgatacccttctgtgcgacataggggaatccagtcctaacccgacaatcgaggagggaagaactctaagggtcctcaagatggtggaaccctggctgcggggtaatcagttttgtattaagatcttgaacccatatatgcctagcgtcgtggagaccctggaacagatgcagcgcaaacatggcgggatgctcgttagaaatcccctttctaggaactccacacacgagatgtactgggtatcatgcggaactggcaatattgtgagcgcggtcaacatgacctcgcgaatgctgttaaaccggttcacaatggctcatcgtaagcctacctatgagagagatgtggacctgggtgcagggactcgccacgttacggtggaaccagaggtcgccaatttggatatcattggacaaaggatcgaaaacataaaaaatgagcacaagtctacatggcattacgacgaagataacccctataaaacctgggcttaccacggcagttatgaggtgaagccttccggcagcgcctcatccatggtaaatggggtggttcggctcctgactaagccatgggacgtcattcccatggtgacccagatcgcaatgacagacacgaccccgtttggacagcaaagagtgttcaaagagaaggtcgatactcgcacacctagggccaaacgaggtaccactcagatcatggaagttacagctaagtggctatggggctttctttctcggaacaaaaagccaagaatttgtaccagggaggaattcacacgcaaggtgcgtagcaatgcggccataggggcagtatttgtggacgagaaccagtggaatagtgctaaagaagccgtcgaggatgagcggttctgggacctggtgcatagagaaagggagctccacaagcagggaaaatgcgcaacttgcgtttacaacatgatgggcaagcgcgaaaaaaagctgggtgagtttgggaaggccaaaggatcccgagctatctggtacatgtggttgggcgcccggttcctggaatttgaggcgctcggcttcatgaatgaggatcattggttcagcagagaaaactctctttcaggggtggagggagaaggtctgcacaagttaggctatattctgagggacatcagtaaaattcccgggggaaatatgtacgcagatgacaccgccggctgggatacgcgcatcaccgaggacgatttgcaaaacgaggctaagataacagacatcatggaacctgagcacgccctcctggcaacttccatttttaaactaacctatcagaataaggtcgtgagagtacagcggccagctaaaaacggtacagttatggatgtgatcagcaggcgtgaccagcgagggtctggacaagtcggcacttacggccttaacaccttcacgaatatggaagtgcagctgattcgccagatggagtcggaagggatctttctcccctcagagctggagacaccgaacttggccgaaagagtgttagactggctggagaagcatggagctgaacggctcaagaggatggccataagcggtgatgactgtgtcgttaaacctattgatgaccgcttcgcaaccgcgcttactgccctgaatgatatgggcaaggtgagaaaagacatcccccagtgggagccatccaaggggtggaacgattggcaacaggtacctttttgcagtcaccatttccaccagctaatcatgaaagacggacgggaaattgtggtcccctgtaggaatcaggatgagctggtgggccgagctcgtgtttctcaaggtgccgggtggagcctcagagagacagcatgcttgggaaagtcctatgctcagatgtggcagctgatgtactttcaccgccgggaccttaggctggccgcaaacgccatatgttcagcggtgccagtcgattgggtgcccaccagtagaactacctggtctatccatgctcaccatcaatggatgacaacggaagacatgctcagcgtatggaatcgcgtttggattgaggaaaacccttggatggaggacaagacccacgtgtcctcatgggaagaggtcccatatttaggcaaacgggaggatcagtggtgcggcagcctgatcgggttgactgccagggcaacatgggccaccaatattcaggtggctatcaaccaggttcgaagactgataggaaatgaaaactacctcgactacatgacttctatgaagcggttcaaaaatgagtccgatccggaaggtgccctttggtga

SEQ ID NO: 13431 - RNA, 9879 nt, synthetic construct
  misc_feature 1..9879: note = derived and/or modified CDS sequence (opt3) from DENV-1__KF973456__SS-prME
  source 1..9879: mol_type = other RNA
agcgtgaccatgctgctcatgcttctgcccacagccttggctttccacttaactacgagaggcggggagcctcatatgatcgtctccaagcacgaaaggggaaaatctctgctatttaagacctcaacaggtgttaacatgtgcactctcattgcaatggacctgggcgagctttgtgaagataccatgacatacaaatgcccacggataaccgaggccgaaccggacgatgtggactgttggtgcaatgcgactgatacatgggtaacctatgggacgtgtagtcagactggagagcatcgccgagacaagcgtagcgtggctctggccccccacgtcggcttgggtctcgagaccagaacagaaacttggatgtcctctgagggggcatggaaacaaatccagagggtggaaacctgggccctgcggcatcctggattcacagttattgctctgtttctcgcacacgccatcggcacctcgattacgcagaagggcatcatattcatcttactgatgcttgtgactccatcaatggctatgcgctgcgtcgggattggaaacagagattttgtggagggtttgagcggcgccacatgggtagacgttgtgctggagcacgggagttgtgtcaccactatggcgaagaataaacccacactagatatcgaactcctgaagaccgaggtgacgaaccctgcagtgcttaggaaactgtgcattgaagccaagatctccaataccacaactgactctcggtgtccaacccagggagaggctacattggtcgaagagcaagatgccaacttcgtttgccgccgaactctcgtggacagaggctggggtaatgggtgtggactgtttggcaaaggcagcttactgacctgcgcaaagttcaagtgcgtaacaaaactcgaggggaagatagtgcagtacgaaaaccttaaatattccgtcattgtgaccgttcatactggagatcagcaccaggtgggtaatgagacgacagaacatggcaccatcgctactattaccccccaagcccctacatcagagatccagctgaccgactacggggcgttggccctagactgtagtccaaggactggactggattttaacgaaatggtcctcctgacaatgaaggagaaaagctggcttgtgcacaagcagtggttcctggacttgccgctcccctggacgtctggcgcatccacctcacaggagacttggaatcggcaagatctgttagtaacatttaaaaccgctcacgccaagaagcaggaagttgtggtcctgggtagccaggagggggctatgcatacagccctaactggcgcaaccgaaatccaaacgagtggaaccacaactattttcgccggccacctcaaatgccgtctgaagatggacaaacttaccttgaaggggacatcttatgtgatgtgtactggatcctttaaactggagaaggaagtcgctgagacccagcatggtacggtgctcgttcaggtgaagtacgagggcacagatgcgccttgcaaaataccattcagcacccaggacgaaaagggggtaactcaaaacggacgcctgatcacagcaaatcccattgtcaccgataaagagaagcctgtgaacatcgaaactgagccacccttcggcgagtcgtatatagttgtgggtgccggggaaaaagctcttaagctgtcttggtttaagaaaggctcctcaattggaaagatgttcgaggccaccgcaagaggcgccaggcggatggctatcttgggggacacagcctgggattttggaagtatcggtggcgtcttcacgagcgtggggaaactcgtacaccaggtgtttggaaccgcatacggcgttctgttctccggtgtctcttggactatgaagattgggatcggcattttactgacatggctaggactcaatagccgatcaaccagtctgtccatgacatgtatagcggtgggcatggtgactctttacttgggggtcatggttcaggctgacagcggatgcgtgatcaactggaaaggccgcgaactgaagtgtggttctgggatttttgtgaccaacgaggtacatacgtggacagaacagtataagttccaagccgattcaccgaaaagactcagtgcagccatcggaaaggcttgggaggagggcgtctgcggtatcaggagcgccacccggctggaaaatattatgtggaaacagatatccaacgagttaaatcacatcctgcttgaaaacgacatgaagtttactgtggttgtgggcgacgcaaatgggattttggctcagggaaaaaagatgatccgccctcagcccatggagcacaaatactcttggaagtcgtggggcaaggccaaaattatcggggcggatatacaaaacaccacattcatcattgacggaccagatactcctgaatgtcccgacgatcagagagcctggaatatctgggaggtcgaggactatggctttggtattttcaccacaaacatctggctcaagctgagggatagctacacgcagatgtgcgaccatcgtctaatgtccgctgcaataaaagattcaaaggccgtgcacgctgacatggggtattggattgaaagtgagaaaaatgaaacctggaagctggcccgggcatcttttatcgaggttaagacttgtacatggccaaaaagccataccctctggtccaacggagtgctggaatcagagatgattatccccaagatatacggcggtcctatcagccagcacaattatcgaccaggctacttcactcaaacagcggggccgtggcaccttggaaaattggagctggatttcgacttatgcgaaggcaccacggtagtcgtggatgagcattgcgggaacagaggaccctctctcaggactaccacagtgaccggcaagattatccacgaatggtgttgccgctcctgtactctgcctccacttcggtttagaggtgaggacgggtgctggtacggaatggagattaggcccgtcaaagaaaaggaggaaaatctggttcgcagtatggtgagcgccggctctggtgaggtagactccttctcattgggcatcctctgtgtgagtataatgattgaagaggtcatgcgaagccggtggtcgcgtaagatgctgatgacagggaccctagctgtgtttctgctcctgatcatgggacagcttacatggaacgatttgatcagactgtgcattatggttggcgccaatgcatccgacaggatggggatgggaactacctatttagctctcatggccacgttcaaactgcgccctatgtttgcagtgggcatccttttccggagactgacatctagggaggtcctactcctgaccattggtttgagcctggtggcctcagttgaattaccaaacagtctcgaggaactgggggatggacttgctatgggcataatgatgctgaagttgctcactgagtttcagccccatcaactgtggaccacactactgtcccttactttcatcaaaaccacgctctctctggactacgcgtggaagacaaccgccatggcattgagcattgtgtccctgtttccgatctgtttatcaactacaagccagaaaaccacttggctccctgtcctgcttggcagtttcgggtgcaagccactgacaatgtatttgattaccgaaaacaagatctggggacgaaaatcttggcccataaatgagggtatcatggctattggcatcgtatccattctcctgagctcgctactgaagaacgatgtgcctcttgccgggcccctcatcgccggaggcatgctgatagcttgttacgttatttcaggttctagtgcagacttgtccttagagaaagccgcggaagtgagctgggagcaggaagctgagcactctgggacgagccataatatcctggtcgaagtgcaggatgacggaactatgcgcatcaaggatgaggagaaagacgataccctcacaattctgcttaaggccaccctgttggcagtatccggcgtgtatccaatgtcaatacctgccacactatttgtctggtacttctggcaaaaaaagaagcagcggagtggcgttctgtgggacactcccagcccaccggaagtggagagagctgtgctcgatgacgggatctataggattctgcagcgtggacttttaggtcgctctcaggtcggcgtgggggtttttcaagacggagtattccacaccatgtggcacgtgacgcggggcgcagtcctgatgtaccagggtaaaagactcgaaccttcctgggcctcagtgaagaaagatttgatcagttacgggggaggctggaggttccagggcagctggaacacaggggaggaggttcaggtgattgcggtcgaacccggaaagaatccaaaaaacgtgcaaactacccccggtacatttaagacccctgagggcgaagtaggggctatcgccctggacttcaagccaggaacttccggctctcccatagtcaatcgagagggtaaaatcgtggggctctatggaaacggcgttgtgaccacatcgggcacgtacgtcagcgcaattgcccaggctaaggcctcacaggaagggcctctgccggagatcgaggatgaagtgtttaaaaagcggaatcttactattatggacctgcatccaggatccggtaaaacccgcagatatttgcccgcaatcgttagggaggctataaagcggaagctacgaacactgattctcgcccctaccagagtggtcgcgagtgaaatggccgaggcattaaaaggcatgccaatccgctaccaaactacagctgtgaagtctgaacacaccgggagggagatcgtagatctgatgtgccatgccacgttcactatgcgtcttctgagccccgtgcgggttcctaactataatatgattatcatggacgaggctcactttacagatccggcatccatagccgccagaggatacatttcaaccagggtcggcatgggtgaagctgcggcaatcttcatgaccgccactcccccagggtctgtggaggcttttcctcagagcaacgccgtgattcaggacgaagagcgcgatatccccgaacgaagttggaattccggatatgactggataacagatttcccaggcaaaaccgtctggtttgtacctagcattaagtctggcaacgacatcgcaaattgtctcagaaaaaacgggaagcgggtgatccagttgtcaaggaagacattcgacactgagtaccaaaaaacgaagaacaatgattgggactacgttgtgaccacagatatttccgagatgggagccaactttcgcgctgaccgtgtcatcgatcccagacggtgcctgaaaccagtgattctcaaggacggtccggaaagggttatactggcgggccctatgcccgtgactgtcgccagtgcagctcagcgccgagggagaatcggacggaatcagaacaaagagggcgatcagtatgtgtacatgggtcaaccacttaataacgacgaagatcatgcccactggaccgaggcaaagatgctactggacaatattaacacacccgaggggatcatccctgccttgttcgaaccagagagggaaaagagcgctgccattgatggcgagtatcgcttaagaggagaagcgaggaaaaccttcgtagagctgatgcggcgtggcgacctccccgtgtggctgtcgtacaaggttgcatctgaggggtttcagtattccgatcgccgatggtgcttcgacggagaaagaaataaccaggtccttgaggaaaatatggacgtggagatatggactaaagaaggtgagaggaagaaactgcggcctcgctggctcgatgccagaacgtacagcgacccgttggctctgagggagtttaaggaattcgccgctggccggcgatcagtgagtggggatctaatcctggagattggaaaactcccacagcaccttaccctgagagcacaaaacgccttagacaatttggtcatgctgcataactctgaacagggcggtaaggcttatcgccacgccatggaggaactccccgatacaatcgagactctgatgcttctggcactcattgcggttttgaccgggggcgtgatgctgtttttcttatccggaaagggcctagggaaaacaagcatcggactgctctgtgtaaccgcctcaagtgctcttctgtggatggccagcgtggagcctcattggatagcagcttccatcattttggaatttttcctgatggtcctcctgatccccgagccagacaggcagcggactcctcaggataatcaacttgcctacgtggttattggtctcctgtttatgatcttgacagtggcagccaacgaaatgggcctgttagagacgaccaagcgtgacctagggataggacacgtcgctgcggagaaccaccagcatgccactatgctggatgtagacctcagacccgcatctgcttggacactttacgccgtggccaccaccgttattacaccaatgatgaggcacactatcgaaaatacgaccgcaaacattagcctgacagctatcgccaatcaggcggctatattgatgggcctggataaaggttggcctatctccaagatggacattggggtgccgctcctggcccttggctgctattcacaagtcaaccccttaactctgaccgcagccgtgctcatgttggtcgctcattacgcaatcattggaccaggcctgcaggccaaagcgacacgcgaggctcagaagcggaccgccgcagggatcatgaagaatcctactgtggatggaatagttgccattgacctagaccccgtggtatatgatgctaaattcgaaaagcagctgggccaaatcatgctccttatcctgtgtacgtctcagattttgctgatgcgaacaacctgggccctctgcgagagtatcactctggcaaccggtccattaacaactctttgggaagggtcgcctggaaaattttggaacaccacaatagctgtgagcatggccaatattttcagaggctcctacctggcgggtgccggcctcgcattttctctaatgaagtcactggggggaggcaggcgcgggacgggagctcagggcgagaccttgggtgagaaatggaagcggcagctgaaccaactcagcaagcccgaattcaatacttataaaagatccgggatcatggaggtcgaccgtagtgaagccaaggagggacttaaaaggggcgaaacaaccaagcacgcagtttctcggggtactgctaaactgcgctggttcgtggagcgaaacttggtcaagccggagggcaaggtgattgatctggggtgtggaagaggcgggtggagctactattgcgccggactcaaaaaggtaacagaagtgaaaggctacaccaagggtgggccaggacatgaggaacctatccccatggccacgtacggctggaatttagttaaactgcactcaggcaaggacgtgtttttcatgccacccgagaaatgtgatacccttctgtgcgacataggggaatccagtcctaacccgacaatcgaggagggaaggactctacgggtcctcaagatggtggaaccctggctgcgcggtaatcagttttgtattaagatcttgaacccatatatgcctagcgtcgtggagaccctggaacagatgcagagaaaacacggcgggatgctcgttaggaatcccctttctcgaaactccacacatgagatgtactgggtatcatgcggaactggcaatattgtgagcgcggtcaacatgacctcgcggatgctgttaaaccgtttcacaatggctcacagaaagcctacctatgagcgcgatgtggacctgggtgcagggactaggcatgttacggtggaaccagaggtcgccaatttggatatcattggacaacggatcgaaaacataaaaaatgagcacaagtctacatggcactacgacgaagataacccctataaaacctgggcttaccatggcagttatgaggtgaagccttccggcagcgcctcatccatggtaaatggggtggttagactcctgactaagccatgggacgtcattcccatggtgacccagatcgcaatgacagacacgaccccgtttggacagcaacgcgtgttcaaagagaaggtcgatactaggacacctcgagccaaacggggtaccactcagatcatggaagttacagctaagtggctatggggctttctttctagaaacaaaaagccaaggatttgtacccgcgaggaattcacacgtaaggtgcggagcaatgcggccataggggcagtatttgtggacgagaaccagtggaatagtgctaaagaagccgtcgaggatgagagattctgggacctggtgcacagggaacgcgagctccataagcagggaaaatgcgcaacttgcgtttacaacatgatgggcaagcgagaaaaaaagctgggtgagtttgggaaggccaaaggatcccgggctatctggtacatgtggttgggcgccagattcctggaatttgaggcgctcggcttcatgaatgaggatcactggttcagcagggaaaactctctttcaggggtggagggagaaggtctgcataagttaggctatattctgcgcgacatcagtaaaattcccgggggaaatatgtacgcagatgacaccgccggctgggatacgagaatcaccgaggacgatttgcaaaacgaggctaagataacagacatcatggaacctgagcacgccctcctggcaacttccatttttaaactaacctatcagaataaggtcgtgcgggtacagaggccagctaaaaacggtacagttatggatgtgatcagccgtcgagaccagcgcgggtctggacaagtcggcacttacggccttaacaccttcacgaatatggaagtgcagctgattagacagatggagtcggaagggatctttctcccctcagagctggagacaccgaacttggccgaacgggtgttagactggctggagaagcacggagctgaaaggctcaagcgcatggccataagcggtgatgactgtgtcgttaaacctattgatgacagattcgcaaccgcgcttactgccctgaatgatatgggcaaggtgcggaaagacatcccccagtgggagccatccaaggggtggaacgattggcaacaggtacctttttgcagtcatcacttccatcagctaatcatgaaagacggaagggaaattgtggtcccctgtcgaaatcaggatgagctggtgggccgtgctagagtttctcaaggtgccgggtggagcctccgcgagacagcatgcttgggaaagtcctatgctcagatgtggcagctgatgtactttcaccggagggaccttagactggccgcaaacgccatatgttcagcggtgccagtcgattgggtgcccaccagtcgcactacctggtctatccacgctcatcaccaatggatgacaacggaagacatgctcagcgtatggaatcgggtttggattgaggaaaacccttggatggaggacaagacccatgtgtcctcatgggaagaggtcccatatttaggcaaaagggaggatcagtggtgcggcagcctgatcgggttgactgcccgagcaacatgggccaccaatattcaggtggctatcaaccaggttagacggctgataggaaatgaaaactacctcgactacatgacttctatgaagaggttcaaaaatgagtccgatccggaaggtgccctttggtga

SEQ ID NO: 13432 - RNA, 9879 nt, synthetic construct
  misc_feature 1..9879: note = derived and/or modified CDS sequence (opt3) from DENV-1__KF973459__SS-prME
  source 1..9879: mol_type = other RNA
agcgtgaccatgctgctcatgcttctgccaacagcattggctttccacttaactacgcgaggaggggaacctcatatgatcgtctccaagcaggaaaggggaaaatctctgctatttaagacctcagccggtgttaacatgtgcacactcattgccatggacctgggcgaactttgtgaagatactctgacctacaaatgcccacagataacagaggcggaaccggacgatgtggactgttggtgcaatgctaccgatacttgggtaacatatgggacctgtagtcagacgggagagcaccggcgcgacaagcgaagcgtggccttggcaccccatgtcggcctcggtctggagactcgtaccgaaacatggatgtcctctgagggggcctggaaacagatccagagagtggaaacttgggctctgaggcaccctggattcaccgttattgcactctttttagcccatgctatcggcacatcgattacccaaaagggcatcatattcatcctgcttatgttggtgacgccatcaatggccatgcggtgcgtcgggattggaaaccgcgattttgtggagggtctgagcggcgcgacttgggtagacgttgtgctagagcacgggagttgtgtcacaaccatggcaaagaataaacccactctcgatatcgaactgcttaagacagaggtgaccaaccctgccattctgagaaaattgtgcatcgaagctaagatatccaatacgaccacagactctaggtgtccaactcagggagaggccaccctcgtggaagaacaggatgcaaacttcgtctgccggcgcacatttgttgaccgaggctggggtaatgggtgtggactgttcggcaaaggcagcttactgacttgcgctaagtttaagtgcgtgaccaaactcgaggggaagattgtacagtacgaaaaccttaaatattccgtgatcgtcacagtgcacaccggagatcaacatcaggttggtaatgagactacggaacacggcacaattgccaccatcactccccaggcgcctacctcagagatccagctgacagactacggggccttgaccctagactgtagtccaagaactggactggatttcaacgaaatggtgctcctgacaatgaaggagaaaagctggcttgtccataagcaatggtttctggacttgccgctcccctggacgtctggcgcatccacctcacaggagacttggaataggcaggatctgttagtgacattcaaaaccgctcacgccaagaagcaagaagtagttgtgctgggtagccaggagggggctatgcacacagccctaactggcgcaaccgaaattcagacgagtggaaccacaactatatttgccggccatctcaaatgccggctgaagatggacaaacttaccttgaaggggacatcttatgtcatgtgtactggatccttcaaactggagaaggaagtggctgagacccagcacggtacggtcctcgtgcaagttaagtacgagggcacagatgcgccttgcaaaatcccattcagcacccaggacgaaaagggggtgactcagaacggacgtctgattacagcaaatcccatcgtaaccgataaagagaagcctgtcaacatagaaactgagccaccctttggcgagtcgtatattgtggttggtgccggggaaaaagctcttaagctgtcttggttcaagaaaggctcctcaatcggaaagatgtttgaggccaccgcacgcggcgccagaaggatggctatcttgggggacacagcctgggatttcggaagtattggtggcgtgtttacgagcgtcgggaaactcgtgcatcaggtattcggaaccgcatacggcgtgctgttttccggtgtttcttggactatgaagatcgggattggcatattactgacatggctaggactcaatagccggtcaaccagtctgtccatgacatgtatcgcggtcggcatggtgactctttacttgggggtgatggtccaagctgacagcggatgcgttattaactggaaaggccgagaactgaagtgtggttctgggatcttcgtgaccaacgaggtgcacacgtggacagaacagtataagtttcaggccgattcaccgaaacgcctcagtgcagccatcggaaaggcttgggaggagggcgtatgcggtattagaagcgccaccaggctggaaaatataatgtggaaacagatctccaacgagttaaatcatattctgcttgaaaacgacatgaagttcactgtcgtggttggcgacgcaaatgggatcttggctcaaggcaaaaagatgattcggcctcagcccatggagcacaaatactcttggaagtcgtggggcaaggccaaaatcataggggcggatatccagaacaccacatttattatcgacggaccagatactcctgaatgtcccgacaatcagcgcgcctggaacatttgggaggtggaggattatggcttcggtatctttaccacaaatatatggctcaagctgagagacagctacacgcaagtctgcgatcacaggctaatgtccgctgcaattaaagactcaaaggccgtgcatgctgatatggggtattggatcgaaagtgagaaaaacgaaacctggaagctggcccgtgcatctttcattgaggttaagacttgtacatggccaaaaagccacaccctctggtccaatggagtgctggaatcagagatgatcatacccaagatctacggcggtcctattagccagcataactatcggccaggctacttcactcagacagcggggccgtggcaccttggaaaattggagctggactttgatttatgcgaaggcaccacggtagtcgtggacgagcactgcgggaatcgaggaccctctctcagaactaccacagtgaccggcaagatcattcatgaatggtgttgcaggtcctgtactctgcctccacttcgcttccggggtgaggatgggtgctggtacggaatggagatcagacccgtcaaagaaaaggaggaaaacctggttaggagtatggtgagcgccggctctggtgaggtagactccttgtcactcggcatactgtgtgctagtattatgatcgaagaggtgatgcgcagccgatggtcgcggaagatgctaatgacagggaccctggccgtctttctcctgcttatcatgggacaattgacatggaatgacctgattcgtttatgcatcatggtgggcgcaaacgcttccgatagaatggggatgggaactacctatctcgccctgatggcaacgttcaaaatgaggcctatgtttgccgttggccttctgttccgccggctaacatctagagaggtgctcctgttgaccattggtctgagcttagtcgcttcagtggaactcccaaacagtctggaggaacttggggacggactggcgatgggcataatgatgttgaagctcctgactgagtttcagccccaccagctatggaccacactgctttccctcactttcatcaaaaccacgctgtctttggattacgcctggaagacaaccgcaatggctctgagcattatctccttatttccgctctgtctgtcaactacaagccagaaaaccacttggcttcctgttctgttgggcagtttcgggtgcaagccactcacaatgtttctgattaccgaaaataagatctggggaaggaaatcttggcccctaaacgagggtataatggccatcggcattgtgtccatcctgcttagctcgctcctgaagaatgacgtccctttggccgggcccttaattgctggaggcatgctgatcgcatgttatgtaatatcaggttctagtgccgatctctccctggagaaagcggctgaagtgagctgggagcaagaagccgagcattctgggacgagccacaacattcttgttgaagtgcaggacgatggaactatgaagatcaaagacgaggagcgagatgacaccctgacaatcttgctaaaggcaaccctgctcgccgtctccggcgtgtacccaatgtcaattcctgctacactgttcgtatggtatttttggcagaaaaagaagcagcgcagtggcgtgctttgggatactcccagcccaccggaagtcgagcgggcagttttagacgatgggatatacagaatcctgcaaaggggactcttgggtcgttctcaggtgggcgtgggggtcttccaggacggagtgttccataccatgtggcacgttacgcgcggcgccgtactgatgtatcagggtaaacggctcgaaccttcctgggcgtcagtgaagaaagacctgattagttacgggggaggctggagatttcaaggcagctggaatacaggggaggaggtccaggtgatcgctgttgaacccggaaagaaccccaaaaatgtgcagactacccccggtacattcaagacccctgagggcgaagtcggggccattgcacttgattttaagccaggaacttccggctctcccatcgtgaacagggagggtaaaatagtagggctgtacggaaatggcgtcgtgaccacatcgggcacgtatgttagcgccatcgctcaagccaaggtgtcacaggaagggcctttgccggagattgaggacgaagtcttcaaaaagcgaaacctaactatcatggatctgcacccaggatccggtaaaacccggcgctacctccccgcaattgtgagagaggctatcaagaggaagttacggacactgatacttgcccctacccgagttgtggcgagtgaaatggccgaggcactgaaaggcatgccaattagatatcagactacagctgtcaagtctgaacataccgggcgcgagatcgtggacctcatgtgccacgccacgtttactatgaggttgctgagccccgtacgtgtgcctaattacaacatgatcattatggatgaggctcatttcacagacccggcatccatcgccgcccggggatatatatcaaccagagttggcatgggtgaagctgcggcaatttttatgaccgccactcccccagggtctgtcgaggctttccctcagagcaatgccgtgatccaagatgaagagagggacattcccgaacgcagttggaactccggatacgattggatcacagactttccaggcaaaaccgtgtggttcgtccctagcataaagtctggcaatgatattgcaaactgtctccggaaaaacgggaagagagtaatccagctgtcaagaaagacatttgacactgagtatcagaaaacgaagaataacgactgggattacgtggttaccacagacatctccgagatgggagccaatttcagggctgatcgcgtgattgacccccgtagatgccttaaaccagtcatcctaaaggatggtccggaacgggtgattctggcgggccctatgcccgttactgtggccagtgcagctcagaggcgcgggcgaataggaagaaaccaaaataaagagggcgaccagtacgtctatatgggtcagccattgaacaatgatgaagaccacgcccattggaccgaggcaaagatgttactggataacatcaatacacccgaggggattatccctgccctcttcgaaccagagcgggaaaagagcgctgccatcgacggcgagtacaggctgcgcggagaagcgagaaaaacctttgtggagcttatgaggcggggcgatctgcccgtatggctctcgtataaggtggcatctgaggggttccagtactccgaccgtcgctggtgctttgatggagaacgaaacaatcaagttttggaggaaaacatggacgtcgagatttggactaaagaaggtgagagaaagaaactgaggcctcggtggctagacgcccgcacgtatagcgatccgctggctctcagagagttcaaggaatttgccgctggcaggcggtcagtgagtggggaccttatactggagatcggaaaattaccacagcacttgaccctgcgagcacagaatgccctcgataacctggtgatgcttcacaattctgaacagggcggtaaggcttacagacatgccatggaggaactgcccgacacaattgagactctcatgttgctggcattaatcgcggtcctaaccgggggcgttacactgttctttctctccggaaagggccttgggaaaaccagcattggactgttgtgtgtgactgcctcaagtgctctgctctggatggccagcgtagagcctcactggatcgcagcttccataatcctggagttctttcttatggtgctcctgattcccgagccagatcgccaaaggacacctcaggacaaccagttggcctatgtcgtgatcggtctgttattcatgattctaacggttgcagccaacgaaatgggcctgctcgagaccactaagaaagatcttgggatcggacatgtggctgcggagaatcaccaacacgccacaatgctggacgtcgatttgcggcccgcatctgcttggaccctgtacgccgtagccaccacagtgataactccaatgatgcgtcatacgattgaaaacaccacagcaaatatcagcctcactgctattgccaaccaggcggctatcctgatgggccttgacaagggttggcctatatccaaaatggatatcggggttccgttactggccctcggctgctactcacaggtgaatcccttgaccctgacagcagccgtcctaatgctggtggctcactatgcaattatcggaccaggcctccaggccaaggcgaccagagaggctcaaaagaggactgccgcagggattatgaaaaaccctacggtcgacggaatcgtggccatagatcttgaccccgttgtgtacgacacaaagtttgaaaaacagctgggccagattatgttgctgatcctctgtacctctcagatcctgttaatgcgcactacctgggctctttgcgagagtattacactggccactggtccactcaccacactatgggaagggtcgcctggaaagttctggaatacgaccatcgcagtaagcatggctaacatatttcggggctcctatctggccggtgcgggcttggccttctctctgatgaaatcactcgggggaggccgaagagggactggagcacaaggcgagacacttggtgagaagtggaagaggcagctgaatcagttgagcaaatccgagttcaacatttacaagcgcagtgggatcatggaggtggatcggtctgaagctaaagagggactgaagagaggcgaaaccactaaacatgccgtcagccgtggtacagcaaagctcaggtggtttgttgagcggaatttagtgaagcccgagggcaaagtcattgacctggggtgtggacgcggcgggtggtcatattactgcgctggacttaagaaagtgaccgaagtaaagggctatacgaaaggtgggccgggacacgaggaaccaatccctatggccacctacggctggaacctggtgaagctacattccggcaaagatgttttctttatgcccccagagaagtgtgacacactcctgtgcgatataggggaaagtagccccaatcctactatcgaggagggacgaaccttgagagtgctgaagatggtcgaaccgtggctcaggggtaaccagttctgtattaaaatccttaatccctacatgccatctgtggtcgagacactggaacaaatgcagcggaagtatggcgggatgttagtgcgcaaccctctgtccagaaattcaactcacgagatgtactgggttagctgcggaaccggcaacattgtatcggccgtgaacatgacatctaggatgttgctcaatcgatttaccatggcgcaccggaaacccacttatgagcgtgacgtcgatctgggtgctgggacgagacatgtggcagttgaacctgaggtggccaacctagacatcattggacagcgcatcgaaaatataaagaacgagcacaaaagtacatggcattacgatgaagacaatccatataagacctgggcttaccacggctcctatgaggtcaagcccagcggctcagcctcctctatggtgaacggggtagtgaggcttctgactaaaccttgggatgttattccaatggtcacccaaatcgcaatgacagacacgacccccttcggacagcagcgggtgtttaaggagaaagtggacactagaacaccgcgcgccaagaggggtaccactcagatcatggaagtcacagctaaatggctctggggcttcctgagccgaaataagaagcctcggatttgtaccagagaggaatttacaaggaaagttcgcagtaacgcggccataggggcagtgttcgtagatgagaatcaatggaactccgctaaggaagccgtggaggacgagcgtttttgggatttggtccaccgggaaagagagctgcataaacagggaaagtgcgcaacttgcgtgtacaatatgatgggcaaaagggaaaagaagctcggtgagttcgggaaagccaagggaagccgcgctatctggtacatgtggcttggcgcccgatttctggagttcgaggcgttaggcttcatgaacgaggaccactggttttctcgggaaaattcactgagtggggttgagggagaaggtttgcataaactcggctatattctgagagatatctccaagattccagggggaaacatgtacgcagacgataccgccggctgggacacgaggatcaccgaggatgacctacagaatgaggctaaaataacagatatcatggaacccgagcacgcccttctggcaactagcattttcaagctcacctatcagaacaaagtggtccgcgtgcaaagacctgctaagaacggtacagtaatggacgttatctctcggagggatcagcgtgggtcgggacaggtgggcacttacggcctgaatacctttacgaacatggaagtccagttgattcgacaaatggagtcagaagggatcttcttaccaagcgagctggagacacccaatctcgccaagcgcgtgcttgactggctggaaaaacatggagctgagagactaaagcggatggccatatccggtgacgattgtgtggtcaaaccgattgacgataggtttgcaaccgcgctgactgccctcaacgacatgggcaaggttcgcaaagatatccctcagtgggaacccagtaaggggtggaatgactggcaacaggtgccattctgctctcaccactttcatcaattgatcatgaaggatggaagagagattgtagtgccttgtcggaaccaggacgaactggtcggcagggctcgagtgagccagggtgccgggtggtcccttcgtgagacagcatgcctgggaaaatcatatgctcaaatgtggcagctcatgtacttccacagacgcgatttacggctggccgcaaatgccatatgtagtgcggttcccgtggactgggtcccaacctctaggactacctggagcatccatgctcaccaccagtggatgacaacggaggatatgttgtccgtgtggaacagagtatggattgaagagaatccctggatggaagacaagacccatgtttcaagctgggaggaagtgccttatctgggcaaacgcgaggaccagtggtgcggctctctcatcgggcttactgcccgggcaacatgggccaccaacattcaagtcgctatcaatcaggtgaggcgactgataggaaacgagaattacctagattacatgacttccatgaagagatttaaaaacgaaagtgacccagagggtgccctgtggtga

SEQ ID NO: 13433 - RNA, 9879 nt, synthetic construct
  misc_feature 1..9879: note = derived and/or modified CDS sequence (opt3) from DENV-1__KF973460__SS-prME
  source 1..9879: mol_type = other RNA
agcgtgaccatgctgctcatgcttctgcccaccgccttggctttccacttaactacgagaggaggggaacctcatatgatagtctccaagcacgaaagaggaaaatctctgttatttaagacctcaacaggtgttaacatgtgcactctcattgcaatggacctgggcgaactttgtgaagataccatgacatacaaatgcccacggataaccgaggccgaaccggacgatgtggactgttggtgcaatgcgactgatacatgggtaacctatgggacgtgtagtcaaactggagagcatcgccgagacaagcgtagcgtggctctggccccacacgtcggcttgggtctcgagaccagaacagaaacttggatgtcctctgagggggcatggaaacaaatccaaagggtggaaacctgggccctgcggcatcctggattcacagttattgctctgtttctcgcacacgccatcggcacctcgattacgcagaagggcatcatattcatcttactgatgcttgtgactccatcaatggctatgcgctgcgtcgggattggaaacagagattttgtggagggtttgagcggcgccacatgggtagacgttgtgctggagcacgggagttgtgtcaccactatggcgaagaataaacccacattggatatcgaactcctgaagaccgaggtgacgaaccctgcagtgcttaggaaactgtgcattgaagccaagatctccaataccacaactgactctcggtgtccaacccagggagaggctacattggtcgaagaacaagatgccaacttcgtttgccgccgaactctcgtggacagaggctggggtaatgggtgtggactgtttggcaaaggcagcttactgacctgcgcaaagttcaagtgcgtaacaaaactcgaggggaagatagtgcagtacgaaaaccttaaatattccgtcattgtgaccgttcatactggagatcagcaccaggtgggtaatgagacgacagaacatggcaccatcgctactattacaccccaagcccctacatcagagatccagctgaccgactacggggcgttggccctagactgtagtccaaggactggactggattttaacgaaatggtcctcctgacaatgaaggagaaaagctggcttgtgcacaagcagtggttcctggacttgccgctcccctggacgtctggcgcatccacctcacaggagacttggaatcggcaagatctgttagtaacatttaaaaccgctcacgccaagaagcaggaagttgtggtcctgggtagccaggagggggctatgcatacagccctaactggcgcaaccgaaatccaaacgagtggaaccacaactattttcgccggccacctcaaatgccgtctgaagatggacaaacttaccttgaaggggacatcttatgtgatgtgtactggatcctttaaactggagaaggaagtcgctgagacccagcatggtacggtgctcgttcaggtgaagtacgagggcacagatgcgccttgcaaaataccattcagcacccaggacgaaaagggggtaactcaaaacggacgcctgatcacagcaaatcccattgtcaccgataaagagaagcctgtgaacatcgaaactgagccacccttcggcgagtcgtatatagttgtgggtgccggggaaaaagctcttaagctgtcttggtttaagaaaggctcctcaattggaaagatgttcgaggccaccgcaagaggcgccaggcggatggctatcttgggggacacagcctgggattttggaagtatcggtggcgtcttcacgagcgtggggaaactcgtacaccaggtgtttggaaccgcatacggcgttctgttctccggtgtctcttggactatgaagattgggatcggcattttactgacatggctaggactcaatagccgatcaaccagtctgtccatgacatgtatagcggtgggcatggtgactctttacttgggggtcatggttcaggctgacagcggatgcgtgatcaactggaaaggccgcgaactgaagtgtggttctgggatttttgtgaccaacgaggtacatacgtggacagaacagtataagttccaagccgattcaccgaaaagactcagtgcagccatcggaaaggcttgggaggagggcgtctgcggtatcaggagcgccacccggctggaaaatattatgtggaaacagatatccaacgagttaaatcacatcctgcttgaaaacgacatgaagtttactgtggttgtgggcgacgcaaatgggattttggctcagggcaaaaagatgatccgccctcagcccatggagcacaaatactcttggaagtcgtggggcaaggccaaaattatcggggcggatatacaaaacaccacattcatcattgacggaccagatactcctgaatgtcccgacgatcagagagcctggaatatctgggaggtcgaggactatggctttggtattttcaccacaaacatctggctcaagctgagggatagctacacgcagatgtgcgaccatcgtctaatgtccgctgcaataaaagattcaaaggccgtgcacgctgacatggggtattggattgaaagtgagaaaaatgaaacctggaagctggcccgggcatcttttatcgaggttaagacttgtacatggccaaaaagccataccctctggtccaacggagtgctggaatcagagatgattatccccaagatatacggcggtcctatcagccagcacaattatcgaccaggctacttcactcaaacagcggggccgtggcaccttggaaaattggagctggatttcgacttatgcgaaggcaccacggtagtcgtggatgagcattgcgggaacagaggaccctctctcaggactaccacagtgaccggcaagattatccacgaatggtgttgccgctcctgtactctgcctccacttcggtttagaggtgaggacgggtgctggtacggaatggagattaggcccgtcaaagaaaaggaggaaaatctggttcgcagtatggtgagcgccggctctggtgaggtagactccttgtcactcggcatcctgtgtgtgagtataatgattgaagaggtcatgcgaagccggtggtcgcgtaagatgctaatgacagggaccctggctgtgttcctcctgcttatcatgggacagttgacatggaacgatctgatcagattatgcattatggttggcgccaatgcatccgacaggatggggatgggaactacctatctcgctctgatggccacgtttaaacttcgccctatgttcgcagtgggcatcctgtttcggagactaacatctagggaggtcctcctgttgaccattggtctgagcttagtggcctcagttgaactcccaaacagtctggaggaacttggggatggactggctatgggcataatgatgttgaagctcctgactgagttccagccccatcaactatggaccacactgctttccctcacttttatcaaaaccacgctgtctttggactacgcgtggaagacaaccgccatggcactgagcattgtgtccttattcccgctctgtctgtcaactacaagccagaaaaccacttggcttcctgtcctgttgggcagttttgggtgcaagccactcacaatgtatttcatcaccgaaaacaagatttggggacgaaaatcttggcccatcaatgagggtataatggctatcggcattgtatccatcctgctaagctcgctgcttaagaacgatgtgcctctcgccgggcccctgattgccggaggcatgttgatcgcttgttacgttatatcaggttctagtgcagacttatccctggagaaagccgcggaagtgagctgggagcaggaagctgagcactctgggacgagccataatattctcgtcgaagtgcaggatgacggaactatgcgcatcaaggatgaggagaaagacgataccctgacaatccttctgaaggccaccttgctagcagtatccggcgtgtatccaatgtcaattcctgccacactgtttgtctggtacttctggcagaaaaagaagcagcggagtggcgttctctgggacactcccagcccaccggaagtggagagagctgtgctggatgacgggatatataggatccttcagcgtggattactgggtcgctctcaggtcggcgtgggggtttttcaagacggagtattccacaccatgtggcacgtgacgcggggcgcagtcctcatgtaccagggtaaaagattggaaccttcctgggcctcagtgaagaaagatctgattagttacgggggaggctggaggttccagggcagctggaacacaggggaggaggttcaggtgatcgcggtcgaacccggaaagaatcccaaaaatgtgcaaactacccccggtacatttaagacccctgagggcgaagtaggggctattgccctcgacttcaagccaggaacttccggctctcccatcgtcaatcgagagggtaaaatagtggggctgtatggaaacggcgttgtgaccacatcgggcacgtacgtcagcgcaatcgcccaggctaaggcctcacaggaagggcctcttccggagattgaggatgaagtgtttaaaaagcggaatctgactatcatggacttgcatccaggatccggtaaaacccgcagatatctacccgcaattgttagggaggctatcaagcggaagctgcgaacactcatattagcccctaccagagtggtcgcgagtgaaatggccgaggcactgaaaggcatgccaattcgctaccaaactacagctgtgaagtctgaacacaccgggagggagatcgtagatcttatgtgccatgccacgttcactatgcgtctgctcagccccgtgcgggttcctaactataatatgatcattatggacgaggctcactttacagatccggcatccatcgccgccagaggatacatatcaaccagggtcggcatgggtgaagctgcggcaattttcatgaccgccactcccccagggtctgtggaggcttttcctcagagcaacgccgtgatccaggacgaagaacgcgatattcccgaacgaagttggaactccggatatgactggatcacagatttcccaggcaaaaccgtctggtttgtacctagcataaagtctggcaacgacattgcaaattgtttgaggaaaaacgggaagcgggtgatccagctgtcaaggaagacattcgacactgagtaccagaaaacgaagaacaatgattgggactacgttgtgaccacagatatctccgagatgggagccaactttcgcgctgaccgtgtcattgatcccagacggtgcctcaaaccagtgatcctgaaggacggtccggaaagggttattcttgcgggccctatgcccgtgactgtcgccagtgcagctcagcgccgagggagaataggacggaatcagaacaaagagggcgatcagtatgtgtacatgggtcaaccactaaataacgacgaagatcatgcccactggaccgaggcaaagatgctgttggacaatatcaacacacccgaggggattatccctgccttattcgaaccagagagggaaaagagcgctgccatcgatggcgagtatcgcctgagaggagaagcgaggaaaaccttcgtagagctcatgcggcgtggcgacctgcccgtgtggctttcgtacaaggttgcatctgaggggtttcagtattccgatcgccgatggtgcttcgacggagaaagaaataaccaggtcctggaggaaaatatggacgtggagatttggactaaagaaggtgagaggaagaaactccggcctcgctggttggatgccagaacgtacagcgacccgctggctctaagggagtttaaggagttcgccgctggccggcgatcagtgagtggggatctgatactcgagatcggaaaacttccacagcacctgaccttaagagcacaaaacgccttggacaatctggtcatgctccataactctgaacagggcggtaaggcttatcgccacgccatggaggaactgcccgatacaattgagactcttatgctgctcgcattgatcgcggttctgaccgggggcgtgacattatttttcctatccggaaagggcctggggaaaaccagcattggactcctttgtgtaactgcctcaagtgctctgttgtggatggccagcgtggagcctcattggatcgcagcttccataatcctggaatttttcctcatggtcctgcttattcccgagccagacaggcagcggacacctcaggataatcaactcgcctacgtggttatcggtctgttgtttatgattctgacggtggcagccaacgaaatgggcttactagagaccactaagcgtgacctggggatcggacacgtcgctgcggagaaccaccagcatgccacaatgctcgatgtagaccttagacccgcatctgcttggaccctgtacgccgtggccaccacagttataactccaatgatgaggcacacgattgaaaataccacagcaaacatcagcttgactgctattgccaatcaggcggctatcctgatgggcctcgataaaggttggcctatatccaagatggacatcggggtgccgctgcttgccttaggctgctattcacaagtcaaccccctgaccctcacagcagccgtgttgatgctggtcgctcattacgcaattatcggaccaggcctacaggccaaagcgacccgcgaggctcagaagcggactgccgcagggattatgaagaatcctacggtggatggaatcgttgccatagacctggaccccgtggtatatgatgctaaattcgaaaagcagctcggccaaattatgcttctgatcttgtgtatctctcagattctgctcatgcgaacaacctgggccctgtgcgagagtatcactttagcaaccggtccacttacaactctgtgggaagggtcgcctggaaaattttggaacaccacaatagctgtgagcatggccaatattttcagaggctcctacctcgcgggtgccggcctagcattttctctgatgaagtcactagggggaggcaggcgcgggacgggagctcagggcgagaccctgggtgagaaatggaagcggcagctcaaccaacttagcaagcccgagttcaatacttataaaagatccgggatcatggaggtcgaccgtagtgaagccaaggagggactgaaaaggggcgaaacaaccaagcacgcagtttctcggggtactgctaaattgcgctggttcgtggagcgaaacctggtcaagccggagggcaaggtgattgatctcgggtgtggaagaggcgggtggagctactattgcgccggactgaaaaaggtaacagaagtgaaaggctacaccaagggtgggccaggacatgaggaacctatccccatggccacgtacggctggaatctagttaaacttcactcaggcaaggacgtgtttttcatgccacccgagaaatgtgataccctgctatgcgacataggggaatccagtcctaacccgacaatcgaggagggaaggactctccgggtcctgaagatggtggaaccctggttgcgcggtaatcagttttgtattaagatcctgaacccatatatgcctagcgtcgtggagaccctcgaacagatgcagagaaaacacggcgggatgcttgttaggaatcccctgtctcgaaactccacacatgagatgtactgggtatcatgcggaactggcaatattgtgagcgcggtcaacatgacctcgcggatgttactgaaccgtttcacaatggctcacagaaagcctacctatgagcgcgatgtggacttgggtgcagggactaggcatgttgccgtggaaccagaggtcgctaatctcgatatcattggacaacggatcgaaaacatcaaaaatgagcacaagtctacgtggcactacgacgaagataacccctataaaacatgggcctaccatggcagttatgaggtgaagccttccggcagcgcatcatccatggtaaatggggtggttagactgctaaccaagccatgggacgtcattcccatggtgactcagatcgccatgaccgacacaacgccgtttggacagcaacgcgtgttcaaagagaaggtcgataccaggactcctcgagctaaacggggtacaacccagatcatggaagttactgcgaagtggctttggggctttctgtctagaaacaaaaagccaaggatttgtacacgcgaggagttcacccgtaaggtgcggagcaatgccgcaataggggctgtatttgtggacgagaaccagtggaatagtgccaaagaagcagtcgaggatgagagattctgggacctcgtgcacagggaacgcgagctgcataagcagggaaaatgcgccacatgcgtttacaacatgatgggcaagcgagagaaaaagttgggtgagtttgggaaggctaaaggatcccgggccatctggtacatgtggctgggcgcgagattcctcgaatttgaggcacttggcttcatgaatgaggatcactggttcagcagggaaaactctctgtcaggggtggagggagaaggtttacataagctgggctatattttgcgcgacatcagtaaaattcccgggggaaatatgtacgccgatgacactgctggctgggataccagaatcacggaggacgatctccaaaacgaggccaagataaccgacatcatggaacctgagcacgcactgctagctacatccatttttaaacttacttatcagaataaggtcgtgcgggtacagaggccagccaaaaacggtaccgttatggatgtgatcagccgtcgagaccagcgcgggtctggacaagtcggcacatacggcctgaacactttcaccaatatggaagtgcagctcattagacagatggagtcggaagggatctttctgccctcagagttggagacgccgaacttagctgaacgggtgctggactggctcgagaagcacggagccgaaaggcttaagcgcatggcaataagcggtgatgactgtgtcgttaaacctattgatgacagattcgcgacagccctgaccgctctaaatgatatgggcaaggtgcggaaagacatcccccagtgggagccatccaaggggtggaacgattggcaacaggtacctttttgcagtcatcacttccatcagctgatcatgaaagacggaagggaaattgtggtcccctgtcgaaatcaggatgagctcgtgggccgtgccagagtttctcaaggtgcagggtggagcttgcgcgagactgcttgcctgggaaagtcctatgcccagatgtggcagcttatgtactttcaccggagggacctgagactcgcagccaacgcgatatgttcagctgtgccagtcgattgggtgcccacaagtcgcaccacttggtctatccacgcccatcaccaatggatgaccacagaagacatgttaagcgtatggaatcgggtttggattgaggaaaacccttggatggaggacaagacgcatgtgtcctcatgggaagaggtcccatatctgggcaaaagggaggatcagtggtgcggcagcttgatcgggctgaccgcacgagccacttgggctacaaatattcaggtggccatcaaccaggttagacggctcataggaaatgaatcttaccttgactacatgacctccatgaagaggttcaaaaacgagagtgatccggaaggtgcactgtggtga

SEQ ID NO: 13434 - RNA, 9879 nt, synthetic construct
  misc_feature 1..9879: note = derived and/or modified CDS sequence (opt3) from DENV-1__KF973461__SS-prME
  source 1..9879: mol_type = other RNA
agcgtgaccatgctgctcatgcttctgcccacagccttggctttccacttaactacgagaggcggggagcctcatatgatcgtctccaagcaggaaaggggaaaatctctgctatttaagacctcagcaggtgttaacatgtgcacactcattgccatggacctgggcgagctttgtgaagatactatgacctacaaatgcccacaaataacagaggcggaaccggacgatgtggactgttggtgcaatgctaccgatacttgggtaacatatgggacctgtagtcagacgggagagcaccggcgcgacaagcgaagcgtggccctggcaccccatgtcggcttgggtctcgagactcgtaccgaaacatggatgtcctctgagggggcctggaaacagatccagagagtggaaacttgggctctgaggcaccctggattcaccgttattgcactgtttctcgcccatgctatcggcacatcgattacccaaaagggcatcatattcatcttactgatgcttgtgacgccatcaatggccatgcggtgcgtcgggattggaaaccgcgattttgtggagggtttgagcggcgcgacttgggtagacgttgtgctggagcacgggagttgtgtcacaaccatggcaaagaataaacccactctagatatcgaactcctgaagacagaggtgaccaaccctgccattcttagaaaactgtgcatcgaagctaagatatccaatacgaccacagactctaggtgtccaactcagggagaggccaccttggtggaagagcaggatgcaaacttcgtctgccggcgcacatttgttgaccgaggctggggtaatgggtgtggactcttcggcaaaggcagcctgttaacttgcgctaagtttaagtgcgtgaccaaactggaggggaagattgtacagtacgaaaacctcaaatattccgtgatcgtcacagtgcacaccggagatcaacatcaggttggtaatgagactacggaacacggcacaattgccaccatcactccccaggcgcctacctcagagatccagcttacagactacggggccctgaccttggactgtagtccaagaactggactagatttcaacgaaatggtgctgctcacaatgaaggagaaaagctggctggtccataagcaatggtttcttgacctgccgttgccctggacgtctggcgcatccacctcacaggagacttggaataggcaggatctcctggtgacattcaaaaccgctcacgccaagaagcaagaagtagttgtgttaggtagccaggagggggctatgcacacagccctgactggcgcaaccgaaattcagacgagtggaaccacaactatatttgccggccatctaaaatgccggctcaagatggacaaactgacccttaaggggacatcttatgtcatgtgtactggatccttcaaattggagaaggaagtggctgagacccagcacggtacggtcctggtgcaagttaagtacgagggcacagatgcgccttgcaaaatcccattcagcacccaggacgaaaagggggtgactcagaacggacgtctcattacagcaaatcccatcgtaaccgataaagagaagcctgtcaacatagaaactgagccaccctttggcgagtcgtatattgtggttggtgccggggaaaaagctctgaagctttcttggttcaagaaaggctcctcaatcggaaagatgtttgaggccaccgcacgcggcgccagaaggatggctatcctgggggacacagcctgggatttcggaagtatgggtggcgtgtttacgagcgtcgggaaattggtgcatcaggtattcggaaccgcatacggcgtgctcttttccggtgtttcttggactatgaagattgggatcggcattctgttaacatggctgggactaaatagccggtcaaccagtctctccatgacatgtatagcggtcggcatggtgactctgtaccttggggtgatggtccaagctgacagcggatgcgttatcaactggaaaggccgagaattgaagtgtggttctgggattttcgtgaccaacgaggtgcacacgtggacagaacagtataagtttcaggccgattcaccgaaacgcctgagtgcagccatcggaaaggcttgggaggagggcgtatgcggtatcagaagcgccaccaggctcgaaaatattatgtggaaacagatatccaacgagctgaatcatatcttactggaaaacgacatgaagttcactgtcgtggttggcgacgcaaatgggattcttgctcaaggaaaaaagatgatccggcctcagcccatggagcacaaatactcttggaagtcgtggggcaaggccaaaattatcggggcggatatacagaacaccacatttatcattgacggaccagatactcctgaatgtcccgacaatcagcgcgcctggaacatctgggaggtggaggattatggcttcggtatttttaccacaaatatctggttgaagctcagagacagctacacgcaaatgtgcgatcacaggctgatgtccgctgcaataaaagactcaaaggccgtccatgctgatatggggtattggattgaaagtgagaaaaacgaaacctggaagctagcccgtgcatctttcatcgaggtgaagacttgtacatggccaaaaagccacaccctgtggtccaatggagttctcgaatcagagatgattatccccaagatatacggcggtcctatcagccagcataactatcggccaggctacttcactcagacagcggggccgtggcacctgggaaaacttgagttggactttgaactgtgcgagggcaccacggtggtagtcgatgaacactgcgggaatcgaggaccctctttaagaactaccacagtgaccggcaagattatccatgagtggtgttgcaggtcctgtactctccctccactgcgcttccggggtgaggacgggtgctggtacggaatggaaattagacccgtgaaagagaaggaagagaaccttgtcaggagtatggttagcgccggctctggtgaagtggattccttttcactgggcatcttgtgtgctagtataatgattgaggaggtaatgcgcagccgatggtcgcggaagatgctcatgacagggaccctggccgtgttcctactgctcatcatgggacaactgacatggaatgaccttatccgtttgtgcattatggtcggcgcaaacgcttccgacagaatggggatgggaactacctatctggccttaatggcaacgtttaaaatgaggcctatgttcgccgtgggcctcctgtttcgccggcttacatctagagaagttctgctactcaccatcggtctgagcttggtggcttcagtcgagctgccaaacagtttagaagagctcggggatggactggcgatgggcattatgatgcttaagctgttgactgaattccagccccaccagctctggaccacactgctatccctgacttttataaaaaccacgctttctctcgactacgcctggaagatcacagcaatggctctgagcattatctccttgttcccgctgtgtttatcaaccactagccagaaaacaacctggctccctgtgctgcttggcagttttgggtgcaagccactgactatgttcttgattacagagaataagatctggggaaggaaatcttggcccctcaacgagggtataatggccatcggcattgtttccatcctgctaagctcgctgcttaagaatgatgtgcctctcgccgggcccctgattgctggaggcatgttgatcgcatgttatgtcatatcaggttctagtgccgacttatccctggaaaaagcggctgaggtaagctgggaacaagaggccgaacattctgggaccagccacaacattctcgtggaggttcaggatgacggaacgatgaagatcaaagatgaggaacgagacgatactctgaccatccttctgaaggcaacattgctagccgtgtccggcgtctacccaatgtcaattcctgctaccctgtttgtgtggtatttctggcagaaaaagaagcagcgcagtggcgtactctgggacacacccagcccaccggaggtggaacgggcagtcctggatgacgggatatacagaatccttcaaaggggattactgggtcgttctcaggttggcgtgggggtgttccaggatggagtctttcatactatgtggcacgtgacccgcggcgccgttctcatgtatcagggtaaacggttggagccttcctgggcgtcagtaaagaaagacctgattagttacgggggaggctggagattccaaggcagctggaatacgggggaggaagtgcaggtcatcgctgtggagcccggaaagaacccaaaaaatgttcagacaactcccggtacctttaagacacctgaaggcgaggtgggggccattgcactcgacttcaagccaggaacctccggctctcccatcgtcaacagggaaggtaaaatagtggggctgtacggaaatggcgtagtcactacctcgggcacatatgtgagcgccatcgctcaagccaaggcatcacaggaggggcctcttccggagattgaagatgaggtttttaaaaagcgaaacctgacgatcatggacttgcacccaggatccggtaaaactcggcgctacctacccgctattgtgagagaagccatcaagaggaagctgcggaccctcatattagcgcctacacgagtcgtggccagtgagatggcagaagctctgaaaggcatgccaattagatatcagaccactgccgttaagtctgagcatacagggcgcgagatcgtggatcttatgtgccacgctaccttcacgatgaggctgctcagccccgtccgtgtgcctaattacaacatgatcattatggacgaagcacattttactgatccggcctccatcgccgctcggggatatatatcaacaagagtaggcatgggtgaggcggcagccattttcatgaccgctacccccccagggtctgtggaagcctttcctcagagcaatgcagttatccaagacgaggaaagggatattcccgagcgcagttggaactccggatacgactggatcactgatttcccaggcaaaacagtctggtttgtgcctagcataaagtctggcaatgacattgccaactgtttgcgaaaaaacgggaagagagtgatccagctgtcacggaagaccttcgatacagagtatcagaaaactaagaataacgactgggactacgtcgtaacgaccgatatctccgaaatgggagctaatttcagggcggaccgcgtgattgatccccgtagatgcctcaaaccagttatcctgaaggacggtccggagcgggtgattcttgccggccctatgcccgtcacagtggcaagtgctgcccagaggcgcgggcgaataggaagaaaccaaaataaagaaggcgatcagtacgtttatatgggtcagccactaaacaatgacgaggatcacgcacattggactgaggccaagatgctgttggacaacatcaatacccccgaagggattatccctgctttatttgagccagaacgggagaagagcgccgcgatcgatggcgaatacaggctgcgcggagaggcaagaaaaacattcgtggagctcatgaggcggggcgacctgcccgtctggctttcgtataaggtggcctctgaagggtttcagtactccgatcgtcgctggtgcttcgacggagagcgaaacaatcaagtactggaagagaacatggatgtggaaatttggaccaaagagggtgagagaaagaaactcaggcctcggtggttggacgctcgcacttatagcgacccgctggccctaagagaatttaaggagttcgctgcaggcaggcggtcagttagtggggatctgatactcgaaatcggaaaacttccacagcacctgacgttacgagcccagaatgctttggacaacctggtcatgctccacaattctgagcagggcggtaaggcctacagacatgcaatggaagagctgcccgataccattgagacacttatgctgctcgcgttgatcgccgtgctgactgggggcgtgaccttatttttcctatccggaaagggcctggggaaaacaagcattggactcctttgtgtcaccgcttcaagtgccctgttgtggatggcaagcgttgaacctcactggatcgctgcctccataatcctggagtttttcctcatggtgctgcttattcccgaaccagaccgccaaaggactcctcaggataaccagctcgcatatgtagtgatcggtctgttgtttatgattctgacagtcgccgctaacgagatgggcttactagagacgaccaagaaagacctggggatcggacatgtggcggccgaaaatcaccaacacgcaactatgctcgatgttgaccttcggcccgcttctgcctggacactgtacgccgtggcaaccaccgtcataacaccaatgatgcgtcatactattgagaacacgaccgctaatatcagcttgacagccattgcgaaccaggctgccatcctgatgggcctcgataagggttggcctatatccaaaatggacatcggggtaccgctgcttgcattaggctgctactcacaggtgaatcccctgactctcaccgccgctgttttgatgctggtggcacactatgccattatcggaccaggcctacaggcgaaggctacaagagaagcccaaaagaggaccgcagccgggattatgaaaaaccctactgtcgatggaatcgtggctatagacctggatcccgtcgtgtacgacacgaagttcgagaaacagctcggccagattatgcttctgatcttgtgtacatctcagatcctgctcatgcgcaccacttgggccctgtgcgaaagtattaccttagcaacaggtccacttactaccctgtgggaggggtcgcctggaaagttttggaatacaacgatcgctgttagcatggccaacatattccggggctcctatctcgcgggtgccggcctagcattctctctgatgaaatcattggggggaggccgaagagggaccggagctcaaggcgagactctgggtgaaaagtggaagaggcagctcaatcagcttagcaaatccgagtttaacatttacaagcgcagtgggatcatggaagtggaccggtctgaggccaaagaaggactgaagagaggcgagacaaccaaacatgcagtaagccgtggtactgctaagttgaggtggttcgtggagcggaatctggtcaagcccgaaggcaaagttattgatctcgggtgtggacgcggcgggtggtcatattactgcgccggattaaagaaagtgacagaggtcaagggctataccaaaggtgggccgggacacgaagagccaatccctatggccacgtacggctggaacctggtgaagcttcattccggcaaagacgtatttttcatgcccccagaaaagtgtgataccctgctatgcgacataggggagagtagccccaatcctacaatcgaggaaggacgaactctcagagtgctgaagatggttgagccgtggttgaggggtaaccagttttgtattaaaatcctgaatccctacatgccatctgtggtcgaaaccctcgagcaaatgcagcggaagtatggcgggatgcttgtgcgcaaccctctgtccagaaattcaacacacgagatgtactgggtcagctgcggaactggcaacattgtgtcggcggttaacatgacctctaggatgttactgaatcgattcacaatggctcaccggaaacccacctatgaacgtgatgtagacttgggtgcagggactagacatgtggccgtcgagcctgaagtggctaacctcgatatcattggacagcgcatcgagaatataaagaacgaacacaaaagtacgtggcattacgacgaggataatccatataagacatgggcctaccacggctcctatgaggttaagcccagcggctcagcatcctctatggtgaacggggtcgtgaggctgctaaccaaaccttgggacgtaattccaatggtgactcaaatcgccatgaccgatacaacgccctttggacagcagcgggttttcaaggaaaaagtcgacaccagaactccgcgcgctaagaggggtacaacccagatcatggaggtgactgcgaaatggctttggggctttctgagccgaaataagaagcctcggatttgtacaagagaagagttcaccaggaaagtgcgcagtaacgccgcaataggggctgtctttgttgacgaaaatcaatggaactccgccaaggaggcagtggaggatgaacgtttctgggacctcgtacggagagagagggaactgcacaaacagggaaagtgcgccacatgcgtgtacaatatgatgggcaaacgcgagaagaagttgggtgaatttgggaaagctaagggaagccgagccatctggtacatgtggctgggcgcgcggttcctcgagttcgaggcacttggctttatgaacgaagatcattggttctctagagagaattcactgagtggggtcgaaggagagggtttacacaaactgggctatattttgagggacatctccaagattccagggggaaacatgtacgccgatgacactgctggctgggatacccgcatcacggaggacgatctccagaatgaagccaaaataaccgacatcatggagcccgaacatgcactgctagctacaagcatttttaagcttacttatcagaacaaagtggttagagtgcaacggcctgccaagaacggtaccgtcatggatgtgatctctaggcgtgaccagcgagggtcgggacaggtaggcacatacggcctgaatactttcaccaacatggaggttcagctcattcgccaaatggaatcagaggggatctttctgccaagcgagttggaaacgcccaatttagctgagagagtgctggattggctcgaaaagcacggagccgagcggcttaaaaggatggcaatatccggtgacgactgtgtcgtgaagccgattgatgaccgcttcgcgacagccctgaccgctctaaacgatatgggcaaagtgagaaaggacatccctcagtgggaacccagtaaagggtggaatgattggcagcaggtcccattttgctctcatcacttccaccaactgatcatgaaggacggacgggagattgttgtgccttgtaggaaccaggatgagctcgtaggccgagcccgtgtgagccagggtgcagggtggtccttgagagaaactgcttgcctgggaaagtcatatgcccaaatgtggcagcttatgtactttcatcgccgggacctgaggctcgcagccaatgcgatatgtagtgctgtccccgtggattgggttccaacatctagaaccacttggagcatccacgcccatcaccagtggatgaccacagaggacatgttatccgtgtggaaccgcgtctggattgaagagaatccctggatggaagataaaacgcacgtgtcaagctgggaggaggtaccttatctgggcaagcgggaagaccagtggtgcggctctttgatcgggctgaccgcaagggccacttgggctacaaacattcaagttgccatcaatcaggtgcgaagactcataggaaacgagaattaccttgactacatgacctccatgaaacggttcaagaacgaaagtgatccagagggtgcactgtggtga

SEQ ID NO: 13435 - RNA, 9879 nt, synthetic construct
  misc_feature 1..9879: note = derived and/or modified CDS sequence (opt3) from DENV-1__KF973462__SS-prME
  source 1..9879: mol_type = other RNA
agcgtgaccatgctgctcatgcttctgcccacagcattggctttccacttaactacgcgaggaggggaacctcatatgatcgtctccaagcaggaaaggggaaaatctctgctgtttaagacctcagccggtgttaacatgtgcaccctcattgccatggacctgggcgaactttgtgaagatactctgacctacaaatgcccacaaataatcgaagcggaaccggacgatgtggactgttggtgcaatgctacagatacctgggtaacttatgggacatgtagtcagaccggagagcaccggcgcgacaagcgaagcgtggccttggcaccccatgtcggcctcggtctggagacgcgtactgaaacctggatgtcctctgagggggcctggaaacagattcagagggtggaaacatgggctctgaggcaccctggattcactgttatcgcactctttttagcccatgctattggcacctcgatcacacaaaagggcataatcttcattctgcttatgttggtgaccccatcaatggccatgcggtgcgtcgggatcggaaaccgcgattttgtggagggtctgagcggcgcgacgtgggtagacgttgtgctagagcacgggagttgtgtcactacaatggcaaagaataaacccaccctcgatattgaactgcttaagactgaggtgacaaaccctgccatcctgagaaaattgtgcatagaagctaagatttccaataccacgaccgactctaggtgtccaacacagggagaggccactctcgtggaagaacaggatgcaaacttcgtctgccggcgcacctttgttgaccgaggctggggtaatgggtgtggactgttcggcaaaggcagcttactgacatgcgctaagtttaagtgcgtgactaaactcgaggggaagatcgtacagtacgaaaaccttaaatattccgtgattgtcaccgtgcacacaggagatcaacatcaggttggtaatgagaccactgaacacggcacgatcgccacaatcaccccacaggcgcctacttcagagattcagctgaccgactacggggccttgacactagactgtagtccaagaaccggactggatttcaacgaaatggtgctcctgactatgaaggagaaaagctggcttgtccataagcaatggtttctggacttgccgctcccctggacatctggcgcatccacgtcacaggagacctggaataggcaggatctgttagtgactttcaaaacagctcacgccaagaagcaagaagtagttgtgctgggtagccaggagggggctatgcacaccgccctaacaggcgcaactgaaatacagaccagtggaacgaccacaatctttgccggccatctcaaatgccggctgaagatggacaaacttactttgaaggggacctcttatgtcatgtgtacaggatccttcaaactggagaaggaaatggctgagactcagcacggtaccgtgctcgtccaagtgaagtacgagggcacggatgcgccttgcaaaattccattcagcacacaggacgaaaagggggttacccagaacggacgtctgatcactgcaaatcccatagtgacagataaagagaagcctgtaaacattgaaaccgagccaccctttggcgagtcgtatatcgtcgtgggtgccggggaaaaagctcttaagctgtcttggttcaagaaaggctcctcaatcggaaagatgtttgaggccactgcacgcggcgccagaaggatggctattttgggggacaccgcctgggatttcggaagtatcggtggcgtttttacaagcgtggggaaactcgtccatcaggtgttcggaacggcatacggcgtactgttttccggtgtgtcttggaccatgaagattgggataggcatcttactgacttggctaggactcaatagccggtcaacaagtctgtccatgacctgtattgcggttggcatggtcacactttacttgggggtgatggtgcaagctgacagcggatgcgtcatcaactggaaaggccgagaactgaagtgtggttctgggatcttcgttactaacgaggtgcacacctggacggaacagtataagtttcaggccgattcaccgaaacgcctcagtgcagccattggaaaggcttgggaggagggcgtgtgcggtataagaagcgccacaaggctggaaaatatcatgtggaaacagatttccaacgagttaaatcatatcctgcttgaaaacgacatgaagttcaccgtagtcgtgggcgacgcaaatgggattttggctcaaggcaaaaagatgatccggcctcagcccatggagcacaaatactcttggaagtcgtggggcaaggccaaaataatcggggcggatattcagaacactacctttatcattgacggaccagatacacctgaatgtcccgacaatcagcgcgcctggaacatctgggaggttgaggattatggcttcggtatatttactaccaatatttggctcaagctgagagacagctacacacaagtgtgcgatcacaggctaatgtccgctgcaatcaaagactcaaaggccgtccatgctgatatggggtattggattgaaagtgagaaaaacgaaacgtggaagctggcccgtgcatctttcatcgaggtgaagacctgtacttggccaaaaagccacacactctggtccaatggagttctggaatcagagatgataatccccaagatttacggcggtcctatcagccagcataactatcggccaggctacttcacccagactgcggggccgtggcaccttggaaaattggagctggactttgatttatgcgaaggcacaaccgtggtagtcgacgagcactgcgggaatcgaggaccctctctcagaacgactaccgtgacaggcaagattatccatgaatggtgttgcaggtcctgtaccctgcctccacttcgcttccggggtgaggatgggtgctggtacggaatggagataagacccgtgaaagaaaaggaggaaaacctggtcaggagtatggttagcgccggctctggtgaggtggactccttttcattgggcattctctgtgctagtatcatgatcgaagaggtaatgcgcagccgatggtcgcggaagatgctgatgactgggacactagccgtgttcctgctcctgattatgggacaacttacctggaatgacttgatccgtctgtgcattatggtcggcgcaaacgcttccgatagaatggggatgggaacaacttatttagccctcatggcaacctttaaaatgaggcctatgttcgccgtgggcctgctttttcgccggctgacgtctagagaggttctactcctgacaataggtttgagcctggtggcttcagtcgaattaccaaacagtctcgaggaactgggggacggacttgcgatgggcatcatgatgctgaagttgctcaccgagttccagccccaccagctgtggactaccctactgtcccttacatttattaaaactaccctctctctggattacgcctggaagacgacagcaatggctttgagcatcatttccctgttcccgttatgtctctcaaccactagccagaaaacaacctggctgcctgtgcttctgggcagttttgggtgcaagccattgactatgttcctcatcacagaaaataagatatggggaaggaaatcttggcccctgaacgagggtatcatggccattggcatcgtttccattctactgagctcgcttctcaagaatgacgtgcctctggccgggcccttgatcgctggaggcatgttaatagcatgttatgtcatttcaggttctagtgccgatctgtccctcgagaaagcggctgaagtaagctgggagcaagaagccgagcattctgggaccagccacaacatcctggtggaagttcaggacgatggaacgatgaagatcaaagacgaggagcgagatgacactcttaccattctgttgaaggcaacactactggccgtgtccggcgtctacccaatgtcaatacctgctaccctctttgtgtggtatttctggcagaaaaagaagcagcgcagtggcgtactgtgggatacacccagcccaccggaagtggagcgggcagtccttgacgatgggatctacagaattttacaaaggggactgctcggtcgttctcaggttggcgtgggggtgttccaggacggagtctttcatactatgtggcacgtgacccgcggcgccgttttgatgtatcagggtaaacggctggaaccttcctgggcgtcagtaaagaaagacctcatcagttacgggggaggctggagattccaaggcagctggaatacgggggaggaggtgcaggtcattgctgtggaacccggaaagaaccccaaaaatgttcagacaactcccggtacctttaagacacctgagggcgaagtgggggccatcgcactggatttcaagccaggaacctccggctctcccatagtcaacagggagggtaaaatcgtggggctttacggaaatggcgtagtcactacctcgggcacatatgtgagcgccattgctcaagccaaggtttcacaggaagggcctctgccggagatcgaggacgaagtgtttaaaaagcgaaacttgacgattatggatctacacccaggatccggtaaaactcggcgctacctgcccgcaatcgtcagagaggctataaagaggaagctccggaccttaattctggcccctacacgagtggttgcgagtgaaatggccgaggcacttaaaggcatgccaatcagatatcagaccactgctgtgaagtctgaacatacagggcgcgagatcgtcgacctgatgtgccacgccaccttcacgatgaggctcttgagccccgtgcgtgtacctaattacaacatgattatcatggatgaggctcattttactgacccggcatccatagccgcccggggatatatttcaacaagagtgggcatgggtgaagctgcggcaatcttcatgaccgccacacccccagggtctgttgaggcttttcctcagagcaatgccgtcattcaagatgaagagagggacatccccgaacgcagttggaactccggatacgattggataactgacttcccaggcaaaacagtgtggtttgtgcctagcattaagtctggcaatgatatcgcaaactgtctgcggaaaaacgggaagagagtcatccagctctcaagaaagaccttcgacacagagtatcagaaaactaagaataacgactgggattacgtagtgacgaccgacatttccgagatgggagccaatttcagggctgatcgcgttatcgacccccgtagatgcctgaaaccagtgattcttaaggatggtccggaacgggtcatactagcgggccctatgcccgtgacagttgccagtgcagctcagaggcgcgggcgaatcggaagaaaccaaaataaagagggcgaccagtacgtgtatatgggtcagccactgaacaatgatgaagaccacgcccattggactgaggcaaagatgttgttagataacattaatacccccgaggggatcatccctgccctgtttgaaccagagcgggaaaagagcgctgccattgacggcgagtacaggctccgcggagaagcgagaaaaacattcgtcgagctgatgaggcggggcgatcttcccgtgtggctgtcgtataaggtagcatctgaggggtttcagtactccgaccgtcgctggtgcttcgatggagaacgaaacaatcaagtgctcgaggaaaacatggacgttgagatatggaccaaagaaggtgagagaaagaaattgaggcctcggtggctggacgcccgcacttatagcgatccgctagctctgagagagtttaaggagttcgccgctggcaggcggtcagtcagtggggacctcatccttgagattggaaaactgccacagcacttaacgttgcgagcacagaatgccctggataacctcgtgatgctgcacaattctgaacagggcggtaaggcttacagacatgccatggaggaacttcccgacaccatcgagacactgatgctcttggcactgattgcggtgttaactgggggcgtcaccctatttttcctgtccggaaagggcctcgggaaaacaagcatcggacttctgtgtgttaccgcctcaagtgctttgctgtggatggccagcgtggagcctcactggatagcagcttccatcattctcgaatttttcctgatggtacttctcatccccgagccagatcgccaaaggactcctcaggacaaccagctggcctatgtggtcattggtttgctgtttatgatcttaacagtggcagccaacgaaatgggcctactggagacgaccaagaaagatctcgggataggacatgttgctgcggagaatcaccaacacgccactatgcttgacgtggatctgcggcccgcatctgcttggacattgtacgccgtcgccaccaccgtaattacaccaatgatgcgtcatactatcgaaaacacgaccgcaaatattagcctgacagctatcgccaaccaggcggctatactcatgggcctggacaagggttggcctatctccaaaatggatattggggtgccgcttttagccctgggctgctactcacaggttaatcccctcactttgaccgcagccgtgctgatgctagtcgctcactatgcaatcattggaccaggcctgcaggccaaggcgacaagagaggctcaaaagaggaccgccgcagggatcatgaaaaaccctactgtggacggaatagtcgccattgatctcgaccccgtggtttacgacacgaagttcgaaaaacagcttggccagatcatgctgttgatcctgtgtacatctcagattctcctgatgcgcaccacttgggctttatgcgagagtatcacccttgccacaggtccactgactaccctctgggaagggtcgcctggaaagttttggaatacaacgatagcagtgagcatggctaacattttccggggctcctatctagccggtgcgggcctggccttctctttgatgaaatcactagggggaggccgaagagggaccggagcacaaggcgagactctcggtgagaagtggaagaggcagcttaatcagctgagcaaatccgaatttaacatctacaagcgcagtgggattatggaggtagatcggtctgaagctaaagagggattgaagagaggcgaaacaaccaaacatgccgtgagccgtggtactgcaaagctgaggtggttcgtcgagcggaatctcgttaagcccgagggcaaagtgatcgacttagggtgtggacgcggcgggtggtcatattactgcgctggactgaagaaagtcacagaagtgaagggctataccaaaggtgggccgggacacgaggaaccaatacctatggccacgtacggctggaaccttgtacgactgcattccggcaaggatgtgtttttcatgcccccagagaaatgtgacaccctactctgcgatatcggggaaagtagccccaatcctacaattgaggagggaagaactctgagggttttgaagatggtggaaccgtggctgcggggtaaccagttttgtatcaagattctcaatccctacatgccatctgtcgtggagacccttgaacaaatgcagcgcaaatatggcgggatgctggtcagaaaccctttatccagaaattcaacacacgagatgtactgggtgagctgcggaactggcaacatcgtttcggccgtaaacatgacctctcgaatgctgttgaatcggttcacaatggcgcaccgtaagcccacctatgagagagacgtggatctcggtgctgggactcgccatgtcgcagtggaacctgaggttgccaacctggacattatcggacagaggatagaaaatattaaaaacgagcacaagagtacgtggcattacgatgaagacaatccatataaaacatgggcttaccacggctcctatgaggtgaagcccagcggctcagcctcctctatggtcaacggggtggtacggctacttaccaagccttgggatgtgatcccaatggttactcaaatcgcaatgaccgacacaacgccctttggacagcagagagtcttcaaagagaaggtggacacccgcactccgagggccaaacgaggtacaacccagattatggaagtgactgctaagtggctgtggggctttctcagccggaataaaaagcctagaatatgtacaagggaggagttcacccgcaaggtccgtagtaacgcggccatcggggcagtttttgtggatgagaatcaatggaactccgctaaagaagccgtagaggacgagcggttctgggatctggtgcacagagaaagggagttgcataagcagggaaaatgcgcaacatgcgtctacaatatgatgggcaagcgcgagaaaaagctgggtgagtttgggaaggccaaaggaagccgagctatttggtacatgtggctcggcgcccggttccttgagttcgaggcgctgggctttatgaacgaggaccactggttctctagagaaaattcattaagtggggtggagggagaaggtctgcataagttgggctatatcctcagggatatttccaaaatcccagggggaaacatgtacgcagacgatactgccggctgggacacccgcataacggaggatgacctgcagaatgaggctaagatcaccgatattatggaacccgagcacgccctacttgcaacaagcatctttaaactgacttatcagaacaaggttgtgagagtccaacggcctgctaaaaacggtaccgtgatggacgtaatttctaggcgtgatcagcgagggtcgggacaggttggcacatacggcctcaatactttcaccaacatggaagtgcagctgatccgccaaatggagtcagaagggatatttttgccaagcgagttagagacgcccaatctggccaagagagtcctcgactggcttgaaaagcatggagctgagcggctgaaaaggatggccatttccggtgacgattgtgtggtgaagccgatcgacgatcgcttcgcaacagcgctaaccgccctgaacgacatgggcaaaatcagaaaggatattcctcagtgggaacccagtaaagggtggaatgactggcagcaggtcccattttgctctcaccacttccatcaactcataatgaaggatggacgggagatcgttgtgccttgtaggaaccaggacgaattggtaggccgagctcgtgtgagccagggtgccgggtggtccctgagagagactgcatgccttggaaagtcatatgctcaaatgtggcagctgatgtactttcaccgccgggatctcaggttagccgcaaatgccatttgtagtgcggtccccgtggactgggttccaacatctagaaccacttggagcatccatgctcaccaccagtggatgaccacagaggatatgctgtccgtgtggaaccgcgtctggattgaagagaatccctggatggaagacaaaacgcatgtgtcaagctgggaggaagtaccttatttgggcaagcgggaggaccagtggtgcggctctctgatcgggctcaccgccagggcaacttgggccacaaacatacaagttgctatcaatcaggtgcgaagacttattggaaacgagaattacctggattacatgacctccatgaaacggttcaagaacgaaagtgacccagagggtgccctatggtga

SEQ ID NO: 13436 - RNA, 9879 nt, synthetic construct
  misc_feature 1..9879: note = derived and/or modified CDS sequence (opt3) from DENV-1__KF973463__SS-prME
  source 1..9879: mol_type = other RNA
agcgtgaccatgctgctcatgcttatgcccaccgccctggctttccacttgactacgagaggaggggaacctcatatgatcgtctccaagcacgaaaggggaaaagcattactgtttaagacctctacaggtgttaacatgtgcactctgattgccatggacctcggcgaactgtgtgaagataccatgacatacaaatgcccacggataaccgaggcggaaccggacgatgtggactgttggtgcaatgctactgatacatgggtaacctatgggacgtgttcacagactggagagcatcgccgagacaagcgtagtgtggcccttgcaccccacgtcggcctgggtttggagaccagaacagaaacttggatgagctccgagggggcctggaaacaaatccagagggtggaaacctgggctctccggcatcctggattcacagttattgcactgtttctggcccacgctatcggcacctctattacgcagaagggcatcatattcatcctcttaatgctggtgactccatcgatggccatgcgctgcgtcgggattggaaacagagattttgtggagggtctttcaggcgcgacatgggtagacgttgtgttggagcacgggagctgtgtcaccactatggcaaagaataaacccacactggatatcgaactactcaagaccgaggtgacgaaccctgccgtgctgaggaaactttgcattgaagctaagatcagtaataccacaactgactcccggtgtccaacccagggagaggccacactggtcgaagaacaagatgcaaacttcgtttgccgccgaacttttgtggacagaggctggggtaatgggtgtggattgttcggcaaaggctctctcctgacctgcgctaagtttaagtgcgtaacaaaattagaggggaagatagtgcagtacgaaaacctgaaatatagcgtcattgtgaccgttcatactggagatcagcaccaggtgggtaatgagacgacagaacatggcaccatcgccactattacaccccaagcgcctacatccgagatccagctcaccgactacggggcccttactctggactgttcaccaaggacaggattggatttcaacgaaatggtcctactgacgatgaaggagaaaagttggctcgtgcacaagcagtggtttctggaccttccgctgccctggaccagcggcgcatctacttcccaggagacatggaatcggcaagatttgctcgtaaccttcaaaacagctcacgccaagaagcaggaagttgtggtcctgggttcacaggagggggctatgcatactgccttaaccggcgcaacggaaatccaaaccagcggaacaactaccatttttgccggccacctgaaatgccgtctaaagatggacaaactcacactgaaggggacaagttatgtgatgtgtaccggatctttcaaacttgagaaggaagtcgctgagacgcagcatggtacagtgttggttcaggtgaagtacgagggcaccgatgcgccttgcaaaataccattctccactcaggacgaaaagggggtaacacaaaacggacgcctgatcaccgcaaatcccattgtcactgataaagagaagcctgtgaacatcgaaaccgagccaccctttggcgagagctatatagttgtgggtgccggggaaaaagctctcaagctgtcgtggttcaagaaaggatcttccattggaaagatgtttgaggccacagcaagaggcgccaggcggatggctatccttggggacacggcctgggatttcggatcaatcggtggcgtctttaccagtgtggggaaactggtacaccaggtgttcggaactgcatacggcgttttgtttagcggtgtctcctggacaatgaagattgggatcggcattctcctgacctggttaggactaaattctcgaagcacatcactaagtatgacttgtatagcggtgggcatggtgaccctctacctgggggtcatggttcaggctgactccggatgcgtgatcaactggaaaggccgcgaacttaagtgtggtagcgggattttcgtgacgaacgaggtacatacatggaccgaacagtataagtttcaagccgattctccgaaaagattgtcagcagccatcggaaaggcttgggaggagggcgtctgcggtatcaggagtgccactcggctggaaaatattatgtggaaacagataagcaacgagctcaatcacatcctgttagaaaacgacatgaagttcaccgtggttgtgggcgacgcaaatgggattctggctcagggcaagaagatgatccgccctcagcccatggagcacaaatactcctggaagtcttggggcaaggccaaaattatcggggcggatatacaaaacacaacttttatcattgacggaccagatacccctgaatgtcccgacgatcagagagcctggaatatctgggaggtcgaggactatggcttcggtatttttacaacgaacatctggcttaagttgagggattcgtacacccagatgtgcgaccatcgtctcatgagcgctgcaataaaagattccaaggccgtgcacgctgacatggggtattggattgaatcagagaaaaatgaaacttggaagctggcccgggcaagtttcatcgaggttaagacatgtacctggccaaaatctcatactctatggagcaacggagtgctggaatccgagatgattatccccaagatatacggcggtcctatctcacagcacaattatcgaccaggctacttcacacaaaccgcggggccgtggcacctcggaaaactggagcttgattttgacttgtgcgaaggcacgactgtagtcgtggatgagcattgcgggaacagaggacccagcctgaggaccacaaccgtgactggcaagattatccacgaatggtgttgccgctcttgtacattacctccactccggttcagaggtgaggacgggtgctggtacggaatggagattaggcccgtcaaagaaaaggaggaaaatctggttcgctccatggtgagtgccggcagcggtgaggtagactctttttcccttggcatcctgtgtgtgtcaataatgattgaagaggtcatgcgaagtcggtggagccgtaagatgttgatgaccgggacactcgctgtgttcctgctactgatcatgggacagctcacttggaacgatctgatcagactttgcattatggttggcgccaatgcatcggacaaaatggggatgggaaccacgtatttggctctgatggccacatttaagatgaggcctatgttcgcagtgggcatcttatttcgccggctcacctccagagaggtcctgcttctgactattggtctatctctcgtggccagcgttgaactgccaaactcattggaggaactgggggatggattagctatgggcataatgatgctcaaactgcttaccgagttccagccccatcaactgtggacaactttgctcagtctgacctttatcaagacgacactatccctggactacgcgtggaaaaccactgccatggcactttctattgtgagcctcttcccgctgtgtttgtccacaacctcacagaagactacatggctgcctgtcttactcggcagctttgggtgcaagccactgaccatgttccttatcacggaaaacaaaatttggggaaggaagagttggcccatcaatgagggtataatggctatcggcattgtatctatcctgttgtccagcctcctgaaaaacgatgtgcctctagccgggcccctgattgccggaggcatgcttatcgcttgttatgttatatcgggttcatctgcagacctcagtctggagaaggccgcggaagtgtcctgggagcaggaagctgagcacagcgggacttctcataatattttggtcgaagtgcaggatgacggaaccatgcgaatcaaagatgaggagaaggacgatacattaaccatcctgctcaaagccacactgcttgcagtaagcggcgtgtacccaatgtccattcctgccactctgtttgtctggtatttctggcaaaagaagaaacagcgctcaggcgttttgtgggacacccccagtccaccggaagtggagcgggctgtgctagatgacgggatatacagaatcctgcagaggggactcctgggtcgtagccaggtcggcgtgggggttttccaagacggagtatttcacacgatgtggcacgtgacacgcggcgcagtccttatgtatcagggtaagcggttagaaccttcttgggcctccgtgaaaaaggatctgatttcatacgggggaggctggagattccagggcagttggaacactggggaggaggttcaggtgatcgcggtcgaacccggcaaaaatccaaagaacgtgcaaaccacacccggtacctttaagactagcgagggcgaagtaggggctattgccctcgacttcaaacctggaacctccggctctccaatcgtcaatagggagggtaagatagtggggttgtacggaaacggcgttgtgacaacgtcgggcacttatgtcagcgcaatcgcccaggctaaaacctcacaggaagggcccctgcctgagattgaggatgaagtgtttaagaaacgaaatctcacaatcatggacctgcatccgggatccggtaagacccggcgctaccttccagccattgttagagaggcaatcaagaaaaagctgaggactttgatactagctcccacacgggtggtcgccagtgaaatggcggaggccctgaaaggcatgcctattcgatatcaaaccacggcagtgaagtctgaacacactgggagagagatcgtagatctcatgtgccatgctacattcaccatgcgcttactgagcccagtgagggttcccaactacaatatgatcattatggacgaggcccactttaccgatcctgcttccatcgcagcccgtggatatatatcaactcgggtcggcatgggtgaagccgctgcgattttcatgacagcaaccccgcccgggtctgtggaggcctttccacagagcaacgctgtgatccaggacgaagagagagatattcctgaaaggagttggaactccggatacgactggatcacagatttccccggcaaaactgtctggtttgtaccaagcataaagtctggcaatgacattgccaattgtcttcgcaagaacgggaaacgagtgatccagctgtcaagaaagacgttcgacaccgagtatcagaaaactaagaacaatgattgggactacgttgtgactaccgatatctccgagatgggagcaaacttccgggccgacagggtcattgatcctcgccgttgcctcaaacccgtgatcttgaaggacggtccagaaagagttattctggctggcccgatgcctgtgacagtcgcgagtgccgcacaacggagggggcgcataggacgaaatcagaacaaggagggcgatcagtacgtgtatatgggtcaacccctcaataacgacgaagatcatgctcactggaccgaggccaaaatgctgcttgacaatatcaacactccagaggggattatccccgcactatttgaacctgagagagaaaagagcgccgctatcgatggcgagtaccggctgaggggagaagcccgcaaaacgttcgtagagttgatgagaaggggcgacttaccagtgtggctgtcgtataaggttgcgtctgaggggtttcagtactccgatcggcgttggtgcttcgacggagaacgcaataaccaggtcctcgaggaaaatatggacgtggagatttggaccaaagaaggtgagcgaaagaaactgagacccaggtggcttgatgcacggacatatagcgaccctctggccctccgcgagtttaaggagttcgctgccggcagaaggtcagtgagtggggatttgatactggagatcggaaagctaccgcagcacctgactctccgggctcaaaacgcacttgacaatctggtcatgttacataactctgaacagggcggtaaagcctaccgacacgctatggaggaattgccagataccattgagacactgatgctcctggcccttatcgcagttctgaccgggggcgtgactctctttttcttgtccggaaagggcctggggaaaacaagcattggattactatgtgtaacggcgtcaagtgccctgctctggatggctagcgtggagccccattggatcgccgcatccataatccttgaatttttcctgatggtcttgctgattcctgagcccgacagacagcgcaccccacaggataatcaactcgcttatgtggttatcggtctgctttttatgattctcactgtggccgcaaacgaaatgggcctgttggagacaaccaagagggacctggggatcggacacgtcgccgctgagaaccaccagcatgcgaccatgttagatgtagacctacggcctgcctctgcatggacactgtacgctgtggccactacggttataacccccatgatgcgtcacacaattgaaaatactaccgccaacatcagcctcacagcaattgctaatcaggccgcgatccttatgggcctggataaaggttggccaatatccaagatggacatcggggtgcctttgctggctctcggctgctactcacaagtcaacccgctgacccttactgccgcagtgttaatgctggtcgcccattatgctattatcggacccggcctccaggcaaaggccacgagagaggcgcagaaaaggacagctgccgggattatgaagaatccaaccgtggatggaatcgttgcaatagacttggaccctgtggtatacgatgccaaattcgaaaagcagctgggccaaattatgctactgatcctctgtacttctcagatccttctgatgcgcaccacatgggctttgtgcgagagtattactctggccaccggtcccctcacaacgctgtgggaagggtcgccaggaaaattttggaacaccactatcgcagtgagcatggctaatatattccggggctcctatttagccggtgcgggccttgccttctctctgatgaagtcactcgggggaggccgaagagggacaggagcacagggcgagaccctaggtgagaagtggaaaaggcagctgaaccaattgagcaagcctgaatttaatacttacaaacgctccgggattatggaggtcgaccggagtgaagctaaggagggactgaaaagaggcgaaacaaccaagcacgccgtttctcgtggtacggcaaagctcaggtggttcgtggagcggaaccttgtcaaacccgagggcaaggtgatcgatctggggtgtggacgcggcgggtggagctattactgcgctggattgaaaaaggtaaccgaagtgaaaggctatacaaagggtgggccgggacatgaggaaccaattcctatggccacttacggctggaatctggttaaactccactcaggcaaggacgtgtttttcatgcccccagagaagtgtgataccttactgtgcgacatcggggaatccagtcccaaccctacaatagaggagggacgaactcttagagtcctgaaaatggtggaaccgtggctaaggggtaatcagttttgtatcaagattctcaacccctacatgccaagcgtcgtggagaccctggaacagatgcagcggaaacacggcgggatgttggttcgcaatcctctgtctagaaactccacacatgagatgtattgggtatcatgcggaaccggcaatatcgtgagcgccgtcaacatgacttcgaggatgctccttaaccgattcacgatggcgcaccggaagcccacatacgagcgtgatgtggacctgggtgctgggaccagacatgttgcagtggaacctgaggtcgccaatttagatattatcggacaacgcattgaaaacatcaaaaatgagcacaagtctacttggcactatgacgaagataacccatacaagacctgggcttatcatggcagttacgaggtgaaaccctccggcagcgcctcatccatggtaaatggggtggttaggctgttgacaaagccttgggacgtcataccaatggtgacgcagattgcaatgaccgacactacaccctttggacagcaacgggtgttcaaagagaaggtcgataccagaactccgcgcgccaaaaggggtacaacccagatcatggaagttacagctaagtggctctggggctttctgtctcgaaacaagaaacctcggatctgtactagagaggagttcaccaggaaggtgcgcagcaatgcggccattggggcagtatttgtggacgagaaccagtggaatagtgctaaagaagccgtcgaggatgagcgtttctgggacctagtgcaccgggaaagagagcttcataagcagggaaaatgcgcaacgtgcgtttataacatgatgggcaagagggaaaagaaactgggtgagtttgggaaggccaaaggatcccgcgctatatggtacatgtggctcggcgcccgattcctggagttcgaggcgttgggctttatgaatgaggatcactggttcagccgggaaaactctctgtcaggggtggagggagaaggtctccataaacttggctacatcctgagagacattagtaaaatcccagggggaaatatgtatgcagatgacaccgccggctgggatacaaggattactgaggacgatttacaaaacgaggctaagatcaccgacataatggaacccgagcacgccctgttggcaacatccatctttaaactcacttaccagaataaggtcgtgcgcgtacagagacctgctaagaacggtaccgttatggatgtgattagccggagggaccagcgtgggtctggacaagtcggcacgtatggcctgaacacattcaccaatatggaagtgcagctaatccgacagatggagtcggaagggatttttcttccatcagagctggagactcccaacctcgccgaacgcgtgctggactggttggagaaacacggagctgaaagattaaagcggatggccatcagcggtgatgactgtgtcgttaaaccgatagatgacaggttcgcaacagcgctgaccgccctcaatgatatgggcaaggtgcgcaaagacattcctcagtgggagccctccaaggggtggaacgattggcaacaggtaccattttgcagtcatcacttccatcagcttatcatgaaggacggaagagaaatcgtggtcccttgtcggaatcaggatgagctggtgggcagggctcgagtttctcaaggtgccgggtggagcctacgtgagactgcatgcctgggaaaatcctacgctcagatgtggcagctcatgtattttcacagacgcgacttgcggctggccgcaaacgccatttgttcagcggtgcccgtcgattgggtgccaaccagtaggacaacgtggtctatacacgctcatcaccaatggatgaccactgaagacatgcttagcgtatggaatagagtttggatcgaggaaaacccctggatggaggacaagacacatgtgtcctcatgggaagaggtcccttacctgggcaaacgcgaggatcagtggtgcggcagcctcattgggttaaccgcccgggcaacttgggccacaaatatccaggtggctattaaccaggttaggcgactgatcggaaatgaaaactatttggactacatgacctctatgaagagattcaaaaatgagtccgatccagaaggtgccctgtggtga

SEQ ID NO: 13437 - RNA, 9879 nt, synthetic construct
  misc_feature 1..9879: note = derived and/or modified CDS sequence (opt3) from DENV-1__KF973464__SS-prME
  source 1..9879: mol_type = other RNA
agcgtgaccatgctgctcatgcttctgcccacagccttggctttccacttaactacgagaggcggggagcctcatatgatcgtctccaagcaggaaaggggaaaatctctgctatttaagacctcagcaggtgttaacatgtgcacactcattgccatggacctgggcgagctttgtgaagatactatgacctacaaatgcccacaaataacagaggcggaaccggacgatgtggactgttggtgcaatgctaccgatacttgggtaacatatgggacctgtagtcagacgggagagcaccggcgcgacaagcgaagcgtggccctggcaccccatgtcggcttgggtctcgagactcgtaccgaaacatggatgtcctctgagggggcctggaaacagatccagagagtggaaacttgggctctgaggcaccctggattcaccgttattgcactgtttctcgcccatgctatcggcacatcgattacccaaaagggcatcatattcatcttactgatgcttgtgacgccatcaatggccatgcggtgcgtcgggattggaaaccgcgattttgtggagggtttgagcggcgcgacttgggtagacgttgtgctggagcacgggagttgtgtcacaaccatggcaaagaataaacccactctagatatcgaactcctgaagacagaggtgaccaaccctgccattcttagaaaactgtgcatcgaagctaagatatccaatacgaccacagactctaggtgtccaactcagggagaggccaccttggtggaagagcaggatgcaaacttcgtctgccggcgcacatttgttgaccgaggctggggtaatgggtgtggactcttcggcaaaggcagcctgttaacttgcgctaagtttaagtgcgtgaccaaactggaggggaagattgtacagtacgaaaacctcaaatattccgtgatcgtcacagtgcacaccggagatcaacatcaggttggtaatgagactacggaacacggcacaattgccaccatcactccccaggcgcctacctcagagatccagcttacagactacggggccctgaccttggactgtagtccaagaactggactagatttcaacgaaatggtgctgctcacaatgaaggagaaaagctggctggtccataagcaatggtttcttgacctgccgttgccctggacgtctggcgcatccacctcacaggagacttggaataggcaggatctcctggtgacattcaaaaccgctcacgccaagaagcaagaagtagttgtgttaggtagccaggagggggctatgcacacagccctgactggcgcaaccgaaattcagacgagtggaaccacaactatatttgccggccatctaaaatgccggctcaagatggacaaactgacccttaaggggacatcttatgtcatgtgtactggatccttcaaattggagaaggaagtggctgagacccagcacggtacggtcctggtgcaagttaagtacgagggcacagatgcgccttgcaaaatcccattcagcacccaggacgaaaagggggtgactcagaacggacgtctcattacagcaaatcccatcgtaaccgataaagagaagcctgtcaacatagaaactgagccaccctttggcgagtcgtatattgtggttggtgccggggaaaaagctctgaagctttcttggttcaagaaaggctcctcaatcggaaagatgtttgaggccaccgcacgcggcgccagaaggatggctatcctgggggacacagcctgggatttcggaagtattggtggcgtgtttacgagcgtcgggaaattggtgcatcaggtattcggaaccgcatacggcgtgctcttttccggtgtttcttggactatgaagatcgggattggcatactgttaacatggctgggactaaatagccggtcaaccagtctctccatgacatgtatcgcggtcggcatggtgactctgtaccttggggtgatggtccaagctgacagcggatgcgttattaactggaaaggccgagaattgaagtgtggttctgggatcttcgtgaccaacgaggtgcacacgtggacagaacagtataagtttcaggccgattcaccgaaacgcctgagtgcagccatcggaaaggcttgggaggagggcgtatgcggtattagaagcgccaccaggctcgaaaatataatgtggaaacagatctccaacgagctgaatcatattttactggaaaacgacatgaagttcactgtcgtggttggcgacgcaaatgggatccttgctcaaggaaaaaagatgattcggcctcagcccatggagcacaaatactcttggaagtcgtggggcaaggccaaaatcataggggcggatatccagaacaccacatttattatcgacggaccagatactcctgaatgtcccgacaatcagcgcgcctggaacatttgggaggtggaggattatggcttcggtatctttaccacaaatatatggttgaagctcagagacagctacacgcaaatgtgcgatcacaggctgatgtccgctgcaattaaagactcaaaggccgtccatgctgatatggggtattggatcgaaagtgagaaaaacgaaacctggaagctagcccgtgcatctttcattgaggtgaagacttgtacatggccaaaaagccacaccctgtggtccaatggagttctcgaatcagagatgatcatacccaagatctacggcggtcctattagccagcataactatcggccaggctacttcactcagacagcggggccgtggcacctgggaaaacttgagttggactttgatctgtgcgaaggcaccacggtggtagtcgacgagcactgcgggaatcgaggaccctctttaagaactaccacagtgaccggcaagatcattcatgaatggtgttgcaggtcctgtactctccctccactgcgcttccggggtgaggatgggtgctggtacggaatggagatcagacccgtgaaagaaaaggaggaaaaccttgtcaggagtatggttagcgccggctctggtgaggtggactccttttcactgggcatattgtgtgctagtattatgatcgaagaggtaatgcgcagccgatggtcgcggaagatgctcatgacagggaccctggccgtgttcctactgctcatcatgggacaactgacatggaatgaccttattcgtttgtgcatcatggtcggcgcaaacgcttccgatagaatggggatgggaactacctatctggccttaatggcaacgtttaaaatgaggcctatgttcgccgtgggcctcctgtttcgccggcttacatctagagaggttctgctactcaccattggtctgagcttggtggcttcagtcgaactgccaaacagtttagaggaactcggggacggactggcgatgggcataatgatgcttaagctgttgactgagttccagccccaccagctctggaccacactgctatccctgacttttatcaaaaccacgctttctctcgattacgcctggaagacaaccgcaatggctctgagcattatctccttgttcccgctgtgtttatcaactacaagccagaaaaccacttggctccctgtgctgcttggcagttttgggtgcaagccactgacaatgttcttgattaccgaaaataagatctggggaaggaaatcttggcccctcaacgagggtataatggccatcggcattgtttccatcctgctaagctcgctgcttaagaatgacgtgcctctcgccgggcccctgattgctggaggcatgttgatcgcatgttatgtcatatcaggttctagtgccgatttatccctggagaaagcggctgaagtaagctgggagcaagaagccgagcattctgggacgagccacaacattctcgtggaagttcaggacgatggaactatgaagatcaaagacgaggagcgagatgacaccctgacaatccttctgaaggcaaccttgctagccgtgtccggcgtctacccaatgtcaattcctgctacactgtttgtgtggtatttctggcagaaaaagaagcagcgcagtggcgtactctgggatactcccagcccaccggaagtggagcgggcagtcctggacgatgggatatacagaatccttcaaaggggattactgggtcgttctcaggttggcgtgggggtgttccaggacggagtctttcataccatgtggcacgtgacgcgcggcgccgttctcatgtatcagggtaaacggttggaaccttcctgggcgtcagtaaagaaagacctgattagttacgggggaggctggagattccaaggcagctggaatacaggggaggaggtgcaggtcatcgctgtggaacccggaaagaacccaaaaaatgttcagactacccccggtatttttaagacacctgagggcgaagtgggggccatcgcactcgatttcaagccaggaacctccggctctcccatagtcaacagggagggtaaaatcgtggggctgtacggaaatggcgtagtcactacctcgggcacatatgtgagcgccattgctcaagccaaggcatcacaggaagggcctcttccggagatcgaggacgaagtttttaaaaagcgaaacctgacgattatggatttgcacccaggatccggtaaaactcggcgctacctacccgctatggtgagagaggccatcaagaggaagctgcggaccctcatattagcgcctacacgagtcgtggccagtgaaatggcagaggctctgaaaggcatgccaattagatatcagaccactgccgttaagtctgaacatacagggcgcgagatcgtggaccttatgtgccacgctaccttcacgatgaggctgctcagccccgtccgtgtgcctaattacaacatgatcattatggatgaggcacattttactgacccggcctccatcgccgctcggggatatatatcaacaagagtaggcatgggtgaagcggcagccattttcatgaccgctacccccccagggtctgtggaggcctttcctcagagcaatgcagttatccaagatgaagagagggacattcccgaacgcagttggaactccggatacgattggatcactgacttcccaggcaaaacagtctggtttgtgcctagcataaagtctggcaatgatattgccaactgtttgcgaaaaaacgggaagagagtgatccagctgtcacggaagaccttcgacacagagtatcagaaaactaagaataacgactgggattacgtcgtaacgaccgacatctccgagatgggagctaatttcagggcggatcgcgtgattgacccccgtagatgcctcaaaccagttatcctgaaggatggtccggaacgggtgattcttgccggccctatgcccgtcacagtggcaagtgctgcccagaggcgcgggcgaataggaagaaaccaaaataaagagggcgaccagtacgtttatatgggtcagccactaaacaatgatgaagaccacgcacattggactgaggccaagatgctgttggataacatcaatacccccgaggggattatccctgctttatttgaaccagagcgggaaaagagcgccgcgatcgacggcgagtacaggctgcgcggagaagcaagaaaaacattcgtggagctcatgaggcggggcgatctgcccgtctggctttcgtataaggtggcctctgaggggtttcagtactccgaccgtcgctggtgcttcgatggagaacgaaacaatcaagtactggaggaaaacatggacgtggagatttggaccaaagaaggtgagagaaagaaactcaggcctcggtggttggacgctcgcacttatagcgatccgctggccctaagagagtttaaggaattcgctgcaggcaggcggtcagttagtggggacctgatactcgagatcggaaaacttccacagcacctgacgttacgagcccagaatgctttggataacctggtcatgctccacaattctgaacagggcggtaaggcctacagacatgcaatggaggaactgcccgacaccattgagacacttatgctgctcgcgttgatcgccgtgctgactgggggcgtgaccttatttttcctatccggaaagggcctggggaaaacaagcattggactcctttgtgtcaccgcttcaagtgccctgttgtggatggcaagcgttgagcctcactggatcgctgcctccataatcctggaatttttcctcatggtgctgcttattcccgagccagatcgccaaaggactcctcaggacaaccagctcgcatatgtagtgatcggtctgttgtttatgattctgacagtcgccgctaacgaaatgggcttactagagacgaccaagaaagatctggggatcggacatgtggcggccgagaatcaccaacacgcaactatgctcgacgttgatcttcggcccgcttctgcctggacactgtacgccgtggcaaccaccgtcataacaccaatgatgcgtcatactattgaaaacacgaccgctaatatcagcttgacagccattgcgaaccaggctgccatcctgatgggcctcgacaagggttggcctatatccaaaatggatatcggggtaccgctgcttgcattaggctgctactcacaggtgaatcccctgactctcaccgccgctgttttgatgctggtggcacactatgccattatcggaccaggcctacaggcgaaggctacaagagaggcccaaaagaggaccgcagccgggattatgaaaaaccctactgtcgacggaatcgtggctatagatctggaccccgtcgtgtacgacacgaagttcgaaaaacagctcggccagattatgcttctgatcttgtgtacatctcagatcctgctcatgcgcaccacttgggccctgtgcgagagtattaccttagcaacaggtccacttactaccctgtgggaagggtcgcctggaaagttttggaatacaacgatcgctgttagcatggccaacatattccggggctcctatctcgcgggtgccggcctagcattctctctgatgaaatcattggggggaggccgaagagggaccggagctcaaggcgagactctgggtgagaagtggaagaggcagctcaatcagcttagcaaatccgaatttaacatttacaagcgcagtgggatcatggaggtggatcggtctgaagccaaagagggactgaagagaggcgaaacaaccaaacatgcagtaagccgtggtactgctaagttgaggtggttcgtggagcggaatctggtcaagcccgagggcaaagttattgacctcgggtgtggacgcggcgggtggtcatattactgcgccggattaaagaaagtgacagaagtcaagggctataccaaaggtgggccgggacacgaggaaccaatccctatggccacgtacggctggaacctggtgaagcttcattccggcaaagatgtatttttcatgcccccagagaagtgtgacaccctgctatgcgatataggggaaagtagccccaatcctacaatcgaggagggacgaactctcagagtgctgaagatggttgaaccgtggttgaggggtaaccagttttgtattaaaatcctgaatccctacatgccatctgtggtcgagaccctcgaacaaatgcagcggaagtatggcgggatgcttgtgcgcaaccctctgtccagaaattcaacacacgagatgtactgggtcagctgcggaactggcaacattgtgtcggcggttaacatgacctctaggatgttactgaatcgattcacaatggctcaccggaaacccacctatgagcgtgacgtagatttgggtgcagggactagacatgtggccgtcgaacctgaggtggctaacctcgacatcattggacagcgcatcgaaaatataaagaacgagcacaaaagtacgtggcattacgatgaagacaatccatataagacatgggcctaccacggctcctatgaggttaagcccagcggctcagcatcctctatggtgaacggggtcgtgaggctgctaaccaaaccttgggatgtaattccaatggtgactcaaatcgccatgaccgacacaacgccctttggacagcagcgggttttcaaggagaaagtcgacaccagaactccgcgcgctaagaggggtacaacccagatcatggaagtgactgcgaaatggctttggggctttctgagccgaaataagaagcctcggatttgtacaagagaggaattcaccaggaaagtgcgcagtaacgccgcaataggggctgtctttgttgatgagaatcaatggaactccgccaaggaagcagtggaggacgagcgtttctgggatctcgtacaccgggaaagagagctgcataaacagggaaagtgcgccacatgcgtgtacaatatgatgggcaaaagggaaaagaagttgggtgagtttgggaaagctaagggaagccgcgccatctggtacatgtggctgggcgcgcgattcctcgaattcgaggcacttggctttatgaacgaggaccactggttctctcgggaaaattcactgagtggggtcgagggagaaggtttacataaactgggctatattttgagagatatctccaagattccagggggaaacatgtacgccgacgatactgctggctgggacaccaggatcacggaggatgacctccagaatgaggccaaaataaccgatatcatggaacccgagcacgcactgctagctacaagcatttttaagcttacttatcagaacaaagtggttcgcgtgcaaagacctgccaagaacggtaccgtcatggacgtgatctctcggagggatcagcgtgggtcgggacaggtaggcacatacggcctgaatactttcaccaacatggaagttcagctcattcgacaaatggagtcagaagggatctttctgccaagcgagttggagacgcccaatttagctgaacgcgtgctggactggctcgagaagcatggagccgaaagacttaaacggatggcaatatccggtgacgattgtgtcgtgaagccgattgacgataggttcgcgacagccctgaccgctctaaacgacatgggcaaagtgcgcaaggatatccctcagtgggagcccagtaaagggtggaatgactggcagcaggtcccattttgctctcaccacttccatcaactgatcatgaaggatggaagagaaattgttgtgccttgtcggaaccaggacgagctcgtaggcagggcccgagtgagccagggtgcagggtggtccttgcgtgagactgcttgcctgggaaagtcatatgcccaaatgtggcagcttatgtactttcacagacgcgatctgcggctcgcagccaatgcgatatgtagtgctgtccccgtggactgggttccaacatctaggaccacttggagcatccatgcccaccaccagtggatgaccacagaagatatgttatccgtgtggaacagagtctggattgaggaaaatccctggatggaggacaaaacgcatgtgtcaagctgggaagaggtaccttatctgggcaagcgcgaggaccagtggtgcggctctttgatcgggctgaccgcacgggccacttgggctacaaacattcaagttgccatcaatcaggtgaggcgactcataggaaacgaaaattaccttgattacatgacctccatgaaaagattcaagaacgagagtgacccagaaggtgcactgtggtga

SEQ ID NO: 13438 - RNA, 9879 nt, synthetic construct
  misc_feature 1..9879: note = derived and/or modified CDS sequence (opt3) from DENV-1__KF973465__SS-prME
  source 1..9879: mol_type = other RNA
agcgtgaccatgctgctcatgcttctgcccacagccttggctttccacttaactacgagaggcggggagcctcatatgatcgtctccaagcaggaaaggggaaaatctctgctatttaagacctcagcaggtgttaacatgtgcacactcattgccatggacctgggcgagctttgtgaagatactatgacctacaaatgcccacaaataacagaggcggaaccggacgatgtggactgttggtgcaatgctaccgatacttgggtaacatatgggacctgtagtcagacgggagagcaccggcgcgacaagcgaagcgtggccctggcaccccatgtcggcttgggtctcgagactcgtaccgaaacatggatgtcctctgagggggcctggaaacagatccagagagtggaaacttgggctctgaggcaccctggattcaccgttattgcactgtttctcgcccatgctatcggcacatcgattacccaaaagggcatcatattcatcttactgatgcttgtgacgccatcaatggccatgcggtgcgtcgggattggaaaccgcgattttgtggagggtttgagcggcgcgacttgggtagacgttgtgctggagcacgggagttgtgtcacaaccatggcaaagaataaacccactctagatatcgaactcctgaagacagaggtgaccaaccctgccattcttagaaaactgtgcatcgaagctaagatatccaatacgaccacagactctaggtgtccaactcagggagaggccaccttggtggaagagcaggatgcaaacttcgtctgccggcgcacatttgttgaccgaggctggggtaatgggtgtggactcttcggcaaaggcagcctgttaacttgcgctaagtttaagtgcgtgaccaaactggaggggaagattgtacagtacgaaaacctcaaatattccgtgatcgtcacagtgcacaccggagatcaacatcaggttggtaatgagactacggaacacggcacaattgccaccatcactccccaggcgcctacctcagagatccagcttacagactacggggccctgaccttggactgtagtccaagaactggactagatttcaacgaaatggtgctgctcacaatgaaggagaaaagctggctggtccataagcaatggtttcttgacctgccgttgccctggacgtctggcgcatccacctcacaggagacttggaataggcaggatctcctggtgacattcaaaaccgctcacgccaagaagcaagaagtagttgtgttaggtagccaggagggggctatgcacacagccctgactggcgcaaccgaaattcagacgagtggaaccacaactatatttgccggccatctaaaatgccggctcaagatggacaaactgacccttaaggggacatcttatgtcatgtgtactggatccttcaaattggagaaggaagtggctgagacccagcacggtacggtcctggtgcaagttaagtacgagggcacagatgcgccttgcaaaatcccattcagcacccaggacgaaaagggggtgactcagaacggacgtctcattacagcaaatcccatcgtaaccgataaagagaagcctgtcaacatagaaactgagccaccctttggcgagtcgtatattgtggttggtgccggggaaaaagctctgaagctttcttggttcaagaaaggctcctcaatcggaaagatgtttgaggccaccgcacgcggcgccagaaggatggctatcctgggggacacagcctgggatttcggaagtatgggtggcgtgtttacgagcgtcgggaaattggtgcatcaggtattcggaaccgcatacggcgtgctcttttccggtgtttcttggactatgaagattgggatcggcattctgttaacatggctgggactaaatagccggtcaaccagtctctccatgacatgtatagcggtcggcatggtgactctgtaccttggggtgatggtccaagctgacagcggatgcgttatcaactggaaaggccgagaattgaagtgtggttctgggattttcgtgaccaacgaggtgcacacgtggacagaacagtataagtttcaggccgattcaccgaaacgcctgagtgcagccatcggaaaggcttgggaggagggcgtatgcggtatcagaagcgccaccaggctcgaaaatattatgtggaaacagatatccaacgagctgaatcatatcttactggaaaacgacatgaagttcactgtcgtggttggcgacgcaaatgggattcttgctcaaggaaaaaagatgatccggcctcagcccatggagcacaaatactcttggaagtcgtggggcaaggccaaaattatcggggcggatatacagaacaccacatttatcattgacggaccagatactcctgaatgtcccgacaatcagcgcgcctggaacatctgggaggtggaggattatggcttcggtatttttaccacaaatatctggttgaagctcagagacagctacacgcaaatgtgcgatcacaggctgatgtccgctgcaataaaagactcaaaggccgtccatgctgatatggggtattggattgaaagtgagaaaaacgaaacctggaagctagcccgtgcatctttcatcgaggtgaagacttgtacatggccaaaaagccacaccctgtggtccaatggagttctcgaatcagagatgattatccccaagatatacggcggtcctatcagccagcataactatcggccaggctacttcactcagacagcggggccgtggcacctgggaaaacttgagttggactttgaactgtgcgagggcaccacggtggtagtcgatgaacactgcgggaatcgaggaccctctttaagaactaccacagtgaccggcaagattatccatgagtggtgttgcaggtcctgtactctccctccactgcgcttccggggtgaggacgggtgctggtacggaatggaaattagacccgtgaaagagaaggaagagaaccttgtcaggagtatggttagcgccggctctggtgaagtggattccttttcactgggcatcttgtgtgctagtataatgattgaggaggtaatgcgcagccgatggtcgcggaagatgctcatgacagggaccctggccgtgttcctactgctcatcatgggacaactgacatggaatgaccttatccgtttgtgcattatggtcggcgcaaacgcttccgacagaatggggatgggaactacctatctggccttaatggcaacgtttaaaatgaggcctatgttcgccgtgggcctcctgtttcgccggcttacatctagagaagttctgctactcaccatcggtctgagcttggtggcttcagtcgagctgccaaacagtttagaagagctcggggatggactggcgatgggcattatgatgcttaagctgttgactgaattccagccccaccagctctggaccacactgctatccctgacttttataaaaaccacgctttctctcgactacgcctggaagacaaccgcaatggctctgagcatcatttccttgttcccgctgtgtttatcaactacaagccagaaaaccacttggctccctgtgctgcttggcagttttgggtgcaagccactgacaatgttcttgatcaccgagaataagatttggggaaggaaatcttggcccctcaacgagggtatcatggccataggcatcgtttccattctgctaagctcgctgcttaagaatgatgtgcctctcgccgggcccctgatcgctggaggcatgttgattgcatgttatgtcatctcaggttctagtgccgacttatccctggaaaaagcggctgaggtaagctgggaacaagaggccgaacattctgggacgagccacaacatactcgtggaggttcaggatgacggaactatgaagattaaagatgaggaacgagacgataccctgacaatccttctgaaggcaaccttgctagccgtgtccggcgtctacccaatgtcaatccctgctacactgtttgtgtggtatttctggcagaaaaagaagcagcgcagtggcgtactctgggacactcccagcccaccggaggtggaacgggcagtcctggatgacgggatttacagaatacttcaaaggggattactgggtcgttctcaggttggcgtgggggtgttccaggatggagtctttcataccatgtggcacgtgacgcgcggcgccgttctcatgtatcagggtaaacggttggagccttcctgggcgtcagtaaagaaagacctgatcagttacgggggaggctggagattccaaggcagctggaatacaggggaggaagtgcaggtcattgctgtggagcccggaaagaacccaaaaaatgttcagactacccccggtacatttaagacccctgaaggcgaggtgggggccatcgcactcgacttcaagccaggaacttccggctctcccattgtcaacagggaaggtaaaatcgtggggctgtacggaaatggcgtagtcaccacatcgggcacgtatgtgagcgccatagctcaagccaaggcatcacaggaggggcctcttccggagatcgaagatgaggtttttaaaaagcgaaacctgactattatggacttgcacccaggatccggtaaaacccggcgctacctacccgctatcgtgagagaagccattaagaggaagctgcggacactcatcttagcgcctacccgagtcgtggccagtgagatggcagaagctctgaaaggcatgccaataagatatcagactacagccgttaagtctgagcataccgggcgcgagattgtggatcttatgtgccacgctacgttcactatgaggctgctcagccccgtccgtgtgcctaattacaacatgatcatcatggacgaagcacattttacagatccggcctccattgccgctcggggatatatctcaaccagagtaggcatgggtgaggcggcagccatattcatgaccgctactcccccagggtctgtggaagcctttcctcagagcaatgcagttattcaagacgaggaaagggatatccccgagcgcagttggaactccggatacgactggattacagatttcccaggcaaaaccgtctggtttgtgcctagcatcaagtctggcaatgacatagccaactgtttgcgaaaaaacgggaagagagtgattcagctgtcacggaagacattcgatactgagtatcagaaaacgaagaataacgactgggactacgtcgtaaccacagatatctccgaaatgggagctaatttcagggcggaccgcgtgatcgatccccgtagatgcctcaaaccagttattctgaaggacggtccggagcgggtgatccttgccggccctatgcccgtcactgtggcaagtgctgcccagaggcgcgggcgaattggaagaaaccaaaataaagaaggcgatcagtacgtttatatgggtcagccactaaacaatgacgaggatcacgcacattggaccgaggccaagatgctgttggacaacataaatacacccgaagggatcattcctgctttatttgagccagaacgggagaagagcgccgcgatcgatggcgaatacaggctgcgcggagaggcaagaaaaaccttcgtggagctcatgaggcggggcgacctgcccgtctggctttcgtataaggtggcctctgaagggtttcagtactccgatcgtcgctggtgcttcgacggagagcgaaacaatcaagtactggaagagaacatggatgtggaaatctggactaaagagggtgagagaaagaaactcaggcctcggtggttggacgctcgcacgtatagcgacccgctggccctaagagaatttaaggagttcgctgcaggcaggcggtcagttagtggggatctgattctcgaaataggaaaacttccacagcacctgaccttacgagcccagaatgctttggacaacctggtcatgctccacaattctgagcagggcggtaaggcctacagacatgcaatggaagagctgcccgatacaatcgagactcttatgctgctcgcgttgattgccgtgctgaccgggggcgtgacattatttttcctatccggaaagggcctggggaaaaccagcatcggactcctttgtgtcactgcttcaagtgccctgttgtggatggcaagcgttgaacctcactggattgctgcctccatcatactggagtttttcctcatggtgctgcttatccccgaaccagaccgccaaaggacacctcaggataaccagctcgcatatgtagtgattggtctgttgtttatgatcctgacggtcgccgctaacgagatgggcttactagagaccactaagaaagacctggggattggacatgtggcggccgaaaatcaccaacacgcaacaatgctcgatgttgaccttcggcccgcttctgcctggaccctgtacgccgtggcaaccacagtcatcactccaatgatgcgtcatacgatagagaacaccacagctaatattagcttgactgccatcgcgaaccaggctgccattctgatgggcctcgataagggttggcctatctccaaaatggacataggggtaccgctgcttgcattaggctgctactcacaggtgaatcccctgaccctcacagccgctgttttgatgctggtggcacactatgccatcattggaccaggcctacaggcgaaggctaccagagaagcccaaaagaggactgcagccgggatcatgaaaaaccctacggtcgatggaattgtggctatcgacctggatcccgtcgtgtacgacacaaagttcgagaaacagctcggccagataatgcttctgattttgtgtacctctcagatcctgctcatgcgcactacctgggccctgtgcgaaagtatcacattagcaactggtccacttaccacactgtgggaggggtcgcctggaaagttttggaatacgaccattgctgttagcatggccaacatcttccggggctcctatctcgcgggtgccggcctagcattctctctgatgaaatcattggggggaggccgaagagggactggagctcaaggcgagacactgggtgaaaagtggaagaggcagctcaatcagcttagcaaatccgagtttaacatatacaagcgcagtgggattatggaagtggaccggtctgaggccaaagaaggactgaagagaggcgagaccactaaacatgcagtaagccgtggtacagctaagttgaggtggttcgtggagcggaatctggtcaagcccgaaggcaaagttatcgatctcgggtgtggacgcggcgggtggtcatattactgcgccggattaaagaaagtgaccgaggtcaagggctatacgaaaggtgggccgggacacgaagagccaattcctatggccacctacggctggaacctggtgaagcttcattccggcaaagacgtatttttcatgcccccagaaaagtgtgatacactgctatgcgacatcggggagagtagccccaatcctactatagaggaaggacgaaccctcagagtgctgaagatggttgagccgtggttgaggggtaaccagttttgtatcaaaattctgaatccctacatgccatctgtggtcgaaacactcgagcaaatgcagcggaagtatggcgggatgcttgtgcgcaaccctctgtccagaaattcaactcacgagatgtactgggtcagctgcggaaccggcaacatcgtgtcggcggttaacatgacatctaggatgttactgaatcgattcaccatggctcaccggaaacccacttatgaacgtgatgtagacttgggtgcagggacgagacatgtggccgtcgagcctgaagtggctaacctcgatattatcggacagcgcattgagaatatcaagaacgaacacaaaagtacatggcattacgacgaggataatccatataagacctgggcctaccacggctcctatgaggttaagcccagcggctcagcatcctctatggtgaacggggtcgtgaggctgctaactaaaccttgggacgtaataccaatggtgacccaaattgccatgacagatacgaccccctttggacagcagcgggttttcaaggaaaaagtcgacactagaacaccgcgcgctaagaggggtaccactcagatcatggaggtgacagcgaaatggctttggggctttctgagccgaaataagaagcctcggatctgtaccagagaagagttcacaaggaaagtgcgcagtaacgccgcaattggggctgtctttgttgacgaaaatcaatggaactccgccaaggaggcagtggaggatgaacgtttctgggacctcgtacggagagagagggaactgcacaaacagggaaagtgcgccacttgcgtgtacaatatgatgggcaaacgcgagaagaagttgggtgaatttgggaaagctaagggaagccgagccatatggtacatgtggctgggcgcgcggttcctcgagttcgaggcacttggctttatgaacgaagatcattggttctctagagagaattcactgagtggggtcgaaggagagggtttacacaaactgggctatatcttgagggacatttccaagatcccagggggaaacatgtacgccgatgacaccgctggctgggatacgcgcattaccgaggacgatctccagaatgaagccaaaatcacagacataatggagcccgaacatgcactgctagctactagcatctttaagcttacctatcagaacaaagtggttagagtgcaacggcctgccaagaacggtacagtcatggatgtgatttctaggcgtgaccagcgagggtcgggacaggtaggcacttacggcctgaataccttcacgaacatggaggttcagctcatccgccaaatggaatcagaggggatttttctgccaagcgagttggaaacacccaatttagctgagagagtgctggattggctcgaaaagcacggagccgagcggcttaaaaggatggcaatctccggtgacgactgtgtcgtgaagccgatagatgaccgcttcgcgaccgccctgactgctctaaacgatatgggcaaagtgagaaaggacattcctcagtgggaacccagtaaagggtggaatgattggcagcaggtcccattttgctctcatcacttccaccaactgatcatgaaggacggacgggagatcgttgtgccttgtaggaaccaggatgagctcgtaggccgagcccgtgtgagccagggtgcagggtggtccttgagagaaacagcttgcctgggaaagtcatatgcccaaatgtggcagcttatgtactttcatcgccgggacctgaggctcgcagccaatgcgatttgtagtgctgtccccgtggattgggttccaacctctagaactacctggagcatacacgcccatcaccagtggatgacaacggaggacatgttatccgtgtggaaccgcgtctggatcgaagagaatccctggatggaagataaaacccacgtgtcaagctgggaggaggtaccttatctgggcaagcgggaagaccagtggtgcggctctttgattgggctgactgcaagggccacatgggctaccaacatccaagttgccattaatcaggtgcgaagactcatcggaaacgagaattaccttgactacatgacttccatgaaacggttcaagaacgaaagtgatccagagggtgcactgtggtga

SEQ ID NO: 13439 - RNA, 9879 nt, synthetic construct
  misc_feature 1..9879: note = derived and/or modified CDS sequence (opt3) from DENV-1__KF973466__SS-prME
  source 1..9879: mol_type = other RNA
agcgtgaccatgctgctcatgcttatgcccacagccctggctttccacttgactacgagaggcggggaacctcatatgatcgtctccaagcacgaaagaggaaaagcattactgtttaagacctctacaggtgttaacatgtgcactctgattgccatggacctcggcgaactgtgtgaagataccatgacatacaaatgcccacggataaccgaggcggaaccggacgatgtggactgttggtgcaatgctactgatacatgggtaacctatgggacgtgttcacagactggagagcatcgccgagacaagcgtagtgtggcccttgcaccccacgtcggcctgggtttggagaccagaacagaaacttggatgagctccgagggggcctggaaacaaatccaaagggtggaaacctgggctctccggcatcctggattcacagttattgcactgtttctggcccacgctatcggcacctctattacgcagaagggcatcatattcatcctcttaatgctggtgactccatcgatggccatgcgctgcgtcgggattggaaacagagattttgtggagggtctttcaggcgcgacatgggtagacgttgtgttggagcacgggagctgtgtcaccactatggcaaagaataaacccacactggatatcgaactactcaagaccgaggtgacgaaccctgccgtgctgaggaaactttgcattgaagctaagatcagtaataccacaactgactcccggtgtccaacccagggagaggccacactggtcgaagaacaagatgcaaacttcgtttgccgccgaacttttgtggacagaggctggggtaatgggtgtggattgttcggcaaaggctctctcctgacctgcgctaagtttaagtgcgtaacaaaattagaggggaagatagtgcagtacgaaaacctgaaatatagcgtcattgtgaccgttcatactggagatcagcaccaggtgggtaatgagacgacagaacatggcaccatcgccactattaccccacaagcgcctacatccgagatccagctcaccgactacggggcccttactctggactgttcaccaaggacaggattggatttcaacgaaatggtcctactgacgatgaaggagaaaagttggctcgtgcacaagcagtggtttctggaccttccgctgccctggaccagcggcgcatctacttcccaggagacatggaatcggcaagatttgctcgtaaccttcaaaacagctcacgccaagaagcaggaagttgtggtcctgggttcacaggagggggctatgcatactgccttaaccggcgcaacggaaatccaaaccagcggaacaactaccatttttgccggccacctgaaatgccgtctaaagatggacaaactcacactgaaggggacaagttatgtgatgtgtaccggatctttcaaacttgagaaggaagtcgctgagacgcagcatggtacagtgttggttcaggtgaagtacgagggcaccgatgcgccttgcaaaataccattctccactcaggacgaaaagggggtaacacaaaacggacgcctgatcaccgcaaatcccattgtcactgataaagagaagcctgtgaacatcgaaaccgagccaccctttggcgagagctatatagttgtgggtgccggggaaaaagctctcaagctgtcgtggttcaagaaaggatcttccattggaaagatgtttgaggccacagcaagaggcgccaggcggatggctatccttggggacacggcctgggatttcggatcaatcggtggcgtctttaccagtgtggggaaactggtacaccaggtgttcggaactgcatacggcgttttgtttagcggtgtctcctggacaatgaagattgggatcggcattctcctgacctggttaggactaaattctcgaagcacatcactaagtatgacttgtatagcggtgggcatggtgaccctctacctgggggtcatggttcaggctgactccggatgcgtgatcaactggaaaggccgcgaacttaagtgtggtagcgggattttcgtgacgaacgaggtacatacatggaccgaacagtataagtttcaagccgattctccgaaaagattgtcagcagccatcggaaaggcttgggaggagggcgtctgcggtatcaggagtgccactcggctggaaaatattatgtggaaacagataagcaacgagctcaatcacatcctgttagaaaacgacatgaagttcaccgtggttgtgggcgacgcaaatgggattctggctcagggcaagaagatgatccgccctcagcccatggagcacaaatactcctggaagtcttggggcaaggccaaaattatcggggcggatatacaaaacacaacttttatcattgacggaccagatacccctgaatgtcccgacgatcagagagcctggaatatctgggaggtcgaggactatggcttcggtatttttacaacgaacatctggcttaagttgagggattcgtacacccagatgtgcgaccatcgtctcatgagcgctgcaataaaagattccaaggccgtgcacgctgacatggggtattggattgaatcagagaaaaatgaaacttggaagctggcccgggcaagtttcatcgaggttaagacatgtacctggccaaaatctcatactctatggagcaacggagtgctggaatccgagatgattatccccaagatatacggcggtcctatctcacagcacaattatcgaccaggctacttcacacaaaccgcggggccgtggcacctcggaaaactggagcttgattttgacttgtgcgaaggcacgactgtagtcgtggatgagcattgcgggaacagaggacccagcctgaggaccacaaccgtgactggcaagattatccacgaatggtgttgccgctcttgtacattacctccactccggttcagaggtgaggacgggtgctggtacggaatggagattaggcccgtcaaagaaaaggaggaaaatctggttcgctccatggtgagtgccggcagcggtgaggtagactctttttcccttggcatcctgtgtgtgtcaataatgattgaagaggtcatgcgaagtcggtggagccgtaagatgttgatgaccgggacactcgctgtgttcctgctactgatcatgggacagctcacttggaacgatctgatcagactttgcattatggttggcgccaatgcatcggacaggatggggatgggaaccacgtatttggctctgatggccacatttaaaatgcgccctatgttcgcagtgggcatcttatttcggagactcacctccagggaggtcctgcttctgactattggtctatctctcgtggccagcgttgaactgccaaactcattggaggaactgggggatggattagctatgggcataatgatgctcaagctgcttaccgagttccagccccatcaactgtggacaactttgctcagtctgacctttatcaaaacgacactatccctggactacgcgtggaagaccactgccatggcactttctattgtgagcctcttcccgctgtgtttgtccacaacctcacagaaaactacatggctgcctgtcttactcggcagctttgggtgcaagccactgaccatgttccttatcacggaaaacaagatttggggacgaaaaagttggcccatcaatgagggtataatggctatcggcattgtatctatcctgttgtccagcctcctgaagaacgatgtgcctctagccgggcccctgattgccggaggcatgcttatcgcttgttatgttatatcgggttcatctgcagacctcagtctggagaaagccgcggaagtgtcctgggagcaggaagctgagcacagcgggacttctcataatattttggtcgaagtgcaggatgacggaaccatgcgcatcaaggatgaggagaaagacgatacattaaccatcctgctcaaggccacactgcttgcagtaagcggcgtgtacccaatgtccattcctgccactctgtttgtctggtatttctggcagaaaaagaagcagcggtcaggcgttttgtgggacacccccagtccaccggaagtggagagagctgtgctagatgacgggatatacaggatcctgcagcgtggactcctgggtcgcagccaggtcggcgtgggggttttccaagacggagtatttcacacgatgtggcacgtgacacggggcgcagtccttatgtatcagggtaaaagattagaaccttcttgggcctccgtgaagaaagatctgatttcatacgggggaggctggaggttccagggcagttggaacactggggaggaggttcaggtgatcgcggtcgaacccggaaagaatcccaaaaacgtgcaaaccacacccggtacctttaagactagcgagggcgaagtaggggctattgccctcgacttcaagcctggaacctccggctctccaatcgtcaatcgagagggtaaaatagtggggttgtacggaaacggcgttgtgacaacgtcgggcacttatgtcagcgcaatcgcccaggctaagacctcacaggaagggcccctgcctgagattgaggatgaagtgtttaaaaagcggaatctcacaatcatggacctgcatccgggatccggtaaaacccgcagataccttccagccattgttagggaggcaatcaagcggaagctgcgaactttgatactagctcccacaagagtggtcgccagtgaaatggcggaggccctgaaaggcatgcctattcgctatcaaaccacggcagtgaagtctgaacacactgggagggagatcgtagatctcatgtgccatgctacattcaccatgcgtttactgagcccagtgcgggttcccaactacaatatgatcattatggacgaggcccactttaccgatcctgcttccatcgcagccagaggatatatatcaactagggtcggcatgggtgaagccgctgcgattttcatgacagcaaccccgcccgggtctgtggaggcctttccacagagcaacgctgtgatccaggacgaagaacgcgatattcctgaacgaagttggaactccggatacgactggatcacagatttccccggcaaaactgtctggtttgtaccaagcataaagtctggcaatgacattgccaattgtcttaggaaaaacgggaagcgggtgatccagctgtcaaggaagacgttcgacaccgagtatcagaaaactaagaacaatgattgggactacgttgtgactaccgatatctccgagatgggagcaaacttccgcgccgaccgtgtcattgatcctagacggtgcctcaaacccgtgatcttgaaggacggtccagaaagggttattctggctggcccgatgcctgtgacagtcgcgagtgccgcacaacgccgagggagaataggacggaatcagaacaaagagggcgatcagtacgtgtatatgggtcaacccctcaataacgacgaagatcatgctcactggaccgaggccaagatgctgcttgacaatatcaacactccagaggggattatccccgcactatttgaacctgagagggaaaagagcgccgctatcgatggcgagtaccgcctgagaggagaagccaggaaaacgttcgtagagttgatgcggcgtggcgacttaccagtgtggctgtcgtataaggttgcgtctgaggggtttcagtactccgatcgccgatggtgcttcgacggagaaagaaataaccaggtcctcgaggaaaatatggacgtggagatttggaccaaagaaggtgagaggaagaaactgcggccccgctggcttgatgcaagaacatatagcgaccctctggccctcagggagtttaaggagttcgctgccggccggcgatcagtgagtggggatttgatactggagatcggaaaactaccgcagcacctgactctcagagctcaaaacgcacttgacaatctggtcatgttacataactctgaacagggcggtaaggcctaccgccacgctatggaggaattgccagataccattgagacactgatgctcctggcccttatcgcagttctgaccgggggcgtgactctctttttcttgtccggaaagggcctggggaaaacaagcattggattactatgtgtaacggcgtcaagtgccctgctctggatggctagcgtggagccccattggatcgccgcatccataatccttgaatttttcctgatggtcttgctgattcctgagcccgacaggcagcggaccccacaggataatcaactcgcttatgtggttatcggtctgctttttatgattctcactgtggccgcaaacgaaatgggcctgttggagacaaccaagcgtgacctggggatcggacacgtcgccgctgagaaccaccagcatgcgaccatgttagatgtagacctaagacctgcctctgcatggacactgtacgctgtggccactacggttataacccccatgatgaggcacacaattgaaaatactaccgccaacatcagcctcacagcaattgctaatcaggccgcgatccttatgggcctggataaaggttggccaatatccaagatggacatcggggtgcctttgctggctctcggctgctactcacaagtcaacccgctgacccttactgccgcagtgttaatgctggtcgcccattatgctattatcggacccggcctccaggcaaaagccacgcgcgaggcgcagaagcggacagctgccgggattatgaagaatccaaccgtggatggaatcgttgcaatagacttggaccctgtggtatacgatgccaaattcgaaaagcagctgggccaaattatgctactgatcctctgtacttctcagatccttctgatgcgaaccacatgggctttgtgcgagagtattactctggccaccggtcccctcacaacgctgtgggaagggtcgccaggaaaattttggaacaccactatcgcagtgagcatggctaatatattcagaggctcctatttagccggtgcgggccttgccttctctctgatgaagtcactcgggggaggcaggcgcgggacaggagcacagggcgagaccctaggtgagaaatggaagcggcagctgaaccaattgagcaagcctgaatttaatacttacaaaagatccgggattatggaggtcgaccgtagtgaagctaaggagggactgaaaaggggcgaaacaaccaagcacgccgtttctcggggtacggcaaaactccgctggttcgtggagcgaaaccttgtcaagcccgagggcaaggtgatcgatctggggtgtggaagaggcgggtggagctattactgcgctggattgaaaaaggtaaccgaagtgaaaggctatacaaagggtgggccgggacatgaggaaccaattcctatggccacttacggctggaatctggttaaactccactcaggcaaggacgtgtttttcatgcccccagagaaatgtgataccttactgtgcgacatcggggaatccagtcccaaccctacaatagaggagggaaggactcttcgggtcctgaagatggtggaaccgtggctacgcggtaatcagttttgtatcaagattctcaacccctacatgccaagcgtcgtggagaccctggaacagatgcagagaaaacacggcgggatgttggttaggaatcctctgtctcgaaactccacacatgagatgtattgggtatcatgcggaaccggcaatatcgtgagcgccgtcaacatgacttcgcggatgctccttaaccgtttcacgatggcgcacagaaagcccacatacgagcgcgatgtggacctgggtgctgggaccaggcatgttgcagtggaacctgaggtcgccaatttagatattatcggacaacggattgaaaacatcaaaaatgagcacaagtctacttggcactatgacgaagataacccatacaaaacctgggcttatcatggcagttacgaggtgaagccctccggcagcgcctcatccatggtaaatggggtggttagactgttgacaaagccttgggacgtcataccaatggtgacgcagattgcaatgaccgacactacaccctttggacagcaacgcgtgttcaaagagaaggtcgataccaggactccgcgagccaaacggggtacaacccagatcatggaagttacagctaagtggctctggggctttctgtctagaaacaaaaagcctaggatctgtactcgcgaggagttcacccgtaaggtgcggagcaatgcggccattggggcagtatttgtggacgagaaccagtggaatagtgctaaagaagccgtcgaggatgagagattctgggacctagtgcacagggaacgcgagcttcataagcagggaaaatgcgcaacgtgcgtttataacatgatgggcaagcgagagaaaaagctgggtgagtttgggaaggccaaaggatcccgggctatatggtacatgtggctcggcgccagattcctggagttcgaggcgttgggctttatgaatgaggatcactggttcagcagggaaaactctctgtcaggggtggagggagaaggtctccataaacttggctacatcctgcgcgacattagtaaaatcccagggggaaatatgtatgcagatgacaccgccggctgggatacaagaattactgaggacgatttacaaaacgaggctaagatcaccgacataatggaacccgagcacgccctgttggcaacatccatctttaaactcacttaccagaataaggtcgtgcgggtacagaggcctgctaaaaacggtaccgttatggatgtgattagccgtcgagaccagcgcgggtctggacaagtcggcacgtatggcctgaacacattcaccaatatggaagtgcagctaatcagacagatggagtcggaagggatttttcttccatcagagctggagactcccaacctcgccgaacgggtgctggactggttggagaagcacggagctgaaaggttaaagcgcatggccatcagcggtgatgactgtgtcgttaaaccgatagatgacagattcgcaacagcgctgaccgccctcaatgatatgggcaaggtgcggaaagacattcctcagtgggagccctccaaggggtggaacgattggcaacaggtaccattttgcagtcatcacttccatcagcttatcatgaaagacggaagggaaatcgtggtcccttgtcgaaatcaggatgagctggtgggccgtgctagagtttctcaaggtgccgggtggagcctacgcgagactgcatgcctgggaaagtcctacgctcagatgtggcagctcatgtattttcaccggagggacttgagactggccgcaaacgccatttgttcagcggtgcccgtcgattgggtgccaaccagtcgcacaacgtggtctatacacgctcatcaccaatggatgaccactgaagacatgcttagcgtatggaatcgggtttggatcgaggaaaacccctggatggaggacaagacacatgtgtcctcatgggaagaggtcccttacctgggcaaaagggaggatcagtggtgcggcagcctcattgggttaaccgcccgagcaacttgggccacaaatatccaggtggctattaaccaggttagacggctgatcggaaatgaaaactatttggactacatgacctctatgaagaggttcaaaaatgagtccgatccagaaggtgccctgtggtga

SEQ ID NO: 13440 - RNA, 9879 nt, synthetic construct
  misc_feature 1..9879: note = derived and/or modified CDS sequence (opt3) from DENV-1__KF973471__SS-prME
  source 1..9879: mol_type = other RNA
agcgtgaccatgctgctcatgcttctgcccacagccttggctttccacttaactacgagaggcggggagcctcatatgatcgtctccaagcaggaaaggggaaaatctctgctatttaagacctcagcaggtgttaacatgtgcacactcattgccatggacctgggcgagctttgtgaagatactatgacctacaaatgcccacaaataacagaggcggaaccggacgatgtggactgttggtgcaatgctaccgatacttgggtaacatatgggacctgtagtcagacgggagagcaccggcgcgacaagcgaagcgtggccctggcaccccatgtcggcttgggtctcgagactcgtaccgaaacatggatgtcctctgagggggcctggaaacagatccagagagtggaaacttgggctctgaggcaccctggattcaccgttattgcactgtttctcgcccatgctatcggcacatcgattacccaaaagggcatcatattcatcttactgatgcttgtgacgccatcaatggccatgcggtgcgtcgggattggaaaccgcgattttgtggagggtttgagcggcgcgacttgggtagacgttgtgctggagcacgggagttgtgtcacaaccatggcaaagaataaacccactctagatatcgaactcctgaagacagaggtgaccaaccctgccattcttagaaaactgtgcatcgaagctaagatatccaatacgaccacagactctaggtgtccaactcagggagaggccaccttggtggaagagcaggatgcaaacttcgtctgccggcgcacatttgttgaccgaggctggggtaatgggtgtggactcttcggcaaaggcagcctgttaacttgcgctaagtttaagtgcgtgaccaaactggaggggaagattgtacagtacgaaaacctcaaatattccgtgatcgtcacagtgcacaccggagatcaacatcaggttggtaatgagactacggaacacggcacaattgccaccatcactccccaggcgcctacctcagagatccagcttacagactacggggccctgaccttggactgtagtccaagaactggactagatttcaacgaaatggtgctgctcacaatgaaggagaaaagctggctggtccataagcaatggtttcttgacctgccgttgccctggacgtctggcgcatccacctcacaggagacttggaataggcaggatctcctggtgacattcaaaaccgctcacgccaagaagcaagaagtagttgtgttaggtagccaggagggggctatgcacacagccctgactggcgcaaccgaaattcagacgagtggaaccacaactatatttgccggccatctaaaatgccggctcaagatggacaaactgacccttaaggggacatcttatgtcatgtgtactggatccttcaaattggagaaggaagtggctgagacccagcacggtacggtcctggtgcaagttaagtacgagggcacagatgcgccttgcaaaatcccattcagcacccaggacgaaaagggggtgactcagaacggacgtctcattacagcaaatcccatcgtaaccgataaagagaagcctgtcaacatagaaactgagccaccctttggcgagtcgtatattgtggttggtgccggggaaaaagctctgaagctttcttggttcaagaaaggctcctcaatcggaaagatgtttgaggccaccgcacgcggcgccagaaggatggctatcctgggggacacagcctgggatttcggaagtattggtggcgtgtttacgagcgtcgggaaattggtgcatcaggtattcggaaccgcatacggcgtgctcttttccggtgtttcttggactatgaagatcgggattggcatactgttaacatggctgggactaaatagccggtcaaccagtctctccatgacatgtatcgcggtcggcatggtgactctgtaccttggggtgatggtccaagctgacagcggatgcgttattaactggaaaggccgagaattgaagtgtggttctgggatcttcgtgaccaacgaggtgcacacgtggacagaacagtataagtttcaggccgattcaccgaaacgcctgagtgcagccatcggaaaggcttgggaggagggcgtatgcggtattagaagcgccaccaggctcgaaaatataatgtggaaacagatctccaacgagctgaatcatattttactggaaaacgacatgaagttcactgtcgtggttggcgacgcaaatgggatccttgctcaaggaaaaaagatgattcggcctcagcccatggagcacaaatactcttggaagtcgtggggcaaggccaaaatcataggggcggatatccagaacaccacatttattatcgacggaccagatactcctgaatgtcccgacaatcagcgcgcctggaacatttgggaggtggaggattatggcttcggtatctttaccacaaatatatggttgaagctcagagacagctacacgcaaatgtgcgatcacaggctgatgtccgctgcaattaaagactcaaaggccgtccatgctgatatggggtattggatcgaaagtgagaaaaacgaaacctggaagctagcccgtgcatctttcattgaggtgaagacttgtacatggccaaaaagccacaccctgtggtccaatggagttctcgaatcagagatgatcatacccaagatctacggcggtcctattagccagcataactatcggccaggctacttcactcagacagcggggccgtggcacctgggaaaacttgagttggactttgatctgtgcgaaggcaccacggtggtagtcgacgagcactgcgggaatcgaggaccctctttaagaactaccacagtgaccggcaagatcattcatgaatggtgttgcaggtcctgtactctccctccactgcgcttccggggtgaggatgggtgctggtacggaatggagatcagacccgtgaaagaaaaggaggaaaaccttgtcaggagtatggttagcgccggctctggtgaggtggactccttttcactgggcatattgtgtgctagtattatgatcgaagaggtaatgcgcagccgatggtcgcggaagatgctcatgacagggacccctgccgtgttcctgctactgatcatgggacaactcacatggaatgacctgattcgtctttgcatcatggtcggcgcaaacgcttccgatagaatggggatgggaactacctatttggccctgatggcaacgtttaaaatgaggccaatgttcgccgtgggcttactctttcgccggctgacatctagagaggttcttctgctaaccattggtctcagcctggtggcttcagtcgaattgcccaacagtctggaggaattaggggacggactcgcgatgggcataatgatgctgaagcttctgactgagttccagccgcaccagttgtggaccacactcctgtccctaacttttatcaaaaccacgctgtctcttgattacgcctggaagacaaccgcaatggctctcagcattatctccctgttccctttgtgtctgtcaactacaagccagaaaaccacttggttaccagtgctcctgggcagttttgggtgcaagccccttacaatgttcctgattaccgaaaataagatctggggaaggaaatcttggcctttgaacgagggtataatggccatcggcattgtttccatcctcctgagctcgctactgaagaatgacgtgccccttgccgggccactcacggctggaggcatgctgattgcatgttatgtcatctcaggttctagtgccgatttgtccttagagaaagcggctgaagtaagctgggagcaagaagccgagcattctgggactagccacaacatactggtggaagttcaggacgatggaaccatgaagattaaagacgaggagcgagatgacacactcaccatcctgcttaaggcaacactgttggccgtgtccggcgtctaccctatgtcaatccccgctactctatttgtgtggtatttctggcagaaaaagaagcagcgcagtggcgtactgtgggataccccaagcccgcctgaagtggagcgggcagtcctcgacgatgggatttacagaatactgcaaaggggacttttaggtcgttctcaggttggcgtgggggtgttccaggacggagtctttcatacgatgtggcacgtgacacgcggcgccgttctgatgtatcagggtaaacggctcgaaccctcctgggcgtcagtaaagaaagacttgatcagttacgggggaggctggagattccaaggcagctggaatactggggaggaggtgcaggtcattgctgtggaaccaggaaagaaccccaaaaatgttcagaccacacctggtacctttaagactccagagggcgaagtgggggccatcgcactggatttcaagcccggaacctccggctctcctattgtcaacagggagggtaaaatcgtggggctctacggaaatggcgtagtcacaacgtcgggcacttatgtgagcgccatagctcaagccaaggcatcacaggaagggccgctgccagagatcgaggacgaagtttttaaaaagcgaaaccttaccattatggatctgcaccccggatccggtaaaacacggcgctacttgcctgctatcgtgagagaggccattaagaggaagctacggaccctgatcctcgcgccaactcgagtcgtggccagtgaaatggcagaggctttaaaaggcatgcccataagatatcagacaaccgccgttaagtctgaacatacggggcgcgagattgtggacctgatgtgccacgctactttcacaatgaggcttctgagccctgtccgtgtgccgaattacaacatgatcatcatggatgaggcacattttaccgaccccgcctccattgccgctcggggatatatctcaaccagagtaggcatgggtgaagcggcagccatattcatgactgctacaccacctgggtctgtggaggcctttccccagagcaatgcagttattcaagatgaagagagggacatcccagaacgcagttggaactccggatacgattggattaccgacttccctggcaaaacagtctggtttgtgcccagcatcaagtctggcaatgatatagccaactgtctccgaaaaaacgggaagagagtgattcagttgtcacggaagactttcgacacggagtatcagaaaaccaagaataacgactgggattacgtcgtaacaactgacatctccgagatgggagctaatttcagggcggatcgcgtgatcgacccacgtagatgcctgaaaccggttattctcaaggatggtcctgaacgggtgatcctggccggccccatgccagtcaccgtggcaagtgctgcccagaggcgcgggcgaattggaagaaaccaaaataaagagggcgaccagtacgtttatatgggtcagccccttaacaatgatgaagaccacgcacattggacagaggccaagatgctactggataacataaatacccctgaggggatcattccagctttgtttgaacccgagcgggaaaagagcgccgcgatcgacggcgagtacaggttacgcggagaagcaagaaaaactttcgtggagctgatgaggcggggcgatctccctgtctggctgtcgtataaggtggcctctgaggggtttcagtactccgaccgtcgctggtgcttcgatggagaacgaaacaatcaagtacttgaggaaaacatggacgtggagatctggacgaaagaaggtgagagaaagaaactgaggccgcggtggctcgacgctcgcacctatagcgatccattggccctgagagagtttaaggaattcgctgcaggcaggcggtcagttagtggggacctaattctggagataggaaaactcccccagcaccttacactgcgagcccagaatgctttagataacttggtcatgctgcacaattctgaacagggcggtaaggcctacagacatgcaatggaggaactccctgacactatcgagaccctgatgcttctggcgctcattgccgtgttgacagggggcgtgaccctgtttttcttatccggaaagggcctagggaaaactagcatcggactgctctgtgtcacagcttcaagtgcccttctgtggatggcaagcgttgagccccactggattgctgcctccatcatattggaatttttcctgatggtgctcctgatcccagagcctgatcgccaaaggacgccccaggacaaccagcttgcatatgtagtgattggtctcctgtttatgatcttgaccgtcgccgctaacgaaatgggcctgttagagactacaaagaaagatctagggattggacatgtggcggccgagaatcaccaacacgcaaccatgctggacgttgatctccggccagcttctgcctggaccctttacgccgtggcaacaactgtcatcacgcctatgatgcgtcataccatagaaaacacaactgctaatattagcctgaccgccatcgcgaaccaggctgccattttgatgggcctggacaagggttggccgatctccaaaatggatataggggtacccctcctggcacttggctgctactcacaggtgaatccattaacactgaccgccgctgttctcatgttggtggcacactatgccatcattggacctggcctgcaggcgaaggctactagagaggcccaaaagaggacggcagccgggatcatgaaaaaccccacagtcgacggaattgtggctatcgatctagacccagtcgtgtacgacaccaagttcgaaaaacagctgggccagataatgctccttattctgtgtacttctcagatcttgctgatgcgcaccacatgggccctctgcgagagtatcactctggcaaccggtcctttaacaacgctttgggaagggtcgcccggaaagttttggaataccactattgctgttagcatggccaacatcttccggggctcctatctggcgggtgccggcctcgcattctctctaatgaaatcactggggggaggccgaagagggacaggagctcaaggcgagaccttgggtgagaagtggaagaggcagctgaatcagctcagcaaatccgaatttaacatatacaagcgcagtgggattatggaggtggatcggtctgaagccaaagagggacttaagagaggcgaaactacaaaacatgcagtaagccgtggtaccgctaagctgaggtggttcgtggagcggaatttggtcaagccggagggcaaagttatcgacctggggtgtggacgcggcgggtggtcatattactgcgccggactcaagaaagtgacggaagtcaagggctataccaaaggtgggccaggacacgaggaacctattcccatggccacatacggctggaacttagtgaagctgcattccggcaaagatgtatttttcatgccacccgagaagtgtgacactcttctgtgcgatatcggggaaagtagccctaatccgaccgtggaggagggacgaacactaagagttctcaagatggtggaaccctggctgaaaggtaaccagttttgtataaagatcttgaatccatacatgccttctgtcgtggagactctggaacaaatgcagaggaaatatggcgggatgctcgtccggaaccccctttcccgcaattcaacccacgagatgtactgggtgagctgcggaacaggcaacattgtttcggcggtaaacatgacctctagaatgctgttaaataggttcactatggctcaccgaaagcctacgtatgagcgggacgtggatctgggtgcagggacacgtcatgtcgccgtggaaccagaggttgctaacttggacatcattggacagagaatcgaaaatattaaaaacgagcacaagagtacctggcattacgatgaagacaatccctataagacttgggcctaccacggctcctatgaggtgaaacctagcggctcagcatcctctatggtcaacggggtggtacgcctcctgaccaagccatgggatgtgatccccatggttacacaaatagccatgacggacaccactccgtttggacagcagagggtcttcaaagagaaggtggacacacggacccctagagctaaacgcggtactacacagattatggaagtgaccgcgaagtggctatggggctttcttagcaggaataagaaaccacgaatctgtacacgggaggaattcactagaaaggtcaggagtaacgccgcaatcggggctgtttttgtggatgagaatcaatggaactccgccaaagaagcagtagaggacgagcgcttctgggatctggtgcaccgtgaacgggagctccataagcagggaaaatgcgccacctgcgtctacaatatgatgggcaagagagaaaagaaactgggtgagtttgggaaggctaaaggaagcagggccatttggtacatgtggttgggcgcgcgcttcctggaattcgaggcactcggctttatgaacgaggaccactggttctctcgagaaaattcacttagtggggtggagggagaaggtctgcataagttaggctatatactgcgggatatctccaaaattcccgggggaaacatgtacgccgacgatacggctggctgggacaccagaatcacagaggatgacttgcagaatgaggccaagattactgatatcatggaacctgagcacgcactcctggctaccagcatatttaaactaacatatcagaacaaggttgtgagggtccaacgcccagccaagaacggtactgtgatggacgtaatctctagacgggatcagagggggtcgggacaggttggcacctacggccttaatacgttcacaaacatggaagtgcagctgattcgtcaaatggagtcagaagggatctttctccccagcgagctggagaccccgaatttggctgaacgagtcttagactggctggagaaacatggagccgaacgcctcaagagaatggcaatttccggtgacgattgtgtggtgaaacctatcgacgatcggttcgcgactgcccttacagctctgaacgacatgggcaaggtcaggaaagatataccccagtgggagccaagtaaggggtggaatgactggcagcaggttcctttttgctctcaccacttccatcaactaattatgaaggatggacgcgaaatcgtggtaccctgtagaaaccaggacgagctggtgggccgggccagggtcagccagggtgcagggtggtccctccgagagaccgcttgcttgggaaaatcatatgcccaaatgtggcagctgatgtactttcaccgtagagatcttcgcctggcagccaatgcgatctgtagtgctgtgccagttgactgggtgcccacttctcggaccacatggagcattcatgcccaccaccagtggatgacgaccgaagatatgctctccgtctggaacagggtgtggatagaggaaaatccttggatggaggacaagactcatgtatcaagctgggaagaggttccatatttaggcaaaagagaggaccagtggtgcggctctctgatcgggttgacagcacgcgccacctgggctactaacattcaagtggccatcaatcaggtccggaggctgattggaaacgaaaattacctcgattacatgacatccatgaagcgattcaaaaacgagagtgacccggaaggtgcactttggtga

SEQ ID NO: 13441 - RNA, 9879 nt, synthetic construct
  misc_feature 1..9879: note = derived and/or modified CDS sequence (opt3) from DENV-1__KF973472__SS-prME
  source 1..9879: mol_type = other RNA
agcgtgaccatgctgctcatgcttctgcccaccgccttggctttccacttaactacgagaggaggggaacctcatatgatcgtctccaagcacgaaaggggaaaatctctgctgtttaagacctcaacaggtgttaatatgtgcactctcattgccatggacctgggagaactttgtgaagataccatgacatacaaatgcccacggataaccgaggccgaaccggacgatgtggactgttggtgcaatgcgactgatacatgggtaacctatgggacgtgtagtcagactggagagcatcgccgagacaagcgtagcgtggctctggcaccccacgtcggcttgggtctcgagaccagaacagaaacttggatgtcctctgagggggcttggaaacaaatccagagggtggaaacctgggccctgcggcatcctggattcacagttattgctctgtttctcgcacacgccatcggcacctcgattacgcagaagggcatcatattcatcttactgatgcttgtgactccatcaatggctatgcgctgcgtcgggattggaaacagagattttgtggagggtttgagcggcgccacatgggtagacgttgtgctggagcacgggagttgtgtcaccactatggcgaagaataaacccacactagatatcgaactcctgaagaccgaggtgacgaaccctgcagtgcttaggaaactgtgcattgaagccaagatctccaataccacaactgactctcggtgtccaacccagggagaggctacattggtcgaagaacaagatgccaacttcgtttgccgccgaactctcgtggacagaggctggggtaatgggtgtggactgtttggcaaaggcagcttactgacctgcgcaaagttcaagtgcgtaacaaaactcgaggggaagatagtgcagtacgaaaaccttaaatattccgtcattgtgaccgttcatactggagatcagcaccaggtgggtaatgagacgacagaacatggcaccatcgctactattacaccccaagcccctacatcagagatccagctgaccgactacggggcgttggccctagactgtagtccaaggactggactggattttaacgaaatggtcctcctgacaatgaaggagaaaagctggcttgtgcacaagcagtggttcctggacttgccgctcccctggacgtctggcgcatccacctcacaggagacttggaatcggcaagatctgttagtaacatttaaaaccgctcacgccaagaagcaggaagttgtggtcctgggtagccaggagggggctatgcatacagccctaactggcgcaaccgaaatccaaacgagtggaaccacaactattttcgccggccacctcaaatgccgtctgaagatggacaaacttaccttgaaggggacatcttatgtgatgtgtactggatcctttaaactggagaaggaagtcgctgagacccagcatggtacggtgctcgttcaggtgaagtacgagggcacagatgcgccttgcaaaataccattcagcacccaggacgaaaagggggtaactcaaaacggacgcctgatcacagcaaatcccattgtcaccgataaagagaagcctgtgaacatcgaaactgagccacccttcggcgagtcgtatatagttgtgggtgccggggaaaaagctcttaagctgtcttggtttaagaaaggctcctcaattggaaagatgttcgaggccaccgcaagaggcgccaggcggatggctatcttgggggacacagcctgggattttggaagtatcggtggcgtcttcacgagcgtggggaaactcgtacaccaggtgtttggaaccgcatacggcgttctgttctccggtgtctcttggactatgaagattgggatcggcattttactgacatggctaggactcaatagccgatcaaccagtctgtccgtgacatgtatagcggtgggcatggtcactctttacttgggggttatggtgcaggctgacagcggatgcgtgatcaactggaaaggccgcgaactgaagtgtggttctgggatttttgtaaccaacgaggtccatacgtggacagaacagtataagttccaagccgattcaccgaaaagactcagtgcagccatcggaaaggcttgggaggagggcgtgtgcggtatcaggagcgccacccggctggaaaatattatgtggaaacagatatccaacgagttaaatcacatcctgcttgaaaacgacatgaagtttactgttgtggtcggcgacgcaaatgggattttggctcagggcaagaaaatgatccgccctcagcccatggagcacaaatactcttggaaatcgtggggcaaggccaaaattatcggggcggatatacaaaacaccacattcatcattgacggaccagatactcctgaatgtcccgacgatcagagagcctggaatatctgggaggtggaggactatggctttggtattttcaccacaaacatctggctcaagctgagggatagctacacgcagatgtgcgaccatcgtctaatgtccgctgcaataaaagattcaaaggccgttcacgctgacatggggtattggattgaaagtgagaaaaatgaaacctggaagctggcccgggcatcttttatcgaggtgaagacttgtacatggccaaaaagccataccctctggtccaacggagtactggaatcagagatgattatccccaagatatacggcggtcctatcagccagcacaattatcgaccaggctacttcactcaaacagcggggccgtggcaccttggaaaattggagctggatttcgacttatgcgaaggcaccacggtcgtggtggatgagcattgcgggaacagaggaccctctctcaggactaccacagtcaccggcaagattatccacgaatggtgttgccgctcctgtactctgcctccacttcggtttagaggtgaggacgggtgctggtacggaatggagattaggcccgttaaagaaaaggaggaaaatctggtgcgcagtatggtaagcgccggctctggtgaggtggactccttctcattgggcatcctctgtgtcagtataatgattgaagaggtgatgcgaagccggtggtcgcgtaagatgctgatgacagggaccctagctgtttttctgctcctgatcatgggacagcttacatggaacgatttgatcagactgtgcattatggtgggcgccaatgcatccgacaggatggggatgggaactacctatttagctctcatggccacgttcaaactgcgccctatgtttgcagtcggcatccttttccggagactgacatctagggaggtgctactcctgaccattggtttgagcctggttgcctcagtggaattaccaaacagtctcgaggaactgggggatggacttgctatgggcataatgatgctgaagttgctcactgagtttcagccccatcaactgtggaccacactactgtcccttactttcatccgaaccacgctctctctggactacgcgtggaaaacaaccgccatggcattgagcattgtctccctgtttccgttatgtctctcaactacaagccagaagaccacttggctgcctgtacttctgggcagtttcgggtgcaaaccattgacaatgtattttatcaccgaaaacaagatttggggacgcaagtcttggcccatcaatgagggtataatggctatcggcattgtgtccatcctcctgagctcgctactgaaaaacgatgttcctcttgccgggcccctcattgccggaggcatgctgatcgcttgttacgtgatatcaggttctagtgcagacttgtccttagagaaggccgcggaagtcagctgggagcaggaagctgagcactctgggacgagccataatattctggtggaagtacgggatgacggaactatgagaatcaaagatgaggagaaggacgataccctcacaatcctgcttaaagccaccctgttggcagtgtccggcgtctatccaatgtcaattcctgccacactattcgtttggtacttttggcagaagaaaaagcaaaggagtggcgtgctgtgggacactcccagcccaccggaagtggagcgtgctgtcctcgatgacgggatatatcgcatcctgcagcggggacttttaggtagatctcaggtgggcgttggggtattccaggacggagtgttccacaccatgtggcacgtcacgaggggcgcagtgctgatgtaccaaggtaagcgactcgaaccttcctgggcctcagttaaaaaggatttgattagttacgggggaggctggcggtttcagggcagctggaacacaggggaggaggtgcaggtcatcgcggtggaacccggcaaaaatccaaagaacgtacagactacccccggtacattcaaaacccctgagggcgaagtcggggctattgccctggactttaagccaggaacttccggctctcccatcgtgaatcgcgagggtaagatagttgggctctatggaaacggcgtggtcaccacatcgggcacgtacgtgagcgcaatcgcccaagctaaagcctcacaggaagggcctctgccggagattgaggatgaagttttcaagaaaagaaatcttactatcatggacctgcatccaggatccggtaagaccaggcggtatttgcccgcaattgtgcgagaggctatcaaaagaaagctacgcacactgatactcgcccctaccagggtcgtggcgagtgaaatggccgaggcattaaagggcatgccaattcgttaccagactacagctgtaaaatctgaacacaccgggcgggagatcgtggatctgatgtgccatgccacgtttactatgagacttctgagccccgttagggtccctaactataatatgatcattatggacgaggctcacttcacagatccggcatccatcgccgcccgcggatacatatcaacccgagtgggcatgggtgaagctgcggcaatttttatgaccgccactcccccagggtctgtggaggctttccctcaaagcaacgccgtcatccaggacgaagagagagatattcccgaacggagttggaactccggatatgactggatcacagattttccaggcaagaccgtatggttcgtgcctagcataaaatctggcaacgacattgcaaattgtctcaggaagaacgggaaacgcgttatccagttgtcacgtaagacatttgacactgagtaccagaagacgaaaaacaatgattgggactacgtggtcaccacagatatctccgagatgggagccaacttcagagctgaccgggtgattgatcccaggcgctgcctgaagccagttatcctcaaagacggtccggaacgagtgattctggcgggccctatgcccgtcactgtggccagtgcagctcaaagacgggggaggataggacgcaatcagaacaaggagggcgatcagtatgtatacatgggtcagccacttaataacgacgaagatcatgcccactggaccgaggcaaaaatgctactggacaatatcaacacacccgaggggattatccctgccttgttcgaaccagagagagaaaagagcgctgccatcgatggcgagtataggttacggggagaagcgcgtaagacctttgtggagctgatgcgccgaggcgacctccccgtttggctgtcgtacaaagtcgcatctgaggggttccaatattccgatagaaggtggtgctttgacggagaacggaataaccaggtgcttgaggaaaatatggacgtggagatttggactaaggaaggtgagcgcaaaaagctgagacctaggtggctcgatgcccggacgtacagcgacccgttggctctgcgagagttcaaagaatttgccgctggcagacgctcagtcagtggggatctaatactggagatcggaaagctcccacagcaccttaccctgagggcacagaacgccttagacaatttggttatgctgcataactctgaacaaggcggtaaggcttatcggcacgccatggaggaactccccgatacaattgagactctgatgcttctggcactcatcgcggtgttgaccgggggcgtaacactgttctttttatccggaaagggcctagggaagaccagcattggactgctctgtgtgactgcctcaagtgcacttctgtggatggccagcgtcgagcctcattggatcgcagcttccataatcttggagttctttctgatggtgctcctgattcccgagccagaccgtcagagaacacctcaggataatcagcttgcctacgttgtgatcggtctcctgttcatgattttgacggtcgcagccaacgaaatgggcctgttagagaccactaaaagggacctagggatcggacacgtagctgcggagaaccaccaacatgccacaatgctggatgtggacctccgccccgcatctgcttggaccctttacgccgttgccaccacagtgataactccaatgatgcggcacacgattgaaaataccacagcaaacatcagcctgactgctattgccaatcaggcggctatcttgatgggcctggataagggttggcctatatccaaaatggacatcggggtcccgctcctggcccttggctgctattcacaggtgaaccccttaaccctgacagcagccgtcctcatgttggtggctcattacgcaattatcggaccaggcctgcaagccaaggcgacccgagaggctcagaaaagaactgccgcagggattatgaagaatcctacggttgatggaatcgtggccatagacctagaccccgtagtgtatgatgctaagtttgaaaaacagctgggccagattatgctccttatcctgtgtacatctcaaatcttgctgatgaggaccacttgggccctctgcgagagtattaccctggcaacaggtccattaactaccctttgggaagggtcgcctggaaagttctggaacacaacgatcgctgtcagcatggccaatatatttcgcggctcctacctggcgggtgccggcctcgcattctctctaatgaaatcactagggggaggccggagagggaccggagctcagggcgagactttgggtgagaagtggaaacgtcagctgaaccagctcagcaagcccgagttcaatacatataagaggtccgggattatggaggttgaccggagtgaagccaaagagggacttaagcgcggcgaaaccactaaacacgcagtgtctcgaggtacagctaagctgagatggtttgtcgagaggaacttggtgaaaccggagggcaaggtaatcgatctggggtgtggacggggcgggtggagctactattgcgccggactcaagaaagtgaccgaagttaagggctacacgaaaggtgggccaggacatgaggaacctattcccatggccacctacggctggaatttagtgaagctgcactcaggcaaagacgtcttctttatgccacccgagaagtgtgatacacttctgtgcgacatcggggaatccagtcctaacccgactatagaggagggacgcaccctaagagtgctcaaaatggtcgaaccctggctgaggggtaatcaattctgtatcaagattttgaacccatatatgcctagcgtggttgagacactggaacagatgcagcgaaagcacggcgggatgctcgtacggaatcccctttctcgtaactccactcatgagatgtactgggtgtcatgcggaaccggcaatatcgtcagcgcggtgaacatgacatcgagaatgctgttaaaccgctttaccatggctcacaggaaacctacttatgagcgggatgttgacctgggtgcagggacgagacatgtggccgtcgaaccagaggtggctaatttggatattatcggacagcgcattgaaaacatcaagaatgagcacaaatctacatggcactacgacgaagataacccctataagacctgggcctaccatggcagttatgaggtaaaaccttccggcagcgcatcatccatggtgaatggggttgtcaggctcctgactaagccatgggacgtgatacccatggtgacccaaattgccatgacagacacgaccccgttcggacagcagcgagtctttaaggagaaagttgatactcggacacctagagctaagaggggtaccactcaaatcatggaagtgacagcgaaatggctatggggcttcctttctcgcaacaagaaaccacgtatctgtacccgggaggaatttacaagaaaggtaaggagcaatgccgcaattggggctgtgttcgtcgacgagaaccagtggaatagtgccaaggaagcagtggaggatgagcgcttttgggacctggttcaccgagaacgggagctccataaacagggaaagtgcgccacttgcgtgtacaacatgatgggcaaaagagaaaagaaactgggtgagttcgggaaggctaagggatccagggccatatggtacatgtggttgggcgcgcgctttctggagttcgaggcactcggcttcatgaatgaggatcactggtttagcagagaaaactctctttcaggggtcgagggagaaggtctgcataaattaggctatatcctgcgggacattagtaagatccccgggggaaatatgtacgccgatgacaccgctggctgggatacgaggattaccgaggacgatttgcagaacgaggccaaaatcacagacataatggaacctgagcacgcactcctggctacttccatcttcaagctaacctatcaaaataaagtggtacgtgttcagcgaccagccaagaacggtacagtgatggatgtcattagccgcagagaccagcgggggtctggacaggtgggcacttacggccttaacacctttacgaatatggaagtgcaactgatcaggcagatggagtcggaagggattttcctcccctcagagctggagacaccgaacttggctgaacgcgtcttagactggctggagaaacacggagccgaaagactcaagcggatggcaatcagcggtgatgactgtgttgtgaagcctatagatgacaggtttgcgaccgcccttactgctctgaatgatatgggcaaagtacgaaaggacattccccagtgggagccatccaaagggtggaacgattggcagcaagtgcctttctgcagtcatcactttcatcagctaatcatgaaggacggacgtgaaatcgtcgtgccctgtagaaatcaggatgagctggttggccgcgcccgggtgtctcagggtgcagggtggagcctcagggagacagcttgcttgggaaaatcctatgcccaaatgtggcagctgatgtacttccacagacgcgaccttcggctggcagccaacgcgatttgttcagctgtcccagtggattgggtacccaccagtaggactacctggtctatacacgcccatcaccagtggatgacaacggaagacatgctcagcgtttggaatcgagtgtggatcgaggaaaacccttggatggaggacaagacccatgtctcctcatgggaagaggtgccatatttaggcaagagagaggatcaatggtgcggcagcctgattgggttgactgcacgggccacatgggctaccaatatccaggttgccattaaccaggtgaggcgcctgatcggaaatgaatcttacctcgactacatgacttccatgaaacgttttaagaacgagagtgatccggaaggtgcactttggtga

SEQ ID NO: 13442 - RNA, 9879 nt, synthetic construct
  misc_feature 1..9879: note = derived and/or modified CDS sequence (opt3) from DENV-1__KF973474__SS-prME
  source 1..9879: mol_type = other RNA
agcgtgaccatgctgctcatgcttctgcccactgccttggctttccacttaactacgagaggaggggaacctcatatgatcgtctccaagcacgaaagaggaaaatctctgttatttaagacctcaaccggtgttaacatgtgcactctcattgcaatggacctgggcgaactttgtgaagataccatgacatacaaatgcccacggataaccgaggccgaaccggacgatgtggactgttggtgcaatgcgactgatacatgggtaacctatgggacgtgtagtcaaactggagagcatcgccgagacaagcgtagcgtggctctggccccacacgtcggcttgggtctcgagaccagaacagaaacttggatgtcctctgagggggcatggaaacaaatccaaagggtggaaacctgggccctgcggcatcctggattcacagttattgctctgtttctcgcacacgccatcggcacctcgattacgcagaagggcatcatattcatcttactgatgcttgtgactccatcaatggctatgcgctgcgtcgggattggaaacagagattttgtggagggtttgagcggcgccacatgggtagacgttgtgctggagcacgggagttgtgtcaccactatggcgaagaataaacccacattggatatcgaactcctgaagaccgaggtgacgaaccctgcagtgcttaggaaactgtgcattgaagccaagatctccaataccacaactgactctcggtgtccaacccagggagaggctacattggtcgaagaacaagatgccaacttcgtttgccgccgaactctcgtggacagaggctggggtaatgggtgtggactgtttggcaaaggcagcttactgacctgcgcaaagttcaagtgcgtaacaaaactcgaggggaagatagtgcagtacgaaaaccttaaatattccgtcattgtgaccgttcatactggagatcagcaccaggtgggtaatgagacgacagaacatggcaccatcgctactattacaccccaagcccctacatcagagatccagctgaccgactacggggcgttggccctagactgtagtccaaggactggactggattttaacgaaatggtcctcctgacaatgaaggagaaaagctggcttgtgcacaagcagtggttcctggacttgccgctcccctggacgtctggcgcatccacctcacaggagacttggaatcggcaagatctgttagtaacatttaaaaccgctcacgccaagaagcaggaagttgtggtcctgggtagccaggagggggctatgcatacagccctaactggcgcaaccgaaatccaaacgagtggaaccacaactattttcgccggccacctcaaatgccgtctgaagatggacaaacttaccttgaaggggacatcttatgtgatgtgtactggatcctttaaactggagaaggaagtcgctgagacccagcatggtacggtgctcgttcaggtgaagtacgagggcacagatgcgccttgcaaaataccattcagcacccaggacgaaaagggggtaactcaaaacggacgcctgatcacagcaaatcccattgtcaccgataaagagaagcctgtgaacatcgaaactgagccacccttcggcgagtcgtatatagttgtgggtgccggggaaaaagctcttaagctgtcttggtttaagaaaggctcctcaattggaaagatgttcgaggccaccgcaagaggcgccaggcggatggctatcttgggggacacagcctgggattttggaagtatcggtggcgtcttcacgagcgtggggaaactcgtacaccaggtgtttggaaccgcatacggcgttctgttctccggtgtctcttggactatgaagattgggatcggcattttactgacatggctaggactcaatagccgatcaaccagtctgtccatgacatgtatagcggtgggcatggtgactctttacttgggggtcatggttcaggctgacagcggatgcgtgatcaactggaaaggccgcgaactgaagtgtggttctgggatttttgtgaccaacgaggtacatacgtggacagaacagtataagttccaagccgattcaccgaaaagactcagtgcagccatcggaaaggcttgggaggagggcgtctgcggtatcaggagcgccacccggctggaaaatattatgtggaaacagatatccaacgagttaaatcacatcctgcttgaaaacgacatgaagtttactgtggttgtgggcgacgcaaatgggattttggctcagggcaaaaagatgatccgccctcagcccatggagcacaaatactcttggaagtcgtggggcaaggccaaaattatcggggcggatatacaaaacaccacattcatcattgacggaccagatactcctgaatgtcccgacgatcagagagcctggaatatctgggaggtcgaggactatggctttggtattttcaccacaaacatctggctcaagctgagggatagctacacgcagatgtgcgaccatcgtctaatgtccgctgcaataaaagattcaaaggccgtgcacgctgacatggggtattggattgaaagtgagaaaaatgaaacctggaagctggcccgggcatcttttatcgaggttaagacttgtacatggccaaaaagccataccctctggtccaacggagtgctggaatcagagatgattatccccaagatatacggcggtcctatcagccagcacaattatcgaccaggctacttcactcaaacagcggggccgtggcaccttggaaaattggagctggatttcgacttatgcgaaggcaccacggtagtcgtggatgagcattgcgggaacagaggaccctctctcaggactaccacagtgaccggcaagattatccacgaatggtgttgccgctcctgtactctgcctccacttcggtttagaggtgaggacgggtgctggtacggaatggagattaggcccgtcaaagaaaaggaggaaaatctggttcgcagtatggtgagcgccggctctggtgaggtagactccttctcattgggcatcctctgtgtgagtataatgattgaagaggtcatgcgaagccggtggtcgcgtaagatgctgatgacagggaccctagctgtgtttctgctcctgatcatgggacagcttacatggaacgatttgatcagactgtgcattatggttggcgccaatgcatccgacaggatggggatgggaactacctatttagctctcatggccacgttcaaactgcgccctatgtttgcagtgggcatccttttccggagactgacatctagggaggtcctactcctgaccattggtttgagcctggtggcctcagttgaattaccaaacagtctcgaggaactgggggatggacttgctatgggcataatgatgctgaagttgctcactgagtttcagccccatcaactgtggaccacactactgtcccttactttcatcaaaaccacgctctctctggactacgcgtggaagacaaccgccatggcattgagcattgtgtccctgtttccgttatgtctctcaactacaagccagaaaaccacttggctgcctgtccttctgggcagtttcgggtgcaagccattgacaatgtatctcatcaccgaaaacaagatttggggacgaaaatcttggcccatcaatgagggtataatggctatcggcattgtatccatcctgctaagctcgctgcttaagaacgatgtgcctctcgccgggcccctgattgccggaggcatgttgatcgcttgttacgttatatcaggttctagtgcagacttatccctggagaaagccgcggaagtgagctgggagcaggaagctgagcactctgggacgagccataatattctcgtcgaagtgcaggatgacggaactatgcgcatcaaggatgaggagaaagacgataccctgacaatccttctgaaggccaccttgctagcagtatccggcgtgtatccaatgtcaattcctgccacactgtttgtctggtacttctggcagaaaaagaagcagcggagtggcgttctctgggacactcccagcccaccggaagtggagagagctgtgctggatgacgggatatataggatccttcagcgtggattactgggtcgctctcaggtcggcgtgggggtttttcaagacggagtattccacaccatgtggcacgtgacgcggggcgcagtcctcatgtaccagggtaaaagattggaaccttcctgggcctcagtgaagaaagatctgattagttacgggggaggctggaggttccagggcagctggaacacaggggaggaggttcaggtgatcgcggtcgaacccggaaagaatcccaaaaatgtgcaaactacccccggtacatttaagacccctgagggcgaagtaggggctattgccctcgacttcaagccaggaacttccggctctcccatcgtcaatcgagagggtaaaatagtggggctgtatggaaacggcgttgtgaccacatcgggcacgtacgtcagcgcaatcgcccaggctaaggcctcacaggaagggcctcttccggagattgaggatgaagtgtttaaaaagcggaatctgactatcatggacttgcatccaggatccggtaaaacccgcagatatctacccgcaattgttagggaggctatcaagcggaagctgcgaacactcatattagcccctaccagagtggtcgcgagtgaaatggccgaggcactgaaaggcatgccagtgcgctaccaaactacagctgtaaagtctgaacacaccgggagggagattgtggatcttatgtgccatgccacgttcactatgcgtctgctcagccccgttcgggtccctaactataatatgatcatcatggacgaggctcactttacagatccggcatccattgccgccagaggatacatctcaaccagggtgggcatgggtgaagctgcggcaatattcatgaccgccactcccccagggtctgtggaggcttttcctcagagcaacgccgtcattcaggacgaagaacgcgatatccccgaacgaagttggaactccggatatgactggattacagatttcccaggcaaaaccgtatggtttgtgcctagcatcaagtctggcaacgacatagcaaattgtttgaggaaaaacgggaagcgggttattcagctgtcaaggaagacattcgacactgagtaccagaaaacgaagaacaatgattgggactacgtggtcaccacagatatctccgagatgggagccaactttcgcgctgaccgtgtgatcgatcccagacggtgcctcaaaccagttattctgaaggacggtccggaaagggtgatccttgcgggccctatgcccgtcactgtggccagtgcagctcagcgccgagggagaattggacggaatcagaacaaagagggcgatcagtatgtatacatgggtcaaccactaaataacgacgaagatcatgcccactggaccgaggcaaagatgctgttggacaatataaacacacccgaggggatcattcctgccttattcgaaccagagagggaaaagagcgctgccatcgatggcgagtatcgcctgagaggagaagcgaggaaaaccttcgtggagctcatgcggcgtggcgacctgcccgtttggctttcgtacaaggtcgcatctgaggggtttcagtattccgatcgccgatggtgcttcgacggagaaagaaataaccaggtgctggaggaaaatatggacgtggagatctggactaaagaaggtgagaggaagaaactccggcctcgctggttggatgccagaacgtacagcgacccgctggctctaagggagtttaaggagttcgccgctggccggcgatcagtcagtggggatctgattctcgagataggaaaacttccacagcacctgaccttaagagcacaaaacgccttggacaatctggttatgctccataactctgaacagggcggtaaggcttatcgccacgccatggaggaactgcccgatacaatcgagactcttatgctgctcgcattgattgcggtgctgaccgggggcgtaacattatttttcctatccggaaagggcctggggaaaaccagcatcggactcctttgtgtgactgcctcaagtgctctgttgtggatggccagcgtcgagcctcattggattgcagcttccatcatactggaatttttcctcatggtgctgcttatccccgagccagacaggcagcggacacctcaggataatcaactcgcctacgttgtgattggtctgttgtttatgatcctgacggtcgcagccaacgaaatgggcttactagagaccactaagcgtgacctggggattggacacgtagctgcggagaaccaccagcatgccacaatgctcgatgtggaccttagacccgcatctgcttggaccctgtacgccgttgccaccacagtgatcactccaatgatgaggcacacgatagaaaataccacagcaaacattagcttgactgctatcgccaatcaggcggctattctgatgggcctcgataaaggttggcctatctccaagatggacataggggtcccgctgcttgccttaggctgctattcacaagtgaaccccctgaccctcacagcagccgtcttgatgctggtggctcattacgcaatcattggaccaggcctacaggccaaagcgacccgcgaggctcagaagcggactgccgcagggatcatgaagaatcctacggttgatggaattgtggccatcgacctggaccccgtagtgtatgatgctaaattcgaaaagcagctcggccaaataatgcttctgattttgtgtacatctcagatcctgctcatgcgaaccacttgggccctgtgcgagagtatcaccttagcaacaggtccacttactaccctgtgggaagggtcgcctggaaaattttggaacacaacgattgctgtcagcatggccaatatcttcagaggctcctacctcgcgggtgccggcctagcattttctctgatgaagtcactagggggaggcaggcgcgggaccggagctcagggcgagactctgggtgagaaatggaagcggcagctcaaccaacttagcaagcccgagttcaatacatataaaagatccgggataatggaggttgaccgtagtgaagccaaggagggactgaaaaggggcgaaaccactaagcacgcagtgtctcggggtacagctaaattgcgctggttcgtcgagcgaaacctggtgaagccggagggcaaggtaattgatctcgggtgtggaagaggcgggtggagctactattgcgccggactgaaaaaggtgaccgaagttaaaggctacacgaagggtgggccaggacatgaggaacctatccccatggccacctacggctggaatctagtgaaacttcactcaggcaaggacgtctttttcatgccacccgagaaatgtgatacactgctatgcgacattggggaatccagtcctaacccgactatcgaggagggaaggaccctccgggtgctgaagatggtcgaaccctggttgcgcggtaatcagttttgtataaagatcctgaacccatatatgcctagcgtggttgagacactcgaacagatgcagagaaaacacggcgggatgcttgtaaggaatcccctgtctcgaaactccactcatgagatgtactgggtgtcatgcggaaccggcaatattgtcagcgcggtgaacatgacatcgcggatgttactgaaccgtttcaccatggctcacagaaagcctacttatgagcgcgatgttgacttgggtgcagggacgaggcatgtgacagtcgaaccagaggtggccaatctcgatatcattggacaacggatcgaaaacattaaaaatgagcacaagtctacctggcactacgacgaagataacccctataaaacttgggcttaccatggcagttatgaggtaaagccttccggcagcgcctcatccatggtgaatggggttgtcagactgctaaccaagccatgggacgtgatccccatggtgacacagatagcaatgacggacaccactccgtttggacagcaacgcgtcttcaaagagaaggttgatacaaggacccctcgagccaaacggggtactacacagattatggaagtgaccgctaagtggctttggggctttctgtctagaaacaaaaagccaaggatctgtacacgcgaggagttcactcgtaaggtacggagcaatgcggccatcggggcagtgtttgtcgacgagaaccagtggaatagtgctaaagaagccgtggaggatgagagattctgggacctcgttcacagggaacgcgagctgcataagcagggaaaatgcgcaacctgcgtgtacaacatgatgggcaagcgagagaaaaagttgggtgagtttgggaaggccaaaggatcccgggctatttggtacatgtggctgggcgccagattcctcgaatttgaggcgcttggcttcatgaatgaggatcactggttcagcagggaaaactctctgtcaggggtcgagggagaaggtttacataagctgggctatatattgcgcgacatcagtaaaattcccgggggaaatatgtacgcagatgacacggccggctgggataccagaatcacagaggacgatctccaaaacgaggctaagattactgacatcatggaacctgagcacgccctgctagcaacctccatatttaaacttacatatcagaataaggtggtacgggttcagaggccagctaaaaacggtactgtgatggatgtcatcagccgtcgagaccagcgcgggtctggacaagtgggcacctacggcctgaacacgttcacaaatatggaagtgcagctcattagacagatggagtcggaagggatctttctgccctcagagttggagaccccgaacttagccgaacgggtcctggactggctcgagaagcacggagctgaaaggcttaagcgcatggccattagcggtgatgactgtgttgtgaaacctatcgatgacagattcgcaactgcgctgacagccctaaatgatatgggcaaggtacggaaagacataccccagtgggagccatccaaggggtggaacgattggcaacaggtgcctttttgcagtcatcacttccatcagctgattatgaaagacggaagggaaatcgtcgtgccctgtcgaaatcaggatgagctcgttggccgtgctagagtgtctcaaggtgccgggtggagcttgcgcgagaccgcatgcctgggaaagtcctatgctcagatgtggcagcttatgtactttcaccggagggacctgagactcgccgcaaacgccatctgttcagcggtcccagtggattgggtacccacaagtcgcaccacatggtctattcacgctcatcaccaatggatgacgaccgaagacatgttaagcgtttggaatcgggtgtggatagaggaaaacccttggatggaggacaagactcatgtctcctcatgggaagaggtgccatatctgggcaaaagggaggatcagtggtgcggcagcttgatcgggctgacagcccgagcaacctgggccactaatattcaggttgctatcaaccaggtgagacggctcattggaaatgaaaactaccttgactacatgacatctatgaagaggttcaaaaatgagtccgatccggaaggtgccctgtggtga

SEQ ID NO: 13443 - RNA, 9879 nt, synthetic construct
  misc_feature 1..9879: note = derived and/or modified CDS sequence (opt3) from DENV-1__KF973475__SS-prME
  source 1..9879: mol_type = other RNA
agcgtgaccatgctgctcatgcttatgcccacagccctggctttccacttgactacgagaggcggggaacctcatatgatcgtctccaagcacgaaagaggaaaagcattactgtttaagacctctacaggtgttaacatgtgcactctgattgccatggacctcggcgaactgtgtgaagataccatgacatacaaatgcccacggataaccgaggcggaaccggacgatgtggactgttggtgcaatgctactgatacatgggtaacctatgggacgtgttcacagactggagagcatcgccgagacaagcgtagtgtggcccttgcaccccacgtcggcctgggtttggagaccagaacagaaacttggatgagctccgagggggcctggaaacaaatccaaagggtggaaacctgggctctccggcatcctggattcacagttattgcactgtttctggcccacgctatcggcacctctattacgcagaagggcatcatattcatcctcttaatgctggtgactccatcgatggccatgcgctgcgtcgggattggaaacagagattttgtggagggtctttcaggcgcgacatgggtagacgttgtgttggagcacgggagctgtgtcaccactatggcaaagaataaacccacactggatatcgaactactcaagaccgaggtgacgaaccctgccgtgctgaggaaactttgcattgaagctaagatcagtaataccacaactgactcccggtgtccaacccagggagaggccacactggtcgaagaacaagatgcaaacttcgtttgccgccgaacttttgtggacagaggctggggtaatgggtgtggattgttcggcaaaggctctctcctgacctgcgctaagtttaagtgcgtaacaaaattagaggggaagatagtgcagtacgaaaacctgaaatatagcgtcattgtgaccgttcatactggagatcagcaccaggtgggtaatgagacgacagaacatggcaccatcgccactattaccccacaagcgcctacatccgagatccagctcaccgactacggggcccttactctggactgttcaccaaggacaggattggatttcaacgaaatggtcctactgacgatgaaggagaaaagttggctcgtgcacaagcagtggtttctggaccttccgctgccctggaccagcggcgcatctacttcccaggagacatggaatcggcaagatttgctcgtaaccttcaaaacagctcacgccaagaagcaggaagttgtggtcctgggttcacaggagggggctatgcatactgccttaaccggcgcaacggaaatccaaaccagcggaacaactaccatttttgccggccacctgaaatgccgtctaaagatggacaaactcacactgaaggggacaagttatgtgatgtgtaccggatctttcaaacttgagaaggaagtcgctgagacgcagcatggtacagtgttggttcaggtgaagtacgagggcaccgatgcgccttgcaaaataccattctccactcaggacgaaaagggggtaacacaaaacggacgcctgatcaccgcaaatcccattgtcactgataaagagaagcctgtgaacatcgaaaccgagccaccctttggcgagagctatatagttgtgggtgccggggaaaaagctctcaagctgtcgtggttcaagaaaggatcttccattggaaagatgtttgaggccacagcaagaggcgccaggcggatggctatccttggggacacggcctgggatttcggatcaatcggtggcgtctttaccagtgtggggaaactggtacaccaggtgttcggaactgcatacggcgttttgtttagcggtgtctcctggacaatgaagattgggatcggcattctcctgacctggttaggactaaattctcgaagcacatcactaagtatgacttgtatagcggtgggcatggtgaccctctacctgggggtcatggttcaggctgactccggatgcgtgatcaactggaaaggccgcgaacttaagtgtggtagcgggattttcgtgacgaacgaggtacatacatggaccgaacagtataagtttcaagccgattctccgaaaagattgtcagcagccatcggaaaggcttgggaggagggcgtctgcggtatcaggagtgccactcggctggaaaatattatgtggaaacagataagcaacgagctcaatcacatcctgttagaaaacggcatgaagttcaccgtggttgtgggggacgcaaatggcattctggctcagggcaaaaagatgatccgccctcagcccatggagcacaaatactcctggaagtcttgggggaaggccaaaattatcggagcggacatacaaaacacaacttttatcattgatggcccagacacccctgaatgtcccgatgaccagagagcctggaatatctgggaggtcgaggattatggtttcgggatttttacaacgaacatctggcttaagttgagggactcgtacacccagatgtgcgatcatcgtctcatgagcgctgcaataaaagactccaaggccgtgcacgctgatatgggatattggattgaatcagagaaaaatgaaacttggaagctggcccgggcaagtttcatcgaggttaagacatgtacctggccaaaatctcatactctatggagcaacggcgtgctggaatccgagatgattatccccaagatatacggtggccctatctcacagcacaattatcgaccagggtacttcacacaaaccgcgggaccgtggcacctcggcaaactggagcttgactttgatttgtgcgaagggacgactgtagtcgtggacgagcattgcggaaacagaggccccagcctgaggaccacaaccgtgactggtaagattatccacgaatggtgttgccgctcttgtacattacctccactccggttcagaggggaggatggatgctggtacggcatggagattaggcccgtcaaagaaaaggaggaaaatctggttcgctccatggtgagtgccggtagcggcgaggtagactctttttcccttgggatcctgtgtgtgtcaataatgattgaagaggtcatgcgaagtcggtggagccgtaagatgttgatgaccggaacactcgctgtgttcctgctactgatcatgggccagctcacttggaacgacctgatcagactttgcattatggttggggccaatgcatcggataggatgggaatgggcaccacgtatttggctctgatggccacatttaaaatgcgccctatgttcgcagtgggtatcttatttcggagactcacctccagggaggtcctgcttctgactattgggctatctctcgtggccagcgttgaactgccaaactcattggaggaactgggagacggcttagctatgggcataatgatgctcaagctgcttaccgagttccagccccatcaactgtggacaactttgctcagtctgacctttatcaaaacgacactatccctggattacgcgtggaagaccactgccatggcactttctattgtgagcctcttcccgctgtgtttgtccacaacctcacagaaaactacatggctgcctgtcttactcgggagctttggatgcaagccactgaccatgttccttatcacggaaaacaagatttggggtcgaaaaagttggcccatcaatgagggcataatggctatcgggattgtatctatcctgttgtccagcctcctgaagaacgacgtgcctctagccggacccctgattgccggcggtatgcttatcgcttgttatgttatatcggggtcatctgcagatctcagtctggagaaagccgcggaagtgtcctgggagcaggaagctgagcacagcggaacttctcataatattttggtcgaagtgcaggacgatggcaccatgcgcatcaaggacgaggagaaagatgacacattaaccatcctgctcaaggccacactgcttgcagtaagcggcgtgtacccaatgtccattcctgccactctgtttgtctggtatttctggcagaagaagaagcagcggtcaggggttttgtgggatacccccagtccaccggaagtggagagagctgtgctagacgatggaatatacaggatcctgcagcgtggtctcctgggccgcagccaggtcggggtgggagttttccaagacggcgtatttcacacgatgtggcacgtgacacggggtgcagtccttatgtatcaggggaaaagattagaaccttcttgggcctccgtgaagaaagacctgatttcatacggaggcggctggaggttccaggggagttggaacactggagaggaggttcaggtgatcgcggtcgaacccggtaagaatcccaagaacgtgcaaaccacacccggcacctttaagactagcgagggggaagtaggagctattgccctcgatttcaagcctggcacctccggttctccaatcgtcaatcgagaggggaaaatagtgggattgtacggcaacggcgttgtgacaacgtcggggacttatgtcagcgcaatcgcccaggctaagacctcacaggaaggacccctgcctgagattgaggacgaagtgtttaaaaagcggaatctcacaatcatggatctgcatccgggttccggcaaaacccgcagataccttccagccattgttagggaggcaatcaagcggaagctgcgaactttgatactagctcccacaagagtggtcgccagtgaaatggcggaggccctgaaagggatgcctattcgctatcaaaccacggcagtgaagtctgaacacactggaagggagatcgtagacctcatgtgccatgctacattcaccatgcgtttactgagcccagtgcgggttcccaactacaatatgatcattatggatgaggcccactttaccgaccctgcttccatcgcagccagaggctatatatcaactagggtcggtatgggggaagccgctgcgattttcatgacagcaaccccgcccggatctgtggaggcctttccacagagcaacgctgtgatccaggatgaagaacgcgacattcctgaacgaagttggaactccggctacgattggatcacagacttccccggcaaaactgtctggtttgtaccaagcataaagtctgggaatgatattgccaattgtcttaggaaaaacggaaagcgggtgatccagctgtcaaggaagacgttcgacaccgagtatcagaaaactaagaacaatgactgggattacgttgtgactaccgacatctccgagatgggtgcaaacttccgcgccgatcgtgtcattgaccctagacggtgcctcaaacccgtgatcttgaaggatggcccagaaagggttattctggctgggccgatgcctgtgacagtcgcgagtgccgcacaacgccgaggaagaataggccggaatcagaacaaagagggtgaccagtacgtgtatatggggcaacccctcaataacgatgaagaccatgctcactggaccgaggccaagatgctgcttgataatatcaacactccagagggcattatccccgcactatttgaacctgagagggaaaagagcgccgctatcgacggagagtaccgcctgagaggcgaagccaggaaaacgttcgtagagttgatgcggcgtggggatttaccagtgtggctgtcgtataaggttgcgtctgagggatttcagtactccgaccgccgatggtgcttcgatggtgaaagaaataaccaggtcctcgaggaaaatatggacgtggagatttggaccaaagaaggcgagaggaagaaactgcggccccgctggcttgacgcaagaacatatagcgatcctctggccctcagggagtttaaggagttcgctgccgggcggcgatcagtgagtggagacttgatactggagatcggcaaactaccgcagcacctgactctcagagctcaaaacgcacttgataatctggtcatgttacataactctgaacagggtgggaaggcctaccgccacgctatggaggaattgccagacaccattgagacactgatgctcctggcccttatcgcagttctgaccggcggagtgactctctttttcttgtccggcaaggggctgggaaaaacaagcattggtttactatgtgtaacggcgtcaagtgccctgctctggatggctagcgtggagccccattggatcgccgcatccataatccttgaatttttcctgatggtcttgctgattcctgagcccgataggcagcggaccccacaggacaatcaactcgcttatgtggttatcggcctgctttttatgattctcactgtggccgcaaacgaaatggggctgttggagacaaccaagcgtgatctgggaatcggccacgtcgccgctgagaaccaccagcatgcgaccatgttagacgtagatctaagacctgcctctgcatggacactgtacgctgtggccactacggttataacccccatgatgaggcacacaattgaaaatactaccgccaacatcagcctcacagcaattgctaatcaggccgcgatccttatgggtctggacaaagggtggccaatatccaagatggatatcggcgtgcctttgctggctctcggatgctactcacaagtcaacccgctgacccttactgccgcagtgttaatgctggtcgcccattatgctattatcggccccgggctccaggcaaaagccacgcgcgaggcgcagaagcggacagctgccggaattatgaagaatccaaccgtggacggcatcgttgcaatagatttggaccctgtggtatacgacgccaaattcgaaaagcagctgggtcaaattatgctactgatcctctgtacttctcagatccttctgatgcgaaccacatgggctttgtgcgagagtattactctggccaccgggcccctcacaacgctgtgggaaggatcgccaggcaaattttggaacaccactatcgcagtgagcatggctaatatattcagaggttcctatttagccggcgcggggcttgccttctctctgatgaagtcactcggaggcgggaggcgcggaacaggcgcacagggtgagaccctaggggagaaatggaagcggcagctgaaccaattgagcaagcctgaatttaatacttacaaaagatccggaattatggaggtcgatcgtagtgaagctaaggagggcctgaaaaggggtgaaacaaccaagcacgccgtttctcggggcacggcaaaactccgctggttcgtggagcgaaaccttgtcaagcccgaggggaaggtgatcgacctgggatgtggcagagggggatggagctattactgcgctggcttgaaaaaggtaaccgaagtgaaaggttatacaaaagggggaccgggccatgaggaaccaattcctatggccacttacggctggaatctggttaaactccactcagggaaggatgtgtttttcatgcccccagagaaatgtgacaccttactgtgcgatatcggagaatccagtcccaaccctacaatagaggagggtaggactcttcgggtcctgaagatggtggaaccgtggctacgcggcaatcagttttgtatcaagattctcaacccctacatgccaagcgtcgtggagaccctggaacagatgcagagaaaacacgggggaatgttggttaggaatcctctgtctcgaaactccacacatgagatgtattgggtatcatgcggcaccggtaatatcgtgagcgccgtcaacatgacttcgcggatgctccttaaccgtttcacgatggcgcacagaaagcccacatacgagcgcgacgtggatctgggggctggaaccaggcatgttgcagtggaacctgaggtcgccaatttagacattatcggccaacggattgaaaacatcaaaaatgagcacaagtctacttggcactatgatgaagacaacccatacaaaacctgggcttatcatggcagttacgaggtgaagccctccgggagcgcctcatccatggtaaatggagtggttagactgttgacaaagccttgggatgtcataccaatggtgacgcagattgcaatgaccgacactacaccctttggtcagcaacgcgtgttcaaagagaaggtcgacaccaggactccgcgagccaaacggggcacaacccagatcatggaagttacagctaagtggctctgggggtttctgtctagaaacaaaaagcctaggatctgtactcgcgaggagttcacccgtaaggtgcggagcaatgcggccattggagcagtatttgtggatgagaaccagtggaatagtgctaaagaagccgtcgaggacgagagattctgggatctagtgcacagggaacgcgagcttcataagcagggcaaatgcgcaacgtgcgtttataacatgatgggtaagcgagagaaaaagctgggggagtttggaaaggccaaaggctcccgggctatatggtacatgtggctcggcgccagattcctggagttcgaggcgttggggtttatgaatgaggaccactggttcagcagggaaaactctctgtcaggagtggagggtgaaggcctccataaacttgggtacatcctgcgcgatattagtaaaatcccaggaggcaatatgtatgcagacgataccgccggttgggacacaagaattactgaggatgacttacaaaacgaggctaagatcaccgatataatggaacccgagcacgccctgttggcaacatccatctttaaactcacttaccagaataaggtcgtgcgggtacagaggcctgctaaaaacgggaccgttatggacgtgattagccgtcgagatcagcgcggatctggccaagtcggcacgtatgggctgaacacattcaccaatatggaagtgcagctaatcagacagatggagtcggaaggaatttttcttccatcagagctggagactcccaacctcgccgaacgggtgctggactggttggagaagcacggtgctgaaaggttaaagcgcatggccatcagcggcgacgattgtgtcgttaaaccgatagacgatagattcgcaacagcgctgaccgccctcaatgacatggggaaggtgcggaaagatattcctcagtgggagccctccaagggatggaacgactggcaacaggtaccattttgcagtcatcacttccatcagcttatcatgaaagatggcagggaaatcgtggtcccttgtcgaaatcaggacgagctggtgggtcgtgctagagtttctcaaggggccggatggagcctacgcgagactgcatgcctgggcaagtcctacgctcagatgtggcagctcatgtattttcaccggagggatttgagactggccgcaaacgccatttgttcagcggtgcccgtcgactgggtgccaaccagtcgcacaacgtggtctatacacgctcatcaccaatggatgaccactgaagatatgcttagcgtatggaatcgggtttggatcgaggaaaacccctggatggaggacaagacacatgtgtcctcatgggaagaggtcccttacctgggcaaaagggaggaccagtggtgcgggagcctcattggattaaccgcccgagcaacttgggccacaaatatccaggtggctattaaccaggttagacggctgatcggtaatgaaaactatttggattacatgacctctatgaagaggttcaaaaatgagtccgacccagaaggcgccctgtggtga

SEQ ID NO: 13444 - RNA, 9879 nt, synthetic construct
  misc_feature 1..9879: note = derived and/or modified CDS sequence (opt3) from DENV-1__FJ898448__SS-prME
  source 1..9879: mol_type = other RNA
agcgtgaccatgctgctcatgcttctgcccaccgtcttgactttccacttaacgaccagaggaggggagcctcatatgatcgtttccaagcaggaaaggggaaaatctctgttatttaagacatcagccggtgtgaatatgtgcactctcattgctatggacctgggcgagctttgtgatgacaccatgacatacaaatgcccgcggataaccgaaactgagccggatgacgtagattgttggtgcaatgcaacagaaacctgggtgacgtatgggacttgtagtcaaaccggagagcaccgccgagacaagcgtagcgtcgccctggcgccccatgtgggcttgggtctcgagacaagaactgaaacctggatgtcctctgagggggcttggaggcagatccagaaagttgaaacatgggccctgcggcaccctggattcaccgtgattgcactgtttctcgcccatgctatcggcacgtcgattactcagaagggcatcatattcatcttactgatgcttgtcacaccatcaatggcaatgcgctgcgtggggattggaaatagagattttgtagagggtttgagcggcgccacctgggttgacgtggtcctggagcacgggagttgtgtgactacaatggctaaggataaacccaccttggacatcgaactcctgaagacggaggtgaccaatcctgccgtccttaggaaactgtgcattgaagcgaagatctccaacacaactaccgattctcggtgtccaacacaaggagaggcaactttggttgaagaacaagacaccaatttcgtgtgccgccgaacatttgtagatagaggctggggtaacgggtgtggactcttcggcaaaggcagcctgataacctgcgccaagtttaagtgcgtgactaaattagaggggaagattgtccagtacgaaaatctgaaatattccgtgatcgttacggtgcacacaggagaccagcatcaagtcggtaacgagaccactgaacacggcaccattgctacaatcacaccccaggcccctacttcagagatccagctcacagactacggggcacttacgctggattgtagtccaaggaccggattggacttcaatgaaatggtgctactgactatgaaggagaaaagctggctcgtacataagcagtggtttctggatcttccgctgccctggacatctggcgcttccacctcacaagagacatggaaccggcaggacttgctcgttactttcaaaaccgcccacgcgaagaagcaggaagtggtcgtgctgggtagccaagagggggccatgcacacggcattaaccggcgctacagaaattcagacaagtggaaccacaactatatttgccggccatctgaaatgccgtctaaagatggataaactcaccctgaaggggatctcttatgtcatgtgtacgggatccttcaaacttgagaaggaagtggctgagacacagcacggtaccgttttggtgcaggtaaagtacgagggcactgacgccccttgcaaaattccattcagctcgcaagatgaaaagggggtcacacagaatggacgcctggtgaccgcaaaccccatcgttactgacaaagagaagcctgtgaatatagaagccgagccaccctttggcgagtcttatattgtcgtgggtgctggggaaaaagcgctcaagctgtcctggttcaagaaaggctcaagtatcggaaagatgtttgaggcaaccgccagaggcgctaggcggatggccatccttggggatacagcatgggacttcggaagcattggtggcgtatttacgtccgtggggaaactggttcatcagatcttcggaaccgcctacggcgtcttgttttctggtgtgagctggactatgaagattgggataggcatcctcctgacatggttaggactgaactcacgaagtacctccctaagcatgacatgtattgctgtgggcatggtcactctctacctgggggttatggtgcaggccgattctggatgcgtgatcaattggaaaggccgcgaacttaagtgtggttcagggatcttcgtaaccaacgaggtccacacgtggacagaacaatataagtttcaggcagacagtccgaaaagattgagcgcggctattggaaaggcctgggaggagggcgtgtgcggtataaggtccgcaacccggctggaaaacatcatgtggaaacagatttctaatgagctcaaccatatcctgttagaaaatgacatgaagttcactgttgtggtcggcgatgtgtcggggattctggcccagggcaagaaaaccatccgccctcaacccatggagcacaaatacagctggaagtcctggggcaaggctaaaataatcggggccgacgttcagaacacaacttttattatcgatggaccaaatacccctgaatgtcccgacgatcagagagcatggaacatttgggaggtggaggactatggcttcggtatctttacaacgaatatatggcttaagttgagggattcatacacccaggtatgcgaccaccgtctcatgagtgctgccattaaagattctaaggcggtccatgccgacatggggtattggatcgaaagcgagaaaaacgaaacttggaagctggctcgggcatccttcattgaggtgaagacatgtgtgtggccaaaatcacacaccctatggagcaatggagtcctggaatctgagatgatcatacccaagatctacggcggtcctatttcccaacataactatcgaccaggctacttcactcagacagccgggccgtggcacctcggaaaactggagcttgattttgacttgtgcgaaggcaccacggttgtggtagatgagcactgcgggaatagaggacccagtctgaggactaccacagtgaccggcaagatcattcatgaatggtgttgccgcagctgtactttacctccactccggttcaaaggtgaggacgggtgctggtacggaatggagatcagacccgtcaaggaaaaggaggaaaacctggtgaaatctatggtttccgctggctcaggtgaggtggacagttttagccttggcctgttgtgtatatcgattatgatcgaagaggtcatgaggtcccgctggtctcgaaagatgctcatgacagggaccctggtggttttcctactgctcacactgggacagcttacttggaatgatttgatccggctgtgcattatggtgggcgccaacgcaagcgacaatatggggatgggaaccacgtatttagcgctcatggccacatttcgtatgagacctatgttcgctgtcggcctgctttttaggcgcctgacctcacgggaggtactactcctgactgtgggtttgagtctggttgcctccgtggaattaccaaactctctcgatgagctgggggacggacttgcaatgggcatcatgattctgaaattgctcaccgatttccaaagccaccagctgtgggctacactactgtcccttacttttgtcaagaccacgctctcactgcattacgcctggaaaacaatggcaatgatattgagcatcgtgagtctgttacccctctgtctgtctaccacttcccagaagacaacctggcttccggtactgttgggcagcctcgggtgcaagcctctgactatgttcctaattacagaaaacaaaatctggggaagaaagtcgtggccactgaatgagggtattatggccgtgggcatcgtctcaatacttctctctagtctgttgaaaaacgacgttcccttagctgggcctctgatcgcgggaggcatgctcattgcctgttatgtgatctccggtagctctgcagatctgagccttgaaaaggctgccaaagtgtcctgggaggaggaagccgagcactcaggggctagtcataatattctggtcgaaatccaggacgatggaaccatgaagataaaagacgaggaaagggatgacacgattactatcttgctaaaggcaaccctgctcgccatcagcggcgtgtaccccatgtctattccagcgacactgtttgtttggcacttctggcaaaagaaaaagcagcgatccggcgtactttgggataccccttcacccccagaggtggagaaagctgtcttagacgacgggatatatcgcatcctgcagcggggactcttgggtagaagtcaggtgggcgttggggtgtttcaagaaggagtcttccacacaatgtggcatgtgactaggggcgccgtactgatgtaccagggtaagcgtctcgagccgagctgggcatccgtcaaaaaggatctgatttcttatgggggaggctggcgcttccagggctcgtggaacaccggggaagaggtgcaggttatcgccgtggagcctggaaagaatcccaaaaacgtccaaacggctccaggtacatttaagactagcgaaggcgaggtgggggcaattgcccttgacttcaaacccggaacctcaggctcccctatcgttaatcgggaaggtaagatagtggggctgtacggaaacggcgtcgtgacaaccagtggcacttacgtatctgcgatcgctcaggccaaagcaagccaggaggggccattgcccgaaattgaggatgaggtgtttagaaagaggaatctaaccatcatggacctgcaccctggatccggtaagacacgacggtatctcccggccattgttcgcgaagctatcaaaagaaagttaaggacgctggtccttgccccaactcgggtggtggcatcagagatggctgaagccctgaaaggcatgcccatacgataccaaaccacagcggtcaagtctgagcataccgggaaagaaattgtagatctcatgtgccacgccactttcacaatgagattgctgagccctgtgcgcgttccaaactataatatgatcatcatggacgaggcacattttaccgatcccgctagtattgccgctaggggatacatctccacgcgtgtgggcatgggtgaggcagccgccatattcatgactgctacacctccggggagcgtcgaagcgtttccccagtctaacgcagtgattcaggacgaggaaaaggatatcccagagcggtcatggaactccggatatgactggattaccgatttccctggcaagaccgtttggtttgtgcccagtatcaaaagcggcaacgacatagccaattgtctcagaaagaacgggaaaagggtcattcagctgtcgcgcaagactttcgacacagaataccagaaaaccaagaacaatgattgggactatgtggtaacaactgatatctctgagatgggagctaactttcgagccgacagagtgatcgatccacggaggtgccttaagcctgttattctaaaagacggtcccgagcgcgtcatcctggcaggcccaatgccggtgacggtggcctccgctgcgcagcgtagagggcggattggaaggaatcagaacaaggaaggcgatcagtacatatacatgggtcaacctttgaataacgacgaggatcacgcccactggaccgaagcaaaaatgttactggacaatatcaacacacccgaggggattatcccagctctcttcgagcccgaacgcgaaaagagcgccgcaatcgatggcgaatatcgactgagaggagaggcccggaaaactttcgtcgaacttatgaggcgcggcgacctgcctgtttggctctcatacaaggtggctagtgaggggtttcagtattctgatagaaggtggtgcttcgacggagagcggaataaccaggtattggaagagaatatggacgtggaaatttggaccaaagagggtgaacgtaagaagctgcgcccacgatggctagatgccagaacatactccgaccccctggcgctcagggagtttaaagagttcgcagccggccggcgcagcgtctcaggggatcttatactggaaatcggaaagttacctcagcatttgacccaaagagctcagaacgccctggacaatctcgtgatgctgcacaacagtgagcagggcggtaaggcttataggcatgcaatggaggagcttccggatactattgaaacgatcatgctgctcgccttgattgctgttctgaccgggggcgtgacattatttttcctaagcggacggggcctggggaagacttccatcggactcctttgtgtcacctctagctccgccctgttgtggatggcatcagtagagccacactggatagcggcctctatcattctggagtttttcctcatggtgctgcttatccccgaacctgaccgacagagaacaccccaagataatcagctcgcttacgttgtgattggtctgttgtttatgatcctgaccgtcgccgcaaacgagatgggcttactagaaactactaaaaaggacctggggataggacacgctgccgcagagaaccatcaccatgccgctatgctcgatgtggaccttcacccagcgagtgcctggacgctgtatgcagtcgctaccactattatcacacctatgatgcgccataccattgagaataccacagccaacatctcgttgactgccatagcaaatcaggctgccatcctgatgggcctcgataagggttggcccattagcaaaatggacatcggggtgccactgcttgcgttaggctgctactcccaagttaaccctctgacgctcaccgctgccgtgttgatgctggtagcacactacgccattatcggaccgggcctacaggctaaggcaacaagggaagcccagaaacggactgcggctgggataatgaagaatcccaccgtggatggaattgtcgccatcgacctggacccagttgtgtatgatgcaaaattcgagaagcagctcggccaaatcatgcttctgattttgtgtacatctcagatcctgctcatgcgtaccacttgggccctgtgcgaatcaataacgttagctacaggtcctcttaccactctgtgggaggggagccccggaaagttttggaacaccacaattgccgtctccatggcaaatatcttcagaggcagttacctcgctggtgccggcctagcgttttctctgatgaaaagcctagggggaggcaggcgcgggactggagcccagggcgaaaccctgggtgagaagtggaaacggcagctcaaccaactttcaaagtccgagttcaatacatataaacgaagtgggattatcgaagtggacagaagcgaggcaaaggaaggactgaagaggggcgagacgaccaaacacgctgtatctcgcggtactgccaagttgcggtggttcgtggaaagaaacctggttaaaccagagggcaaggtgatagatctcgggtgtggacgtggcgggtggtcctactattgcgcaggactgaaaaaggtcacagaggtgaaaggctacaccaagggtgggcctggacatgaggagcccatcccgatggctacttatggctggaatctagtcaaacttcactcaggcaaagacgtgtttttcattccacctgaaaagtgtgatacactgctatgcgacatcggggagagctcgcccaacccaaccattgaagagggaaggacgctccgggttctgaaaatggtagagccctggttgcgcggtaatcagttttgtatcaagattctgaacccttacatgccgtctgtggtcgaaaccctcgagcagatgcagcgaaaacatggcgggatgcttgtgagaaatcccctgagtaggaactccacacacgaaatgtactgggttagctgcggaactggcaatatcgtgtcagccgtcaacatgacctcccggatgttactgaaccgcttcacaatggcccacagaaagccaacttatgagagggatgtggacttgggtgcggggacccgacatgtagctgtggagcctgaagttgcaaatctcgatataattggacaacggatcgagaacatcaagaatgaacacaaatctacatggcattacgacgaggataacccctataagacctgggcctaccacggcagctatgaagtcaaacctagtggctccgctagctctatggtgaatggggtggtccgtctgctaactaagccatgggacgttattcccatggtgacgcagatagccatgacagacaccactccttttggacagcaaagagtattcaaagagaaggtggatacccgcacaccaaaggcaaaaaggggtacggcccagatcatggaggtcaccgctaagtggctttggggctttctgtcacggaacaaaaagcccagaatttgtactcgcgaagagttcacaaggaaagtgcgaagtaatgcggccatcggggcagtttttgtggacgaaaaccagtggaactccgctaaggaggccgtcgaagatgagcggttctgggacctcgtgagaagggagcgcgaactgcataagcagggaaaatgcgcaacctgcgtatacaacatgatgggcaagcgtgagaaaaagttgggtgaatttgggaaagccaagggaagccgggctatttggtatatgtggctgggcgccagattcctcgagtttgaagcgcttggcttcatgaatgaggatcactggttctctagggagaactcgctgtcaggggttgaaggagagggtttacacaaactgggctacatcttgcgcgacataagcaagatcccagggggaaatatgtacgcagatgacactgccggctgggatacacgaattaccgaagacgatctccaaaacgaggctaagatcacagacattatggagcctgaacatgccctgctagcaacttccatctttaaacttacctatcagaataaggtggtccgggtgcagagaccagctaaaaacggtacggtgatggatgtcataagtaggcgcgaccagagagggtctggacaagttggcacctacggcctgaacacattcactaatatggaggcccagctcattcggcagatggaaagcgaggggatcttttccccctcagaactggagacccctaacttggctggaagggtgttagactggctggagaagcacggtacagaacgtctccgacgcatggccatcagtggcgatgactgtgtagtgaaaccaattgatgacagattcgcaactgcgcttaccgccctgaatgatatggggaaggtccggaaggacataccccagtgggagccgtctaaaggatggaacgattggcaacaggtgcctttttgcagccatcacttccaccagctaatcatgaaggacggcagggaaattgttgtgccctgtcgcaatcaggatgagctggtcggtagagctcgggtgtcccaaggggccggatggtcactcagggaaacggcatgcttgggcaaaagctatgctcagatgtggcagctgatgtactttcatcgacgtgaccttagactggccgcaaacgccatctgttctgcggtaccagttgattgggtgcctacatcccgcaccacttggagtattcacgctcatcaccaatggatgacaaccgaggacatgctcagcgtctggaatcgggtgtggatcgaggaaaacccctggatggaggacaagactcatgtttcgtcctgggaagatgtgccatatttaggcaaaagggaggaccagtggtgcgggtctctgataggattgaccgccagagcaacatgggccacgaatatccaggtcgctattaaccaggtgcgccggctgatcggtaatgaaaactacctcgattatatgacctcaatgaagaggttcaagaatgagagcgaccccgagggcgccctttggtga

SEQ ID NO: 13445 - RNA, 9879 nt, synthetic construct
  misc_feature 1..9879: note = derived and/or modified CDS sequence (opt3) from DENV-1__GQ868602__SS-prME
  source 1..9879: mol_type = other RNA
tccgtgaccatgctgctcatgcttctgcccactgccttggctttccacttaactacgcggggaggggaacctcatatgatcgtatccaagcaggaaaggggaaaatctctgctatttaagacctcagccggtgttaatatgtgcaccctcattgccatggacctgggcgaactttgtgaagatactatgacctacaaatgcccacggataacagagaccgaaccggacgatgtggactgttggtgcaatgcgactgagacatgggtaacctatgggacgtgtagtcaaactggagagcaccgccgagataagcgtagcgtggctctggcaccccatgtcggcttgggtctcgaaaccagaacagagacttggatgtcctctgaaggggcatggaggcagatccagaaagtggagacctgggccctgcggcaccctggattcacagttattgctctgtttctcgcccatgccatcggcacctcgattacgcagaagggcatcattttcatcttactgatgcttgtgactccatcaatggctatgcgctgcgtcgggattggaaatagggactttgtggagggtttgagcggcgccacatgggtagatgttgtgctggaacacgggagttgtgtcaccactatggcgaaggacaaacccacactagatatcgagctcctgaagaccgaagtgacgaatcctgcagtgcttaggaaactgtgcattgaggccaagatctccaacaccacaactgactctcggtgtccaacccaaggagaagctacattggtcgaggagcaggatactaatttcgtttgccgccgaacctttgtggacagaggctggggtaacgggtgtggactcttcggcaaaggcagcctgataacatgcgccaagtttaagtgcgtaaccaaattagaagggaagattgtgcagtacgagaatctgaaatattccgtcatcgtgactgttcacacgggagatcagcatcaagtgggtaacgaaacaaccgagcacggcactaccgcaacaattacaccccaggctcctacttcagaaatccagctcacagactacggggcccttacgctggactgtagtccaaggaccggattggatttcaatgagatggtcctactgactatgaaggagaaaagctggctcgtgcataagcagtggtttctggaccttccgctgccctggacatctggcgcgtccacctcacaagaaacatggaaccggcaggatttgctcgtaactttcaaaaccgcccacgcaaagaagcaggaggttgtggtcctgggtagccaagaaggggctatgcacacggccttaaccggcgctacagagatccagacaagtggaaccacaactatttttgccggccatctgaaatgccgtctaaagatggacaaactcaccctgaagggggtgtcttatgtcatgtgtacgggatccttcaaacttgaaaaggaggtggcagagacacagcacggtaccgttttggtgcaggtaaagtacgaaggcactgatgccccttgcaaaataccattcagctcgcaagacgagaagggggtcacacagaatggacgcctgatcaccgctaaccccattgtgactgataaagaaaagcctgttaatatcgaggcggagccaccctttggcgaatcttatctcgtggtcggtgcaggggagaaagccctgaaactttcctggttcaagaaaggctcaagtataggaaagatgtttgaagctaccgccagaggcgcaaggcggatggccattctgggggacacagcttgggatttcggaagcatcggtggcgtgtttacgtccgtagggaaattgatccatcagattttcggaaccgcctacggcgtgctcttttctggtgttagctggactatgaagatcgggattggcatactgttaacatggctgggactaaactcacgaagtacctccctcagcatgacatgtatcgcagtcggcatggtgactctgtaccttggggtgatggtccaggcggactctggatgcgttattaattggaaaggccgcgagttgaagtgtggttcagggatcttcgtgaccaacgaagtgcacacgtggacagagcaatataagtttcaggctgatagtccgaaaagactgagcgccgcaatcggaaaggcctgggaggaaggcgtatgcggtattaggtccgctacccggctcgagaacataatgtggaaacagatctctaatgaactgaaccatattttactggagaatgacatgaagttcactgtcgtggttggcgacgtgaacggggtccttgcccagggcaagaaaatgatccgccctcaacccatggaacacaaatactcgtggaaaagctggggcaaggcaaaggtgattggggctgatgttcagaatatcacctttataatcgacggaccaaacacacctgagtgtcccgatgaccagagagcctggaatatttgggaggtggaagattatggcttcggtatctttactaccaacatttggttgaagctcagggactcctacacacaggtatgcgatcaccgtctgatgtcagcggccatcaaagacagtaaggctgtccatgcagatatggggtattggatagagtctgagaagaatgagacgtggaagctaacccgggccagcttcattgaagtgaagacttgtatctggccaaaatcccacacactgtggtcaaacggagtgctcgagagcgagatgattatccccaagatatacggcggtcctatctctcaacataattatcgaccaggctacttcacccagactgctgggccgtggcacctgggaaaacttgaattggactttggcctgtgcgaggggacaaccgtcgttgtggatgaacactgcggaaacagaggcccctccttaaggacgactaccgtaacaggtaagattatccatgagtggtgttgccgcagttgtaccctccctccactgcggttcaaaggggaggacggatgctggtacggcatggaaattagacccgtgaaggagaaggaagagaatcttgtcaaaagcatggtgtctgccggttccggcgaagttgattcatttagtctggggttgctctgtatcagcataatgattgaggaggtgatgaggtcgcgctggtcccgaaagatgctgatgactggaacactagcagtcttcctgctcctgatcatgggccagcttacctggaacgacttgatccggctgtgcattatggtgggggcgaatgcctctgacaaaatgggaatgggcacaacttatttagctctcatggccacctttcgtatgagacctatgttcgcagttggtctgctttttaggcgcctgacgagccgggaagtgctactcctgacagtcgggttgtcactggtagctagtgtggagttaccaaactccctcgaagaactgggagatggccttgccatgggcatcatgatgctgaagttgctcaccgacttccaatctcaccagctgtgggcaactctactgagccttacctttgttaaaacaactttctccctccattacgcctggaagaccatggctatgattctgtcaatagtgagcttgtttcccctgtgtttaagtacgacatctcagaagaccacttggctcccggtcctgcttgggtccctgggatgcaaacctttgacaatgttcctcatcaccgaaaacaagatttggggtagaaaaagctggccactgaatgagggcatcatggcggtggggattgtatcgatcctactgtcatctcttctcaagaacgatgtgcccctggccggacctttgatagcaggcggtatgttaatcgcttgttatgtcattagtgggtccagcgccgacctgtctctcgagaaagccgctgaagttagctgggaggaagaggcagaacactccggagcctcacataatatcctggtggaggtgcaggatgacggcactatgaagattaaagatgaggaaagggacgatacacttaccatcctgttgaaggcgacgctactggctataagtggcgtctaccccatgagcattccagccactctctttgtgtggtatttctggcaaaagaaaaagcagcgatctggggttctgtgggacaccccttcacccccagaggtagaacgcgcagtgcttgatgacggaatctaccggatcttacagagaggtctgctcggcaaaagccaggtcggggtgggagttttccaagagggcgtgtttcacacaatgtggcacgtcaccaggggtgccgtgttgatgtatcaggggaagcgtctggagccgagttgggctagcgtcaaaaaggatctcatttcctacggaggcggctggcgcttccaggggtcttggaacatgggagaagaggtccaggtgatagcagttgaacctggtaagaatcccaaaaacgtgcaaacagccccaggcacttttaagacccccgagggggaagtcggagcgatcgctctggacttcaaacctggcacgtcgggtagcccaattgtgaatcgggaggggaagatcgttggactttacggcaacggcgtggtcacaacttcagggacctatgtgtccgccattgcacaggccaaagctagtcaggagggacccctgcctgaaatcgaggacgaagtatttagaaagaggaatttgacaataatggatctacatccgggttctggcaagacccgacggtacctgccagccatcgtgcgcgaggcaattaaaagaaagctcaggactttagttctggctcccacccgggtcgtggccagcgaaatggcggaggcccttaaagggatgcctatccgatatcaaacaacggcagtgaagtccgagcacactggaaaagaaattgtcgacctgatgtgccatgctaccttcacaatgagactcttgtcaccagtacgcgtgcccaactacaatatgatcataatggatgaggcccactttaccgaccctgcttctattgcagccaggggctatatcagcactcgtgttggtatgggggaagccgctgcgatcttcatgacagcaaccccgcccggaagtatggaggcctttccacagtccaacgctgccattcaggatgaagaacgggacatccctgagagaagctggaactctggctacgattggataacggacttccccggcaagactgtgtggtttgtcccatcaattaagtccgggaacgatatcgcaaattgtctgaggaaaaacggaaagcgcgtggttcagctcagtcgaaaaacattcgacaccgaatatcaaaagaccaaaaacaatgattgggactacgtggtcactacagacattagcgagatgggtgccaacttcagagctgatcgggtgatcgaccctaggcgctgcctgaagcccgtaatacttaaggatggcccagaacgtgtgattctagcggggccgatgcctgttaccgtcgcctcggcagctcagagacggggaaggatcggccgcaatcagaacaaagagggtgaccagtacatctatatggggcaacccctgaataacgatgaggaccatgcccactggacagaagcaaagatgttgttagataatattaacactccagagggcatcattcccgccctgtttgaacctgagcgagaaaaatctgctgccatagacggagagtacagactccggggcgaggcgaggaagacgttcgtggaactgatgcgcagaggggatcttccagtgtggctgtcctataaagtcgcaagcgagggatttcagtactcagacaggcggtggtgcttcgatggtgaacgtaataaccaggttctcttgaagaatatggacgtggagatctggaccaaagaaggcgagcgcaagaagctgcgacccagatggctagatgccaggacatatagtgaccctctggctctccgggagtttaaagagttcgccgctgggcgcagatctgtatccggagaccttattctggagatcggcaagttaccgcagcacttgactcaaagggcacagaacgccctggataatctcgtgatgctgcataacagcgaacagggtgggaaggcttaccggcacgccatggaggaacttccagacaccatcgagacactgatgctcttggcactgattgcggtcttaaccggcggagtgactctatttttcctgtcaggccgagggctcggaaagacgagtataggtcttctgtgtgttatggccagctccgctttgctgtggatggcctctgtggagccccattggatcgcagctagcattatcctcgaatttttcctgatggtccttctcattcctgagcccgatagacagcgcaccccacaagacaatcagctggcctatgtagtgatcggcttgctgtttatgatattaacagttgcagccaacgaaatggggctactggagactaccaaaaaggatctcggaatcggccacgtggctgcggagtcccaccatcacgccgcaatgcttgacgtcgatctgcatcctgcttcagcctggacattgtacgccgtggcaaccactattatcacacccatgatgaggcacacgattgaaaacaccactgctaatatctctctgacagccatagcgaaccaggctgccattctcatgggtctggacaaggggtggccaatcagtaaaatggatattggcgtccctcttttagcactgggatgctactcgcaagtgaatccgctcaccttgaccgccgctgttctgatgctagtggcacattatgccatcataggccccgggctgcaggcgaaggctacacgggaggcccagaaacgtactgcagccggaatcatgaagaacccaacggtagacggcattgtggctatcgatctcgaccctgtcgtttacgatgccaaattcgaaaagcagcttggtcaaattatgctgttgatcctgtgtaccagccagatactcctgatgagaacaacttgggcattatgcgagtccattacccttgctacagggcccctgaccactctctgggaaggatctccaggcaagttttggaatacgacaatcgccgtgtcaatggcgaacatcttcaggggtagctatctagccggcgcagggctggctttctccttgatgaaaagtctgggaggcgggcgccggggaaccggcgcccagggtgagactctcggggagaagtggaaacgacagcttaatcaactgtctaagagcgaatttaacacctacaaaagatcaggaattatcgaggtcgacaggtccgaagcaaaggagggcttgaagcgcggtgaaacaactaaacacgctgtgagtcggggcaccgccaagctgagatggttcgtagagcgtaatctcgtgaaacctgaggggaaggttatagacttaggatgtggcagagggggatggagctattactgcgccggcctgaaaaaggtgacagaagtcaaaggttatacgaaagggggacccggccacgaggaaccgattccaatggcgacctacggctggaaccttgtgaagctgtactctgggaaagatgtctttttcactcctcccgagaagtgtgacacactactctgcgatatcggagaatcctcaccaaatcccaccattgaggagggtcggactctgcgcgtgttgaaaatggttgaaccttggctgcgaggcaaccagttttgtatcaaggtactcaatccgtatatgcccagcgtggtcgagacacttgaacagatgcagagaaaacatgggggaatgctggtgaggaacccattatcgagaaattctacccacgagatgtactgggttagttgcggcacgggtaacatagtgtccgctgtcaatatgaccagccgcatgctgttgaacagattcacaatggcacataggaagcctacttatgagcgagacgtggatctcggggccggaacccggaacgtagctgtggaacccgaggttgccaatctggacatcattggccaacgtatcgaaaacattaagaatgagcacaaatcaacatggcactacgatgaagacaacccttataagacttgggcataccatggctcctatgaggtcaaaccatctgggagcgccagttccatggtgaatggagtggtcagactacttaccaagccctgggatgttatccctatggtgacacagattgctatgaccgacactacgccatttggtcagcaacgcgtattcaaagagaaggtggatacaaggacccccaaggcgaaacggggcactgcccagatcatggaagtcaccgcaagatggctgtgggggtttctcagccgcaacaagaaaccgaggatatgtacacgagaggagttcacgcggaaggtgagatctaatgctgccattggagcagtttttatcgacgagaaccagtggaactcagccaaagaagctgtggaggacgagaggttctgggatctggtccaccgcgaacgtgagttgcataagcagggcaagtgcgcaacctgcgtgtacaacatgatgggtaaacgggaaaagaaactgggggagtttggaaaggcgaaaggcagtagagcaatctggtacatgtggctcggcgccaggttccttgagttcgaggctctggggtttatgaatgaggaccactggttctcccgcgaaaacagcttatctggagtagagggtgaaggcctgcataagttggggtatattctccgagatatatcgaaaatccctggaggcaatatgtacgccgacgatactgcaggttgggacacacggattaccgaggatgacctgcaaaacgaggctaagatcactgatattatggaaccagagcacgccctacttgctacatcaatctttaagctgacctatcagaataaagttgtgagagtccagaggcccgccaagaacgggacagtgatggacgtgataagccgcagagatcagcggggatccggccaagtcggcacttacgggctcaacaccttcacgaatatggaagcacagctgatcaggcagatggagagtgaaggaatatttttgccttctgagttagagaccccaaacctggcggaacgtgttctcgactggcttgagaaacacggtatcgaacgactgaagcgcatggccattagcggcgatgactgtgtggtaaaacccatcgacgatagattcgctacagccctaactgcactgaatgacatggggaaggtgcggaaggatataccgcagtgggagccttccaaaggatggaacgactggcaacaggtccccttttgctcacatcacttccatcagctcattatgaaggatggcagggaaatcgtggttccatgtcgcaatcaggacgagttggtgggtagagctcgggtcagtcaaggggccggatggtctctgagggagaccgcatgccttggcaaaagctatgcccagatgtggcagctgatgtactttcaccgacgtgatctcagattagcggctaacgccatctgttccgcagtgcctgtagactgggttcccacatcacgcactacctggagcattcacgcccatcaccaatggatgacgacagaagatatgctgtctgtgtggaatcgggtctggatagaggaaaacccatggatggaggacaagacccatgtgtccagttgggaagatgttccctatttgggcaaaagggaggaccagtggtgcgggagcctgatcggactcactgctagagccacatgggcaaccaatattcaggtggctatcaaccaggtccgccggcttattggtaatgagaactacctggactacatgacttcgatgaagaggttcaagaatgaaaacgatcctgagggcgccctatggtga

SEQ ID NO: 13446 - RNA, 9879 nt, synthetic construct
  misc_feature 1..9879: note = derived and/or modified CDS sequence (opt3) from DENV-1__KF921911__SS-prME
  source 1..9879: mol_type = other RNA
agcgtgaccatgctgctcatgcttctgcccaccgccttggctttccacttaactacgagaggaggggagcctcatatgatcgtctccaagcaggaaaggggaaaatctctgttatttaagacctcagttggtattaacatgtgcacactcatagcaatggacctgggagagctttgtgaagatactatgacctacaaatgcccacggatcacagaggccgaaccggacgatgtggactgttggtgcaatgcgaccgatacttgggtaacatatgggacctgtagtcaaacgggagagcaccgccgagacaagcgtagcgtggctctggcaccccatgtcggcttgggtctcgagactagaaccgaaacatggatgtcctctgagggggcatggaaacagattcagaaggtggaaacttgggccctgaggcaccctggattcaccgttacagctctgtttctcgcacatgccatcggcacctcgattacgcagaagggcatcatattcatcttactgatgcttgtgactccatcaatggctatgcggtgcgtcgggattggaaaccgcgattttgtggagggtttgagcggcgccacatgggtagacgttgtgctggagcacgggagttgtgtcaccactatggcgaaagataagcccacactagacatcgaactcctgaaaaccgaggtgacgaatcctgcagtgcttagaaagctgtgcattgaagccaaaatctccaacaccacaactgattctaggtgtccaacccaaggagaggctacattggtcgaggaacaggacagcaatttcgtttgccggcgcacttttgtggatcgaggctggggtaacgggtgtggactcttcggcaagggctccctgttaacctgcgccaagtttaaatgcgtaacaaagctggaggggaaaatagtgcagtacgaaaatctcaagtattcagtcattgtgaccgttcacactggagaccagcatcaagtgggtaacgagacgacagaacacggcaccatcgcaactattacaccccaggctcctacaagtgagatccagcttaccgactacggggccctgactttggattgtagcccaagaacaggactagacttcaatgaaatggtcctgctcacgatgaaagagaagtcttggctggtgcataaacagtggtttcttgatctgccgttgccctggacctccggcgcgtcaactagccaagagacatggaacaggcaggacctcctggtaaccttcaagacagcccacgcaaagaaacaggaagttgtggtcttaggtagtcaagagggggctatgcacactgccctgaccggcgctacggaaatccagacctctggaacaactaccatttttgccggccatctaaagtgccggctcaaaatggataagctgacacttaaagggatgtcctatgtgatgtgtactggcagcttcaagttggagaaggaagtcgcagagacccagcacggtacggtgctggttcaggtgaaatacgagggcacagacgccccttgcaagataccattctcggctcaagatgaaaaaggggtaacccagaatggacgtctcatcactgcgaaccccattgtcacagacaaggagaaacctgtgaatatcgaaaccgagccaccctttggcgagtcttatatagttattggtgcaggggaaaaggccctgaaactttcctggttcaaaaagggctcaagtatcggaaaaatgtttgaggctactgcccgcggcgcaagaaggatggccatcctgggggataccgcttgggacttcggaagcattggtggcgtgtttacatccgtcgggaagttggtgcatcaggtattcggagccgcatacggcgtgctcttttctggtgttagctggacgatgaaaatcgggattggcatactgttaacctggctgggactaaactcacggagtacttccctcagcatgacatgtatcgcggtcggcatggtgaccctgtaccttggggtgatggtccaggctgattctggatgcgttattaattggaagggccgagaattgaagtgtggttcagggatcttcgtgacaaacgaggtgcacacttggaccgaacaatataaatttcaggccgacagtccgaagcgcctgagcgcagccatcggaaaggcttgggaggagggcgtatgcggtattagatccgccacgaggctcgaaaacataatgtggaagcagatctctaatgagctgaaccatattttactggaaaatgacatgaaattcacagtcgtggttggcgatgcaaacgggatccttgctcagggaaagaaaatgattcggcctcaacccatggagcaccgctactcgtggaaaagctggggcaaggccaaaatcataggggcggacatccagaataccacttttattatcgatggaccagacacccctgaatgtcccgatgaccagagagcctggaacatttgggaggtggaggattatggcttcggtatctttacaactaatatatggttgaagctcagggactcctacacccagatgtgcgatcaccgtctgatgtcagctgcaattaaagacagtaaggccgtccatgctgatatggggtattggatcgaatctgagaaaaacgaaacatggaagctagcccgggccagcttcattgaggtgaagacgtgtatctggccaaaatcccacaccctgtggtcaaatggagttctcgaaagcgagatgataatccccaagatttacggcggtcctatctctcaacataactatcgaccaggctacttcactcagacagcggggccgtggcacctgggaaaacttgagttggactttgatctgtgcgaaggcaccactgtggtagtcgacgagcactgcgggaatagaggaccctccttaaggacaaccacggtgactggcaagattatccatgaatggtgttgccgcagttgtaccctccctccactgcggttcagaggtgaggacgggtgctggtacggaatggagataaggcccgtgaaagaaaaggaggaaaaccttgtccgcagcatggtttctgccggctccggtgaggtggattcatttagtctgggcattttgtgtgtaagcatcatgatcgaagaggtgatgcgatcgcggtggaatcgtaagatgctcatgacagggaccctggctgtcttcctactgctcattatgggacagctgacttggaacgaccttatcagattgtgcattatggtgggcgccaatgcatccgataggatggggatgggaacaacctatctggctttaatggccacatttaaaatgcgccctatgttcgcagttggcctcctgtttcggagacttacttctagggaggtgctgctactcaccataggtctgagcttggtcgcctcagtggaactgccaaacagtttagaggaactcggggacggactggctatgggcatcatgatgcttaagctgttgacggagttccaaccccaccagctctggacaaccctgctatccctgacttttattaaaaccacactttctctcgattacgcgtggcgaactatggccatggttctgagcatcgtgtccttgttcccgctgtgtttatcaaccacgagccagaagacaacctggctccctgtcctgcttggcagttttgggtgcaaaccactgactatgttcttgattacagaaaacaagatctggggacgcaagtcttggcccctcaatgagggtataatggcaatcggcattgtatccatcctgctaagctcgctgcttaaaaacgacgtgcctctcgctgggcccctgattgccggaggcatgttgatcgcctgttatgttatatcaggttctagtgctgatttatccctggagaaggcagccgaagtgagctgggaggaagaggcggaacattctgggaccagccacaatattctcgtcgaggtgcaggacgatggaactatgaaaatcaaggacgaggaacgggatgacacactgaccatccttctgaaagctacgttgctagccgtatccggcgtgtacccaatgtcaattcctgcaactctgtttgtctggtatttctggcaaaagaaaaagcagagaagtggcgttctctgggatacccccagcccaccggaggtggaaagggccgtgctggacgacgggatataccgtatccttcagcgcggattactgggtcggtctcaggtcggcgtgggggttttccaagatggagtatttcatacaatgtggcacgtgaccagaggcgctgtcctcatgtatcagggtaagaggttggagccttcctgggcatcagtgaaaaaggacctgattagttacgggggaggctggcgattccagggcagctggaacacaggggaggaagttcaggtgatcgccgtcgagcccggcaagaatccaaagaacgtgcaaactacccccggtacgtttaaaacacctgaaggcgaggtaggggcgattgctctcgatttcaagccaggaacttccggctctcccatcgtcaatcgggaaggtaagatagtgtcgctgtacgggaacggagttgtgaccacaagcggcacctatgtctcagccatcgcacaggccaaaacttcccaggagggccctcttccggagattgaagacgaggtgtttaagaaacgcaatctgaccatcatggatttgcacccagggagtggaaagacaagaaggtacctacccgctattgttcgggaagccatcaaacgaaagctgagaacgctcatattagcacctactcgcgtggtcgcttctgagatggccgaagcgctgaagggtatgccaattaggtatcaaaccacagccgtgaaaagcgagcataccggccgtgagatcgtagaccttatgtgccacgcaactttcacaatgcggctgctctcccccgtgagagttcctaactacaatatgatcattatggatgaagctcattttaccgacccggcctcaatcgctgcaagggggtatatatctacgcgcgtcggaatgggcgaggccgccgctattttcatgactgcgacacccccaggtagcgtggaagcatttcctcagagtaacgccgtgatccaggatgaggaacgagacattcccgagagatcctggaatagcgggtacgattggatcaccgacttcccaggaaagaccgtctggtttgtaccttctataaaatcaggcaacgacattgctaattgtttgcggaagaacggcaaaagggtgatccagctgtcccgcaagactttcgatacagagtatcaaaagaccaaaaacaatgactgggattacgttgtgacaactgacatcagtgaaatgggggccaacttccgtgcagatagagtcattgacccccggaggtgcctcaagccagtgatcctgaaagatggaccggagcgcgttattcttgccggtcctatgcccgtgacggtcgctagcgcggcccagcgaagaggccggatagggaggaatcagaacaaggaaggagaccagtacgtgtatatgggccaaccactaaataacgatgaggaccacgcacattggaccgaggctaaaatgctgttggataatatcaacacacccgaaggtattatccctgccttatttgagccagaacgcgagaagtcggcagccatcgacggggaatacagactgaggggcgaggctcggaagactttcgtagagctcatgcgtcgcggagatctgcccgtgtggctttcttataaagttgcctccgaaggctttcagtacagcgaccgaagatggtgcttcgacggggagaggaataaccaggtcctggaagagaatatggatgtggaaatttggaccaaggagggagagcggaaaaagctccgccctagatggttggacgcgaggacatattcagatccgctggcactacgggaatttaaagagttcgccgctggtcgaagaagtgtgtctggcgacctgatactcgaaatcgggaaacttccacagcacctgaccttacgcgcccaaaacgctttggataatctggtcatgctccacaactccgagcagggaggcaaagcatacaggcatgccatggaggaactgcccgacactattgagacgcttatgctgctcgctttgatcgccgttctgaccggtggggtgacattatttttcctaagcggcaagggactgggcaagacttcaattgggctcctttgtgtaatggcaagtagcgcgctgttgtggatggccaatgtggaacctcactggatcgctgcctccataatcctggagtttttcctcatggtcctgcttattcccgaaccagatcggcagcgtacccctcaggacaaccaactcgcatatgtggttatcggactgttgtttatgattctgacagtggctgccaacgagatgggtttactagagaccactaaaaaggatctgggcatcgggcatgtcgcagccgaaaatcagcaccacgctacaatgctcgacgtagatcttagacccgcgtctgcctggacgctgtacgcagtggctaccactgttataacaccaatgatgaggcataccattgagaacaccacagccaatatcagcttgactgccattgcaaaccaggctgccatcctgatgggactcgacaaaggctggcctatatccaagatggatatcggtgtgccgctgcttgcgttagggtgctactcacaagtcaatcccctgacgctcaccgctgccgtgttgatgctggtcgcacactatgccattatcggcccaggactacaggctaaagcaacacgcgaagcccagaagcggactgcggctggcattatgaagaaccctaccgtggacgggatcgttgccatagacctggatcccgtggtatacgacgcaaaattcgagaagcagctcggacaaattatgcttctgatcttgtgtacatctcagatcctgctcatgcgaaccacttgggccctgtgcgaaagtattacgttagctacaggcccacttaccactctgtgggagggttcgcctgggaaattttggaataccacaatcgccgtgagcatggcaaacatattcagaggatcctatctcgctggcgccggtctagcgttctctctgatgaagtcattgggcgggggaaggcgcggcactggggcccagggagagaccctgggcgaaaaatggaagcggcagctcaatcaacttagcaagtccgagtttaacacatacaaaagaagtggtattatggaagtcgatcgttctgaggcaaaggaagggctgaaaaggggagagacgaccaagcatgctgttagccggggcactgccaaattgcgctggttcgtggagcgaaatctggtcaagcccgaaggtaaggtgatcgacctcggctgtgggagaggaggctggtcatattactgcgcagggctaaagaaggtaacagaggtgaaaggatataccaagggcggtccggggcacgaggagccaattcctatggctacttacggatggaacctggttaaactttactccggcaaggatgtgtttttcacacccccagaaaaatgtgacaccctgctatgcgatatcggcgagagtagccccaatcctacgatagaggaagggaggaccctccgggtcctgaagatggtggagccgtggttgcgcggaaaccagttttgtatcaagattctgaatccctatatgccatctgtcgtggaaacactcgagcagatgcagagaaaacatggtggcatgcttgttaggaaccctctgtcccgaaattcaactcacgagatgtactgggtaagctgcgggaccggaaacatcgtgtcggccgtcaacatgacatctcggatgttactgaatcgtttcactatggcccacagaaagcccacctatgaacgcgacgtggatttgggcgcgggtacaaggcatgttgctgtggagcctgaagtcgcaaacctcgacattatcgggcaacggattgagaatatcaaaaacgaacacaagagtacctggcattacgatgaggacaatccatataaaacttgggcctaccacggatcctatgaggtgaagcccagcggctcagcttcctctatggtaaacggcgtggttagactgctaacgaagccttgggacgtcataccaatggtgacacagattgccatgaccgatactaccccctttgggcagcaacgcgtgttcaaagaaaaggtcgacacaaggacgccgcgagcaaaacggggaaccgcccagatcatggaggttactgctaagtggctttggggttttctgagcagaaataaaaagcctaggatctgtacacgcgaagagttcacccgtaaggtgcggagtaacgcggccattggcgcagtatttgtggatgaaaatcagtggaactccgctaaagaggccgtcgaggacgaaagattctgggatctcgtgtacagggagcgcgaactgcacaagcaggggaaatgcgcaacttgcgtttacaatatgatgggaaagcgagagaaaaagttgggcgaatttggtaaggccaaagggagccgggctatatggtatatgtggctgggagccagattcctcgagttcgaggcgcttggctttatgaacgaagaccattggttctctagggaaaattcatttagtggcgtggaaggggagggactgcacaagttaggttacatcctgcgcgatatttccaaaatcccaggcgggaacatgtatgcagacgatacagccggatgggacaccagaattacagaggatgacttgcaaaatgaagctaagatcactgatataatggagcccgaacatgccctcctggcaaccagcatcttcaaactaacgtaccagaacaaggtcgtgcgggtacagaggcctgctaaaaacggcaccgttatggacgtgatttctcgtcgagaccagcgcggttcggggcaagtcggaacatatggccttaatacttttaccaacatggaggtgcagctgatcagacagatggaatcagagggcattttcctcccaagcgagctggaaacacccaatttggccgagcgggtgttagattggctggaaaagcacgggactgagaggctcaagcgcatggctatctccggagacgattgtgtcgttaaaccggtggacgatagatttgccaccgcacttatagcgctgaacgacatgggtaaggtacggaaagatattcctcagtgggaacccagtaagggctggaatgactggcaacaggtgccattctgctctcatcactttcaccagctaatcatgaaagatgggagggagatcgtcgtgccttgtcgaaaccaggacgagctggttggacgtgccagagtgagccaaggcgctggttggtccctccgcgaaacggcctgcttggggaagtcatacgcacagatgtggcagctgatgtatttccatcggagggatcttagactggctgccaatgcaatttgtagtgccgtccccgtggactgggtaccaacatctcgcaccacttggagcatacacgcgcatcaccaatggatgacaaccgaggacatgctctccgtttggaaccgggtgtggatcgaagagaatccctggatggaagataagactcacgtctcaagctgggaggaggtgccttacttaggaaaaagggaagaccagtggtgcggctctctgattggcttgaccgctcgagccacatgggcaacgaacatccaggttgccattaatcaggtgagacggctgatcgggaacgagaattacctcgattatatgacctccatgaagaggtttaaaaacgaaagtgacccagagggagctctttggtga

SEQ ID NO: 13447 - RNA, 9879 nt, synthetic construct
  misc_feature 1..9879: note = derived and/or modified CDS sequence (opt3) from DENV-1__KJ189350__SS-prME
  source 1..9879: mol_type = other RNA
agcgtgaccatgctgctcatgcttctgcccacagccttggctttccacttaactacgagaggcggggagcctcatatgatcgtctccaagcaggaaaggggaaaatctctgctatttaagacctcagcaggtgttaacatgtgcacactcattgccatggacctgggcgagctttgtgaagatactatgacctacaaatgcccacggataacagaggcggaaccggacgatgtggactgttggtgcaatgctaccgatacttgggtaacatatgggacctgtagtcaaaacggagagcaccgccgagagaagcgtagcgtggccctggcaccccatgtcggcttgggtctcgaaacgagaactgagacctggatgtcctctgaaggggcctggaaacagatccagagggtggagacatgggctctgcggcaccctggattcactgttattgcatttttcctggcccatgctatcggcacctcgattacacagaagggcatcatatttatcctcttaatgctggtgaccccatcaatggccatgcgctgcgtcgggattggaaatagagacttcgtggagggtcttagcggcgcgacgtgggtagatgttgtgttggaacacgggagttgtgtcactacaatggcaaagaacaaacccaccctggacatcgagctactcaagactgaagtgacaaatcctgccgtgctgaggaaactttgcattgaggctaagatctccaacaccacgaccgattctcggtgtccaacacaaggagaagccactctggtcgaggagcaggacgcaaattttgtttgccgccgaaccttcgtggatagaggctggggtaacgggtgtggattgtttggcaaaggcagcctcctgacatgcgctaagttcaagtgcgtaactaaattagaagggaagatagtgcagtacgagaatctgaaatattccgtcattgtgaccgttcacacaggagaccagcatcaagtgggtaacgaaaccactgagcacggcacgatcgccacaattaccccccaggcgcctacttcagaaatccagctcaccgattacggggcccttacactggactgtagtccaaggaccggattggactttaatgagatggtcctactgactatgaaggagaaaagctggctcgtgcataagcagtggttcctggatcttccgctgccctggacatctggcgcatccacgtcacaagaaacctggaaccggcaggacttgctcgtaacttttaaaacagctcacgccaagaagcaggaggttgtggtcctgggtagccaagaaggggctatgcacaccgccttaacaggcgcaactgagatccagaccagtggaacgaccacaattttcgccggccatctgaaatgccgtctaaagatggataaactcactctgaaggggatgtcttatgtgatgtgtaccggatccttcaaacttgaaaaggaggtcgctgagacacagcacggtactgtgttggttcaggtgaagtacgaaggcaccgacgcgccttgcaaaataccatttagcacgcaagatgagaagggggtaacacagaatggacgcctgatcaccgcaaaccccattgtcactgacaaagaaaagcctgtgaatatcgagacagagccacccttcggcgaatcgtatatagttgtgggtgccggggagaaagctctcaagctgtcttggtttaagagaggctcctcaattggaaaaatgttcgaagccaccgcaaggggcgcccggcgaatggctatccttggggatactgcctgggactttggaagtatcggtggcgtcttcaccagcgtggggaagctggtacatcagatttttggaacagcatacggcgtgttgttctccggtgtttcttggacgatgaaaatcgggattggcatactcctgacctggttaggactgaacagccgctcaactagtctatccatgacatgtatcgcggtcggcatggtgaccctctacctgggggtgatggtccaggctgatagcggatgcgttattaactggaagggcagagagcttaaatgtggttctgggatctttgtgacaaatgaagtgcacacttggaccgagcaatataagttccaggccgactcaccgaagaggttgagtgcagccatcggaaaagcttgggaggaaggcgtatgcggtattcggagcgccacgcgcctggagaacataatgtggaagcagatctccaatgaactcaaccatattctgttagagaatgatatgaaatttacagtcgtggttggcgacgcaaacgggatcctggctcagggaaagaaaatgattagacctcaacccatggaacacaagtactcttggaaatcgtggggcaaggccaagatcataggggcggacatccagaataccactttcattatcgatggaccagacacccctgagtgtcccgatggccagagggcctggaacatttgggaggtggaagactatggttttggggtcttcacaactaatatctggcttaaattgcgtgatagctacacccagatgtgcgaccaccggctcatgtccgctgcaataaaggattcaaaagccgtgcatgctgacatgggatattggattgagagtgaaaagaacgagacatggaaactggcccgagcatctttcatcgaagttaagacgtgtacctggccaaagagccacactctatggtccaatggcgtgctggagtcagagatgattatccccaaaatatacggtggccctatcagccaacataactatagaccagggtactttacacagaccgcgggaccgtggcacctcggcaagctggaacttgatttcgacttgtgcgaggggactacagtagtcgtggatgaacactgcggaaataggggcccctctctgcgcaccacgactgtgaccggtaaaattatccatgagtggtgttgccggtcctgtacattacctccactcagatttaggggggaggacggatgctggtacggcatggaaattcgccccgtcaaggagaaagaagagaacctggttcgaagtatggtgagcgccggttctggcgaagtagattccttctcacttgggatcctgtgtgtgagtataatgattgaggaggtcatgcggagccgttggtcgagaaagatgttgatgaccggaactctcgctgtgtttctgctactgatcatgggccagctcacatggaatgacctgatcaggctttgcattatggttggggccaacgcatccgaccgcatgggaatgggcaccacatatttggctctgatggccactttcaagatgcggcctatgtttgcagtgggtttactcttcagaaggctgacctctcgagaagtccttctgctaacgatcgggctcagcctggtggcctcagttgagttgccaaacagtctggaagagttaggagatggcctcgctatgggcattatgatgctgaaacttctgacagaatttcaaccccaccagttgtggaccactctcctgtccctaaccttcgtgaagacaactctgtctcttgactacgcgtggaaaaccacggccatggcactcagcatagtctccctgtttccgttgtgtctgtcaacaaccagccagaagactacatggttacctgtactcctggggagtttcggatgcaaaccacttaccatgtttctgatcactgagaataagatttggggtcgcaagtcttggcccttgaacgagggcatcatggctattgggatcgtgtccatactcctgagctcgctactgaaaaatgatgttcctcttgccggacccctcatcgccggcggtatgctgattgcttgttatgtgatctcagggtctagtgcagacttgtccttagaaaaggccgcggaggtcagctgggaacaggaggctgaacattctggagccagccactccattctggtggaggtacaagatgacggcacaatgaaaatcaaggatgaggaacgggacgataccctcacgatactgcttaaagcaactctgttggccgtgtcaggcgtctacccaatgagtattcctgctaccctattcgtttggtatttctggcagaagaaaaagcagagaagcggggtgctgtgggacacaccctctccaccggaggtggaaagggcagtcctcgataacggaatctaccgtatcctgcagcgcggtcttttaggccggtcccaagtgggggttggagtatttcaggacggcgtgttccataccatgtggcacgtcacaagaggtgccgtgctgatgtatcaggggaagaggctcgagccttcatgggcgagtgttaaaaaggatttgattagctacggaggcggctggcgatttcaggggtcctggaatactggagaggaagtgcaagtcatagctgtggagcccggtaaaaacccaaagaatgtacagaccacgcccggcacattcaaaactcctgaaggggaggtcggagccatcgcactggactttaagccaggcacctctggttcgcccattgtgaaccgggaagggaagatcgttggactctacggcaatggcgtggtcacaaccagcgggacttatgtgtcagccattgctcaggccaaagcatcccaagagggacctctgccggagatcgaagacgaggttttcaagaaacgcaaccttaccataatggatctgcacccaggtagtggcaagacaagaaggtacttgcccgctatcgtgcgggaagccattaaacgaaagctaagaacgctgatcctcgcgcctactcgcgtcgtggcctctgagatggcagaagctttaaaggggatgccaattaggtatcagaccacagccgtaaaaagcgagcataccggacgtgagatcgtggacctgatgtgccacgctacttttacaatgcggcttctgtcccccgttagagtccctaattacaacatgataattatggatgaagcacatttcaccgacccggcctcaatcgccgctaggggctatatctctacgcgcgtgggtatgggggaggcggcagccatttttatgactgctacacccccaggaagcgtggaagccttccctcagagtaatgcagtcatccaggatgaggaacgagacatacccgagagatcctggaacagcggctacgattggattaccgactttccaggcaagaccgtatggttcgtgccttctatcaaatcagggaatgatattgccaactgtctccggaagaacggaaaaagggttatccaattgtcccgcaagactttcgacacagagtatcagaagaccaaaaataacgattgggactacgtggtcacaactgacataagtgaaatgggtgctaattttcgtgcggatagagtgattgacccccggaggtgcctgaagccagttatcctcaaagatggcccggagcgcgtgatcctggccgggcctatgcccgtcacggcagctagcgccgcacagcgaagaggacggattggcaggaaccagaataaggaaggtgaccaatacgtgtatatggggcagccacttaacaatgatgaggaccacgcccattggaccgaggctaaaatgctactggataacatcaatacacccgaaggcattatacctgccttgttcgagccagaacgcgagaagtcggcggcaatcgacggagaatacagattaaggggcgaggcccggaagacttttgtagagctgatgcgtcgcggggatctccccgtgtggctgtcttataaagttgcttccgaaggattccagtacagcgaccgaagatggtgctttgatggtgagaggaacaatcaggtccttgaagagaacatggacgtggaaatttggaccaaggagggcgagcggaaaaagctgcgccctagatggctcgatgccaggacatattcagacccgttggctctgcgggaattcaaagagtttgcagccgggcgaagaagtgtgtctggagacctaatcctggaaatcggcaagctcccacaacaccttaccctgcgcgctcagaatgccttagataacttggtcatgctgcacaattccgagcagggtgggaaagcatacaggcatgcgatggaagagctccccgacactattgagacgctgatgcttctggccctcatagctgttttgaccggcggagtgacactgttctttttaagcggcaaggggctaggaaagacttcaatcggtctgctctgtgtaaccgccagtagcgcacttctgtggatggcttccgtggaacctcactggattgccgcatctatcattttggagttctttctgatggtcctcctgatccccgaaccagatcggcagcgtacacctcaagacaaccagcttgcctatgtggttataggcctcctgttcatgatcttgaccgtggctgcgaacgagatggggctgttagagactacaaaaaaggatctaggaattggctacgtcgccgcagaaaatcatcagcacgctacgatgctggacgtagatctccaccccgccagcgcctggaccctttacgcagtggctactacagttatcaccccaatgatgagacataccattgagaacacaactgccaatatctccctgacggcgatagctaaccaagccgcaattttgatgggtctggacaaagggtggcctatctcaaagatggatattggcgtgccgctcctggcccttggatgctattctcaggtcaatcccttaaccctgacagctgcagtgctcatgttggtcgcccactacgcgatcataggcccagggctgcaggctaaagccactagggaagcacagaagcgcaccgccgctggaatcatgaagaaccctacagtggacggcattgttgccatcgatctagaccccgtggtatatgatgcaaaatttgagaagcaactgggtcagattatgctccttatcctgtgtaccagtcagatattgctgatgcggactacgtgggctctctgcgaatcgattacactggccaccgggccattaactaccctttgggagggaagccctggcaaattctggaatacaactatcgcggtgtccatggccaacatcttccgaggttcttacctggcaggcgctgggctcgccttttcactaatgaagagcctgggaggcgggagaaggggaaccggcgcacagggtgagacattgggggaaaaatggaagcgccaactgaatcagctctccaagagtgagttcaacacgtataaacggtctggaattatggaagtcgacagaagcgaggctaaggaaggccttaaacgtggtgagaccactaagcatgccgtttcaaggggcacagccaaactgcggtggtttgtggagcgcaatttggtcaagcccgaagggaaggtgatcgacctgggatgtggccgagggggatggtcctactattgcgcgggcctcaaaaaggtaaccgaggtgaaaggttacactaaggggggaccgggccacgaagagccaatacctatggctacatacggctggaacttagttaaactgcatagtgggaaggatgtgttctttatgcccccagaaaaatgtgacacccttctgtgcgatattggagagagctctcccaatcctacgatcgaggaaggtagaaccctaagggtcctcaagatggtggagccgtggctgcggggcaaccagttctgtattaagatcttgaatccctatatgccatccgtcgtggaaacactggagcgcatgcagagaaaacacgggggaatgctcgttaggaaccctctttcacgaaatagcactcacgagatgtactgggtatcgtgcggcaccggtaacatagtgtctgcagtcaacatgacaagtcggatgctgttaaatcgttttactatggcccatagaaagcccacctatgaacgcgacgtggatctgggggctggaacaaggcacgttgccgtggagcctgaagtcgcaaacttggacatcattggccaacggatcgagaatattaaaaacgaacataagtccacctggcactacgatgaggacaatccatataaaacttgggcctaccacggcagctatgaggtgaagccctcagggtccgcttctagcatggtaaacggagtggttagactcctgacgaagccttgggatgtcatcccaatggtgacacagattgcgatgaccgacactacccccttcggtcagcaacgcgtgtttaaagaaaaggtcgatacaaggacgccgcgagccaaacggggcaccactcagatcatggaggttacagcaaagtggctatgggggttccttagtagaaataaaaagcctaggatatgtacccgcgaagagtttactcgtaaggtgcggtccaacgctgccattggagcagtattcgtggacgaaaatcagtggaacagcgccaaagaggctgtcgaggacgaaagattttgggatctggtgcatagggagcgcgaactccacaagcagggcaaatgcgccacatgcgtttacaatatgatgggtaagcgagagaaaaagctgggggaattcggaaaggcgaaaggctctcgggcaatctggtacatgtggttgggcgccagattcctggagtttgaggctctcgggttcatgaacgaagaccattggttttcaagggagaatagtctttccggagtggaaggtgagggcctgcacaagttagggtatatcctgcgcgatattagcaaaataccaggaggcaacatgtacgccgacgataccgcaggttgggacacaagagtcactgaggatgacttgcaaaatgaagctaagatcaccgatattatggagcccgaacatgccctcctggctacgtctatcttcaaactaacctatcagaacaaggtggtacgggttcagaggcctgccaaaaacgggacagtgatggacgtcatttcgcgtcgagatcagcgcggatcaggccaagtgggcacttacgggcttaatacctttacaaacatggaggtgcagctgatcagacagatggaaagcgagggaatattcctcccatccgagctggaaactcccaatttggcagagcgggcgttagactggctggaaaagcacggtgccgagaggctcaagcgcatggctatcagtggcgatgactgtgtcgttaaaccgattgacgatagatttgccaccgcacttacggctctgaacgacatggggaaggtgcggaaagatatccctcagtgggaaccctctaagggatggaatgactggcaacaggtaccattctgcagccaccattttcaccagctaattatgaaagatggcagggagatcgtggtcccttgtcgaaaccaggacgagctggtgggtcgtgccagagtttcccaaggggcaggatggtcactccgcgaaacagcctgcttgggcaagagttatgcgcagatgtggcagctgatgtacttccatcggagggatcttagactggctgccaatgcaatatgttctgccgtgcccgtcgactgggtgccaaccagccgcactacatggtccattcacgctcaccatcaatggatgaccactgaggatatgctctcagtatggaaccgggtttggatcgaagagaatccctggatggaaaacaagacccacgtgagctcttgggaggaggtcccttatttaggcaaaagggaagaccagtggtgcgggtccctgatcggattgacagcccgagcaacgtgggctaccaatattcaggtggccataaaccaggttagacggctgatcggtaatgagaactacctcgattacatgactagtatgaagaggtttaaaaatgaaagcgactcggagggcgcgctttggtga

SEQ ID NO: 13448 - RNA, 9879 nt, synthetic construct
  misc_feature 1..9879: note = derived and/or modified CDS sequence (opt3) from DENV-1__KJ189351__SS-prME
  source 1..9879: mol_type = other RNA
agcgtgaccatgctgctcatgcttctgcccactgtcttggccttccacttaactacgaggggcggggagcctcatatgatcgtttccaagcaggaaaggggcaaatctctgctgtttaagacctcagctggtgtgaacatgtgcaccctcattgccatggacctgggcgagctttgtgaagatactatgacctacaaatgcccacggataacagaggccgaaccggacgatgtagactgttggtgcaatgcgaccgatacttgggtgacatatgggacctgtagtcaaacgggagagcaccgccgagagaagcgtagcgtcgctctggcaccccatgtgggcttgggtctcgaaactagaaccgagacatggatgtcctctgaaggggcttggaaacagatccagagggttgagacttgggccctgcggcaccctggattcaccgtgattgcatttttcctggcacatgccatcggcacatcgattacccagaagggcatcatatttatcctcttaatgctggtcacgccatcaatggctatgcgctgcgtggggattggaaacagagacttcgtagagggtcttagcggcgccacttgggttgatgtggtcttggaacacgggagttgtgtgacaaccatggcgaagaataaacccactctggacatcgagctactcaagacagaagtgaccaaccctgcagtcctgaggaaactttgcattgaggccaagatctccaatacgaccacagattctcggtgtccaactcaaggagaagctaccctggttgaggagcaggacgccaactttgtgtgccgccgaacattcgtagatagaggctggggtaatgggtgtggattgtttggcaaaggcagcctcctgacttgcgcaaagttcaagtgcgtgaccaaattagaagggaagatagtccagtacgagaacctgaaatattccgtgattgttacagtgcacaccggagaccagcatcaagtcggtaatgaaactacggagcacggcacaatcgctaccattactccccaggcccctacctcagaaatccagctcacagattacggggcgcttaccctggactgtagtccaaggactggattggactttaacgagatggtgctactgacaatgaaggagaaaagctggctcgtacataagcagtggttcctggatcttccgctgccctggacgcctggcgcctctacctcccaagaaacttggaatcggcaggacttgctcgttacatttaaaaccgcacacgctaagaagcaggaggtggtcgtgctgggttcacaagaaggggccatgcacacagctttaactggcgccaccgagatccagacgagcggaaccacaactattttcgcaggccatctgaaatgccgtctaaagatggataaactcaccctgaaggggatgagttatgtcatgtgtacaggatctttcaaacttgaaaaggaggtggccgagactcagcacggtaccgttttggtgcaggtaaagtacgaaggcacggacgctccatgcaaaatacccttttccacacaagatgagaagggggtcacccagaacggacgcctgatcactgcgaatcctattgtgacagacaaagaaaagccagttaacatcgagaccgagcccccgttcggcgaaagctatatagtggtcggtgcaggggagaaagccctcaagctgtcgtggtttaagagaggatcttccattggaaaaatgttcgaagctactgccaggggcgcacggcgaatggccatccttggggataccgcttgggactttggatcaatcggtggcgtgttcacaagtgtagggaagctggtgcatcaggtttttggaacggcctacggcgtcttgttcagcggtgtgtcctggaccatgaaaattgggatcggcattctcctgacttggttaggactaaattctcgcagcacatcactaagtatgacctgtatagcagtgggcatggtcacactctacctgggggttatggtgcaggcggattccggatgcgtgatcaactggaagggcagagagcttaaatgtggtagcgggatttttgtaactaacgaagtccacacctggacggagcaatataagttccaggctgactctcctaagaggttgtcagccgcaatcggaaaagcctgggaggaaggcgtgtgcggtatccggagtgctacacgcctggagaatattatgtggaagcagataagcaacgaactcaatcatatcctgttagagaacgatatgaaatttaccgttgtggtcggcgacgccaatgggattctggcacagggaaagaaaatgatcagaccccaaccaatggaacacaagtactcctggaaatcttggggcaaggctaagattatcggggccgacatacagaacactaccttcatcattgatggacctgacacacccgagtgtccagatggccagagggcgtggaatatctgggaggtggaagactatggttttggggttttcactaccaacatttggcttaaattgcgtgattcgtacacacagatgtgcgaccaccggctcatgagcgccgctatcaaggattccaaagcagtgcatgccgacatgggatattggatagagtcagaaaagaatgagacgtggaaactggctcgagccagtttcattgaagtaaagacctgtacttggcccaagtctcacacactatggagcaacggcgtcctggagtccgagatgatcattcctaaaatctacggtggcccaatatcacaacataattatagaccggggtactttacccagactgcaggaccctggcacctcggcaagctggaacttgatttcgacttgtgcgaggggacaaccgtggtggtcgatgaacactgcggaaacaggggccctagcctgcgcacgactaccgttacaggtaaaatcattcatgagtggtgttgccggtcttgtaccttaccacccctcagatttagaggggaagacggatgctggtacggcatggaaatccgccctgtgaaggagaaagaagagaatctggtacgatccatggtgagtgcgggtagcggcgaagtcgattctttctcccttgggattctgtgtgtgtcaatcatgatagaggaggttatgcggagtcgttggagcagaaagatgttgatgactggaacactcgccgtgtttctgctactgattatgggccagctcacctggaacgacctgacaaggctttgcatcatggtcggggctaatgcctcggaccgcatgggaatgggcactacctatttggcactgatggctacgttcaagatgcggccaatgtttgccgtgggtttactcttcagaaggctgacatcccgagaagttcttctgctaaccatcgggctctctctggtggcaagcgtcgagttgcccaactcactggaagagttaggagatggcctcgccatgggcattatgatgctgaaacttctgactgaatttcaaccgcaccagttgtggaccacactcctgagtctaactttcgtaaagaccacgctgtcccttgactacgcttggaaaacaaccgcgatggccctctctatcgtgagcctgtttcctttgtgtctgtccactacatcacagaagaccacttggttaccagttctcctggggagcttcggatgcaaaccccttacaatgtttctgattgcagagaaccgcatatggggtcggaagagttggcctttgaatgagggcatcatggctattgggatcgtgtctattctcctgtccagcctactgaagaacgatgtcccccttgccggaccactcatcgccggcggtatgctgatagcttgttatgtgatctcggggtcatctgcagacttgagtttagaaaaagccgcggaggtatcctgggaacaggaggctgaacatagcggagcctctcacagcattctggtggaggtccaagatgacggcaccatgaagatcaaagatgaggaaagagacgatacgctcactattctgcttaaggcaaccctgttggccgtttccggcgtgtaccctatgtcaatccccgctacactattcgtgtggtatttctggcagaaaaagaaacagaggagtggggtcctgtgggacaccccaagcccgcctgaggtggaacgtgcagttctcgataatggaatataccgcattctgcagcggggtcttttaggcagatctcaagtaggggtgggagtctttcaggacggcgtgttccatacaatgtggcacgttactaggggtgccgtgctgatgtatcaggggaagcgactcgagccctcctgggcgtcagtcaagaaagatttgatcagttacggaggcggctggcggtttcaggggagctggaacaccggagaggaagtgcaagtaatcgctgtcgagccaggtaagaatcccaaaaacgtgcagacgacacctggcactttcaagaccccagaaggggaggttggagccattgcactggactttaaacccggcacatccggttctcctatagtgaatcgcgaagggaagatcgtcggactctacggcaacggcgtggttaccacttcggggacctatgtgagcgccattgctcaggccaaggcatcacaagagggaccgctgccagagatcgaagacgaggtcttcaaaaagagaaatcttacaattatggatctgcaccccggttccggcaaaacgaggcggtacttgcctgctatcgtgcgagaagccataaagagaaaactacgcactctgatcctcgcgccaaccagggtagtggccagtgagatggcagaggctttaaaggggatgcccattcgttatcagacaaccgccgttaagtctgagcatactggacgggagatcgtcgacctgatgtgccacgctacatttaccatgagacttctgagccctgtgagggtgccgaactacaatatgattatcatggatgaagcacatttcacggaccccgcctccatagccgctcgcggctatatttcaactcgagtcggtatgggggaggcggcagccatctttatgacagctaccccacctggatctgtagaagccttcccccagagcaacgcagtgatccaggatgaggaaagagacattccagagcggagttggaactccggctacgattggatcaccgactttcctggcaaaactgtttggttcgtgcccagcataaagtctgggaatgatattgccaattgtctcaggaaaaacggaaagcgcgtcatccaattgtcacgtaaaacattcgacaccgagtatcagaagacaaagaacaatgattgggactacgtggttactacggacatttccgaaatgggtgctaactttagagcggatcgggtgatcgacccaaggcgctgcctgaaaccggtcatactcaaggatggccctgagcgagtgattctggccgggcccatgccagtaaccgtggcaagtgctgcccagagacggggaaggatcggccgcaatcagaacaaagaaggtgaccaatacgtttatatggggcagccccttaataacgatgaggaccacgcacattggacagaggccaagatgctactggataatatcaacactcctgaaggcattatcccagctttgttcgagcccgaaagagagaaaagcgccgcgattgacggagaatacaggttacggggcgaggcacgtaagacctttgtcgagctgatgcgccgaggggatctccctgtgtggctgtcgtataaggtggcctctgaaggattccagtactccgacagaaggtggtgctttgatggtgagcggaataaccaggtccttgaagagaatatggacgttgaaatatggacaaaagagggcgagcgcaagaaactgagaccgaggtggctcgatgctcggacctatagcgacccattggccctgcgagagttcaaggagtttgctgcagggagacgctcagtgagtggagacctaatcctggaaattggcaaactcccccaacaccttactctgagggcccagaacgctttagataatttggtaatgctgcacaactctgagcagggtgggaaggcctaccggcatgcaatggaagaactccctgacacgatcgagaccctgatgcttctggcgctcatcgccgtgttgacaggcggagtcactctgttctttttatccggcaaagggctaggaaagaccagcattggtctgctctgtgtgacagcttcaagtgcccttctgtggatggcaagcgttgaaccccactggatagctgcctccatcattttggagttctttctgatggtgctcctgatcccagaacctgatcgtcagagaacaccccaagacaatcagcttgcatatgtcgtaattggcctcctgttcatgatcttgactgtggccgctaacgagatggggctgttagagacaacgaagaaagatctaggaataggctacgttgcggccgaaaaccatcagcacgcaaccatgctggacgtggatctccacccagcttctgcctggactctttacgccgtcgcaacaaccgtgatcacccctatgatgaggcatacaattgagaatactacggctaacatcagcctgaccgccattgcgaatcaagctgccatcttgatgggtctggacaaggggtggccgatatccaaaatggatattggcgtccccctcctggcacttggatgctattcacaggtgaacccattaacactgactgccgctgttctcatgttggtggcacactacgccatcattggccctgggctgcaggcgaaggctacccgcgaagcccagaaacggacagcagccggaatcatgaagaatcccaccgtagacggcatagtggctatcgatctagacccagtcgtttatgatgccaagtttgagaaacaactgggtcagattatgctccttatcctgtgtacttctcagattttgctgatgcgaacgacatgggcactctgcgaaagtatcaccctggctactgggcctttaaccacactttgggagggatcgcccggcaagttctggaacactaccatagccgtgagcatggcgaatattttcagaggttcctacctggccggcgcagggctcgctttttctctaatgaaatcactgggaggcgggaggcgcggaacaggcgcccagggtgagacgttgggggaaaagtggaaacggcaactgaaccagctcagcaagtccgagttcaatatctataagagaagtggaatcatggaagtcgaccgttctgaggcaaaagaaggccttaagaggggtgagaccactaaacatgctgtgagccggggcacagccaagctgcgctggtttgtagagcgaaacttggtgaaaccggaagggaaggttattgacctgggatgtggcagagggggatggtcatactattgcgccggcctcaagaaagtgaccgaggtcaagggttacactaaagggggaccaggccacgaagaacctatccccatggcgacatacggctggaatttagtgaagctgcattccgggaaagatgtcttctttatgccacccgaaaagtgtgacacccttctgtgcgatataggagagagtagccctaacccgacgattgaggaaggtaggaccctacgggtgctcaaaatggttgagccctggctgcgcggcaatcagttctgtgtaaagatcttgaacccatatatgccttctgtggtcgaaacactggagagaatgcagaggaagcacgggggaatgctcgtgcgaaatcccctttcccggaactcaactcacgagatgtactgggttagctgcggcaccggtaatattgtgtcggctgtcaacatgacatctcgtatgctgttaaacagatttactatggcacatcgcaaacctacctatgaaagggacgtggatctgggggccggaacacggcacgtagctgtggagccagaagttgccaatttggacatcataggccaaagaatcgagaacattaagaatgaacataaaagtacctggcactacgatgaggacaacccctataagacttgggcataccacggctcctatgaggtcaaaagctcagggtccgcctctagcatggtgaatggagtggtccgcctcctgacgaagccttgggatgttatcccaatggtgacacagattgctatgaccgacactacccccttcggtcagcaaagggtatttaaggaaaaagtggatacacgaacgccgcgggcgaagagaggcaccactcagatcatggaggtcacagccaaatggctatgggggttccttagtaggaacaagaaacctcgcatttgtacccgtgaagagtttactcggaaggtgagatccaatgcagctatcggagccgttttcgtggacgaaaaccagtggaatagcgcaaaggaggccgtcgaggacgaaaggttttgggatctggtgcatcgcgagcgagaactccacaaacagggcaagtgcgctacatgcgtatacaacatgatgggtaaacgggagaagaaactgggggagttcggaaaggccaagggctctagagcgatatggtacatgtggttgggcgcaaggttcctggagtttgaggccctcgggttcatgaatgaagaccattggttttcacgcgagaacagtctttccggagttgaaggtgagggcctgcacaaattagggtatattctgagagatatcagcaagatcccaggaggcaatatgtacgctgacgataccgccggttgggacacacggattactgaggatgacttgcaaaacgaagcaaaaataaccgatatcatggagcccgaacatgctctcctggccacgtctattttcaagctaacctatcagaataaagtggtcagggtgcagcgtcctgctaagaacgggacagtgatggacgtcatctcgcgacgcgatcagagaggatcaggccaagttggcacttacgggcttaacacctttacaaatatggaggtgcagctgattcggcagatggaaagcgagggaatcttcctcccatccgagctggaaactcccaacttggccgagagggcattagactggctggaaaaacacggtgcggagcgcctcaagagaatggccataagtggcgatgactgtgtagtgaagccgatcgacgatcggtttgctaccgcccttacggcactgaatgacatggggaaagtcaggaaggatattcctcagtgggaaccctctaaaggatggaacgactggcaacaggtgccattctgcagccaccattttcaccagctaatcatgaaggatggccgagagattgttgtgccttgtcgtaatcaggacgagctggtcggtagagctcgcgtgtcccaaggggccggatggtcactccgggaaacagcatgcttgggcaaaagttatgcccagatgtggcagctgatgtacttccataggagagatcttcgcctggcggctaacgccatctgttctgcagtacccgttgactgggtgccaaccagccggactacatggtccatacacgcccaccatcaatggatgaccactgaggatatgctctcagtctggaatagggtgtggattgaagagaacccctggatggaagacaagacccacgttagctcttgggaggaggtgccttatttaggcaagcgagaagatcagtggtgcgggtccctgatcggattgacagctagagccacgtgggcaaccaatatccaggtcgctattaaccaggtgcggaggctgataggtaatgagaactacctcgactacatgacaagtatgaaacgctttaagaatgaaagcgactcggagggcgccctttggtga

SEQ ID NO: 13449 - RNA, 9879 nt, synthetic construct
  misc_feature 1..9879: note = derived and/or modified CDS sequence (opt3) from DENV-1__KJ189352__SS-prME
  source 1..9879: mol_type = other RNA
agcgtgaccatgctgctcatgcttctgcccactgccttggctttccacttaactacgagaggaggggaacctcatatgatcgtctccaagcaggaaaggggaaaatctctgctatttaagacctcagccggtgttaacatgtgcaccctcattgccatggacctgggcgaactttgtgaagatactatgacctacaaatgcccacggataacagaggcggaaccggacgatgtggactgttggtgcaatgctaccgatacttgggtgacatatgggacctgtagtcaaacgggagagcaccgccgagagaagcgtagcgtggccctggcaccccatgtcggcttgggtctcgaaactagaaccgagacatggatgtcctctgaaggggcctggaaacagatccagagggtggagacttgggctctgcggcaccctggattcaccgttattgcatttttcctggcccatgctatcggcacatcgattacccagaagggcatcatatttatcctcttaatgctggtgacgccatcaatggccatgcgctgcgtcgggattggaaacagagacttcgtggagggtcttagcggcgcgacttgggtagatgttgtgttggaacacgggagttgtgtcacaaccatggcaaagaataaacccactctggacatcgagctactcaagacagaagtgaccaaccctgccgtgctgaggaaactttgcattgaggctaagatctccaatacgaccacagattctcggtgtccaactcaaggagaagccaccctggtcgaggagcaggacgcaaactttgtttgccgccgaacattcgtggatagaggctggggtaatgggtgtggattgtttggcaaaggcagcctcctgacttgcgctaagttcaagtgcgtaaccaaattagaagggaagatagtgcagtacgagaacctgaaatattccgtcattgtgacagttcacaccggagaccagcatcaagtgggtaatgaaactacggagcacggcacaatcgccaccattactccccaggcgcctacctcagaaatccagctcacagattacggggcccttaccctggactgtagtccaaggactggattggactttaacgagatggtcctactgacaatgaaggagaaaagctggctcgtgcataagcagtggttcctggatcttccgctgccctggacgtctggcgcatccacctcacaagaaacttggaatcggcaggacttgctcgtaacatttaaaaccgctcacgccaagaagcaggaggttgtggtcctgggtagccaagaaggggctatgcacacagccttaactggcgcaaccgagatccagacgagtggaaccacaactattttcgccggccatctgaaatgccgtctaaagatggataaactcaccctgaaggggatgtcttatgtgatgtgtacaggatccttcaaacttgaaaaggaggtcgctgagactcagcacggtaccgtgttggttcaggtgaagtacgaaggcacggacgcgccttgcaaaataccatttagcacacaagatgagaagggggtaacccagaacggacgcctgatcactgcaaatcccattgtcacagacaaagaaaagcctgtgaacatcgagaccgagccacccttcggcgaatcgtatatagttgtgggtgccggggagaaagctctcaagctgtcttggtttaagagaggctcctcaattggaaaaatgttcgaagccactgcaaggggcgcccggcgaatggctatccttggggataccgcctgggactttggaagtatcggtggcgtcttcacaagcgtggggaagctggtacatcagatttttggaacggcatacggcgtgttgttctccggtgtttcttggaccatgaaaatcgggattggcatactcctgacttggttaggactgaatagccgctcaacaagtctatccatgacctgtatcgcggtcggcatggtgacactctacctgggggtgatggtccaggctgatagcggatgcgttattaactggaagggcagagagcttaaatgtggttctgggatctttgtgactaacgaagtgcacacctggacggagcaatataagttccaggccgactcaccgaagaggttgagtgcagccatcggaaaggcttgggaggaaggcgtatgcggtattcggagcgccacacgcctggagaatataatgtggagacagatctccaacgaactcaatcatattctgttagagaacgatatgaagtttaccgtcgtggttggcgacgcaaatgggatcctggctcagggcaagaaaatgattaggcctcaacccatggaacacaaatactcttggaagtcgtggggcaaagccaaggtgatcggggcggacatacagaacactaccttcatcattgatggaccagacacacctgagtgtcccgatggccagcgtgcctggaatatctgggaggtcgaagactatggttttggggtgttcactaccaacatttggcttaagttgcgggatagctacacacagatgtgcgaccaccgactcatgtccgctgcaatcaaagattcaaaggccgttcatgctgacatgggatattggatagagagtgagaaaaatgagacgtggaagctggccagagcatctttcattgaagtgaaaacctgtacttggccaaagagccacacactatggtccaacggcgtactggagtcagagatgatcattcccaagatctacggtggccctataagccaacataattataggccagggtactttacccagactgcgggaccgtggcacctcggcaaactggaacttgatttcgacttgtgcgaggggacaaccgtcgtggtggatgaacactgcggaaaccgcggcccctctctgcggacgactaccgtcacaggtaagatcattcatgagtggtgttgcagatcctgtaccttacctccactcaggtttcgcggggaggacggatgctggtacggcatggaaatccgacccgttaaagagaaggaagagaatctggtgcggagtatggtaagcgccggttctggcgaagtggattccttctcacttgggattctgtgtgtcagtatcatgatagaggaggtgatgcgtagcagatggtcgaggaaaatgttgatgactggaacactcgctgtttttctgctactgattatgggccagctcacctggaacgacctgatccgcctttgcatcatggtgggggccaatgcatccgaccggatgggaatgggcacaacttatttggctctgatggccaccttcaagatgagacctatgtttgcagtcggtttactcttcaggcgactgacgtctcgcgaagtgcttctgctaacaattgggctcagcctggttgcctcagtggagttgccaaacagtctggaagagttaggagatggcctcgctatgggcatcatgatgctgaaacttctgaccgaatttcaaccccaccagttgtggactaccctcctgtccctaacattcgtcaaaactaccctgtctcttgactacgcgtggaagacgacagccatggcactcagcattgtatccctgtttccgttgtgtctgtcaaccactagccagaaaacaacctggttacctgtgctcctggggagtttcggatgcaagccacttactatgtttctgataacagagaacaaaatctggggtcggaagtcttggcccttgaatgagggcattatggctatcgggattgtttccatcctcctgagctcgctactgaagaacgatgtgcctcttgccggacccctcatagccggcggtatgctgatcgcttgttatgtcatttcagggtctagtgcagacttgtccttagaaaaagccgcggaggtgagctgggaacaggaggctgaacattctggagccagccactccatcctggtagaggtgcaagatgacggcaccatgaagattaaagatgaggaaagagacgatacgctcactatcctgcttaaggcaaccctgttggccgtctcaggcgtttacccaatgagtatacctgctacactattcgtgtggtatttctggcagaaaaagaaacagaggagcggggtgctgtgggacaccccctctccaccggaggtcgaacgtgcagtgctcgataatggaatttaccgcatcctgcagcggggtcttttaggcagatcccaagttggggtaggagtgtttcaggacggcgtcttccatacaatgtggcacgtgactaggggtgccgttctgatgtatcaggggaagcgactcgagccttcatgggcgagtgtgaagaaagatttgatcagctacggaggcggctggcggtttcaggggtcctggaacaccggagaggaagtccaagtgattgctgtagagcccggtaagaatcccaaaaacgtccagacgacacccggcactttcaagacccctgaaggggaggtgggagccatagcactggactttaaaccaggcacatctggttcgcccatcgttaatcgcgaagggaagattgtgggactctacggcaacggcgtcgtgaccactagcgggacctatgtttcagccatcgctcaggccaaggcatcccaagagggacctctgccggagattgaagacgaggtgttcaaaaagagaaatcttacaatcatggatctgcacccaggtagtggcaaaacgaggcggtacttgcccgctatagtccgagaagccatcaagagaaaactacgcactctgattctcgcgcctaccagggtggtagcctctgagatggcagaggctttaaaggggatgccaatccgttatcagacaaccgccgtaaagagcgagcatactggacgggagattgttgacctgatgtgccacgctacatttaccatgagacttctgtcccccgtcagggtgcctaactacaatatgatcataatggatgaagcacatttcacggacccggcctcaattgccgctcgcggctatatctctactcgagtgggtatgggggaggcggcagccatctttatgacagctacaccaccaggaagcgtcgaagccttccctcagagtaacgcagtaattcaggatgaggaaagagacatccccgagcggtcctggaatagcggctacgattggataaccgactttccaggcaaaactgtgtggttcgttccttctattaagtcagggaacgatatcgccaattgtctcaggaaaaacggaaagcgcgtgattcaattgtcccgtaaaacattcgacaccgagtatcagaagacaaagaacaatgattgggactacgtcgtgactacggacatcagtgaaatgggtgctaactttagagcggatcgggttatagaccccaggcgctgcctgaaaccagtgattctcaaggatggcccggagcgagtcatcctggccgggcctatgcccgtgaccgcagctagcgccgcacagagacggggaaggatcggccgcaatcagaacaaagaaggtgaccaatacgtatatatggggcagccacttaataacgatgaggaccacgcccattggacagaggctaagatgctactggataatattaacactcccgaaggcatcattcctgccttgttcgagccagaaagagagaaatcggcggcaatagacggagaatacaggttacggggcgaggcccgtaagacctttgtggagctgatgcgccgaggggatctccccgtttggctgtcttataaggtcgcttccgaaggattccagtacagcgacagaaggtggtgctttgatggtgagcggaataaccaggtgcttgaagagaatatggacgtggaaatctggacaaaagagggcgagcgcaagaaactgagacctaggtggctcgatgcccggacctattcagacccgttggctctgcgagagttcaaggagtttgcagccgggagacgcagtgtctctggagacctaattctggaaatcggcaaactcccacaacaccttactctgagggctcagaacgccttagataatttggttatgctgcacaactccgagcagggtgggaaggcataccggcatgcgatggaagaactccccgacacgatcgagaccctgatgcttctggccctcattgctgtgttgacaggcggagtaactctgttctttttaagcggcaaagggctaggaaagacctcaataggtctgctctgtgtgacagccagtagcgcacttctgtggatggcttccgtcgaacctcactggatcgccgcatctattatcttggagttctttctgatggtgctcctgattcccgaaccagatcgtcagagaacccctcaagacaatcagcttgcctatgttgtgatcggcctcctgttcatgatattgactgtcgctgcgaacgagatggggctgttagagacaacgaagaaagatctaggaatcggctacgtagccgcagaaaaccatcagcacgctaccatgctggacgtggatctccaccccgccagcgcctggactctttacgcagttgctacaaccgtgattaccccaatgatgaggcatacaatcgagaatactacggccaacatttccctgaccgcgatcgctaatcaagccgcaatattgatgggtctggacaaggggtggcctatttcaaaaatggatatcggcgtcccgctcctggcccttggatgctattctcaggtgaaccccttaacactgactgctgcagtcctcatgttggtggcccactacgcgattatcggcccagggctgcaggctaaggccacccgcgaagcacagaaacggacagccgctggaataatgaagaatcctaccgttgacggcatcgtggccattgatctagaccccgtagtgtatgatgcaaagtttgagaaacaactgggtcagatcatgctccttattctgtgtacgagtcagatcttgctgatgcgaactacatgggctctctgcgaatcgataaccctggccactgggccattaaccacactttgggagggaagccctggcaagttctggaacactaccattgcggtctccatggccaatatcttcagaggttcttacctggcaggcgctgggctcgccttttcactaatgaaaagcctgggaggcgggaggcgcggaacaggcgcacagggtgagacgttgggggaaaagtggaaacggcaactgaaccagctctccaagagtgagttcaatacctataagagatctggaatcatggaagttgaccgtagcgaggctaaagaaggccttaagaggggtgagactacaaaacatgccgtgtcacggggcaccgccaagctgcgctggtttgtcgagcgaaacttggtgaaacccgaagggaaggtaattgacctgggatgtggcagagggggatggtcctactattgcgcgggcctcaagaaagtgactgaggttaagggttacacaaaagggggaccgggccacgaagaaccaatccctatggctacctacggctggaatttagtgaagctgcatagtgggaaagatgtcttctttatgcccccagaaaagtgtgacacgcttctgtgcgatataggagagagctctcccaaccctaccattgaggaaggtaggacactacgggtgctcaaaatggtcgagccgtggctgcgcggcaatcagttctgtatcaagattttgaacccctatatgccatccgtggttgaaactctggagagaatgcagaggaagcacgggggaatgctcgtacgaaatcctctttcacggaacagcacccacgagatgtactgggtgtcgtgcggcacaggtaatatcgtctctgcagtgaacatgacaagtcgtatgctgttaaacagatttaccatggcccatcgcaaacccacatatgaaagggacgttgatctgggggctggaacccggcacgtggccgtcgagcctgaagtggcaaatttggacataatcggccaaagaattgagaacatcaagaatgaacataaatccacttggcactacgatgaggacaacccatataagacgtgggcctaccacggcagctatgaggtaaaaccctcagggtccgcttctagcatggtgaatggagttgtccgcctcctgacaaagccttgggatgtgattccaatggtgacccagatcgcgatgactgacaccacacccttcggtcagcaaagggtctttaaggaaaaagttgatacgcgaaccccgcgggccaagagaggcactacacagattatggaggtgaccgcaaaatggctatgggggttccttagtaggaacaagaaacctcgcatctgtactcgtgaagagtttacacggaaggtaagatccaatgctgccataggagcagtgttcgtcgacgaaaaccagtggaatagcgccaaggaggctgtggaggacgaaaggttttgggatctggttcatcgcgagcgagaactccacaaacagggcaagtgcgcaacctgcgtgtacaacatgatgggtaaacgggagaagaaactgggggagttcggaaaggcgaagggctctagagcaatttggtacatgtggttgggcgccaggttcctggagtttgaggctctcgggttcatgaatgaagaccattggttttcacgcgagaacagtctttccggagtcgaaggtgagggcctgcacaaattagggtatatcctgagagatatcagcaagattccaggaggcaatatgtacgccgacgatacagcaggttgggacactcgggtgaccgaggatgacttgcaaaacgaagctaaaataacggatatcatggagcccgaacatgccctcctggctacctctattttcaagctaacatatcagaataaagtagttagggtgcagcgtcctgccaagaacgggactgtcatggacgtgatctcgcgacgcgatcagagaggatcaggccaagtgggcacctacgggcttaacacatttactaatatggaggtccagctgattcggcagatggaaagcgagggaatcttcctcccatccgagctggaaacccccaacttggcagagagggcgttagactggctggaaaaacacggtgccgagcgcctcaagagaatggctataagtggcgatgactgtgttgtgaagccgatcgacgatcggtttgccacggcacttacagctctgaatgacatggggaaagtaaggaaggatattcctcagtgggaaccctctaaaggatggaacgactggcaacaggtgccattctgcagccaccattttcaccagctaatcatgaaggatggccgagagattgtcgtgccttgtcgtaatcaggacgagctggttggtagagcccgcgtgtcccaaggggcaggatggtcactccgggaaaccgcctgcttgggcaaaagttatgcgcagatgtggcagctgatgtacttccataggagagatcttcgcctggctgccaacgcaatctgttctgccgtccccgtggactgggtaccaactagccggacaacctggtccatacacgctcaccatcaatggatgactaccgaggatatgctctcagtttggaatagggtgtggattgaagagaacccctggatggaaaataagacacacgtcagctcttgggaggaggtgccttatttaggcaagcgagaagaccagtggtgcgggtccctgatcggattgacggccagagcaacctgggctactaacatccaggttgccattaatcaggtgcggaggctgataggtaacgagaattacctcgattacatgacaagtatgaaacgctttaagaacgaaagcgactcggagggcgcgctttggtga

SEQ ID NO: 13450 - RNA, 9879 nt, synthetic construct
  misc_feature 1..9879: note = derived and/or modified CDS sequence (opt3) from DENV-1__KJ189353__SS-prME
  source 1..9879: mol_type = other RNA
agcgtgaccatgctgctcatgcttctgcccacagccttggctttccacttaactacgagaggcggggagcctcatatgatcgtctccaagcaggaaaggggaaaatctctgctatttaagacctcagcaggtgttaacatgtgcacactcattgccatggacctgggcgagctttgtgaagatactatgacctacaaatgcccacggataacagaggcggaaccggacgatgtggactgttggtgcaatgctaccgatacttgggtaacatatgggacctgtagtcaaacgggagagcaccgccgagagaagcgtagcgtggccctggcaccccatgtcggcttgggtctcgaaactagaaccgagacatggatgtcctctgaaggggcctggaaacagatccagagggtggagacttgggctctgcggcaccctggattcaccgttattgcatttttcctggcccatgctatcggcacatcgattacccagaagggcatcatatttatcctcttaatgctggtgacgccatcaatggccatgcgctgcgtcgggattggaaacagagacttcgtggagggtcttagcggcgcgacttgggtagatgttgtgttggaacacgggagttgtgtcacaaccatggcaaagaataaacccactctggacatcgagctactcaagacagaagtgaccaaccctgccgtgctgaggaaactttgcattgaggctaagatctccaatacgaccacagattctcggtgtccaactcaaggagaagccaccctggtcgaggagcaggacgcaaactttgtttgccgccgaacattcgtggatagaggctggggtaatgggtgtggattgtttggcaaaggcagcctcctgacttgcgctaagttcaagtgcgtaaccaaattagaagggaagatagtgcagtacgagaacctgaaatattccgtcattgtgacagttcacaccggagaccagcatcaagtgggtaatgaaactacggagcacggcacaatcgccaccattactccccaggcgcctacctcagaaatccagctcacagattacggggcccttaccctggactgtagtccaaggactggattggactttaacgagatggtcctactgacaatgaaggagaaaagctggctcgtgcataagcagtggttcctggatcttccgctgccctggacgtctggcgcatccacctcacaagaaacttggaatcggcaggacttgctcgtaacatttaaaaccgctcacgccaagaagcaggaggttgtggtcctgggtagccaagaaggggctatgcacacagccttaactggcgcaaccgagatccagacgagtggaaccacaactattttcgccggccatctgaaatgccgtctaaagatggataaactcaccctgaaggggatgtcttatgtgatgtgtacaggatccttcaaacttgaaaaggaggtcgctgagactcagcacggtaccgtgttggttcaggtgaagtacgaaggcacggacgcgccttgcaaaataccatttagcacacaagatgagaagggggtaacccagaacggacgcctgatcactgcaaatcccattgtcacagacaaagaaaagcctgtgaacatcgagaccgagccacccttcggcgaatcgtatatagttgtgggtgccggggagaaagctctcaagctgtcttggtttaagagaggctcctcaattggaaaaatgttcgaagccactgcaaggggcgcccggcgaatggctatccttggggataccgcctgggactttggaagtatcggtggcgtcttcacaagcgtggggaagctggtacatcagatttttggaacggcatacggcgtgttgttctccggtgtttcttggaccatgaaaatcgggattggcatactcctgacttggttaggactgaatagccgctcaacaagtctatccatgacctgtatcgcggtcggcatggtgacactctacctgggggtgatggtccaggctgatagcggatgcgttattaactggaagggcagagagcttaaatgtggttctgggatctttgtgactaacgaagtgcacacctggacggagcaatataagttccaggccgactcaccgaagaggttgagtgcagccatcggaaaagcttgggaggaaggcgtatgcggtattcggagcgccacacgcctggagaatataatgtggaagcagatctccaacgaactcaatcatattctgttagagaacgatatgaaatttaccgtcgtggttggcgacgcaaatgggatcctggctcagggaaagaaaatgattagacctcaacccatggaacacaagtactcttggaaatcgtggggcaaggccaagatcataggggcggacatccagaacactaccttcattatcgatggaccagacacacctgagtgtcccgatggccagagggcctggaatatttgggaggtggaagactatggttttggggtcttcactaccaacatctggcttaaattgcgtgatagctacacacagatgtgcgaccaccggctcatgtccgctgcaataaaggattcaaaagccgtgcatgctgacatgggatattggattgagagtgaaaagaatgagacgtggaaactggcccgagcatctttcatcgaagttaagacctgtacttggccaaagagccacacactatggtccaacggcgtgctggagtcagagatgattatccccaaaatatacggtggccctatcagccaacataattatagaccagggtactttacccagactgcgggaccgtggcacctcggcaagctggaacttgatttcgagttgtgcgaagggacaaccgtagtcgtggacgagcactgcggaaacaggggcccctctctgcgcacgactaccgtgacaggtaaaattatccatgagtggtgttgccggtcctgtaccttacctccactcagatttaggggggaagatggatgctggtacggcatggagattcgccccgtcaaggaaaaagaggaaaatctggttcgaagtatggtgagcgccggttctggcgaggtagactccttctcacttgggatcctgtgtgtgagtataatgattgaggaagtcatgcggagccgttggtcgagaaagatgttgatgactggaacactcgctgtgtttctgctactgatcatgggccagctcacctggaacgatctgatcaggctttgcattatggttggggccaatgcatccgaccgcatgggaatgggcacaacttatttggctctgatggccaccttcaagatgcggcctatgtttgcagtgggtttactcttcagaaggctgacgtctcgagaggtccttctgctaacaatcgggctcagcctggtggcctcagttgaattgccaaacagtctggaggaattaggagacggcctcgctatgggcattatgatgctgaaacttctgaccgagtttcaaccccaccagttgtggactaccctcctgtccctaacattcgtgaagactaccctgtctcttgattacgcgtggaaaacgacagccatggcactcagcatagtctccctgtttccgttgtgtctgtcaaccactagccagaagacaacctggttacctgtactcctggggagtttcggatgcaaaccacttactatgtttctgatcacagagaacaagatttggggtcgcaagtcttggcccttgaatgaaggcatcatggctattgggatcgtgtccatactcctgagctcgctactgaaaaacgacgttcctcttgccggacccctcatcgccggcggtatgctgattgcttgttatgtgatctcagggtctagtgcagatttgtccttagagaaggccgcggaagtcagctgggagcaggaagctgagcattctggagccagccactccattctggtggaggtacaagacgatggcaccatgaaaatcaaggacgaagagcgggatgacacgctcactatactgcttaaagcaaccctgttggccgtgtcaggcgtctacccaatgagtattcctgctacactattcgtttggtatttctggcagaagaaaaagcagagaagcggggtgctgtgggataccccctctccaccggaagtggagagggcagtcctcgacaatggaatctaccgtatcctgcagcgcggtcttttaggccggtcccaagtgggggttggagtatttcaggatggcgtgttccatacaatgtggcacgtcactagaggtgccgtgctgatgtatcaggggaagaggctcgagccttcatgggcgagtgttaaaaaggacttgattagctacggaggcggctggcgatttcaggggtcctggaacaccggagaagaggtgcaagtcatagctgtggaacccggtaaaaatccaaagaacgtacagacgacacccggcactttcaaaacccctgagggggaagtcggagccatcgcactggattttaagccaggcacatctggttcgcccattgtgaatcgggaggggaagatcgttggactctacggcaacggcgtggtcaccactagcgggacctatgtgtcagccattgctcaggccaaagcatcccaagagggacctctgccggaaatcgaggacgaagttttcaagaaacgcaatcttacaataatggacctgcacccaggtagtggcaagacgagaaggtacttgcccgctatcgtgcgggaggccattaaacgaaagctaagaactctgatcctcgcgcctacccgcgtcgtggcctctgaaatggcagaggctttaaaggggatgccaattaggtatcagacaaccgccgtaaaaagcgagcatactggacgtgaaatcgtggatctgatgtgccacgctacatttaccatgcggcttctgtcccccgttagagtccctaactacaatatgataattatggacgaggcacatttcacggatccggcctcaatcgccgctaggggctatatctctactcgcgtgggtatgggggaagcggcagccatttttatgacagctacccccccaggaagcgtggaggccttccctcagagtaacgcagtcatccaggacgaagagcgagatatacccgagagatcctggaatagcggctacgactggattaccgattttccaggcaagactgtatggttcgtgccttctatcaaatcagggaacgacattgccaattgtctccggaagaacggaaaaagggttatccaattgtcccgcaagacattcgataccgaatatcagaagacaaaaaacaatgactgggattacgtggtcactacggacataagtgagatgggtgctaactttcgtgcggacagagtgattgatccccggaggtgcctgaagccagttatcctcaaagacggcccggaacgcgtgatcctggccgggcctatgcccgtcaccgcagctagcgccgcacagcgaagaggacggattggcaggaatcagaacaaggagggtgatcaatacgtgtatatggggcagccacttaataacgacgaggatcacgcccattggacagaagctaaaatgctactggacaatatcaacactcccgagggcattatacctgccttgttcgaaccagagcgcgaaaagtcggcggcaatcgatggagagtacagattaaggggcgaggcccggaagacctttgtagaactgatgcgtcgcggggacctccccgtgtggctgtcttataaagttgcttccgagggattccagtacagcgatcgaagatggtgctttgacggtgaaaggaataaccaggtccttgaggaaaatatggatgtggagatttggacaaaggagggcgaacggaaaaagctgcgccctagatggctcgacgccaggacctattcagatccgttggctctgcgggagttcaaagaatttgcagccgggcgaagaagtgtgtctggagacctaatcctggagatcggcaagctcccacaacaccttactctgcgcgctcagaacgccttagacaatttggtcatgctgcacaactccgaacagggtgggaaagcatacaggcatgcgatggaggagctccccgatacgattgaaaccctgatgcttctggccctcatagctgttttgacaggcggagtgactctgttctttttaagcggcaaggggctaggaaagacctcaatcggtctgctctgtgtaacagccagtagcgcacttctgtggatggcttccgtggagcctcactggattgccgcatctatcattttggaattctttctgatggtcctcctgatccccgagccagaccggcagcgtacccctcaagataatcagcttgcctatgtggttataggcctcctgttcatgatcttgactgtggctgcgaacgagatggggctgttagaaacaacgaaaaaggacctaggaattggctacgtcgccgcagagaaccatcagcacgctaccatgctggatgtagacctccaccccgccagcgcctggactctttacgcagtggctacaaccgttatcaccccaatgatgagacatacaattgaaaatactacggccaacatctccctgaccgcgatagctaatcaagccgcaattttgatgggtctggataaagggtggcctatctcaaagatggacattggcgtgccgctcctggcccttggatgctattctcaggtcaaccccttaacactgactgctgcagtgctcatgttggtcgcccactacgcgatcataggcccagggctgcaggctaaagccaccagggaggcacagaagcgcacagccgctggaatcatgaagaatcctaccgtggatggcattgttgccatcgacctagatcccgtggtatatgacgcaaaatttgaaaagcaactgggtcagattatgctccttatcctgtgtactagtcagatattgctgatgcggacgacatgggctctctgcgagtcgattaccctggccactgggccattaaccacactttgggagggaagccctggcaaattctggaacactaccatcgcggtgtccatggccaatatcttccgaggttcttacctggcaggcgctgggctcgccttttcactaatgaagagcctgggaggcgggagaaggggaacaggcgcacagggtgaaacgttgggggagaaatggaagcgccaactgaaccagctctccaagagtgaattcaatacctataaacggtctggaattatggaggtcgatagaagcgaagctaaggagggccttaaacgtggtgagactacaaagcatgccgtttcaaggggcaccgccaaactgcggtggtttgtggaacgcaacttggtcaagcccgaggggaaggtgatcgacctgggatgtggccgagggggatggtcctactattgcgcgggcctcaaaaaggtaactgaagtgaaaggttacacaaaggggggaccgggccacgaggaaccaatacctatggctacctacggctggaatttagttaaactgcatagtgggaaggacgtgttctttatgcccccagagaaatgtgatacgcttctgtgcgacattggagagagctctcccaaccctaccatcgaagagggtagaacactaagggtcctcaagatggtggaaccgtggctgcggggcaatcagttctgtattaagatcttgaacccctatatgccatccgtcgtggagactctggagcgcatgcagagaaaacacgggggaatgctcgttaggaatcctctttcacgaaacagcacccacgaaatgtactgggtatcgtgcggcacaggtaatatagtgtctgcagtcaacatgactagtcggatgctgttaaaccgttttaccatggcccatagaaagcccacatatgagcgcgatgtggacctgggggctggaaccaggcacgttgccgtggaacctgaggtcgcaaatttggatatcattggccaacggatcgaaaacattaaaaatgagcataagtccacttggcactacgacgaggataacccatataaaacgtgggcctaccacggcagctatgaagtgaagccctcagggtccgcttctagcatggtaaatggagtggttagactcctgacaaagccttgggacgtcatcccaatggtgacccagattgcgatgactgataccacacccttcggtcagcaacgcgtgtttaaagagaaggtcgacacgaggaccccgcgagccaaacggggcactacacagatcatggaagttaccgcaaagtggctatgggggttccttagtagaaacaaaaagcctaggatatgtactcgcgaggaatttacacgtaaggtgcggtccaatgctgccattggagcagtattcgtggatgagaaccagtggaatagcgccaaagaggctgtcgaagacgagagattttgggacctggtgcatagggaacgcgagctccacaagcagggcaaatgcgccacctgcgtttacaacatgatgggtaagcgagaaaaaaagctgggggagttcggaaaggcgaaaggctctcgggcaatctggtacatgtggttgggcgccagattcctggagtttgaagctctcgggttcatgaatgaggatcattggttttcaagggaaaacagtctttccggagtggagggtgagggcctgcacaagttagggtatatcctgcgcgacattagcaaaataccaggaggcaatatgtacgccgatgacacagcaggttgggatactagagtcaccgaagacgatttgcaaaacgaggctaagatcacggacattatggaacccgagcatgccctcctggctacctctatcttcaaactaacatatcagaataaggtggtacgggttcagaggcctgccaaaaacgggactgtgatggatgtcatttcgcgtcgagaccagcgcggatcaggccaagtgggcacctacgggcttaacacatttactaatatggaagtgcagctgatcagacagatggagagcgagggaatattcctcccatccgaactggagacccccaacttggcagaacgggcgttagattggctggagaagcacggtgccgaaaggctcaagcgcatggctatcagtggcgacgattgtgtcgttaaaccgattgacgacagatttgccacggcacttacagctctgaatgatatggggaaggtgcggaaagacatccctcagtgggagccctctaagggatggaacgattggcaacaggtaccattctgcagccaccattttcaccagctaattatgaaagacggcagggagatcgtggtcccttgtcgaaatcaggatgaactggtgggtcgtgccagagtttcccaaggggcaggatggtcactccgcgagaccgcctgcttgggcaagagttatgcgcagatgtggcagctgatgtacttccatcggagggaccttagactggctgccaacgcaatatgttctgccgtgcccgtcgattgggtgccaactagccgcacaacctggtccattcacgctcaccatcaatggatgactaccgaagacatgctctcagtatggaatcgggtttggatcgaggaaaacccctggatggagaataagacacacgtgagctcttgggaggaagtcccttatttaggcaaaagggaggatcagtggtgcgggtccctgatcggattgacggcccgagcaacctgggctactaacattcaggtggccataaatcaggttagacggctgatcggtaacgaaaattacctcgactacatgacaagtatgaagaggtttaaaaacgagagcgattcggagggcgcgctttggtga

SEQ ID NO: 13451 - RNA, 9879 nt, synthetic construct
  misc_feature 1..9879: note = derived and/or modified CDS sequence (opt3) from DENV-1__KJ189354__SS-prME
  source 1..9879: mol_type = other RNA
agcgtgaccatgctgctcatgcttctgcccacagccttggctttccacttaactacgagaggcggggagcctcatatgatcgtctccaagcaggaaaggggaaaatctctgctatttaagacctcagcaggtgttaacatgtgcacactcattgccatggacctgggcgagctttgtgaagatactatgacctacaaatgcccacggataacagaggcggaaccggacgatgtggactgttggtgcaatgctaccgatacttgggtaacatatgggacctgtagtcaaacgggagagcaccgccgagagaagcgtagcgtggccctggcaccccatgtcggcttgggtctcgaaactagaaccgagacatggatgtcctctgaaggggcctggaaacagatccagagggtggagacttgggctctgcggcaccctggattcaccgttattgcatttttcctggcccatgctatcggcacatcgattacccagaagggcatcatatttatcctcttaatgctggtgacgccatcaatggccatgcgctgcgtcgggattggaaacagagacttcgtggagggtcttagcggcgcgacttgggtagatgttgtgttggaacacgggagttgtgtcacaaccatggcaaagaataaacccactctggacatcgagctactcaagacagaagtgaccaaccctgccgtgctgaggaaactttgcattgaggctaagatctccaatacgaccacagattctcggtgtccaactcaaggagaagccaccctggtcgaggagcaggacgcaaactttgtttgccgccgaacattcgtggatagaggctggggtaatgggtgtggattgtttggcaaaggcagcctcctgacttgcgctaagttcaagtgcgtaaccaaattagaagggaagatagtgcagtacgagaacctgaaatattccgtcattgtgacagttcacaccggagaccagcatcaagtgggtaatgaaactacggagcacggcacaatcgccaccattactccccaggcgcctacctcagaaatccagctcacagattacggggcccttaccctggactgtagtccaaggactggattggactttaacgagatggtcctactgacaatgaaggagaaaagctggctcgtgcataagcagtggttcctggatcttccgctgccctggacgtctggcgcatccacctcacaagaaacttggaatcggcaggacttgctcgtaacatttaaaaccgctcacgccaagaagcaggaggttgtggtcctgggtagccaagaaggggctatgcacacagccttaactggcgcaaccgagatccagacgagtggaaccacaactattttcgccggccatctgaaatgccgtctaaagatggataaactcaccctgaaggggatgtcttatgtgatgtgtacaggatccttcaaacttgaaaaggaggtcgctgagactcagcacggtaccgtgttggttcaggtgaagtacgaaggcacggacgcgccttgcaaaataccatttagcacacaagatgagaagggggtaacccagaacggacgcctgatcactgcaaatcccattgtcacagacaaagaaaagcctgtgaacatcgagaccgagccacccttcggcgaatcgtatatagttgtgggtgccggggagaaagctctcaagctgtcttggtttaagagaggctcctcaattggaaaaatgttcgaagccactgcaaggggcgcccggcgaatggctatccttggggataccgcctgggactttggaagtatcggtggcgtcttcacaagcgtggggaagctggtacatcagatttttggaacggcatacggcgtgttgttctccggtgtttcttggaccatgaaaatcgggattggcatactcctgacttggttaggactgaatagccgctcaacaagtctatccatgacctgtatcgcggtcggcatggtgacactctacctgggggtgatggtccaggctgatagcggatgcgttattaactggaagggcagagagcttaaatgtggttctgggatctttgtgactaacgaagtgcacacctggacggagcaatataagttccaggccgactcaccgaagaggttgagtgcagccatcggaaaagcttgggaggaaggcgtatgcggtattcggagcgccacacgcctggagaatataatgtggaagcagatctccaacgaactcaatcatattctgttagagaacgatatgaaatttaccgtcgtggttggcgacgcaaatgggatcctggctcagggaaagaaaatgattagacctcaacccatggaacacaagtactcttggaaatcgtggggcaaggccaagatcataggggcggacatccagaacactaccttcattatcgatggaccagacacacctgagtgtcccgatggccagagggcctggaatatttgggaggtggaagactatggttttggggtcttcactaccaacatctggcttaaattgcgtgatagctacacacagatgtgcgaccaccggctcatgtccgctgcaataaaggattcaaaagccgtgcatgctgacatgggatattggattgagagtgaaaagaatgagacgtggaaactggcccgagcatctttcatcgaagttaagacctgtacttggccaaagagccacacactatggtccaacggcgtgctggagtcagagatgattatccccaaaatatacggtggccctatcagccaacataattatagaccagggtactttacccagactgcgggaccgtggcacctcggcaagctggaacttgatttcgacttgtgcgaggggacaaccgtagtcgtggatgaacactgcggaaacaggggcccctctctgcgcacgactaccgtgacaggtaaaattatccatgagtggtgttgccggtcctgtaccttacctccactcagatttaggggggaggacggatgctggtacggcatggaaattcgccccgtcaaggagaaagaagagaatctggttcgaagtatggtgagcgccggttctggcgaagtagattccttctcacttgggatcctgtgtgtgagtataatgattgaggaggtcatgcggagccgttggtcgagaaagatgttgatgactggaacactcgctgtgtttctgctactgatcatgggccagctcacctggaacgacctgatcaggctttgcattatggttggggccaatgcatccgaccgcatgggaatgggcacaacttatttggctctgatggccaccttcaagatgcggcctatgtttgcagtgggtttactcttcagaaggctgacgtctcgagaagtccttctgctaacaatcgggctcagcctggtggcctcagttgagttgccaaacagtctggaagagttaggagatggcctcgctatgggcattatgatgctgaaacttctgaccgaatttcaaccccaccagttgtggactaccctcctgtccctaacattcgtgaagactaccctgtctcttgactacgcgtggaaaacgacagccatggcactcagcatagtctccctgtttccgttgtgtctgtcaaccactagccagaagacaacctggttacctgtactcctggggagtttcggatgcaaaccacttactatgtttctgatcacagagaacaagatttggggtcgcaagtcttggcccttgaatgagggcatcatggctattgggatcgtgtccatactcctgagctcgctactgaaaaacgatgttcctcttgccggacccctcatcgccggcggtatgctgattgcttgttatgtgatctcagggtctagtgcagacttgtccttagaaaaggccgcggaggtcagctgggaacaggaggctgaacattctggagccagccactccattctggtggaggtacaagatgacggcaccatgaaaatcaaggatgaggaacgggacgatacgctcactatactgcttaaagcaaccctgttggccgtgtcaggcgtctacccaatgagtattcctgctacactattcgtttggtatttctggcagaagaaaaagcagagaagcggggtgctgtgggacaccccctctccaccggaggtggaaagggcagtcctcgataatggaatctaccgtatcctgcagcgcggtcttttaggccggtcccaagtgggggttggagtatttcaggacggcgtgttccatacaatgtggcacgtcactagaggtgccgtgctgatgtatcaggggaagaggctcgagccttcatgggcgagtgttaaaaaggatttgattagctacggaggcggctggcgatttcaggggtcctggaacaccggagaggaagtgcaagtcatagctgtggagcccggtaaaaatccaaagaacgtacagacgacacccggcactttcaaaacccctgaaggggaggtcggagccatcgcactggactttaagccaggcacatctggttcgcccattgtgaatcgggaagggaagatcgttggactctacggcaacggcgtggtcaccactagcgggacctatgtgtcagccattgctcaggccaaagcatcccaagagggacctctgccggagatcgaagacgaggttttcaagaaacgcaatcttacaataatggatctgcacccaggtagtggcaagacgagaaggtacttgcccgctatcgtgcgggaagccattaaacgaaagctaagaactctgatcctcgcgcctacccgcgtcgtggcctctgagatggcagaagctttaaaggggatgccaattaggtatcagacaaccgccgtaaaaagcgagcatactggacgtgagatcgtggacctgatgtgccacgctacatttaccatgcggcttctgtcccccgttagagtccctaactacaatatgataattatggatgaagcacatttcacggacccggcctcaatcgccgctaggggctatatctctactcgcgtgggtatgggggaggcggcagccatttttatgacagctacccccccaggaagcgtggaagccttccctcagagtaacgcagtcatccaggatgaggaacgagacatacccgagagatcctggaatagcggctacgattggattaccgactttccaggcaagactgtatggttcgtgccttctatcaaatcagggaacgatattgccaattgtctccggaagaacggaaaaagggttatccaattgtcccgcaagacattcgacaccgagtatcagaagacaaaaaacaatgattgggactacgtggtcactacggacataagtgaaatgggtgctaactttcgtgcggatagagtgattgacccccggaggtgcctgaagccagttatcctcaaagatggcccggagcgcgtgatcctggccgggcctatgcccgtcaccgcagctagcgccgcacagcgaagaggacggattggcaggaatcagaacaaggaaggtgaccaatacgtgtatatggggcagccacttaataacgatgaggaccacgcccattggacagaggctaaaatgctactggataatatcaacactcccgaaggcattatacctgccttgttcgagccagaacgcgagaagtcggcggcaatcgacggagaatacagattaaggggcgaggcccggaagacctttgtagagctgatgcgtcgcggggatctccccgtgtggctgtcttataaagttgcttccgaaggattccagtacagcgaccgaagatggtgctttgatggtgagaggaataaccaggtccttgaagagaatatggacgtggaaatttggacaaaggagggcgagcggaaaaagctgcgccctagatggctcgatgccaggacctattcagacccgttggctctgcgggaattcaaagagtttgcagccgggcgaagaagtgtgtctggagacctaatcctggaaatcggcaagctcccacaacaccttactctgcgcgctcagaacgccttagataatttggtcatgctgcacaactccgagcagggtgggaaagcatacaggcatgcgatggaagagctccccgacacgattgagaccctgatgcttctggccctcatagctgttttgacaggcggagtgactctgttctttttaagcggcaaggggctaggaaagacctcaatcggtctgctctgtgtaacagccagtagcgcacttctgtggatggcttccgtggaacctcactggattgccgcatctatcattttggagttctttctgatggtcctcctgatccccgaaccagatcggcagcgtacccctcaagacaatcagcttgcctatgtggttataggcctcctgttcatgatcttgactgtggctgcgaacgagatggggctgttagagacaacgaaaaaggatctaggaattggctacgtcgccgcagaaaaccatcagcacgctaccatgctggacgtagatctccaccccgccagcgcctggactctttacgcagtggctacaaccgttatcaccccaatgatgagacatacaattgagaatactacggccaacatctccctgaccgcgatagctaatcaagccgcaattttgatgggtctggacaaagggtggcctatctcaaagatggatattggcgtgccgctcctggcccttggatgctattctcaggtcaaccccttaacactgactgctgcagtgctcatgttggtcgcccactacgcgatcataggcccagggctgcaggctaaagccaccagggaagcacagaagcgcacagccgctggaatcatgaagaatcctaccgtggacggcattgttgccatcgatctagaccccgtggtatatgatgcaaaatttgagaagcaactgggtcagattatgctccttatcctgtgtactagtcagatattgctgatgcggacgacatgggctctctgcgaatcgattaccctggccactgggccattaaccacactttgggagggaagccctggcaaattctggaacactaccatcgcggtgtccatggccaatatcttccgaggttcttacctggcaggcgctgggctcgccttttcactaatgaagagcctgggaggcgggagaaggggaacaggcgcacagggtgagacgttgggggaaaaatggaagcgccaactgaaccagctctccaagagtgagttcaatacctataaacggtctggaattatggaagtcgacagaagcgaggctaaggaaggccttaaacgtggtgagactacaaagcatgccgtttcaaggggcaccgccaaactgcggtggtttgtggagcgcaacttggtcaagcccgaagggaaggtgatcgacctgggatgtggccgagggggatggtcctactattgcgcgggcctcaaaaaggtaactgaggtgaaaggttacacaaaggggggaccgggccacgaagagccaatacctatggctacctacggctggaatttagttaaactgcatagtgggaaggatgtgttctttatgcccccagaaaaatgtgacacgcttctgtgcgatattggagagagctctcccaaccctaccatcgaggaaggtagaacactaagggtcctcaagatggtggagccgtggctgcggggcaatcagttctgtattaagatcttgaacccctatatgccatccgtcgtggaaactctggagcgcatgcagagaaaacacgggggaatgctcgttaggaatcctctttcacgaaacagcacccacgagatgtactgggtatcgtgcggcacaggtaatatagtgtctgcagtcaacatgactagtcggatgctgttaaaccgttttaccatggcccatagaaagcccacatatgaacgcgacgtggatctgggggctggaaccaggcacgttgccgtggagcctgaagtcgcaaatttggacatcattggccaacggatcgagaacattaaaaatgaacataagtccacttggcactacgatgaggacaacccatataaaacgtgggcctaccacggcagctatgaggtgaagccctcagggtccgcttctagcatggtaaatggagtggttagactcctgacaaagccttgggatgtcatcccaatggtgacccagattgcgatgactgacaccacacccttcggtcagcaacgcgtgtttaaagaaaaggtcgatacgaggaccccgcgagccaaacggggcactacacagatcatggaggttaccgcaaagtggctatgggggttccttagtagaaacaaaaagcctaggatatgtactcgcgaagagtttacacgtaaggtgcggtccaatgctgccattggagcagtattcgtggacgaaaaccagtggaatagcgccaaagaggctgtcgaggacgaaaagttttgggatctggtgcatagagagagggaactccacaaacagggcaagtgcgccacctgcgtttacaacatgatgggtaaacgcgagaagaagctgggggaattcggaaaagcgaagggctctcgagcaatctggtacatgtggttgggcgcccggttcctggagtttgaggctctcgggttcatgaatgaagaccattggttttcaagagagaacagtctttccggagtggaaggtgagggcctgcacaaattagggtatatcctgagggatattagcaagataccaggaggcaatatgtacgccgacgatacagcaggttgggacactcgcgtcaccgaggatgacttgcaaaacgaagctaaaatcacggatattatggagcccgaacatgccctcctggctacctctatcttcaagctaacatatcagaataaagtggtaagagttcagcggcctgccaagaacgggactgtgatggacgtcatttcgaggcgtgatcagcgaggatcaggccaagtgggcacctacgggcttaacacatttactaatatggaggtgcagctgatccgccagatggaaagcgagggaatattcctcccatccgagctggaaacccccaacttggcagagagagcgttagactggctggaaaagcacggtgccgagcggctcaaaaggatggctatcagtggcgatgactgtgtcgttaagccgattgacgatcgctttgccacggcacttacagctctgaatgacatggggaaagtgagaaaggatatccctcagtgggaaccctctaaaggatggaacgactggcaacaggtaccattctgcagccaccattttcaccagctaattatgaaggatggccgggagatcgtggtcccttgtaggaatcaggacgagctggtgggtcgagcccgtgtttcccaaggggcaggatggtcactcagagaaaccgcctgcttgggcaagagttatgcgcagatgtggcagctgatgtacttccatcgccgggatcttaggctggctgccaacgcaatatgttctgccgtgcccgtcgactgggtgccaactagcagaacaacctggtccattcacgctcaccatcaatggatgactaccgaggatatgctctcagtatggaatcgcgtttggatcgaagagaacccctggatggaaaataaaacacacgtgagctcttgggaggaggtcccttatttaggcaagcgggaagaccagtggtgcgggtccctgatcggattgacggccagggcaacctgggctactaacattcaggtggccataaatcaggttcgaagactgatcggtaacgagaattacctcgattacatgacaagtatgaaacggtttaagaacgaaagcgactcggagggcgcgctttggtga

SEQ ID NO: 13452 - RNA, 9879 nt, synthetic construct
  misc_feature 1..9879: note = derived and/or modified CDS sequence (opt3) from DENV-1__KJ189355__SS-prME
  source 1..9879: mol_type = other RNA
agcgtgaccatgctgctcatgcttctgcccacagccttggctttccacttaactacgagaggcggggagcctcatatgatcgtctccaagcaggaaaggggaaaatctctgctatttaagacctcagcaggtgttaacatgtgcacactcattgccatggacctgggcgagctttgtgaagatactatgacctacaaatgcccacggataacagaggcggaaccggacgatgtggactgttggtgcaatgctaccgatacttgggtaacatatgggacctgtagtcaaacgggagagcaccgccgagagaagcgtagcgtggccctggcaccccatgtcggcttgggtctcgaaactagaaccgagacatggatgtcctctgaaggggcctggaaacagatccagagggtggagacttgggctctgcggcaccctggattcaccgttattgcatttttcctggcccatgctatcggcacatcgattacccagaagggcatcatatttatcctcttaatgctggtgacgccatcaatggccatgcgctgcgtcgggattggaaacagagacttcgtggagggtcttagcggcgcgacttgggtagatgttgtgttggaacacgggagttgtgtcacaaccatggcaaagaataaacccactctggacatcgagctactcaagacagaagtgaccaaccctgccgtgctgaggaaactttgcattgaggctaagatctccaatacgaccacagattctcggtgtccaactcaaggagaagccaccctggtcgaggagcaggacgcaaactttgtttgccgccgaacattcgtggatagaggctggggtaatgggtgtggattgtttggcaaaggcagcctcctgacttgcgctaagttcaagtgcgtaaccaaattagaagggaagatagtgcagtacgagaacctgaaatattccgtcattgtgacagttcacaccggagaccagcatcaagtgggtaatgaaactacggagcacggcacaatcgccaccattactccccaggcgcctacctcagaaatccagctcacagattacggggcccttaccctggactgtagtccaaggactggattggactttaacgagatggtcctactgacaatgaaggagaaaagctggctcgtgcataagcagtggttcctggatcttccgctgccctggacgtctggcgcatccacctcacaagaaacttggaatcggcaggacttgctcgtaacatttaaaaccgctcacgccaagaagcaggaggttgtggtcctgggtagccaagaaggggctatgcacacagccttaactggcgcaaccgagatccagacgagtggaaccacaactattttcgccggccatctgaaatgccgtctaaagatggataaactcaccctgaaggggatgtcttatgtgatgtgtacaggatccttcaaacttgaaaaggaggtcgctgagactcagcacggtaccgtgttggttcaggtgaagtacgaaggcacggacgcgccttgcaaaataccatttagcacacaagatgagaagggggtaacccagaacggacgcctgatcactgcaaatcccattgtcatcgacaaagaaaagcctgtgaacatagagacagagccacccttcggcgaatcgtatattgttgtgggtgccggggagaaagctctcaagctgtcttggtttaagagaggctcctcaatcggaaaaatgttcgaagccaccgcaaggggcgcccggcgaatggctatccttggggatactgcctgggactttggaagtattggtggcgtcttcaccagcgtggggaagctggtacatcagatctttggaacagcatacggcgtgttgttctccggtgtttcttggacgatgaaaattgggataggcatcctcctgacctggttaggactgaatagccgctcaatgagtctatccatgacttgtattgcggtcggcatggtgacactctacctgggggtgatggtccaggctgatagcggatgcgttatcaactggaagggcagagagcttaaatgtggttctgggatctttgtgaccaacgaagtgcacacatggactgagcaatataagttccaggccgactcaccgaagaggttgagtgcagccattggaaaagcttgggaggaaggcgtatgcggtatacggagcgccacccgcctggagaatatcatgtggaagcagatttccaacgaactcaatcatatcctgttagagaacgatatgaaatttacggtcgtggttggcgacgcaaatgggattctggctcagggaaagaaaatgatcagacctcaacccatggaacacaagtactcttggaaatcgtggggcaaggccaagataatcggggcggacattcagaacacaaccttcatcattgatggaccagacactcctgagtgtcccgatggccagagggcctggaatatctgggaggtggaagactatggttttggggtcttcaccacaaacatatggcttaaattgcgtgatagctacactcagatgtgcgaccaccggctcatgtccgctgcaattaaggattcaaaagccgtgcatgctgacatgggatattggatcgagagtgaaaagaatgagacctggaaactggcccgagcatctttcattgaagttaagacatgtacgtggccaaagagccacaccctatggtccaacggcgtgctggagtcagagatgatcatacccaaaatctacggtggccctattagccaacataattatagaccagggtactttactcagacagcgggaccgtggcacctcggcaagctggaacttgatttcgacttgtgcgaggggaccactgtagtcgtggatgaacactgcggaaacaggggcccctctctgcgcacaaccacggtgactggtaaaatcattcatgagtggtgttgccggtcctgtaccttacctccactcagatttaggggggaggacggatgctggtacggcatggaaatccgccccgtcaaggagaaagaagagaatctggttcgaagtatggtgagcgccggttctggcgaagtagattccttctcacttgggatactgtgtgtgagtattatgatcgaggaggtcatgcggagccgttggtcgagaaagatgttgatgacaggaaccctcgctgtgtttctgctactgatcatgggccagctcacttggaacgacctgattaggctttgcatcatggttggggccaatgcatccgaccgcatgggaatgggcacaacctatttggctctgatggccacattcaagatgcggcctatgtttgcagtgggtttactcttcagaaggctgacttctcgagaagtccttctgctaaccattgggctcagcctggtggcctcagttgagttgccaaacagtctggaagagttaggagatggcctcgctatgggcataatgatgctgaaacttctgacggaatttcaaccccaccagttgtggacaaccctcctgtccctaactttcgtgaagaccacactgtctcttgactacgcgtggaaaactaccgccatggcactcagcatcgtctccctgtttccgttgtgtctgtcaacgacaagccagaagaccacttggttacctgtactcctggggagtttcggatgcaaaccacttacaatgtttctgattaccgagaacaagatctggggtcgcaagtcttggcccttgaatgagggcattatggctatcgggatagtgtccatcctcctgagctcgctactgaaaaacgatgttcctcttgccggacccctcattgccggcggtatgctgatcgcttgttatgtgatttcagggtctagtgcagacttgtccttagaaaaggccgcggaggtcagctgggaacaggaggctgaacattctggagccagccactccatcctggtggaggtacaagatgacggcactatgaaaataaaggatgaggaacgggacgatacactcaccattctgcttaaagcaacgctgttggccgtgtcaggcgtctacccaatgagtatccctgctactctattcgtttggtatttctggcagaagaaaaagcagagaagcggggtgctgtgggacaccccctctccaccggaggtggaaagggcagtcctcgataatggaatctaccgtattctgcagcgcggtcttttaggccggtcccaagtgggggttggagtatttcaggacggcgtgttccatacaatgtggcacgtcaccagaggtgccgtgctgatgtatcaggggaagaggctcgagccttcatgggcgagtgttaaaaaggatttgataagctacggaggcggctggcgatttcaggggtcctggaacacaggagaggaagtgcaagtcatcgctgtggagcccggtaaaaatccaaagaacgtacagactacccccggcacgttcaaaacacctgaaggggaggtcggagccattgcactggactttaagccaggcacttctggttcgcccatcgtgaatcgggaagggaagattgttggactctacggcaacggcgtggtcaccacaagcgggacctatgtgtcagccatcgctcaggccaaagcatcccaagagggacctctgccggagatagaagacgaggttttcaagaaacgcaatcttactatcatggatctgcacccaggtagtggcaagaccagaaggtacttgcccgctattgtgcgggaagccatcaaacgaaagctaagaacactgattctcgcgcctacgcgcgtcgtggcctctgagatggcagaagctttaaaggggatgccaatcaggtatcagactaccgccgtaaaaagcgagcatacaggacgtgagatagtggacctgatgtgccacgctacctttactatgcggcttctgtcccccgttagagtccctaactacaatatgattatcatggatgaagcacatttcacagacccggcctcaatcgccgctaggggctatatttctacccgcgtgggtatgggggaggcggcagccatctttatgacggctactcccccaggaagcgtggaagccttccctcagagtaacgcagtcatacaggatgaggaacgagacattcccgagagatcctggaatagcggctacgattggatcacagactttccaggcaagaccgtatggttcgtgccttctattaaatcagggaacgatatcgccaattgtctccggaagaacggaaaaagggttatacaattgtcccgcaagaccttcgacactgagtatcagaagacaaaaaacaatgattgggactacgtggtcaccacagacattagtgaaatgggtgctaactttcgtgcggatagagtgatcgacccccggaggtgcctgaagccagttatcctcaaagatggcccggagcgcgtgattctggccgggcctatgcccgtcactgcagctagcgccgcacagcgaagaggacggatcggcaggaatcagaacaaggaaggtgaccaatacgtgtatatggggcagccacttaataacgatgaggaccacgcccattggacggaggctaaaatgctactggataatattaacacccccgaaggcataatccctgccttgttcgagccagaacgcgagaagtcggcggcaattgacggagaatacagattaaggggcgaggcccggaagacatttgtagagctgatgcgtcgcggggatctccccgtgtggctgtcttataaagttgcttccgaaggattccagtacagcgaccgaagatggtgctttgatggtgagaggaataaccaggtccttgaagagaatatggacgtggaaatctggactaaggagggcgagcggaaaaagctgcgccctagatggctcgatgccaggacctattcagacccgttggctctgcgggaattcaaagagtttgcagccgggcgaagaagtgtgtctggagacctaatcctggaaattggcaagctcccacaacaccttacactgcgcgctcagaacgccttagataatttggtcatgctgcacaactccgagcagggtgggaaagcatacaggcatgcgatggaagagctccccgacaccatagagactctgatgcttctggccctcatcgctgttttgacgggcggagtgaccctgttctttttaagcggcaaggggctaggaaagacatcaattggtctgctctgtgtaactgccagtagcgcacttctgtggatggcttccgtggaacctcactggatcgccgcatctattatcttggagttctttctgatggtcctcctgatacccgaaccagatcggcagcgtacccctcaagacaatcagcttgcctatgtggttatcggcctcctgttcatgattttgacagtggctgcgaacgagatggggctgttagagaccactaaaaaggatctaggaatcggctacgtcgccgcagaaaaccatcagcacgctacaatgctggacgtagatctccaccccgccagcgcctggacgctttacgcagtggctaccactgttattacaccaatgatgagacataccatcgagaataccacagccaacatatccctgactgcgattgctaatcaagccgcaatcttgatgggtctggacaaagggtggcctatttcaaagatggatatcggcgtgccgctcctggcccttggatgctattctcaggtcaaccccttaacgctgaccgctgcagtgctcatgttggtcgcccactacgcgataatcggcccagggctgcaggctaaagccacaagggaagcacagaagcgcactgccgctggaattatgaagaatcctaccgtggacggcatcgttgccattgatctagaccccgtggtatatgatgcaaaatttgagaagcaactgggtcagatcatgctccttatactgtgtacaagtcagattttgctgatgcggaccacttgggctctctgcgaatcgatcacgctggccacagggccattaaccactctttgggagggaagccctggcaaattctggaacaccacaatcgcggtgtccatggccaatattttccgaggttcttacctggcaggcgctgggctcgccttttcactaatgaagagcctgggaggcgggagaaggggaactggcgcacagggtgagaccttgggggaaaaatggaagcgccaactgaaccagctctccaagagtgagttcaatacatataaacggtctggaatcatggaagtcgacagaagcgaggctaaggaaggccttaaacgtggtgagacgaccaagcatgccgtttcaaggggcactgccaaactgcggtggtttgtggagcgcaacttggtcaagcccgaagggaaggtgatagacctgggatgtggccgagggggatggtcctactattgcgcgggcctcaaaaaggtaacagaggtgaaaggttacaccaaggggggaccgggccacgaagagccaattcctatggctacttacggctggaatttagttaaactgcatagtgggaaggatgtgttctttatgcccccagaaaaatgtgacacacttctgtgcgatatcggagagagctctcccaaccctaccattgaggaaggtagaacgctaagggtcctcaagatggtggagccgtggctgcggggcaatcagttctgtatcaagatattgaacccctatatgccatccgtcgtggaaaccctggagcgcatgcagagaaaacacgggggaatgctcgttaggaatcctctttcacgaaacagcacacacgagatgtactgggtatcgtgcggcactggtaatatcgtgtctgcagtcaacatgaccagtcggatgctgttaaaccgttttacaatggcccatagaaagcccacttatgaacgcgacgtggatctgggggctggaaccaggcacgttgccgtggagcctgaagtcgcaaatttggacattatcggccaacggattgagaacatcaaaaatgaacataagtccacatggcactacgatgaggacaacccatataaaacctgggcctaccacggcagctatgaggtgaagccctcagggtccgcttctagcatggtaaatggagtggttagactcctgactaagccttgggatgtcattccaatggtgacgcagatcgcgatgacagacaccactcccttcggtcagcaacgcgtgtttaaagaaaaggtcgataccaggacaccgcgagccaaacggggcacgacccagataatggaggttactgcaaagtggctatgggggttccttagtagaaacaaaaagcctaggatttgtacacgcgaagagtttacccgtaaggtgcggtccaatgctgccatcggagcagtattcgtggacgaaaaccagtggaatagcgccaaagaggctgtcgaggacgaaagattttgggatctggtgcatagggagcgcgaactccacaagcagggcaaatgcgccacttgcgtttacaacatgatgggtaagcgagagaaaaagctgggggaattcggaaaggcgaaaggctctcgggcaatctggtacatgtggttgggcgccagattcctggagtttgaggctctcgggttcatgaatgaagaccattggttttcaagggagaacagtctttccggagtggaaggtgagggcctgcacaagttagggtatattctgcgcgatataagcaaaatcccaggaggcaatatgtacgccgacgatacagcaggttgggacaccagagtcacagaggatgacttgcaaaacgaagctaagattactgatatcatggagcccgaacatgccctcctggctacctctattttcaaactaacgtatcagaataaggtggtacgggttcagaggcctgccaaaaacgggaccgtgatggacgtcatctcgcgtcgagatcagcgcggatcaggccaagtgggcacatacgggcttaacacttttaccaatatggaggtgcagctgataagacagatggaaagcgagggaatcttcctcccatccgagctggaaacacccaacttggcagagcgggcgttaggttggctggaaaagcacggcgccgagaggctcaagcgcatggctattagtggggacgattgtgtcgttaaaccgatcgacgacagatttgccactgcacttaccgctctgaatgatatgggaaaggtgcggaaagacattcctcagtgggaaccctctaagggctggaacgattggcaacaggtaccattctgcagccaccattttcaccagctaatcatgaaagacggtagggagatagtggtcccttgtcgaaatcaggatgagctggtggggcgtgccagagtttcccaaggagcaggctggtcactccgcgaaacggcctgcttgggcaagagttatgcgcagatgtggcagctgatgtacttccatcggagggaccttagactggctgccaacgcaatttgttctgccgtgcccgtcgattgggtgccaacaagccgcaccacttggtccatccacgctcaccatcaatggatgacaaccgaggacatgctctcagtatggaatcgggtttggatcgaagagaacccctggatggaaaataagactcacgtgagctcttgggaggaggtcccttatttagggaaaagggaagatcagtggtgcggatccctgattggtttgaccgcccgagcaacatgggctacgaacatacaggtggccatcaatcaggttagacggctgattggcaacgagaattacctcgactacatgaccagtatgaagaggtttaaaaacgaaagcgattcggagggggcgctttggtga

SEQ ID NO: 13453 - RNA, 9879 nt, synthetic construct
  misc_feature 1..9879: note = derived and/or modified CDS sequence (opt3) from DENV-1__KJ189358__SS-prME
  source 1..9879: mol_type = other RNA
agcgtgaccatgctgctcatgcttctgcccacagtcttggccttccacttaactacgagaggcggggagcctcatatgatcgtttccaagcaggaaaggggaaaatctctgctatttaagacctcagctggtgtgaacatgtgcacactcattgcaatggacctgggcgagctttgtgaagatactatgacctacaaatgcccacggataacagaggccgaaccggacgatgtagactgttggtgcaatgcgaccgatacttgggtgacatatgggacctgtagtcaaacgggagagcaccgccgagagaagcgtagcgtcgctctggccccccatgtgggcttgggtctcgaaactagaaccgagacatggatgtcctctgaaggggcatggaaacagatccagagggttgagacttgggccctgcggcaccctggattcaccgtgattgcttttttcctggcacatgccatcggcacatcgattacccagaagggcatcatatttatcctcttaatgctggtcacgccatcaatggctatgcgctgcgtggggattggaaacagagacttcgtagagggtcttagcggcgccacttgggttgatgtggtcttggaacacgggagttgtgtgacaaccatggcgaagaataaacccactctggacatcgagctactcaagacagaagtgaccaaccctgcagtcctgaggaaactttgcattgaggccaagatctccaatacgaccacagattctcggtgtccaactcaaggagaagctaccctggttgaggagcaggacgccaactttgtgtgccgccgaacattcgtagatagaggctggggtaatgggtgtggattgtttggcaaaggcagcctcctgacttgcgcaaagttcaagtgcgtgaccaaattagaagggaagatagtccagtacgagaacctgaaatattccgtgattgttacagtgcacaccggagaccagcatcaagtcggtaatgaaactacggagcacggcacaatcgctaccattactccccaggcccctacctcagaaatccagctcacagattacggggcgcttaccctggactgtagtccaaggactggattggactttaacgagatggtgctactgacaatgaaggagaaaagctggctcgtacataagcagtggttcctggatcttccgctgccctggacgtctggcgcctccacctcacaagaaacttggaatcggcaggacttgctcgttacatttaaaaccgcacacgctaagaagcaggaggtggtcgtgctgggtagccaagaaggggccatgcacacagctttaactggcgccaccgagatccagacgagtggaaccacaactattttcgcaggccatctgaaatgccgtctaaagatggataaactcaccctgaaggggatgtcttatgtcatgtgtacaggatccttcaaacttgaaaaggaggtggccgagactcagcacggtaccgttttggtgcaggtaaagtacgaaggcacggacgctccttgcaaaataccatttagcacacaagatgagaagggggtcacccagaacggacgcctgatcactgcgaatcccattgtgacagacaaagaaaagcctgttaacatcgagaccgagccacccttcggcgaatcgtatatagtggtcggtgcaggggagaaagccctcaagctgtcttggtttaagagaggctcctcaattggaaaaatgttcgaagctactgccaggggcgcacggcgaatggccatccttggggataccgcttgggactttggaagtatcggtggcgtgttcacaagcgtagggaagctggtgcatcaggtttttggaacggcctacggcgtcttgttctccggtgtgtcttggaccatgaaaattgggatcggcattctcctgacttggttaggactgaatagccgctcaacaagtctatccatgacctgtatagcagtgggcatggtcacactctacctgggggttatggtgcaggcggatagcggatgcgtgatcaactggaagggcagagagcttaaatgtggttctgggatttttgtaactaacgaagtccacacctggacggagcaatataagttccaggctgactcaccgaagaggttgagtgccgcaatcggaaaagcctgggaggaaggcgtgtgcggtatccggagcgctacacgcctggagaatattatgtggaagcagatatccaacgaactcaatcatatcctgttagagaacgatatgaaatttaccgttgtggtcggcgacgccaatgggattctggcacagggaaagaaaatgatcagacctcaacccatggaacacaagtactcttggaaatcgtggggcaaggctaagattatcggggccgacatacagaacactaccttcatcattgatggaccagacacacctgagtgtcccgatggccagagggcgtggaatatctgggaggtggaagactatggttttggggttttcactaccaacatttggcttaaattgcgtgatagctacacacagatgtgcgaccaccggctcatgtccgccgctatcaaggattcaaaagcagtgcatgccgacatgggatattggatagagagtgaaaagaatgagacgtggaaactggctcgagcctctttcattgaagtaaagacctgtacttggccaaagagccacacactatggtccaacggcgtcctggagtcagagatgatcattcccaaaatctacggtggccctataagccaacataattatagaccagggtactttacccagactgcaggaccgtggcacctcggcaagctggaacttgatttcgacttgtgcgaggggacaaccgtggtggtcgatgaacactgcggaaacaggggcccctctctgcgcacgactaccgttacaggtaaaatcattcatgagtggtgttgccggtcctgtaccttacctccactcagatttaggggggaggacggatgctggtacggcatggaaatccgccccgtgaaggagaaagaagagaatctggtacgaagtatggtgagcgcgggttctggcgaagtcgattccttctcacttgggattctgtgtgtgagtatcatgatagaggaggttatgcggagccgttggtcgagaaagatgttgatgactggaacactcgccgtgtttctgctactgattatgggccagctcacctggaacgacctgatcaggctttgcatcatggtcggggctaatgcctccgaccgcatgggaatgggcacaactcacttggcactgatggctaccttcaagatgcggcctatgtttgccgtgggtttactcttcagaaggctgacgtctcgagaagttcttctgctaacaattgggctcagcctggtggcatcagtcgagttgccaaacagtctggaagagttaggagatggcctcgccatgggcatcatgatgctgaaacttctgaccgaatttcaaccctatcagttgtggactaccctcctgtccctaacattcgtaaagactaccctgtctcttgactacgcttggaaaacgacagcgatggccctcagcattgtgtccctgtttccgttgtgtctgtcaaccactagccagaagacaacctggttacctgttctcctggggagtttcggatgcaaaccacttactatgtttctgataacagagaacaagatctggggtcgcaagtcttggcccttgaatgagggcattatggcaatcgggattgtgtccatcctcctgagctcgctactgaaaaacgatgtccctcttgctggacccctcatagccggcggtatgctgatcgcctgttatgtgatttcagggtctagtgctgacttgtccttagaaaaggcagccgaggtaagctgggaacaggaggcggaacattctggagctagccactccatcctggtggaggtccaagatgacggcaccatgaaaattaaggatgaggaacgggacgatacgctcactatcctgcttaaagccaccctgttggcagtttcaggcgtgtacccaatgagtatacctgccacactattcgtgtggtatttctggcagagaaagaaacagaggagcggggtcctgtgggacaccccctctccaccggaggtggaacgtgctgttctcgataatggaatttaccgcatcctgcagcggggtcttttaggcagatcccaagtaggggtgggagtctttcaggacggcgtgttccatacaatgtggcacgttactaggggtgcagtgctgatgtatcaggggaagcgactcgagccttcatgggccagtgtcaagaaagatttgatcagctacggaggcggctggcggtttcaggggtcctggaacaccggagaggaagtgcaagtaattgcggtcgagcccggtaagaatccaaaaaacgtgcagacgacacccggcactttcaagacccctgaaggggaggttggagctatagccctggactttaaaccaggcacatctggttcgcccatcgtgaatcgcgaagggaagattgtcggactctacggcaacggcgtggttaccactagcgggacctatgtgtcagcaatcgcccaggctaaggcctcccaagagggacctctgccggagattgaagacgaggtcttcaaaaagagaaatcttacaatcatggatctgcacccaggtagtggcaaaacgaggaagtacttgcccgcaatagtgcgggaagctatcaaacgaaagctaagaactctgattctcgcccctacccgcgtagtggcgtctgagatggccgaagcattaaaggggatgccaatcaggtatcagacaaccgctgttaaaagcgagcatactggacgtgagattgtcgacctgatgtgccacgccacatttaccatgcggcttctgtcccccgtgagagtgcctaactacaatatgatcataatggatgaagctcatttcacggacccggcatcaattgccgccaggggctatatctctactcgcgtcggtatgggggaggctgcggcaatctttatgacagccacccccccaggaagcgtagaagctttccctcagagtaacgccgtgattcaggatgaggaacgagacatccccgagagatcctggaatagcggctacgattggataaccgactttccaggcaagactgtttggttcgtgccttctattaaatcagggaacgatatcgcaaattgtctccggaagaacggaaaaagggtcattcaattgtcccgcaagacattcgacaccgagtatcagaagacaaaaaacaatgattgggactacgtggttactacggacatcagtgaaatgggtgccaactttcgtgctgatagagtgatagacccccggaggtgcctgaagccagtcattctcaaagatggcccggagcgcgtgatcctggcggggcctatgcccgtaaccgtggccagcgcagctcagcgaagaggacggatcggcaggaatcagaacaaggaaggtgaccaatacgtttatatggggcagccacttaataacgatgaggaccacgcccattggacagaggcaaaaatgctactggataatattaacactcccgaaggcatcattcctgccttgttcgagccagaacgcgagaagtcggctgccatagacggagaatacagattaaggggcgaggcgcggaagacctttgtcgagctgatgcgtcgcggggatctccccgtgtggctgtcttataaagtggcatccgaaggattccagtacagcgaccgaagatggtgctttgatggtgagaggaataaccaggtccttgaagagaatatggacgttgaaatctggacaaaggagggcgagcggaaaaagctgcgccctagatggctcgatgccaggacctattcagacccgttggctctgcgggaattcaaagagtttgccgctgggcgaagaagtgtgtctggagacctaattctggaaatcggcaagctcccacaacaccttactctgcgcgcacagaacgccttagataatttggtaatgctgcacaactccgagcagggtgggaaagcttacaggcatgccatggaagagctccccgacacgatcgagaccctgatgcttctggcactcattgcggtgttgacaggcggagtcactctgttctttttaagcggcaaggggctaggaaagacctcaataggtctgctctgtgtgacagccagtagcgctcttctgtggatggcctccgttgaacctcactggatcgcagcttctattatcttggagttctttctgatggtgctcctgattcccgaaccagatcggcagcgtacccctcaagacaatcagcttgcctatgtcgtaatcggcctcctgttcatgatattgactgtggcagccaacgagatggggctgttagagacaacgaaaaaggatctaggaatcggctacgttgctgcggaaaaccatcagcacgccaccatgctggacgtggatctccaccccgcaagcgcttggactctttacgccgtcgccacaaccgtgattaccccaatgatgagacatacaatcgagaatactacggcaaacatttccctgaccgctatcgccaatcaagcggctatattgatgggtctggacaaagggtggcctatttcaaagatggatatcggcgtcccgctcctggcccttggatgctattctcaggtgaaccccttaacactgactgcagccgttctcatgttggtggctcactacgcaattatcggcccagggctgcaggccaaagcgaccagggaagctcagaagcgcacagccgcaggaataatgaagaatcctaccgtagacggcatcgtggccattgatctagaccccgtcgtttatgatgctaaatttgagaagcaactgggtcagatcatgctccttattctgtgtactagtcagatcttgctgatgcggacgacatgggccctctgcgaatcgataaccctggcaactgggccattaaccacactttgggagggaagccctggcaaattctggaacactaccattgctgtgtccatggccaatatcttccgaggttcttacctggcgggcgccgggctcgcattttcactaatgaagagcctgggaggcgggagaaggggaacaggcgctcagggtgagacgttgggggaaaaatggaagcgccaactgaaccagctctccaagagtgagttcaatacctataaacggtctggaatcatggaagtcgacagaagcgaggccaaggaaggccttaaacgtggtgagactacaaagcatgcagtgtcaaggggcaccgctaaactgcggtggtttgtagagcgcaacttggtgaagcccgaagggaaggttattgacctgggatgtggccgagggggatggtcctactattgcgccggcctcaaaaaggtgactgaggtcaaaggttacacaaaggggggaccgggccacgaagagccaatccctatggccacctacggctggaatttagtgaaactgcatagtgggaaggatgtcttctttatgcccccagaaaaatgtgacacgcttctgtgcgatataggagagagctctcccaaccctaccattgaggaaggtagaacactaagggtgctcaagatggttgagccgtggctgcggggcaatcagttctgtatcaagattttgaacccctatatgccatccgtagtggaaactctggagcgcatgcagagaaaacacgggggaatgctcgtcaggaatcctctttcacgaaacagcacccacgagatgtactgggtgtcgtgcggcacaggtaatatcgtttctgcggtgaacatgactagtcggatgctgttaaaccgttttaccatggctcatagaaagcccacatatgaacgcgacgtcgatctgggggcaggaaccaggcacgtggccgtagagcctgaagtggctaatttggacataatcggccaacggattgagaacatcaaaaatgaacataagtccacttggcactacgatgaggacaacccatataaaacgtgggcctaccacggcagctatgaggttaagccctcagggtccgcatctagcatggtcaatggagtggtgagactcctgacaaagccttgggatgtcattccaatggttacccagatcgccatgactgacaccacacccttcggtcagcaacgcgtgtttaaagaaaaggtagatacgaggaccccgcgagctaaacggggcactacacagattatggaggtgaccgcgaagtggctatgggggttccttagtagaaacaaaaagcctaggatctgtactcgcgaagagtttacacgtaaggtccggtccaatgccgcaataggagctgtgttcgttgacgaaaaccagtggaatagcgccaaagaggcagtggaggacgaaagattttgggatctggtccatagggagcgcgaactccacaagcagggcaaatgcgccacctgcgtgtacaacatgatgggtaagcgagagaaaaagctgggggaattcggaaaggctaaaggctctcgggccatttggtacatgtggttgggcgcgagattcctggagtttgaggcactcgggttcatgaatgaagaccattggttttcaagggagaacagtctttccggagtagaaggtgagggcctgcacaagttagggtatatcctgcgcgatatcagcaaaattccaggaggcaatatgtacgccgacgatacagctggttgggacactagaataaccgaggatgacttgcaaaacgaagccaagatcacggatattatggagcccgaacatgcacagctcgctacctctatcttcaaactgacatatcagaataaggttgtgcgggtccagaggcctgccaaaaacgggactgtgatggacgtgatttcgcgtcgagatcaacgcggatcaggccaggtcggcacctacgggctaaacacatttactaatatggaggttcagcttatcagacagatggaaagcgagggaatattcctgccatccgagctcgaaacccccaacctggctgagcgggccttggactggttagaaaagaatggtgcagagaggctgaagcgcatggcgatcagtggcgatgactgtgtggtaaaaccgattgacgatagatttgccacggctctcacagcccttaacgacatggggaaggtgcggaaagatatccctcaatgggaaccctctaagggatggaatgactggcagcaggtcccattctgcagccaccactttcatcagctgattatgaaagatggcagggagatcgtggttccttgtcgaaaccaagacgagctagtgggtcgtgcaagagtctcccagggggctggatggtcactgcgcgaaaccgcctgcctcggcaagagttatgcacagatgtggcaattgatgtacttccaccggagggatctgagacttgccgcgaatgctatatgttctgccgtgcccgtagactgggttccaactagccgcacaacctggtccattcatgcacaccaccagtggatgactaccgaggatatgctgtcagtgtggaaccgggtctggatcgaagagaatccctggatggaagacaagacacatgtgagctcttgggaggaggttccttatctcggcaaaagggaagatcagtggtgcgggtccttaatcggactgacggcccgagctacctgggccactaacattcaggtggcaataaatcaagtcagacggttgatcggtaacgagaattacctggactacatgacaagtatgaagaggtttaaaaacgaaagcgactcggagggcgctctctggtga

SEQ ID NO: 13454 - RNA, 9879 nt, synthetic construct
  misc_feature 1..9879: note = derived and/or modified CDS sequence (opt3) from DENV-1__KJ189359__SS-prME
  source 1..9879: mol_type = other RNA
agcgtgaccatgctgctcatgcttctgcccacagtcttggccttccacttaactacgagaggcggggagcctcatatgatcgtttccaagcaggaaaggggaaaatctctgctatttaagacctcagctggtgtgaacatgtgcacactcattgcaatggacctgggcgagctttgtgaagatactatgacctacaaatgcccacggataacagaggccgaaccggacgatgtagactgttggtgcaatgcgaccgatacttgggtgacatatgggacctgtagtcaaacgggagagcaccgccgagagaagcgtagcgtcgctctggccccccatgtgggcttgggtctcgaaactagaaccgagacatggatgtcctctgaaggggcatggaaacagatccagagggttgagacttgggccctgcggcaccctggattcaccgtgattgcttttttcctggcacatgccatcggcacatcgattacccagaagggcatcatatttatcctcttaatgctggtcacgccatcaatggctatgcgctgcgtggggattggaaacagagacttcgtagagggtcttagcggcgccacttgggttgatgtggtcttggaacacgggagttgtgtgacaaccatggcgaagaataaacccactctggacatcgagctactcaagacagaagtgaccaaccctgcagtcctgaggaaactttgcattgaggccaagatctccaatacgaccacagattctcggtgtccaactcaaggagaagctaccctggttgaggagcaggacgccaactttgtgtgccgccgaacattcgtagatagaggctggggtaatgggtgtggattgtttggcaaaggcagcctcctgacttgcgcaaagttcaagtgcgtgaccaaattagaagggaagatagtccagtacgagaacctgaaatattccgtgattgttacagtgcacaccggagaccagcatcaagtcggtaatgaaactacggagcacggcacaatcgctaccattactccccaggcccctacctcagaaatccagctcacagattacggggcgcttaccctggactgtagtccaaggactggattggactttaacgagatggtgctactgacaatgaaggagaaaagctggctcgtacataagcagtggttcctggatcttccgctgccctggacgtctggcgcctccacctcacaagaaacttggaatcggcaggacttgctcgttacatttaaaaccgcacacgctaagaagcaggaggtggtcgtgctgggtagccaagaaggggccatgcacacagctttaactggcgccaccgagatccagacgagtggaaccacaactattttcgcaggccatctgaaatgccgtctaaagatggataaactcaccctgaaggggatgtcttatgtcatgtgtacaggatccttcaaacttgaaaaggaggtggccgagactcagcacggtaccgttttggtgcaggtaaagtacgaaggcacggacgctccttgcaaaataccatttagcacacaagatgagaagggggtcacccagaacggacgcctgatcactgcgaatcccattgtgacagacaaagaaaagcctgttaacatcgagaccgagccacccttcggcgaatcgtatatagtggtcggtgcaggggagaaagccctcaagctgtcttggtttaagagaggctcctcaattggaaaaatgttcgaagctactgccaggggcgcacggcgaatggccatccttggggataccgcttgggactttggaagtatcggtggcgtgttcacaagcgtagggaagctggtgcatcaggtttttggaacggcctacggcgtcttgttctccggtgtgtcttggaccatgaaaattgggatcggcattctcctgacttggttaggactgaatagccgctcaacaagtctatccatgacctgtatagcagtgggcatggtcacactctacctgggggttatggtgcaggcggatagcggatgcgtgatcaactggaagggcagagagcttaaatgtggttctgggatttttgtaactaacgaagtccacacctggacggagcaatataagttccaggctgactcaccgaagaggttgagtgccgcaatcggaaaagcctgggaggaaggcgtgtgcggtatccggagcgctacacgcctggagaatattatgtggaagcagatatccaacgaactcaatcatatcctgttagagaacgatatgaaatttaccgttgtggtcggcgacgccaatgggattctggcacagggaaagaaaatgatcagacctcaacccatggaacacaagtactcttggaaatcgtggggcaaggctaagattatcggggccgacatacagaacactaccttcatcattgatggaccagacacacctgagtgtcccgatggccagagggcgtggaatatctgggaggtggaagactatggttttggggttttcactaccaacatttggcttaaattgcgtgatagctacacacagatgtgcgaccaccggctcatgtccgccgctatcaaggattcaaaagcagtgcatgccgacatgggatattggatagagagtgaaaagaatgagacgtggaaactggctcgagcctctttcattgaagtaaagacctgtacttggccaaagagccacacactatggtccaacggcgtcctggagtcagagatgatcattcccaaaatctacggtggccctataagccaacataattatagaccagggtactttacccagactgcaggaccgtggcacctcggcaagctggaacttgatttcgacttgtgcgaggggacaaccgtggtggtcgatgaacactgcggaaacaggggcccctctctgcgcacgactaccgttacaggtaaaatcattcatgagtggtgttgccggtcctgtaccttacctccactcagatttaggggggaggacggatgctggtacggcatggaaatccgccccgtgaaggagaaagaagagaatctggtacgaagtatggtgagcgcgggttctggcgaagtcgattccttctcacttgggattctgtgtgtgagtatcatgatagaggaggttatgcggagccgttggtcgagaaagatgttgatgactggaacactcgccgtgtttctgctactgattatgggccagctcacctggaacgacctgatcaggctttgcatcatggtcggggctaatgcctccgaccgcatgggaatgggcacaacttatttggcactgatggctaccttcaagatgcggcctatgtttgccgtgggtttactcttcagaaggctgacgtctcgagaagttcttctgctaacaattgggctcagcctggtggcatcagtcgagttgccaaacagtctggaagagttaggagatggcctcgccatgggcatcatgatgctgaaacttctgaccgaatttcaaccccaccagttgtggactaccctcctgtccctaacattcgtaaagactaccctgtctcttgactacgcttggaaaacgacagcgatggccctcagcattgtgtccctgtttccgttgtgtctgtcaaccactagccagaagacaacctggttacctgttctcctggggagtttcggatgcaaaccacttactatgtttctgataacagagaacaagatctggggtcgcaagtcttggcccttgaatgagggcattatggcaatcgggattgtgtccatcctcctgagctcgctactgaaaaacgatgtccctcttgctggacccctcatagccggcggtatgctgatcgcctgttatgtgatttcagggtctagtgctgacttgtccttagaaaaggcagccgaggtaagctgggaacaggaggcggaacattctggagctagccactccatcctggtggaggtccaagatgacggcaccatgaaaattaaggatgaggaacgggacgatacgctcactatcctgcttaaagccaccctgttggcagtttcaggcgtgtacccaatgagtatacctgccacactattcgtgtggtatttctggcagagaaagaaacagaggagcggggtcctgtgggacaccccctctccaccggaggtggaacgtgctgttctcgataatggaatttaccgcatcctgcagcggggtcttttaggcagatcccaagtaggggtgggagtctttcaggacggcgtgttccatacaatgtggcacgttactaggggtgcagtgctgatgtatcaggggaagcgactcgagccttcatgggccagtgtcaagaaagatttgatcagctacggaggcggctggcggtttcaggggtcctggaacaccggagaggaagtgcaagtaattgcggtcgagcccggtaagaatccaaaaaacgtgcagacgacacccggcactttcaagacccctgaaggggaggttggagctatagccctggactttaaaccaggcacatctggttcgcccatcgtgaatcgcgaagggaagattgtcggactctacggcaacggcgtggttaccactagcgggacctatgtgtcagcaatcgcccaggctaaggcctcccaagagggacctctgccggagattgaagacgaggtcttcaaaaagagaaatcttacaatcatggatctgcacccaggtagtggcaaaacgaggcggtacttgcccgcaatagtgcgagaagctatcaagagaaaactacgcactctgattctcgcccctaccagggtagtggcgtctgagatggccgaagcattaaaggggatgccaatccgttatcagacaaccgctgttaagagcgagcatactggacgggagattgtcgacctgatgtgccacgccacatttaccatgagacttctgtcccccgtgagggtgcctaactacaatatgatcataatggatgaagctcatttcacggacccggcatcaattgccgcccgcggctatatctctactcgagtcggtatgggggaggctgcggcaatctttatgacagccacccccccaggaagcgtagaagctttccctcagagtaacgccgtgattcaggatgaggaaagagacatccccgagcggtcctggaatagcggctacgattggataaccgactttccaggcaaaactgtttggttcgtgccttctattaagtcagggaacgatatcgcaaattgtctcaggaaaaacggaaagcgcgtcattcaattgtcccgtaaaacattcgacaccgagtatcagaagacaaagaacaatgattgggactacgtggttactacggacatcagtgaaatgggtgccaactttagagctgatcgggtgatagaccccaggcgctgcctgaaaccagtcattctcaaggatggcccggagcgagtgatcctggcggggcctatgcccgtaaccgtggccagcgcagctcagagacggggaaggatcggccgcaatcagaacaaagaaggtgaccaatacgtttatatggggcagccacttaataacgatgaggaccacgcccattggacagaggcaaagatgctactggataatattaacactcccgaaggcatcattcctgccttgttcgagccagaaagagagaaatcggctgccatagacggagaatacaggttacggggcgaggcgcgtaagacctttgtcgagctgatgcgccgaggggatctccccgtgtggctgtcttataaggtggcatccgaaggattccagtacagcgacagaaggtggtgctttgatggtgagcggaataaccaggtccttgaagagaatatggacgttgaaatctggacaaaagagggcgagcgcaagaaactgagacctaggtggctcgatgcccggacctattcagacccgttggctctgcgagaattcaaggagtttgccgctgggagacgcagtgtgtctggagacctaattctggaaatcggcaaactcccacaacaccttactctgagggcacagaacgccttagataatttggtaatgctgcacaactccgagcagggtgggaaggcttaccggcatgccatggaagagctccccgacacgatcgagaccctgatgcttctggcactcattgcggtgttgacaggcggagtcactctgttctttttaagcggcaaagggctaggaaagacctcaataggtctgctctgtgtgacagccagtagcgctcttctgtggatggcctccgttgaacctcactggatcgcagcttctattatcttggagttctttctgatggtgctcctgattcccgaaccagatcgtcagagaacccctcaagacaatcagcttgcctatgtcgtaatcggcctcctgttcatgatattgactgtggcagccaacgagatggggctgttagagacaacgaagaaagatctaggaatcggctacgttgctgcggaaaaccatcagcacaccactatgctggacgtggatctccaccccgccagcgcatggacactttacgctgtcgccaccaccgtgattacaccaatgatgaggcatactatcgagaatacgaccgccaacatttccctgacagcaatcgctaatcaagccgcgatattgatgggtctggacaaggggtggcctatttcaaaaatcgatattggcgtcccgctcctggctcttggatgctattctcaggtgaaccccttaactctgaccgccgcagttctcatgttggtggcccactacgctatcataggcccagggctgcaggcaaaggccacacgcgaagcgcagaaacggaccgctgccggaatcatgaagaatcctactgtagacggcattgtggcaatcgatctagaccccgtcgtttatgatgccaagtttgagaaacaactgggtcagattatgctccttatcctgtgtacgagtcagatattgctgatgcgaacaacctgggctctctgcgaatcgattactctggccaccgggccattaacaactctttgggagggaagccctggcaagttctggaacaccacaatcgcagtgtccatggctaatatcttcagaggttcttacctggccggcgcggggctcgccttttcactaatgaaaagcctgggaggcgggaggcgcggaacgggcgcacagggtgagaccttgggggaaaagtggaaacggcaactgaaccagctctccaagagtgagttcaatacttataagagatctggaattatggaagtcgaccgtagcgaggctaaagaaggccttaagaggggtgagacaaccaaacatgccgtgtcacggggcactgcaaagctgcgctggtttgtagagcgaaacttggtgaaacccgaagggaaggttatcgacctgggatgtggcagagggggatggtcctactattgcgctggcctcaagaaagtgacagaggtcaagggttacaccaaagggggaccgggccacgaagagccaatacctatggccacgtacggctggaatttagtgaagctgcatagtgggaaagatgtcttctttatgcccccagaaaagtgtgacacccttctgtgcgatattggagagagctctcccaaccctacaatcgaggaaggtaggactctacgggtgctcaaaatggttgagccgtggctgcgcggcaatcagttctgtattaagatcttgaacccctatatgccatccgtagtggaaaccctggagagaatgcagaggaagcacgggggaatgctcgtccgaaatcctctttcacggaacagcacacacgagatgtactgggtgtcgtgcggcactggtaatatagtttctgccgtgaacatgaccagtcgtatgctgttaaacagatttacaatggcgcatcgcaaacccacctatgaaagggacgtcgatctgggggctggaactcggcacgtggcagtagagcctgaagtggccaatttggacatcattggccaaagaatcgagaacattaagaatgaacataaatccacgtggcactacgatgaggacaacccatataagacatgggcttaccacggcagctatgaggttaaaccctcagggtccgcctctagcatggtcaatggagtggtgcgcctcctgaccaagccttgggatgtcatcccaatggttactcagattgcaatgaccgacacaacgcccttcggtcagcaaagggtgtttaaggaaaaagtagatacccgaactccgcgggccaagagaggcacaacccagatcatggaggtgactgctaaatggctatgggggttccttagtaggaacaagaaacctcgcatatgtacacgtgaagagtttacccggaaggtcagatccaatgcggccattggagcagtgttcgttgacgaaaaccagtggaatacagctaaggaggccgtggaggacgaaaggttttgggatctggtccatcgcgagcgagaactccacaaacagggcaagtgcgcaacttgcgtgtacaacatgatgggtaaacgggagaagaaactgggggaattcggaaaggccaagggcagcagagctatctggtacatgtggttgggcgccaggttcctggagtttgaggcgctcgggttcatgaatgaagaccattggttttctcgcgagaactcacttagtggagtagaaggtgagggcctgcacaaattagggtatatcctgagagatatttccaagataccaggaggcaatatgtacgcagacgataccgccggttgggacacgcggatcaccgaggatgacttgcaaaacgaagctaaaattacagatatcatggagcccgaacatgccctcctggcaactagcattttcaagctaacctatcagaataaagttgtgagggtccagcgtcctgctaagaacgggacagtgatggacgtgatctctcgacgcgatcagagaggatcgggccaagtcggcacttacgggcttaacacctttacgaatatggaggttcagctgatacggcagatggaatcagagggaatcttcctcccaagcgagctggaaacacccaacttggccgagagggctttagactggctggaaaaacacggtgccgagcgcctcaagagaatggcaatttccggcgatgactgtgtggtaaagccgatcgacgatcggtttgcgaccgcccttactgctctgaatgacatggggaaagtgaggaaggatattcctcagtgggaacccagtaaaggatggaacgactggcaacaggtcccattctgctctcaccattttcaccagctaatcatgaaggatggccgagagatagtggttccttgtcgtaatcaggacgagctggtgggtagagcccgcgtcagccaaggggcaggatggtccctccgggaaacagcttgcttgggcaaatcatatgcccagatgtggcagctgatgtacttccataggagagatcttcgcctggcagccaacgcgatttgtagtgctgtgcccgtagactgggttccaacctctcggactacctggagcatccacgcccaccatcaatggatgacaacggaggatatgctctccgtgtggaatagggtctggatcgaagagaacccctggatggaagacaagacccacgtgtcaagctgggaggaggttccttatttaggcaagcgagaagatcagtggtgcgggtctctgattggattgactgcaagagccacatgggctaccaatatacaggtggccatcaaccaggtccggaggctgattggtaatgagaactacctcgactacatgacttccatgaaacgctttaagaatgaaagtgacagcgagggcgcactttggtga

SEQ ID NO: 13455 - RNA, 9879 nt, synthetic construct
  misc_feature 1..9879: note = derived and/or modified CDS sequence (opt3) from DENV-1__KJ189360__SS-prME
  source 1..9879: mol_type = other RNA
agcgtgaccatgctgctcatgcttctgcccacagccttggctttccacttaactacgagaggcggggagcctcatatgatcgtctccaagcaggaaaggggaaaatctctgctatttaagacctcagcaggtgttaacatgtgcacactcattgccatggacctgggcgagctttgtgaagatactatgacctacaaatgcccacggataacagaggcggaaccggacgatgtggactgttggtgcaatgctaccgatacttgggtaacatatgggacctgtagtcaaacgggagagcaccgccgagagaagcgtagcgtggccctggcaccccatgtcggcttgggtctcgaaactagaaccgagacatggatgtcctctgaaggggcctggaaacagatccagagggtggagacttgggctctgcggcaccctggattcaccgttattgcatttttcctggcccatgctatcggcacatcgattacccagaagggcatcatatttatcctcttaatgctggtgacgccatcaatggccatgcgctgcgtcgggattggaaacagagacttcgtggagggtcttagcggcgcgacttgggtagatgttgtgttggaacacgggagttgtgtcacaaccatggcaaagaataaacccactctggacatcgagctactcaagacagaagtgaccaaccctgccgtgctgaggaaactttgcattgaggctaagatctccaatacgaccacagattctcggtgtccaactcaaggagaagccaccctggtcgaggagcaggacgcaaactttgtttgccgccgaacattcgtggatagaggctggggtaatgggtgtggattgtttggcaaaggcagcctcctgacttgcgctaagttcaagtgcgtaaccaaattagaagggaagatagtgcagtacgagaacctgaaatattccgtcattgtgacagttcacaccggagaccagcatcaagtgggtaatgaaactacggagcacggcacaatcgccaccattactccccaggcgcctacctcagaaatccagctcacagattacggggcccttaccctggactgtagtccaaggactggattggactttaacgagatggtcctactgacaatgaaggagaaaagctggctcgtgcataagcagtggttcctggatcttccgctgccctggacgtctggcgcatccacctcacaagaaacttggaatcggcaggacttgctcgtaacatttaaaaccgctcacgccaagaagcaggaggttgtggtcctgggtagccaagaaggggctatgcacacagccttaactggcgcaaccgagatccagacgagtggaaccacaactattttcgccggccatctgaaatgccgtctaaagatggataaactcaccctgaaggggatgtcttatgtgatgtgtacaggatccttcaaacttgaaaaggaggtcgctgagactcagcacggtaccgtgttggttcaggtgaagtacgaaggcacggacgcgccttgcaaaataccatttagcacacaagatgagaagggggtaacccagaacggacgcctgatcactgcaaatcccattgtcacagacaaagaaaagcctgtgaacatcgagaccgagccacccttcggcgaatcgtatatagttgtgggtgccggggagaaagctctcaagctgtcttggtttaagagaggctcctcaattggaaaaatgttcgaagccactgcaaggggcgcccggcgaatggctatccttggggataccgcctgggactttggaagtatcggtggcgtcttcacaagcgtggggaagctggtacatcagatttttggaacggcatacggcgtgttgttctccggtgtttcttggaccatgaaaatcgggattggcatactcctgacttggttaggactgaatagccgctcaacaagtctatccatgacctgtatcgcggtcggcatggtgacactctacctgggggtgatggtccaggctgatagcggatgcgttattaactggaagggcagagagcttaaatgtggttctgggatctttgtgactaacgaagtgcacacctggacggagcaatataagttccaggccgactcaccgaagaggttgagtgcagccatcggaaaagcttgggaggaaggcgtatgcggtattcggagcgccacacgcctggagaatataatgtggaagcagatctccaacgaactcaatcatattctgttagagaacgatatgaaatttaccgtcgtggttggcgacgcaaatgggatcctggctcagggaaagaaaatgattagacctcaacccatggaacacaagtactcttggaaatcgtggggcaaggccaagatcataggggcggacatccagaacactaccttcattatcgatggaccagacacacctgagtgtcccgatggccagagggcctggaatatttgggaggtggaagactatggttttggggtcttcactaccaacatctggcttaaattgcgtgatagctacacacagatgtgcgaccaccggctcatgtccgctgcaataaaggattcaaaagccgtgcatgctgacatgggatattggattgagagtgaaaagaatgagacgtggaaactggcccgagcatctttcatcgaagttaagacctgtacttggccaaagagccacacactatggtccaacggcgtgctggagtcagagatgattatccccaaaatatacggtggccctatcagccaacataattatagaccagggtactttacccagactgcgggaccgtggcacctcggcaagctggaacttgatttcgacttgtgcgaggggacaaccgtagtcgtggatgaacactgcggaaacaggggcccctctctgcgcacgactaccgtgacaggtaaaattatccatgagtggtgttgccggtcctgtaccttacctccactcagatttaggggggaggacggatgctggtacggcatggaaattcgccccgtcaaggagaaagaagagaatctggttcgaagtatggtgagcgccggttctggcgaagtagattccttctcacttgggatcctgtgtgtgagtataatgattgaggaggtcatgcggagccgttggtcgagaaagatgttgatgactggaacactcgctgtgtttctgctactgatcatgggccagctcacctggaacgacctgatcaggctttgcattatggttggggccaatgcatccgaccgcatgggaatgggcacaacttatttggctctgatggccaccttcaagatgcggcctatgtttgcagtgggtttactcttcagaaggctgacgtctcgagaagtccttctgctaacaatcgggctcagcctggtggcctcagttgagttgccaaacagtctggaagagttaggagatggcctcgctatgggcattatgatgctgaaacttctgaccgaatttcaaccccaccagttgtggactaccctcctgtccctaacattcgtgaagactaccctgtctcttgactacgcgtggaaaacgacagccatggcactcagcatagtctccctgtttccgttgtgtctgtcaaccactagccagaagacaacctggttacctgtactcctggggagtttcggatgcaaaccacttactatgtttctgatcacagagaacaagatttggggtcgcaagtcttggcccttgaatgagggcatcatggctattgggatcgtgtccatactcctgagctcgctactgaaaaacgatgttcctcttgccggacccctcatcgccggcggtatgctgattgcttgttatgtgatctcagggtctagtgcagacttgtccttagaaaaggccgcggaggtcagctgggaacaggaggctgaacattctggagccagccactccattctggtggaggtacaagatgacggcaccatgaaaatcaaggatgaggaacgggacgatacgctcactatactgcttaaagcaaccctgttggccgtgtcaggcgtctacccaatgagtattcctgctacactattcgtttggtatttctggcagaagaaaaagcagagaagcggggtgctgtgggacaccccctctccaccggaggtggaaagggcagtcctcgataatggaatctaccgtatcctgcagcgcggtcttttaggccggtcccaagtgggggttggagtatttcaggacggcgtgttccatacaatgtggcacgtcactagaggtgccgtgctgatgtatcaggggaagaggctcgagccttcatgggcgagtgttaaaaaggatttgattagctacggaggcggctggcgatttcaggggtcctggaacaccggagaggaagtgcaagtcatagctgtggagcccggtaaaaatccaaagaacgtacagacgacacccggcactttcaaaacccctgaaggggaggtcggagccatcgcactggactttaagccaggcacatctggttcgcccattgtgaatcgggaagggaagatcgttggactctacggcaacggcgtggtcaccactagcgggacctatgtgtcagccattgctcaggccaaagcatcccaagagggacctctgccggagatcgaagacgaggttttcaagaaacgcaatcttacaataatggatctgcacccaggtagtggcaagacgagaaggtacttgcccgctatcgtgcgggaagccattaaacgaaagctaagaactctgatcctcgcgcctacccgcgtcgtggcctctgagatggcagaagctttaaaggggatgccaattaggtatcagacaaccgccgtaaaaagcgagcatactggacgtgagatcgtggacctgatgtgccacgctacatttaccatgcggcttctgtcccccgttagagtccctaactacaatatgataattatggatgaagcacatttcacggacccggcctcaatcgccgctaggggctatatctctactcgcgtgggtatgggggaggcggcagccatttttatgacagctacccccccaggaagcgtggaagccttccctcagagtaacgcagtcatccaggatgaggaacgagacatacccgagagatcctggaatagcggctacgattggattaccgactttccaggcaagactgtatggttcgtgccttctatcaaatcagggaacgatattgccaattgtctccggaagaacggaaaaagggttatccaattgtcccgcaagacattcgacaccgagtatcagaagacaaaaaacaatgattgggactacgtggtcactacggacataagtgaaatgggtgctaactttcgtgcggatagagtgattgacccccggaggtgcctgaagccagttatcctcaaagatggcccggagcgcgtgatcctggccgggcctatgcccgtcaccgcagctagcgccgcacagcgaagaggacggattggcaggaatcagaacaaggaaggtgaccaatacgtgtatatggggcagccacttaataacgatgaggaccacgcccattggacagaggctaaaatgctactggataatatcaacactcccgaaggcattatacctgccttgttcgagccagaacgcgagaagtcggcggcaatcgacggagaatacagattaaggggcgaggcccggaagacctttgtagagctgatgcgtcgcggggatctccccgtgtggctgtcttataaagttgcttccgaaggattccagtacagcgaccgaagatggtgctttgatggtgagaggaataaccaggtccttgaagagaatatggacgtggaaatttggacaaaggagggcgagcggaaaaagctgcgccctagatggctcgatgccaggacctattcagacccgttggctctgcgggaattcaaagagtttgcagccgggcgaagaagtgtgtctggagacctaatcctggaaatcggcaagctcccacaacaccttactctgcgcgctcagaacgccttagataatttggtcatgctgcacaactccgagcagggtgggaaagcatacaggcatgcgatggaagagctccccgacacgattgagaccctgatgcttctggccctcatagctgttttgacaggcggagtgactctgttctttttaagcggcaaggggctaggaaagacctcaatcggtctgctctgtgtaacagccagtagcgcacttctgtggatggcttccgtggaacctcactggattgccgcatctatcattttggagttctttctgatggtcctcctgatccccgaaccagatcggcagcgtacccctcaagacaatcagcttgcctatgtggttataggcctcctgttcatgatcttgactgtggctgcgaacgagatggggctgttagagacaacgaaaaaggatctaggaattggctacgtcgccgcagaaaaccatcagcacgctaccatgctggacgtagatctccaccccgccagcgcctggactctttacgcagtggctacaaccgttatcaccccaatgatgagacatacaattgagaatactacggccaacatctccctgaccgcgatagctaatcaagccgcaattttgatgggtctggacaaagggtggcctatctcaaagatggatattggcgtgccgctcctggcccttggatgctattctcaggtcaaccccttaacactgactgctgcagtgctcatgttggtcgcccactacgcgatcataggcccagggctgcaggctaaagccaccagggaagcacagaagcgcacagccgctggaatcatgaagaatcctaccgtggacggcattgttgccatcgatctagaccccgtggtatatgatgcaaaatttgagaagcaactgggtcagattatgctccttatcctgtgtactagtcagatattgctgatgcggacgacatgggctctctgcgaatcgattaccctggccactgggccattaaccacactttgggagggaagccctggcaaattctggaacactaccatcgcggtgtccatggccaatatcttccgaggttcttacctggcaggcgctgggctcgccttttcactaatgaagagcctgggaggcgggagaaggggaacaggcgcacagggtgagacgttgggggaaaaatggaagcgccaactgaaccagctctccaagagtgagttcaatacctataaacggtctggaattatggaagtcgacagaagcgaggctaaggaaggccttaaacgtggtgagactacaaagcatgccgtttcaaggggcaccgccaaactgcggtggtttgtggagcgcaacttggtcaagcccgaagggaaggtgatcgacctgggatgtggccgagggggatggtcctactattgcgcgggcctcaaaaaggtaactgaggtgaaaggttacacaaaggggggaccgggccacgaagagccaatacctatggctacctacggctggaatttagttaaactgcatagtgggaaggatgtgttctttatgcccccagaaaaatgtgacacgcttctgtgcgatattggagagagctctcccaaccctaccatcgaggaaggtagaacactaagggtcctcaagatggtggagccgtggctgcggggcaatcagttctgtattaagatcttgaacccctatatgccatccgtcgtggaaactctggagcgcatgcagagaaaacacgggggaatgctcgttaggaatcctctttcacgaaacagcacccacgagatgtactgggtatcgtgcggcacaggtaatatagtgtctgcagtcaacatgactagtcggatgctgttaaaccgttttaccatggcccatagaaagcccacatatgaacgcgacgtggatctgggggctggaaccaggcacgttgccgtggagcctgaagtcgcaaatttggacatcattggccaacggatcgagaacattaaaaatgaacataagtccacttggcactacgatgaggacaacccatataaaacgtgggcctaccacggcagctatgaggtgaagccctcagggtccgcttctagcatggtaaatggagtggttagactcctgacaaagccttgggatgtcatcccaatggtgacccagattgcgatgactgacaccacacccttcggtcagcaacgcgtgtttaaagaaaaggtcgatacgaggaccccgcgagccaaacggggcactacacagatcatggaggttaccgcaaagtggctatgggggttccttagtagaaacaaaaagcctaggatatgtactcgcgaagagtttacacgtaaggtgcggtccaatgctgccattggagcagtattcgtggacgaaaaccagtggaatagcgccaaagaggctgtcgaggacgaaagattttgggatctggtgcatagggagcgcgaactccacaagcagggcaaatgcgccacctgcgtttacaacatgatgggtaagcgagagaaaaagctgggggaattcggaaaggcgaaaggctctcgggcaatctggtacatgtggttgggcgccagattcctggagtttgaggctctcgggttcatgaatgaagaccattggttttcaagggagaacagtctttccggagtggaaggtgagggcctgcacaagttagggtatatcctgcgcgatattagcaaaataccaggaggcaatatgtacgccgacgatacagcaggttgggacactagagtcaccgaggatgacttgcaaaacgaagctaagatcacggatattatggagcccgaacatgccctcctggctacctctatcttcaaactaacatatcagaataaggtggtacgggttcagaggcctgccaaaaacgggactgtgatggacgtcatttcgcgtcgagatcagcgcggatcaggccaagtgggcacctacgggcttaacacatttactaatatggaggtgcagctgatcagacagatggaaagcgagggaatattcctcccatccgagctggaaacccccaacttggcagagcgggcgttagactggctggaaaagcacggtgccgagaggctcaagcgcatggctatcagtggcgatgactgtgtcgttaaaccgattgacgatagatttgccacggcacttacagctctgaatgacatggggaaggtgcggaaagatatccctcagtgggaaccctctaagggatggaacgactggcaacaggtaccattctgcagccaccattttcaccagctaattatgaaagatggcagggagatcgtggtcccttgtcgaaatcaggacgagctggtgggtcgtgccagagtttcccaaggggcaggatggtcactccgcgaaaccgcctgcttgggcaagagttatgcgcagatgtggcagctgatgtacttccatcggagggatcttagactggctgccaacgcaatatgttctgccgtgcccgtcgactgggtgccaactagccgcacaacctggtccattcacgctcaccatcaatggatgactaccgaggatatgctctcagtatggaatcgggtttggatcgaagagaacccctggatggaaaataagacacacgtgagctcttgggaggaggtcccttatttaggcaaaagggaagaccagtggtgcgggtccctgatcggattgacggcccgagcaacctgggctactaacattcaggtggccataaatcaggttagacggctgatcggtaacgagaattacctcgattacatgacaagtatgaagaggtttaaaaacgaaagcgactcggagggcgcgctttggtga

SEQ ID NO: 13456 - RNA, 9879 nt, synthetic construct
  misc_feature 1..9879: note = derived and/or modified CDS sequence (opt3) from DENV-1__KJ189361__SS-prME
  source 1..9879: mol_type = other RNA
agcgtgaccatgctgctaatgcttctgcccactgccatggctttccacttgactacgaggggcggggagcctcatatgatcgtctccaagcaggaaaggggaaagtctttactgtttaagacctcagccggtgttaacatgtgcacactaattgccatggacctcggcgagctgtgtgaagatactatgacctacaaatgcccacggataaccgaggcggaaccggacgatgtggactgttggtgcaatgctaccgatacttgggtaacatatgggacctgtagtcaaacgggagagcaccgccgagagaagcgtagcgtggcccttgcaccccatgtcggcctgggtttggaaactagaaccgagacatggatgtcctctgaaggggcctggaaacagatccagagggtggagacttgggctctccggcaccctggattcaccgttattgcatttttcctggcccatgctatcggcacatcgattacccagaagggcatcatatttatcctgctcatgttagtgacgccatcaatggccatgcgctgcgtcgggattggaaacagagacttcgtggagggtctgagcggcgcgacttgggtagatgttgtgcttgaacacgggagttgtgtcacaaccatggcaaagaataaacccactttggacatcgagctgctaaagacagaagtgaccaaccctgccgtgctcaggaaactgtgcattgaggctaagatctccaatacgaccacagattctcggtgtccaactcaaggagaagccacccttgtcgaggagcaggacgcaaactttgtttgccgccgaacattcgtggatagaggctggggtaatgggtgtggactgtttggcaaaggcagcttgctcacttgcgctaagttcaagtgcgtaaccaaactggaagggaagatagtgcagtacgagaacttaaaatattccgtcattgtgacagttcacaccggagaccagcatcaagtgggtaatgaaactacggagcacggcacaatcgccaccattactccccaggcgcctacctcagaaatccagctgacagattacggggccctcacccttgactgtagtccaaggactggactggactttaacgagatggtcttgctaacaatgaaggagaaaagctggctggtgcataagcagtggttcctcgatctgccgcttccctggacgtctggcgcatccacctcacaagaaacttggaatcggcaggacctgttggtaacatttaaaaccgctcacgccaagaagcaggaggttgtggtcctcggtagccaagaaggggctatgcacacagccctgactggcgcaaccgagatccagacgagtggaaccacaactattttcgccggccatttaaaatgccgtctgaagatggataaactaaccctcaaggggatgtcttatgtgatgtgtacaggatccttcaaactggaaaaggaggtcgctgagactcagcacggtaccgtgcttgttcaggtgaagtacgaaggcacggacgcgccttgcaaaataccatttagcacacaagatgagaagggggtaacccagaacggacgcttgatcactgcaaatcccattgtcacagacaaagaaaagcctgtgaacatcgagaccgagccacccttcggcgaatcgtatatagttgtgggtgccggggagaaagctctgaagctctcttggtttaagagaggctcctcaattggaaaaatgttcgaagccactgcaaggggcgcccggcgaatggctatcctgggggataccgcctgggactttggaagtatcggtggcgtcttcacaagcgtggggaaacttgtacatcagatttttggaacggcatacggcgtgctgttctccggtgtttcttggaccatgaaaatcgggattggcatattgctcacttggctgggattaaatagccgctcaacaagtctgtccatgacctgtatcgcggtcggcatggtgacactatacctcggggtgatggtccaggctgatagcggatgcgttattaactggaagggcagagagctgaaatgtggttctgggatctttgtgactaacgaagtgcacacctggacggagcaatataagttccaggccgactcaccgaagaggcttagtgcagccatcggaaaggcttgggaggaaggcgtatgcggtattcggagcgccacacgcttggagaatataatgtggaagcagatctccaacgaactgaatcatattctcctggagaacgatatgaaatttaccgtcgtggttggcgacgcaaatgggatcttagctcagggaaagaaaatgattagacctcaacccatggaacacaagtactcttggaaatcgtggggcaaggccaagatcataggggcggacatccagaacactaccttcattatcgatggaccagacacacctgagtgtcccgatggccagagggcctggaatatttgggaggtggaagactatggttttggggtcttcactaccaacatctggctgaaacttcgtgatagctacacacagatgtgcgaccaccggttgatgtccgctgcaataaaggattcaaaagccgtgcatgctgacatgggatattggattgagagtgaaaagaatgagacgtggaaactcgcccgagcatctttcatcgaagttaagacctgtacttggccaaagagccacacactgtggtccaacggcgtgctagagtcagagatgattatccccaaaatatacggtggccctatcagccaacataattatagaccagggtactttacccagactgcgggaccgtggcacctgggcaagctcgaactggatttcgacctttgcgaggggacaaccgtagtcgtggatgaacactgcggaaacaggggcccctctttgcgcacgactaccgtgacaggtaaaattatccatgagtggtgttgccggtcctgtaccctgcctccattaagatttagaggggaagacggatgctggtacggcatggaaattcgccccgtcaaggagaaagaagagaatctcgttcgaagtatggtgagcgccggttctggcgaagtagattccttctcactggggatcctttgtgtgagtataatgattgaggaggtcatgcggagccgttggtcgagaaagatgctgatgactggaacattggctgtgtttctcctgctaatcatgggccagctgacctggaacgacctcatcaggctgtgcattatggttggggccaatgcatccgaccgcatgggaatgggcacaacttatcttgctttgatggccaccttcaagatgcggcctatgtttgcagtgggtctgttattcagaaggctcacgtctcgagaagtcctgcttctgacaatcgggctaagcctcgtggcctcagttgagctgccaaacagtttggaagaactgggagatggcttagctatgggcattatgatgctcaaactgcttaccgaatttcaaccccaccagctgtggactaccttgctctccctgacattcgtgaagactaccctatctctggactacgcgtggaaaacgacagccatggcacttagcatagtctccctctttccgctgtgtttgtcaaccactagccagaagacaacctggctgcctgtattactcgggagtttcggatgcaaaccactgactatgtttcttatcacagagaacaagatttggggtcgcaagtcttggcccctgaatgagggcatcatggctattgggatcgtgtccatattgctcagctcgctgctcaagaacgatgttcctctggccggaccccttatcgccggcggtatgctcattgcttgttatgtgatctcagggtctagtgcagacctgtccttggaaaaggccgcggaggtcagctgggaacaggaggctgaacattctggagccagccactccattttagtggaggtacaagatgacggcaccatgaaaatcaaggatgaggaacgggacgatacgctgactatactcctgaaagcaacccttctggccgtgtcaggcgtctacccaatgagtattcctgctacattgttcgtttggtatttctggcagaagaaaaagcagagaagcggggtgctatgggacaccccctctccaccggaggtggaaagggcagtcctggataatggaatctaccgtatcctccagcgcggtctgcttggccggtcccaagtgggggttggagtatttcaggacggcgtgttccatacaatgtggcacgtcactagaggtgccgtgttaatgtatcaggggaagaggctggagccttcatgggcgagtgttaaaaaggatctcattagctacggaggcggctggcgatttcaggggtcctggaacaccggagaggaagtgcaagtcatagctgtggagcccggtaaaaatccaaagaacgtacagacgacacccggcactttcaaaacccctgaaggggaggtcggagccatcgcattggactttaagccaggcacatctggttcgcccattgtgaatcgggaagggaagatcgttggactgtacggcaacggcgtggtcaccactagcgggacctatgtgtcagccattgctcaggccaaagcatcccaagagggacctctcccggagatcgaagacgaggttttcaagaaacgcaatctgacaataatggatcttcacccaggtagtggcaagacgagaaggtacctgcccgctatcgtgcgggaagccattaaacgaaagttgagaactctaatcctggcgcctacccgcgtcgtggcctctgagatggcagaagctctcaaggggatgccaattaggtatcagacaaccgccgtaaaaagcgagcatactggacgtgagatcgtggacttaatgtgccacgctacatttaccatgcggctgctttcccccgttagagtccctaactacaatatgataattatggatgaagcacatttcacggacccggcctcaatcgccgctaggggctatatctctactcgcgtgggtatgggggaggcggcagccatttttatgacagctacacccccaggaagcgtggaagccttccctcagagtaacgcagtcatccaggatgaggaacgagacatacccgagagatcctggaatagcggctacgattggattaccgactttccaggcaagactgtatggttcgtgccttctatcaaatcagggaacgatattgccaattgtctgcggaagaacggaaaaagggttatccaactctcccgcaagacattcgacaccgagtatcagaagactaagaacaatgattgggactacgtggtcactacggacataagtgaaatgggtgctaactttcgtgcggatagagtgattgacccccggaggtgcttgaagccagttatcctgaaagatggcccggagcgcgtgatcctcgccgggcctatgcccgtcaccgcagctagcgccgcacagcgaagaggacggattggcaggaatcagaacaaggaaggtgaccaatacgtgtatatggggcagccactgaataacgatgaggaccacgcccattggacagaggctaaaatgcttctagataatatcaacactcccgaaggcattatacctgccctgttcgagccagaacgcgagaagtcggcggcaatcgacggagaatacagattgaggggcgaggcccggaagacctttgtagagttaatgcgtcgcggggatctgcccgtgtggctctcttataaagttgcttccgaaggattccagtacagcgaccgaagatggtgctttgatggtgagaggaataaccaggtcctggaagagaatatggacgtggaaatttggacaaaggagggcgagcggaagaaacttcgccctagatggctggatgccaggacctattcagacccgctcgctttgcgggagttcaaagagtttgcagccgggcgaagaagtgtgtctggagacctgatcctagaaatcggcaaactgccacaacacctcactcttcgcgctcagaacgccctggataatttagtcatgttgcacaactccgagcagggtgggaaagcatacaggcatgcgatggaggaactgcccgacacgattgagaccctcatgctgcttgccctgatagctgttctcacaggcggagtgactttgttctttctgagcggcaaggggttaggaaagacctcaatcggtctactgtgtgtaacagccagtagcgcactcctttggatggcttccgtggaacctcactggattgccgcatctatcattctggagttctttttgatggtcctgctcatccccgaaccagatcggcagcgtacccctcaagacaatcagctggcctatgtggttataggccttctcttcatgatcctgactgtggctgcgaacgagatggggttgctggagacaacgaaaaaggatttaggaattggctacgtcgccgcagaaaaccatcagcacgctaccatgctagacgtagatctgcaccccgccagcgcctggactctctacgcagtggctacaaccgttatcaccccaatgatgagacatacaattgagaatactacggccaacatctcccttaccgcgatagctaatcaagccgcaattctgatgggtttggacaaagggtggcctatctcaaagatggatattggcgtgccgctgctcgccctgggatgctattctcaggtcaacccccttacattaactgctgcagtgctgatgctcgtcgcccactacgcgatcataggcccagggttgcaggctaaagccaccagggaagcacagaagcgcacagccgctggaatcatgaagaatcctaccgtggacggcattgttgccatcgatctggaccccgtggtatatgatgcaaaatttgagaagcaactaggtcagattatgctgctcatcctttgtacaagtcagatactgttgatgcggacgacatgggctctgtgcgaatcgattaccctcgccactgggccactgaccacattatgggagggaagccctggcaaattctggaacactaccatcgcggtgtccatggccaatatcttccgaggttcttaccttgcaggcgctgggctggccttttcactcatgaaaagcctaggaggcgggagaaggggaacaggcgcacagggtgagacgctgggggaaaaatggaagcgccaattgaaccagctgtccaagagtgagttcaatacctataaacggtctggaattatggaagtcgacagaagcgaggctaaggaaggcctcaaacgtggtgagactacaaagcatgccgtttcaaggggcaccgccaaacttcggtggtttgtggagcgcaacctggtcaagcccgaagggaaggtgatcgacttgggatgtggccgagggggatggtcctactattgcgcgggcctgaaaaaggtaactgaggtgaaaggttacacaaaagggggaccgggccacgaggaaccaatacctatggctacctacggctggaatctcgttaaattacatagtgggaaggatgtgttctttatgcccccagaaaaatgtgacacgctgctttgcgatattggagagagctctcccaaccctaccatcgaggaaggtagaacactgagggtcctaaagatggtggagccgtggctccggggcaatcagttctgtattaagatcctgaacccctatatgccatccgtcgtggaaactttggagcgcatgcagagaaaacacgggggaatgctggttaggaatcctctctcacgaaacagcacccacgagatgtactgggtatcgtgcggcacaggtaatatagtgtctgcagtcaacatgacaagtcggatgcttctgaaccgttttaccatggcccatagaaagcccacatatgaacgcgacgtggatttaggggctggaaccaggcacgttgccgtggagcctgaagtcgcaaatctggacatcattggccaacggatcgagaacattaaaaatgaacataagtccacttggcactacgatgaggacaacccatataaaacgtgggcctaccacggcagctatgaggtgaagccctcagggtccgcttctagcatggtaaatggagtggttagattgctcacaaagccttgggatgtcatcccaatggtgacccagattgcgatgactgacaccacacccttcggtcagcaacgcgtgtttaaagaaaaggtcgatacgaggaccccgcgagccaaacggggcactacacagatcatggaggttaccgcaaagtggctgtgggggttcctaagtagaaacaaaaagcctaggatatgtactcgcgaagagtttacacgtaaggtgcggtccaatgctgccattggagcagtattcgtggacgaaaaccagtggaatagcgccaaagaggctgtcgaggacgaaagattttgggatcttgtgcatagggagcgcgaactgcacaagcagggcaaatgcgcaacctgcgtttacaacatgatgggtaagcgagagaaaaagctcggggagttcggaaaggcgaaaggctctcgggcaatctggtacatgtggctgggcgccagattcttggagtttgaggctctggggttcatgaatgaagaccattggttttcaagggagaacagtctctccggagtggaaggtgagggccttcacaagctggggtatatcttacgcgatattagcaaaataccaggaggcaatatgtacgccgacgatacagcaggttgggacactagagtcaccgaggatgacctgcaaaacgaagctaagatcacggatattatggagcccgaacatgccttgctcgctacctctatcttcaaactgacatatcagaataaggtggtacgggttcagaggcctgccaaaaacgggactgtgatggacgtcatttcgcgtcgagatcagcgcggatcaggccaagtgggcacctacgggctaaacacatttactaatatggaggtgcagcttatcagacagatggaaagcgagggaatattcctgccatccgagctcgaaacccccaacctggcagagcgggcgttggactggttagaaaagcacggtgccgagaggctgaagcgcatggctatcagtggcgatgactgtgtcgttaaaccgattgacgatagatttgccacggcactcacagctcttaatgacatggggaaggtgcggaaagatatccctcagtgggaaccctctaagggatggaacgactggcaacaggtaccattctgcagccaccattttcaccagctgattatgaaagatggcagggagatcgtggtcccttgtcgaaatcaggacgagctagtgggtcgtgccagagtttcccaaggggcaggatggtcactgcgcgaaaccgcctgcctcggcaagagttatgcgcagatgtggcagttgatgtacttccatcggagggatctgagacttgctgccaacgcaatatgttctgccgtgcccgtcgactgggtgccaactagccgcacaacctggtccattcacgctcaccatcaatggatgactaccgaggatatgctgtcagtatggaatcgggtttggatcgaagagaacccctggatggaagacaagacacacgtgagctcttgggaggaggtcccttatctcggcaaaagggaagatcagtggtgcgggtccttaatcggactgacggcccgagcaacctgggctactaatattcaggtggccataaaccaggttagacggttgatcggtaatgagaactacctggactacatgacaagtatgaagaggtttaaaaatgaaagcgactcggagggcgcgctctggtga

SEQ ID NO: 13457 - RNA, 9879 nt, synthetic construct
  misc_feature 1..9879: note = derived and/or modified CDS sequence (opt3) from DENV-1__KJ189362__SS-prME
  source 1..9879: mol_type = other RNA
agcgtgaccatgctgctcatgcttctgccaactgcattggctttccacttaactacgaggggcggggagcctcatatgatcgtctccaagcaggaaaggggaaagtctctgctatttaagacctcagccggtgttaacatgtgcactctcattgccatggacctgggcgagctttgtgaagatactatgacctacaagtgcccacggataacagaggcggaaccggacgatgtggactgttggtgcaatgctaccgatacttgggtaacctatgggacctgtagtcaaacgggagagcaccgccgagagaagcgtagcgtggccctggcaccccatgtcggcttgggtctcgaaactagaaccgagacatggatgtcctctgaaggggcctggaaacagatccagagggtggagacttgggctctgcggcaccctggattcaccgttattgcatttttcctggcccatgctatcggcacatcgattacccagaagggcatcatatttatcctcttaatgctggtgacgccatcaatggccatgcgctgcgtcgggattggaaacagagacttcgtggagggtcttagcggcgcgacttgggtagatgttgtgttggaacacgggagttgtgtcacaaccatggcaaagaataaacccactctggacatcgagctactcaagacagaagtgaccaaccctgccgtgctgaggaaactttgcattgaggctaagatctccaatacgaccacagattctcggtgtccaactcaaggagaagccaccctggtcgaggagcaggacgcaaactttgtttgccgccgaacattggtggatagaggctggggtaatgggtgtggactcttcggcaaaggcagcctgttaacttgcgctaagtttaagtgcgtaaccaaactggaagggaagatagtgcagtacgagaacctcaaatattccgtcattgtgacagttcacaccggagaccagcatcaagtgggtaatgaaactacggagcacggcacaatcgccaccattactccccaggcgcctacctcagaaatccagcttacagattacggggccctgaccttggactgtagtccaaggactggactagacttcaacgagatggtcctgctcacaatgaaggagaaaagctggctggtgcataagcagtggtttcttgatctgccgttgccctggacgtctggcgcatccacctcacaagaaacttggaatcggcaggacctcctggtaacattcaaaaccgctcacgccaagaagcaggaggttgtggtcttaggtagccaagaaggggctatgcacacagccctgactggcgcaaccgagatccagacgagtggaaccacaactatttttgccggccatctaaaatgccgtctcaagatggataaactgacccttaaggggatgtcttatgtgatgtgtacaggatccttcaaattggaaaaggaggtcgctgagactcagcacggtaccgtgctggttcaggtgaagtacgaaggcacggacgcgccttgcaaaataccattcagcacacaagatgagaaggggatgacccagaacggacgcctcatcactgcaaatcccattgtaacagacaaagaaaagcctgtcaacatcgagaccgagccaccctttggcgaatcgtatatagtggttggtgccggggagaaagctctgaaactttcttggttcaagagaggctcctcaattggaaaaatgtttgaagccactgcaaggggcgcccggcgaatggctatcctgggggataccgcctgggacttcggaagtatcggtggcgtgtttacaagcgtcgggaagttggtgcatcagattttcggaacggcatacggcgtactcttttccggtgtgtcttggaccatgaaaatcgggattggcatactgttaacttggctgggactaaatagccgctcaacaagtctctccatgacctgtatcgcggttggcatggtcacactgtaccttggggtgatggtgcaggctgatagcggatgcgtcattaactggaagggcagagagttgaaatgtggttctgggatcttcgttactaacgaagtgcacacctggacggagcaatataagtttcaggccgactcaccgaagaggctgagtgcagccatcggaaaggcttgggaggaaggcgtgtgcggtattcggagcgccacacgcctcgagaatataatgtggaagcagatctccaacgaactgaatcatattttactggagaacgatatgaaattcaccgtagtcgtgggcgacgcaaatgggatccttgctcagggaaagaaaatgattagacctcaacccatggaacacaagtactcttggaaatcgtggggcaaggccaagatcataggggcggacatccagaacactacctttattatcgatggaccagacacacctgagtgtcccgatggccagagggcctggaatatttgggaggttgaagactatggtttcggggtgtttactaccaacatctggttgaaactccgtgatagctacacacagatgtgcgaccaccggctgatgtccgctgcaataaaggattcaaaagccgtccatgctgacatgggatattggattgagagtgaaaagaatgagacgtggaaactagcccgagcatctttcatcgaagtgaagacctgtacttggccaaagagccacacactgtggtccaacggcgttctcgagtcagagatgattatccccaaaatatacggtggccctatcagccaacataattatagaccagggtacttcacccagactgcgggaccgtggcacctgggcaaacttgaattggattttgacctgtgcgaggggacaaccgtggtagtcgatgaacactgcggaaacaggggcccctctttacgcacgactaccgtgacaggtaaaattatccatgagtggtgttgccggtcctgtaccctccctccactgagattcagaggggaagacggatgctggtacggcatggaaattcgccccgtgaaggagaaagaagagaatcttgtccgaagtatggttagcgccggttctggcgaagtggattccttttcactggggatcttgtgtgtaagtataatgattgaggaggtgatgcggagccgttggtcgagaaagatgctcatgactggaacactggctgtcttcctactgctcatcatgggccagctgacctggaacgaccttatcaggttgtgcattatggtgggggccaatgcatccgaccgcatgggaatgggcacaacttatctggctttaatggccacctttaagatgcggcctatgttcgcagttggtctcctgtttagaaggcttacgtctcgagaagtgctgctactcacaatcgggctgagcttggtcgcctcagtggagctgccaaacagtttagaggaactcggagatggcctggctatgggcattatgatgcttaaactgttgaccgagttccaaccccaccagctctggactaccctgctatccctgacatttgttcgcactaccctttctctcgactacgcgtggaagacgacagccatggcactgagcatagtgtccttgttcccgctgtgtttatcaaccactagccagaaaacaacctggctccctgtcctgcttgggagttttggatgcaagccactgactatgttcttgatcacagagaacaaaatttggggtcggaagtcttggcccctcaatgagggcatcatggctattgggatcgtatccatactgctaagctcgctgcttaagaacgatgtgcctctcgccggacccctgatcgccggcggtatgttgattgcttgttatgttatctcagggtctagtgcagacttatccctggaaaaagccgcggaggtgagctgggaacaggaggctgaacattctggagccagccactccattctcgtcgaggtgcaagatgacggcaccatgaagatcaaagatgaggaaagagacgatacgctgactatacttctgaaggcaaccttgctagccgtatcaggcgtgtacccaatgagtattcctgctacactgtttgtctggtatttctggcagaaaaagaaacagaggagcggggttctctgggacaccccctctccaccggaggtggaacgtgcagtgctggataatggaatctaccgcatccttcagcggggtttactgggcagatcccaagtcggggtgggagttttccaggacggcgtatttcatacaatgtggcacgtgactaggggtgccgtcctcatgtatcaggggaagcgattggagccttcatgggcgagtgtgaagaaagatctgattagctacggaggcggctggcggttccaggggtcctggaacaccggagaggaagttcaagtgatagctgtcgagcccggtaagaatcccaagaacgtgcagacgacacccggcacttttaagacccctgaaggggaggtaggagccatcgcactcgacttcaaaccaggcacatctggttcgcccattgtcaatcgcgaagggaagatcgtgggactgtacggcaacggcgttgtgaccactagcgggacctatgtctcagccattgctcaggccaaggcatcccaagagggacctcttccggagatcgaagacgaggtgtttaaaaagagaaatctgacaataatggatttgcacccaggtagtggcaaaacgaggcggtacctacccgctatcgttcgagaagccattaagagaaaactgcgcactctcatcttagcgcctaccagggtggtcgcctctgagatggcagaagctctgaaggggatgccaattcgttatcagacaaccgccgtgaaaagcgagcatactggacgggagatcgtagaccttatgtgccacgctacattcaccatgagactgctctcccccgtgagggttcctaactacaatatgataattatggatgaagcacattttacggacccggcctcaatcgccgctcgcggctatatctctactcgagtcggtatgggggaggcggcagccattttcatgacagctacacccccaggaagcgtggaagcctttcctcagagtaacgcagtgatccaggatgaggaaagagacatacccgagcggtcctggaatagcggctacgattggattaccgacttcccaggcaaaactgtctggtttgtaccttctatcaagtcagggaacgatattgccaattgtttgaggaaaaacggaaagcgcgtgatccaactgtcccgtaaaacattcgacaccgagtatcagaagacaaagaacaatgattgggactacgttgtgactacggacataagtgaaatgggtgctaacttcagagcggatcgggtcattgaccccaggcgctgcctcaaaccagtgatcctgaaggatggcccggagcgagttatccttgccgggcctatgcccgtgaccgcagctagcgccgcacagagacggggaaggattggccgcaatcagaacaaagaaggtgaccaatacgtctatatggggcagccactaaataacgatgaggaccacgcccattggacagaggctaagatgctgttggataatatcaacactcccgaaggcattatacctgccttatttgagccagaaagagagaaatcggcggcaatcgacggagaatacaggctgcggggcgaggcccgtaagaccttcgtggagctcatgcgccgaggggatctgcccgtatggctttcttataaggtggcttccgaaggatttcagtacagcgacagaaggtggtgcttcgatggtgagcggaataaccaggttctggaagagaatatggacgtcgaaatttggacaaaagagggcgagcgcaagaaactcagacctaggtggttggatgcccggacctattcagacccgctggctctacgagaatttaaggagttcgcagccgggagacgcagtgtgtctggagacctgatcctcgaaatcggcaaacttccacaacacctgactttaagggctcagaacgccttggataatctggtgatgctccacaactccgagcagggtgggaaggcataccggcatgcgatggaggaactgcccgacacgattgagacccttatgctgctcgccttgatagctgtcctgacaggcggagttactttatttttcctaagcggcaaagggctgggaaagacctcaatcggtctcctttgtgtgacagccagtagcgtactgttgtggatggcatccgtggaacctcactggattgctgcctctatcattctggagtttttcctcatggtcctgcttatccccgaaccagatcgtcagagaacccctcaagacaatcagctcgcatatgtggttataggcctgttgtttatgatcctgactgtggccgctaacgagatggggttactagagacaacgaagaaagatctgggaattggctacgtcgcggccgaaaaccatcagcacgcaaccatgctcgacgtagatcttcaccccgctagcgcctggactctgtacgccgtggcaacaaccgttatcaccccaatgatgaggcatacaattgagaatactacggctaacatctccttgaccgccatagcgaatcaagctgccattctgatgggtctcgacaaggggtggcctatctcaaaaatggatattggcgtgccgctgcttgcattaggatgctattctcaggtcaaccccctgacactcactgccgctgtgttgatgctggtcgcacactacgccatcataggcccagggctacaggcgaaggctacccgcgaagcccagaaacggacagcagccggaatcatgaagaatcctaccgtggacggcattgttgctatcgatctggaccccgtggtatatgatgccaagttcgagaaacaactcggtcagattatgcttctgatcttgtgtacaagtcagatactgctcatgcgaacgacatgggcactgtgcgaatcgattaccttagctactgggccacttaccacactgtgggagggaagccctggcaagttttggaacactaccatcgccgtgtccatggcgaatatcttcagaggttcttacctcgccggcgcagggctagctttctcactgatgaagtccttgggaggcgggaggcgcggaacaggcgcccagggtgagacgctgggggaaaagtggaaacggcaactcaaccagcttagcaagagtgagtttaatacctataagagatctggaattatggaagtcgaccgtagcgaggcaaaagaaggcctgaagaggggtgagactacaaaacatgctgtttcacggggcaccgccaagttgcgctggttcgtggagcgaaacctggtcaaacccgaagggaaggtgatcgacctcggatgtggcagagggggatggtcctactattgcgccggcttaaagaaagtaactgaggtgaagggttacacaaaagggggaccgggccacgaggaaccaatacctatggcgacctacggctggaatctggttaaacttcatagtgggaaagatgtgtttttcatgcccccagaaaagtgtgacacgctgctatgcgatattggagagagctctcccaaccctaccatcgaggaaggtaggacactccgggtcctgaaaatggtggagccgtggttgcgcggcaatcagttttgtattaagatcctgaacccctatatgccatccgtcgtggaaactctcgagagaatgcagaggaagcacgggggaatgcttgttcgaaatcctctgtcacggaacagcacccacgagatgtactgggtatcgtgcggcacaggtaatatagtgtctgctgtcaacatgacaagtcgtatgttactgaacagattcaccatggcacatcgcaaacccacatatgaaagggacgtggatttgggggccggaacccggcacgttgctgtggagcctgaagtcgccaatctcgacatcattggccaaagaatcgagaacattaagaatgaacataaatccacttggcactacgatgaggacaacccatataagacgtgggcataccacggcagctatgaggtgaaaccctcagggtccgcctctagcatggtaaatggagtggttcgcctgctaacaaagccttgggatgtcatcccaatggtgacccagattgctatgactgacaccacaccctttggtcagcaaagggtgttcaaggaaaaagtcgatacgcgaaccccgcgggcgaagagaggcactacacagatcatggaggttaccgccaaatggctttgggggtttctgagtaggaacaagaaacctcgcatatgtactcgtgaagagttcacacggaaggtgagatccaatgcagctattggagccgtatttgtggacgaaaaccagtggaatagcgcaaaggaggccgtcgaggacgaaaggttctgggatctcgtgcatcgcgagcgagaactgcacaaacagggcaagtgcgctacctgcgtttacaacatgatgggtaaacgggagaagaaattgggggaatttggaaaggccaagggctctagagcgatctggtacatgtggctgggcgcaaggttcctcgagttcgaggcccttgggtttatgaatgaagaccattggttctcacgcgagaacagtctgtccggagtggaaggtgagggcttacacaaactggggtatatcttgagagatattagcaagataccaggaggcaatatgtacgctgacgatacagccggttgggacactcgggtcaccgaggatgacctccaaaacgaagcaaaaatcacggatattatggagcccgaacatgctctgctagccacctctatctttaaacttacatatcagaataaagtggtaagggttcagcgtcctgctaagaacgggactgtgatggacgtcatttcgcgacgcgatcagagaggatcaggccaagtgggcacctacgggctgaacacattcactaatatggaggtgcagctcatccggcagatggaaagcgagggaatatttctgccatccgagttggaaacccccaacttagccgagagggcactggactggctcgaaaaacacggtgcggagcgccttaagagaatggccatcagtggcgatgactgtgtcgttaagccgattgacgatcggttcgctacggccctgacagcactaaatgacatggggaaagtgaggaaggatatccctcagtgggaaccctctaaaggatggaacgactggcaacaggtaccattttgcagccaccatttccaccagctgattatgaaggatggccgagagatcgtggtcccttgtcgtaatcaggacgagctcgtgggtagagctcgcgtttcccaaggggccggatggtcattgcgggaaaccgcatgcctgggcaaaagttatgcccagatgtggcagcttatgtactttcataggagagatctgcgcctcgcggctaacgccatatgttctgcagtgcccgtcgactgggtgccaactagccggacaacctggtccattcacgcccaccatcaatggatgactaccgaggatatgttatcagtatggaatagggtttggatcgaagagaacccctggatggaaaataagacacacgtgagctcttgggaggaggtcccttatctgggcaagcgagaagaccagtggtgcgggtccttgatcggactgacggctagagccacctgggcaactaacattcaggtggctataaatcaggttcggaggctcatcggtaacgagaattaccttgattacatgacaagtatgaaacgcttcaagaacgaaagcgactcggagggcgccctgtggtga

SEQ ID NO: 13458 - RNA, 9879 nt, synthetic construct
  misc_feature 1..9879: note = derived and/or modified CDS sequence (opt3) from DENV-1__KJ189363__SS-prME
  source 1..9879: mol_type = other RNA
agcgtgaccatgctgctcatgcttctgcccacagccttggctttccacttaactacgagaggcggggagcctcatatgatcgtctccaagcaggaaaggggaaaatctctgctatttaagacctcagcaggtgttaacatgtgcacactcattgccatggacctgggcgagctttgtgaagatactatgacctacaaatgcccacggataacagaggcggaaccggacgatgtggactgttggtgcaatgctaccgatacttgggtaacatatgggacctgtagtcaaacgggagagcaccgccgagagaagcgtagcgtggccctggcaccccatgtcggcttgggtctcgaaactagaaccgagacatggatgtcctctgaaggggcctggaaacagatccagagggtggagacttgggctctgcggcaccctggattcatggttattgcatttttcctggcccatgctatcggcacctcgattacacagaagggcatcatatttatcctcttaatgctggtgaccccatcaatggccatgcgctgcgtcgggattggaaacagagacttcgtggagggtcttagcggcgcgacgtgggtagatgttgtgttggaacacgggagttgtgtcactacaatggcaaagaataaacccaccctggacatcgagctactcaagactgaagtgacaaaccctgccgtgctgaggaaactttgcattgaggctaagatctccaataccacgaccgattctcggtgtccaacacaaggagaagccactctggtcgaggagcaggacgcaaactttgtttgccgccgaaccttcgtggatagaggctggggtaatgggtgtggattgtttggcaaaggcagcctcctgacatgcgctaagttcaagtgcgtaactaaattagaagggaagatagtgcagtacgagaacctgaaatattccgtcattgtgaccgttcacacaggagaccagcatcaagtgggtaatgaaaccactgagcacggcacgatcgccacaattaccccccaggcgcctacttcagaaatccagctcaccgattacggggcccttacactggactgtagtccaaggaccggattggactttaacgagatggtcctactgactatgaaggagaaaagctggctcgtgcataagcagtggttcctggatcttccgctgccctggacatctggcgcatccacgtcacaagaaacctggaatcggcaggacttgctcgtaacttttaaaacagctcacgccaagaagcaggaggttgtggtcctgggtagccaagaaggggctatgcacaccgccttaacaggcgcaactgagatccagaccagtggaacgaccacaattttcgccggccatctgaaatgccgtctaaagatggataaactcactctgaaggggatgtcttatgtgatgtgtaccggatccttcaaacttgaaaaggaggtcgctgagacacagcacggtactgtgttggttcaggtgaagtacgaaggcaccgacgcgccttgcaaaataccatttagcacgcaagatgagaagggggtaacacagaacggacgcctgatcaccgcaaatcccattgtcactgacaaagaaaagcctgtgaacatcgagacagagccacccttcggcgaatcgtatatagttgtgggtgccggggagaaagctctcaagctgtcttggtttaagagaggctcctcaattggaaaaatgttcgaagccaccgcaaggggcgcccggcgaatggctatccttggggatactgcctgggactttggaagtatcggtggcgtcttcaccagcgtggggaagctggtacatcagatttttggaacagcatacggcgtgttgttctccggtgtttcttggacgatgaaaatcgggattggcatactcctgacctggttaggactgaatagccgctcaactagtctatccatgacatgtatcgcggtcggcatggtgaccctctacctgggggtgatggtccaggctgatagcggatgcgttattaactggaagggcagagagcttaaatgtggttctgggatctttgtgacaaacgaagtgcacacttggaccgagcaatataagttccaggccgactcaccgaagaggttgagtgcagccatcggaaaagcttgggaggaaggcgtatgcggtattcggagcgccacgcgcctggagaatataatgtggaagcagatctccaacgaactcaatcatattctgttagagaacgatatgaaatttacagtcgtggttggcgacgcaaatgggatcctggctcagggaaagaaaatgattagacctcaacccatggaacacaagtactcttggaaatcgtggggcaaggccaagatcataggggcggacatccagaacaccactttcattatcgatggaccagacacccctgagtgtcccgatggccagagggcctggaatatttgggaggtggaagactatggttttggggtcttcacaactaacatctggcttaaattgcgtgatagctacacccagatgtgcgaccaccggctcatgtccgctgcaataaaggattcaaaagccgtgcatgctgacatgggatattggattgagagtgaaaagaatgagacatggaaactggcccgagcatctttcatcgaagttaagacgtgtacctggccaaagagccacactctatggtccaacggcgtgctggagtcagagatgattatccccaaaatatacggtggccctatcagccaacataattatagaccagggtactttacacagaccgcgggaccgtggcacctcggcaagctggaacttgatttcgacttgtgcgaggggactacagtagtcgtggatgaacactgcggaaacaggggcccctctctgcgcaccacgactgtgaccggtaaaattatccatgagtggtgttgccggtcctgtacattacctccactcagatttaggggggaggacggatgctggtacggcatggaaattcgccccgtcaaggagaaagaagagaatctggttcgaagtatggtgagcgccggttctggcgaagtagattccttctcacttgggatcctgtgtgtgagtataatgattgaggaggtcatgcggagccgttggtcgagaaagatgttgatgaccggaactctcgctgtgtttctgctactgatcatgggccagctcacatggaacgacctgatcaggctttgcattatggttggggccaatgcatccgaccgcatgggaatgggcaccacatatttggctctgatggccactttcaagatgcggcctatgtttgcagtgggtttactcttcagaaggctgacctctcgagaagtccttctgctaacgatcgggctcagcctggtggcctcagttgagttgccaaacagtctggaagagttaggagatggcctcgctatgggcattatgatgctgaaacttctgacagaatttcaaccccaccagttgtggaccactctcctgtccctaaccttcgtgaagacaactctgtctcttgactacgcgtggaaaaccacggccatggcactcagcatagtctccctgtttccgttgtgtctgtcaacaaccagccagaagactacatggttacctgtactcctggggagtttcggatgcaaaccacttaccatgtttctgatcactgagaacaagatttggggtcgcaagtcttggcccttgaatgagggcatcatggctattgggatcgtgtccatactcctgagctcgctactgaaaaacgatgttcctcttgccggacccctcatcgccggcggtatgctgattgcttgttatgtgatctcagggtctagtgcagacttgtccttagaaaaggccgcggaggtcagctgggaacaggaggctgaacattctggagccagccactccattctggtggaggtacaagatgacggcacaatgaaaatcaaggatgaggaacgggacgataccctcacgatactgcttaaagcaactctgttggccgtgtcaggcgtctacccaatgagtattcctgctaccctattcgtttggtatttctggcagaagaaaaagcagagaagcggggtgctgtgggacacaccctctccaccggaggtggaaagggcagtcctcgataatggaatctaccgtatcctgcagcgcggtcttttaggccggtcccaagtgggggttggagtatttcaggacggcgtgttccataccatgtggcacgtcacaagaggtgccgtgctgatgtatcaggggaagaggctcgagccttcatgggcgagtgttaaaaaggatttgattagctacggaggcggctggcgatttcaggggtcctggaacactggagaggaagtgcaagtcatagctgtggagcccggtaaaaatccaaagaacgtacagaccacgcccggcacattcaaaactcctgaaggggaggtcggagccatcgcactggactttaagccaggcacctctggttcgcccattgtgaatcgggaagggaagatcgttggactctacggcaacggcgtggtcacaaccagcgggacttatgtgtcagccattgctcaggccaaagcatcccaagagggacctctgccggagatcgaagacgaggttttcaagaaacgcaatcttaccataatggatctgcacccaggtagtggcaagacaagaaggtacttgcccgctatcgtgcgggaagccattaaacgaaagctaagaacgctgatcctcgcgcctactcgcgtcgtggcctctgagatggcagaagctttaaaggggatgccaattaggtatcagaccacagccgtaaaaagcgagcataccggacgtgagatcgtggacctgatgtgccacgctacttttacaatgcggcttctgtcccccgttagagtccctaactacaatatgataattatggatgaagcacatttcaccgacccggcctcaatcgccgctaggggctatatctctacgcgcgtgggtatgggggaggcggcagccatttttatgactgctacacccccaggaagcgtggaagccttccctcagagtaacgcagtcatccaggatgaggaacgagacatacccgagagatcctggaatagcggctacgattggattaccgactttccaggcaagaccgtatggttcgtgccttctatcaaatcagggaacgatattgccaattgtctccggaagaacggaaaaagggttatccaattgtcccgcaagactttcgacacagagtatcagaagaccaaaaacaatgattgggactacgtggtcacaactgacataagtgaaatgggtgctaactttcgtgcggatagagtgattgacccccggaggtgcctgaagccagttatcctcaaagatggcccggagcgcgtgatcctggccgggcctatgcccgtcacggcagctagcgccgcacagcgaagaggacggattggcaggaatcagaacaaggaaggtgaccaatacgtgtatatggggcagccacttaataacgatgaggaccacgcccattggaccgaggctaaaatgctactggataatatcaacacacccgaaggcattatacctgccttgttcgagccagaacgcgagaagtcggcggcaatcgacggagaatacagattaaggggcgaggcccggaagacttttgtagagctgatgcgtcgcggggatctccccgtgtggctgtcttataaagttgcttccgaaggattccagtacagcgaccgaagatggtgctttgatggtgagaggaataaccaggtccttgaagagaatatggacgtggaaatttggaccaaggagggcgagcggaaaaagctgcgccctagatggctcgatgccaggacatattcagacccgttggctctgcgggaattcaaagagtttgcagccgggcgaagaagtgtgtctggagacctaatcctggaaatcggcaagctcccacaacaccttaccctgcgcgctcagaacgccttagataatttggtcatgctgcacaactccgagcagggtgggaaagcatacaggcatgcgatggaagagctccccgacactattgagacgctgatgcttctggccctcatagctgttttgaccggcggagtgacactgttctttttaagcggcaaggggctaggaaagacttcaatcggtctgctctgtgtaaccgccagtagcgcacttctgtggatggcttccgtggaacctcactggattgccgcatctatcattttggagttctttctgatggtcctcctgatccccgaaccagatcggcagcgtacacctcaagacaatcagcttgcctatgtggttataggcctcctgttcatgatcttgaccgtggctgcgaacgagatggggctgttagagactacaaaaaaggatctaggaattggctacgtcgccgcagaaaaccatcagcacgctacgatgctggacgtagatctccaccccgccagcgcctggaccctttacgcagtggctactacagttatcaccccaatgatgagacataccattgagaatacaactgccaacatctccctgacggcgatagctaatcaagccgcaattttgatgggtctggacaaagggtggcctatctcaaagatggatattggcgtgccgctcctggcccttggatgctattctcaggtcaaccccttaaccctgacagctgcagtgctcatgttggtcgcccactacgcgatcataggcccagggctgcaggctaaagccactagggaagcacagaagcgcaccgccgctggaatcatgaagaatcctacagtggacggcattgttgccatcgatctagaccccgtggtatatgatgcaaaatttgagaagcaactgggtcagattatgctccttatcctgtgtaccagtcagatattgctgatgcggactacgtgggctctctgcgaatcgattacactggccaccgggccattaactaccctttgggagggaagccctggcaaattctggaacacaactatcgcggtgtccatggccaatatcttccgaggttcttacctggcaggcgctgggctcgccttttcactaatgaagagcctgggaggcgggagaaggggaaccggcgcacagggtgagacattgggggaaaaatggaagcgccaactgaaccagctctccaagagtgagttcaatacgtataaacggtctggaattatggaagtcgacagaagcgaggctaaggaaggccttaaacgtggtgagaccactaagcatgccgtttcaaggggcacagccaaactgcggtggtttgtggagcgcaacttggtcaagcccgaagggaaggtgatcgacctgggatgtggccgagggggatggtcctactattgcgcgggcctcaaaaaggtaaccgaggtgaaaggttacactaaggggggaccgggccacgaagagccaatacctatggctacatacggctggaatttagttaaactgcatagtgggaaggatgtgttctttatgcccccagaaaaatgtgacacccttctgtgcgatattggagagagctctcccaaccctacgatcgaggaaggtagaaccctaagggtcctcaagatggtggagccgtggctgcggggcaatcagttctgtattaagatcttgaacccctatatgccatccgtcgtggaaacactggagcgcatgcagagaaaacacgggggaatgctcgttaggaatcctctttcacgaaacagcactcacgagatgtactgggtatcgtgcggcaccggtaatatagtgtctgcagtcaacatgacaagtcggatgctgttaaaccgttttactatggcccatagaaagcccacctatgaacgcgacgtggatctgggggctggaacaaggcacgttgccgtggagcctgaagtcgcaaatttggacatcattggccaacggatcgagaacattaaaaatgaacataagtccacctggcactacgatgaggacaacccatataaaacttgggcctaccacggcagctatgaggtgaagccctcagggtccgcttctagcatggtaaatggagtggttagactcctgacgaagccttgggatgtcatcccaatggtgacacagattgcgatgaccgacactacccccttcggtcagcaacgcgtgtttaaagaaaaggtcgatacaaggacgccgcgagccaaacggggcaccactcagatcatggaggttacagcaaagtggctatgggggttccttagtagaaacaaaaagcctaggatatgtacccgcgaagagtttactcgtaaggtgcggtccaatgctgccattggagcagtattcgtggacgaaaaccagtggaatagcgccaaagaggctgtcgaggacgaaagattttgggatctggtgcatagggagcgcgaactccacaagcagggcaaatgcgccacatgcgtttacaacatgatgggtaagcgagagaaaaagctgggggaattcggaaaggcgaaaggctctcgggcaatctggtacatgtggttgggcgccagattcctggagtttgaggctctcgggttcatgaatgaagaccattggttttcaagggagaacagtctttccggagtggaaggtgagggcctgcacaagttagggtatatcctgcgcgatattagcaaaataccaggaggcaatatgtacgccgacgataccgcaggttgggacacaagagtcactgaggatgacttgcaaaacgaagctaagatcaccgatattatggagcccgaacatgccctcctggctacgtctatcttcaaactaacctatcagaataaggtggtacgggttcagaggcctgccaaaaacgggacagtgatggacgtcatttcgcgtcgagatcagcgcggatcaggccaagtgggcacttacgggcttaacacctttacaaatatggaggtgcagctgatcagacagatggaaagcgagggaatattcctcccatccgagctggaaactcccaacttggcagagcgggcgttagactggctggaaaagcacggtgccgagaggctcaagcgcatggctatcagtggcgatgactgtgtcgttaaaccgattgacgatagatttgccaccgcacttacggctctgaatgacatggggaaggtgcggaaagatatccctcagtgggaaccctctaagggatggaacgactggcaacaggtaccattctgcagccaccattttcaccagctaattatgaaagatggcagggagatcgtggtcccttgtcgaaatcaggacgagctggtgggtcgtgccagagtttcccaaggggcaggatggtcactccgcgaaacagcctgcttgggcaagagttatgcgcagatgtggcagctgatgtacttccatcggagggatcttagactggctgccaacgcaatatgttctgccgtgcccgtcgactgggtgccaaccagccgcactacatggtccattcacgctcaccatcaatggatgaccactgaggatatgctctcagtatggaatcgggtttggatcgaagagaacccctggatggaaaataagacccacgtgagctcttgggaggaggtcccttatttaggcaaaagggaagaccagtggtgcgggtccctgatcggattgacagcccgagcaacgtgggctaccaacattcaggtggccataaatcaggttagacggctgatcggtaacgagaattacctcgattacatgactagtatgaagaggtttaaaaacgaaagcgactcggagggcgcgctttggtga

SEQ ID NO: 13459 - RNA, 9879 nt, synthetic construct
  misc_feature 1..9879: note = derived and/or modified CDS sequence (opt3) from DENV-1__KJ189364__SS-prME
  source 1..9879: mol_type = other RNA
agcgtgaccatgctgctcatgcttctgcccacagccttggctttccacttaactacgagaggcggggagcctcatatgatcgtctccaagcaggaaaggggaaaatctctgctatttaagacctcagcaggtgttaacatgtgcacactcattgccatggacctgggcgagctttgtgaagatactatgacctacaaatgcccacggataacagaggcggaaccggacgatgtggactgttggtgcaatgctaccgatacttgggtaacatatgggacctgtagtcaaacgggagagcaccgccgagagaagcgtagcgtggccctggcaccccatgtcggcttgggtctcgaaactagaaccgagacatggatgtcctctgaaggggcctggaaacagatccagagggtggagacttgggctctgcggcaccctggattcaccgttattgcatttttcctggcccatgctatcggcacatcgattacccagaagggcatcatatttatcctcttaatgctggtgacgccatcaatggccatgcgctgcgtcgggattggaaacagagacttcgtggagggtcttagcggcgcgacttgggtagatgttgtgttggaacacgggagttgtgtcacaaccatggcaaagaataaacccactctggacatcgagctactcaagacagaagtgaccaaccctgccgtgctgaggaaactttgcattgaggctaagatctccaatacgaccacagattctcggtgtccaactcaaggagaagccaccctggtcgaggagcaggacgcaaactttgtttgccgccgaacattcgtggatagaggctggggtaatgggtgtggattgtttggcaaaggcagcctcctgacttgcgctaagttcaagtgcgtaaccaaattagaagggaagatagtgcagtacgagaacctgaaatattccgtcattgtgacagttcacaccggagaccagcatcaagtgggtaatgaaactacggagcacggcacaatcgccaccattactccccaggcgcctacctcagaaatccagctcacagattacggggcccttaccctggactgtagtccaaggactggattggactttaacgagatggtcctactgacaatgaaggagaaaagctggctcgtgcataagcagtggttcctggatcttccgctgccctggacgtctggcgcatccacctcacaagaaacttggaatcggcaggacttgctcgtaacatttaaaaccgctcacgccaagaagcaggaggttgtggtcctgggtagccaagaaggggctatgcacacagccttaactggcgcaaccgagatccagacgagtggaaccacaactattttcgccggccatctgaaatgccgtctaaagatggataaactcaccctgaaggggatgtcttatgtgatgtgtacaggatccttcaaacttgaaaaggaggtcgctgagactcagcacggtaccgtgttggttcaggtgaagtacgaaggcacggacgcgccttgcaaaataccatttagcacacaagatgagaaggggatgacccagaacggacgcctgatcactgcaaatcccattgtaacagacaaagaaaagcctgtcaacatcgagaccgagccacccttcggcgaatcgtatatagtggttggtgccggggagaaagctctcaagctgtcttggtttaagagaggctcctcaattggaaaaatgttcgaagccactgcaaggggcgcccggcgaatggctatccttggggataccgcctgggactttggaagtatcggtggcgtgttcacaagcgtcgggaagctggtgcatcagatttttggaacggcatacggcgtattgttctccggtgtgtcttggaccatgaaaatcgggattggcatactcctgacttggttaggactgaatagccgctcaacaagtctatccatgacctgtatcgcggttggcatggtcacactctacctgggggtgatggtgcaggctgatagcggatgcgtcattaactggaagggcagagagcttaaatgtggttctgggatctttgttactaacgaagtgcacacctggacggagcaatataagttccaggccgactcaccgaagaggttgagtgcagccatcggaaaagcttgggaggaaggcgtgtgcggtattcggagcgccacacgcctggagaatataatgtggaagcagatctccaacgaactcaatcatattctgttagagaacgatatgaaatttaccgtagtcgtgggcgacgcaaatgggatcctggctcagggaaagaaaatgattagacctcaacccatggaacacaagtactcttggaaatcgtggggcaaggccaagatcataggggcggacatccagaacactaccttcattatcgatggaccagacacacctgagtgtcccgatggccagagggcctggaatatttgggaggttgaagactatggttttggggtgttcactaccaacatctggcttaaattgcgtgatagctacacacagatgtgcgaccaccggctcatgtccgctgcaataaaggattcaaaagccgtccatgctgacatgggatattggattgagagtgaaaagaatgagacgtggaaactggcccgagcatctttcatcgaagtgaagacctgtacttggccaaagagccacacactatggtccaacggcgttctggagtcagagatgattatccccaaaatatacggtggccctatcagccaacataattatagaccagggtactttacccagactgcgggaccgtggcacctcggcaagctggaacttgatttcgacttgtgcgaggggacaaccgtggtagtcgatgaacactgcggaaacaggggcccctctctgcgcacgactaccgtgacaggtaaaattatccatgagtggtgttgccggtcctgtaccttacctccactcagatttaggggggaggacggatgctggtacggcatggaaattcgccccgtgaaggagaaagaagagaatctggtccgaagtatggttagcgccggttctggcgaagtggattccttctcacttgggatcctgtgtgtaagtataatgattgaggaggtgatgcggagccgttggtcgagaaagatgttgatgactggaacactcgctgtctttctgctactgatcatgggccagctcacctggaacgacctgatcaggctttgcattatggtgggggccaatgcatccgaccgcatgggaatgggcacaacttatttggctctgatggccaccttcaagatgcggcctatgtttgcagttggtttactcttcagaaggctgacgtctcgagaagtgcttctgctaacaatcgggctcagcctggtcgcctcagtggagttgccaaacagtctggaagagttaggagatggcctcgctatgggcattatgatgctgaaacttctgaccgaatttcaaccccaccagttgtggactaccctcctgtccctaacattcgttcgcactaccctgtctcttgactacgcgtggaagacgacagccatggcactcagcatagtgtccctgtttccgttgtgtctgtcaaccactagccagaaaacaacctggttacctgtcctcctggggagtttcggatgcaagccacttactatgtttctgatcacagagaacaaaatttggggtcggaagtcttggcccttgaatgagggcatcatggctattgggatcgtatccatactcctgagctcgctactgaagaacgatgtgcctcttgccggacccctcatcgccggcggtatgctgattgcttgttatgttatctcagggtctagtgcagacttgtccttagaaaaagccgcggaggtgagctgggaacaggaggctgaacattctggagccagccactccattctggtcgaggtgcaagatgacggcaccatgaagatcaaagatgaggaaagagacgatacgctcactatactgcttaaggcaaccctgttggccgtatcaggcgtgtacccaatgagtattcctgctacactattcgtctggtatttctggcagaaaaagaaacagaggagcggggttctgtgggacaccccctctccaccggaggtggaacgtgcagtgctcgataatggaatctaccgcatcctgcagcggggtcttttaggcagatcccaagtcggggtgggagtttttcaggacggcgtattccatacaatgtggcacgtgactaggggtgccgtcctgatgtatcaggggaagcgactcgagccttcatgggcgagtgtgaagaaagatttgattagctacggaggcggctggcggtttcaggggtcctggaacaccggagaggaagttcaagtgatagctgtcgagcccggtaagaatccaaaaaacgtgcagacgacacccggcactttcaagacccctgaaggggaggtaggagccatcgcactggactttaaaccaggcacatctggttcgcccattgtcaatcgcgaagggaagatcgtgggactctacggcaacggcgttgtgaccactagcgggacctatgtctcagccattgctcaggccaaggcatcccaagagggacctctgccggagatcgaagacgaggtgttcaaaaagagaaatcttacaataatggatctgcacccaggtagtggcaaaacgaggcggtacttgcccgctatcgttcgagaagccattaagagaaaactacgcactctgatcctcgcgcctaccagggtggtcgcctctgagatggcagaagctttaaaggggatgccaattcgttatcagacaaccgccgtgaagagcgagcatactggacgggagatcgtagacctgatgtgccacgctacatttaccatgagacttctgtcccccgtgagggttcctaactacaatatgataattatggatgaagcacatttcacggacccggcctcaatcgccgctcgcggctatatctctactcgagtcggtatgggggaggcggcagccatttttatgacagctacccccccaggaagcgtggaagccttccctcagagtaacgcagtgatccaggatgaggaaagagacatacccgagcggtcctggaatagcggctacgattggattaccgactttccaggcaaaactgtctggttcgtaccttctatcaagtcagggaacgatattgccaattgtctcaggaaaaacggaaagcgcgtgatccaattgtcccgtaaaacattcgacaccgagtatcagaagacaaagaacaatgattgggactacgttgtgactacggacataagtgaaatgggtgctaactttagagcggatcgggtcattgaccccaggcgctgcctgaaaccagtgatcctcaaggatggcccggagcgagttatcctggccgggcctatgcccgtgaccgcagctagcgccgcacagagacggggaaggattggccgcaatcagaacaaagaaggtgaccaatacgtctatatggggcagccacttaataacgatgaggaccacgcccattggacagaggctaagatgctactggataatatcaacactcccgaaggcattatacctgccttgttcgagccagaaagagagaaatcggcggcaatcgacggagaatacaggttacggggcgaggcccgtaagacctttgtggagctgatgcgccgaggggatctccccgtatggctgtcttataaggtggcttccgaaggattccagtacagcgacagaaggtggtgctttgatggtgagcggaataaccaggttcttgaagagaatatggacgtcgaaatttggacaaaagagggcgagcgcaagaaactgagacctaggtggctcgatgcccggacctattcagacccgttggctctgcgagaattcaaggagtttgcagccgggagacgcagtgtgtctggagacctaatcctggaaatcggcaaactcccacaacaccttactctgagggctcagaacgccttagataatttggtgatgctgcacaactccgagcagggtgggaaggcataccggcatgcgatggaagagctccccgacacgattgagaccctgatgcttctggccctcatagctgtcttgacaggcggagttactctgttctttttaagcggcaaagggctaggaaagacctcaatcggtctgctctgtgtgacagccagtagcgcacttctgtggatggcttccgtagaacctcactggattgccgcatctatcattttggagttctttctgatggtgctcctgatccccgaaccagatcgtcagagaacccctcaagacaatcagcttgcctatgtcgtgataggcctcctgttcatgatcttgactgttgctgcgaacgagatggggctgttagagacaacgaagaaagatctaggaattggctacgtggccgcagaaaaccatcagcacgctaccatgctggacgtcgatctccaccccgccagcgcctggactctttacgcagtagctacaaccgtgatcaccccaatgatgaggcatacaattgagaatactacggccaacatctccctgaccgcgatagctaatcaagccgcaattttgatgggtctggacaaggggtggcctatctcaaaaatggatattggcgttccgctcctggcccttggatgctattctcaggtgaaccccttaacactgactgctgcagtcctcatgttggtggcccactacgcgatcataggcccagggctgcaggctaaggccacccgcgaagcacagaaacggacagccgctggaatcatgaagaatcctaccgtcgacggcattgtggccatcgatctagaccccgttgtgtatgatgcaaagtttgagaaacaactgggtcagattatgctccttatcctgtgtactagtcagatattgctgatgcgaacgacatgggctctctgcgaatcgattaccctggccactgggccattaaccacactttgggagggaagccctggcaagttctggaacactaccatcgcggtatccatggccaatatcttcagaggttcttacctggcaggcgctgggctcgccttttcactaatgaaaagcctgggaggcgggaggcgcggaacaggcgcacagggtgagacgttgggggaaaagtggaaacggcaactgaaccagctctccaagagtgagttcaatacctataagagatctggaattatggaagtggaccgtagcgaggctaaagaaggccttaagaggggtgagactacaaaacatgccgtctcacggggcaccgccaagctgcgctggtttgttgagcgaaacttggtgaaacccgaagggaaggtcatcgacctgggatgtggcagagggggatggtcctactattgcgcgggcctcaagaaagtgactgaggtaaagggttacacaaaagggggaccgggccacgaagagccaatacctatggctacctacggctggaatttagtgaagctgcatagtgggaaagatgttttctttatgcccccagaaaagtgtgacacgcttctgtgcgatattggagagagctctcccaaccctaccatcgaggaaggtaggacactacgggtgctcaaaatggtcgagccgtggctgcgcggcaatcagttctgtattaagatcttgaacccctatatgccatccgtggtcgaaactctggagagaatgcagaggaagcacgggggaatgctcgtgcgaaatcctctttcacggaacagcacccacgagatgtactgggtttcgtgcggcacaggtaatatagtatctgcagtgaacatgactagtcgtatgctgttaaacagatttaccatggcccatcgcaaacccacatatgaaagggacgtcgatctgggggctggaacccggcacgtggccgttgagcctgaagtggcaaatttggacatcattggccaaagaatcgagaacattaagaatgaacataaatccacttggcactacgatgaggacaacccatataagacgtgggcctaccacggcagctatgaggtcaaaccctcagggtccgcttctagcatggtgaatggagtagtgcgcctcctgacaaagccttgggatgttatcccaatggtcacccagattgcgatgactgacaccacacccttcggtcagcaaagggtgtttaaggaaaaagtggatacgcgaaccccgcgggccaagagaggcactacacagatcatggaggtcaccgcaaaatggctatggagtttcctttccaggaacaagaaacctcgcatatgtactcgtgaagagtttacacggaaggttagaagcaatgctgccattggggcagtgttcgtagacgaaaaccagtggaattctgccaaggaggctgtggaggacgaaaggttttgggatctggtccatcgcgagcgagaactccacaaacagggaaagtgcgccacctgcgtgtacaacatgatgggcaaacgggagaagaaactgggtgaattcgggaaggcgaagggatcaagagcaatctggtacatgtggttgggcgccaggttcctggagtttgaggctctcggcttcatgaatgaagaccattggtttagtcgcgagaactcccttagcggggttgaaggagagggtctgcacaaattaggctatatcctgagagatatttctaagataccagggggaaatatgtacgccgacgatacagcaggctgggacactcgggtgaccgaggatgacttgcaaaacgaagctaaaatcacggatattatggagcccgaacatgccctcctggctacctcgatcttcaagctaacatatcagaataaagtcgtgagggtacagcgtcctgccaagaacggtactgttatggacgtgatttcacgacgcgatcagagagggagcggacaagtcggcacctacggccttaacacatttactaatatggaggtgcagctgatccggcagatggaatccgaggggatattcctcccaagtgagctggaaacccccaacttggcagagagggcgttagactggctggaaaaacacggagccgagcgcctcaagagaatggctatctctggtgatgactgtgtggtcaagccgattgacgatcggtttgccacggcacttacagctctgaatgacatgggcaaagttaggaaggatatccctcagtgggaacccagcaaagggtggaacgactggcaacaggtgccattctgctcccaccattttcaccagctaattatgaaggatggacgagagatcgtagtgccttgtcgtaatcaggacgagctggtcggcagagcccgcgtgtcacaaggtgcagggtggagtctccgggaaaccgcctgcttgggaaaatcttatgcgcagatgtggcagctgatgtacttccataggagagatcttcgcctggctgccaacgcaatatgtagcgccgttcccgtggactgggtcccaacttcccggacaacctggtcaattcacgctcaccatcaatggatgactaccgaggatatgctcagcgtgtggaatagggtatggatcgaagagaacccctggatggaaaataagacacacgtttcttcctgggaggaggtgccttatttaggcaagcgagaagaccagtggtgcggcagtctgatcgggttgacggccagagcaacctgggctactaacattcaggtcgccataaatcaggtgcggaggctgatcggaaacgagaattacctcgattacatgacaagcatgaaacgctttaagaacgaatcggactccgagggtgcgctttggtga

SEQ ID NO: 13460 - RNA, 9879 nt, synthetic construct
  misc_feature 1..9879: note = derived and/or modified CDS sequence (opt3) from DENV-1__KJ189365__SS-prME
  source 1..9879: mol_type = other RNA
agcgtgaccatgctgctcatgcttctgcccacagccttggctttccacttaactacgagaggcggggagcctcatatgatcgtctccaagcaggaaaggggaaaatctctgctatttaagacctcagcaggtgttaacatgtgcacactcattgccatggacctgggcgagctttgtgaagatactatgacctacaaatgcccacggataacagaggcggaaccggacgatgtggactgttggtgcaatgctaccgatacttgggtaacatatgggacctgtagtcaaacgggagagcaccgccgagagaagcgtagcgtggccctggcaccccatgtcggcttgggtctcgaaactagaaccgagacatggatgtcctctgaaggggcctggaaacagatccagagggtggagacttgggctctgcggcaccctggattcaccgttattgcatttttcctggcccatgctatcggcacatcgattacccagaagggcatcatatttatcctcttaatgctggtgacgccatcaatggccatgcgctgcgtcgggattggaaacagagacttcgtggagggtcttagcggcgcgacttgggtagatgttgtgttggaacacgggagttgtgtcacaaccatggcaaagaataaacccactctggacatcgagctactcaagacagaagtgaccaaccctgccgtgctgaggaaactttgcattgaggctaagatctccaatacgaccacagattctcggtgtccaactcaaggagaagccaccctggtcgaggagcaggacgcaaactttgtttgccgccgaacattcgtggatagaggctggggtaatgggtgtggattgtttggcaaaggcagcctcctgacttgcgctaagttcaagtgcgtaaccaaattagaagggaagatagtgcagtacgagaacctgaaatattccgtcattgtgacagttcacaccggagaccagcatcaagtgggtaatgaaactacggagcacggcacaatcgccaccattactccccaggcgcctacctcagaaatccagctcacagattacggggcccttaccctggactgtagtccaaggactggattggactttaacgagatggtcctactgacaatgaaggagaaaagctggctcgtgcataagcagtggttcctggatcttccgctgccctggacgtctggcgcatccacctcacaagaaacttggaatcggcaggacttgctcgtaacatttaaaaccgctcacgccaagaagcaggaggttgtggtcctgggtagccaagaaggggctatgcacacagccttaactggcgcaaccgagatccagacgagtggaaccacaactattttcgccggccatctgaaatgccgtctaaagatggataaactcaccctgaaggggatgtcttatgtgatgtgtacaggatccttcaaacttgaaaaggaggtcgctgagactcagcacggtaccgtgttggttcaggtgaagtacgaaggcacggacgcgccttgcaaaataccatttagcacacaagatgagaagggggtaacccagaacggacgcctgatcactgcaaatcccattgtcacagacaaagaaaagcctgtgaacatcgagaccgagccacccttcggcgaatcgtatatagttgtgggtgccggggagaaagctctcaagctgtcttggtttaagagaggctcctcaattggaaaaatgttcgaagccactgcaaggggcgcccggcgaatggctatccttggggataccgcctgggactttggaagtatcggtggcgtcttcacaagcgtggggaagctggtacatcagatttttggaacggcatacggcgtgttgttctccggtgtttcttggaccatgaaaatcgggattggcatactcctgacttggttaggactgaatagccgctcaacaagtctatccatgacctgtatcgtcgtgggcatggtgacactctacctgggggtcatggttcaggcggatagcggatgcgtgattaactggaagggcagagagcttaaatgtggttctgggatctttgtgactaacgaagtacacacctggacggagcaatataagttccaggctgactcaccgaagaggttgagtgccgcaatcggaaaagcctgggaggaaggcgtctgcggtattcggagcgctacacgcctggagaatataatgtggaagcagatctccaacgaactcaatcatattctgttagagaacgatatgaaatttaccgtggttgtgggcgacgccaatgggatcctggcacagggaaagaaaatgattagacctcaacccatggaacacaagtactcttggaaatcgtggggcaaggctaagatcataggggccgacatccagaacactaccttcattatcgatggaccagacacacctgagtgtcccgatggccagagggcgtggaatatttgggaggtcgaagactatggttttggggtgttcactaccaacatctggcttaaattgcgtgatagctacacacagatgtgcgaccaccggctcatgtccgccgctataaaggattcaaaagcagttcatgccgacatgggatattggattgagagtgaaaagaatgagacgtggaaactggctcgagcctctttcatcgaagtgaagacctgtacttggccaaagagccacacactatggtccaacggcgtactggagtcagagatgattatccccaaaatatacggtggccctatcagccaacataattatagaccagggtactttacccagactgcaggaccgtggcacctcggcaagctggaacttgatttcgacttgtgcgaggggacaaccgtcgtggtggatgaacactgcggaaacaggggcccctctctgcgcacgactaccgtcacaggtaaaattatccatgagtggtgttgccggtcctgtaccttacctccactcagatttaggggggaggacggatgctggtacggcatggaaattcgccccgttaaggagaaagaagagaatctggtgcgaagtatggtaagcgcgggttctggcgaagtggattccttctcacttgggatcctgtgtgtcagtataatgattgaggaggtgatgcggagccgttggtcgagaaagatgttgatgactggaacactcgccgtttttctgctactgatcatgggccagctcacctggaacgacctgatcaggctttgcattatggtgggggctaatgcctccgaccgcatgggaatgggcacaacttatttggcactgatggctaccttcaagatgcggcctatgtttgccgtcggtttactcttcagaaggctgacgtctcgagaagtgcttctgctaacaatcgggctcagcctggttgcatcagtggagttgccaaacagtctggaagagttaggagatggcctcgccatgggcattatgatgctgaaacttctgaccgaatttcaaccccaccagttgtggactaccctcctgtccctaacattcgtcaagactaccctgtctcttgactacgcttggaaaacgacagcgatggccctcagcatagtatccctgtttccgttgtgtctgtcaaccactagccagaagacaacctggttacctgtgctcctggggagtttcggatgcaaaccacttactatgtttctgatcacagagaacaagatttggggtcgcaagtcttggcccttgaatgagggcatcatggcaattgggatcgtttccatactcctgagctcgctactgaaaaacgatgtgcctcttgctggacccctcatcgccggcggtatgctgattgcctgttatgtcatctcagggtctagtgctgacttgtccttagaaaaggcagccgaggtgagctgggaacaggaggcggaacattctggagctagccactccattctggtagaggtgcaagatgacggcaccatgaaaatcaaggatgaggaacgggacgatacgctcactatactgcttaaagccaccctgttggcagtctcaggcgtttacccaatgagtattcctgccacactattcgtgtggtatttctggcagaagaaaaagcagagaagcggggtgctgtgggacaccccctctccaccggaggtcgaaagggctgtgctcgataatggaatctaccgtatcctgcagcgcggtcttttaggccggtcccaagttggggtaggagtgtttcaggacggcgtcttccatacaatgtggcacgtgactagaggtgcagttctgatgtatcaggggaagaggctcgagccttcatgggccagtgtgaaaaaggatttgattagctacggaggcggctggcgatttcaggggtcctggaacaccggagaggaagtccaagtgatagcggtagagcccggtaaaaatccaaagaacgtccagacgacacccggcactttcaaaacccctgaaggggaggtgggagctatcgccctggactttaagccaggcacatctggttcgcccattgttaatcgggaagggaagatcgtgggactctacggcaacggcgtcgtgaccactagcgggacctatgtttcagcaattgcccaggctaaagcctcccaagagggacctctgccggagatcgaagacgaggtgttcaagaaacgcaatcttacaataatggatctgcacccaggtagtggcaagacgagaaggtacttgcccgcaatcgtccgggaagctattaaacgaaagctaagaactctgatcctcgcccctacccgcgtggtagcgtctgagatggccgaagcattaaaggggatgccaattaggtatcagacaaccgctgtgaaaagcgagcatactggacgtgagatcgttgacctgatgtgccacgccacatttaccatgcggcttctgtcccccgtcagagtgcctaactacaatatgataattatggatgaagctcatttcacggacccggcatcaatcgccgccaggggctatatctctactcgcgtgggtatgggggaggctgcggcaatttttatgacagccacccccccaggaagcgtcgaagctttccctcagagtaacgccgtaatccaggatgaggaacgagacatacccgagagatcctggaatagcggctacgattggattaccgactttccaggcaagactgtgtggttcgttccttctatcaaatcagggaacgatattgcaaattgtctccggaagaacggaaaaagggtgatccaattgtcccgcaagacattcgacaccgagtatcagaagacaaaaaacaatgattgggactacgtcgtgactacggacataagtgaaatgggtgccaactttcgtgctgatagagttattgacccccggaggtgcctgaagccagtgatcctcaaagatggcccggagcgcgtcatcctggcggggcctatgcccgtgaccgccgcaagcgctgcccagcgaagaggacggattggcaggaatcagaacaaggaaggtgaccaatacgtatatatggggcagccacttaataacgatgaggaccacgcacattggacagaggccaaaatgctactggataatatcaacactcccgaaggcattatacctgctttgttcgagccagaacgcgagaagtcggccgcgatcgacggagaatacagattaaggggcgaggcacggaagacctttgtggagctgatgcgtcgcggggatctccccgtttggctgtcttataaagtcgcctccgaaggattccagtacagcgaccgaagatggtgctttgatggtgagaggaataaccaggtgcttgaagagaatatggacgtggaaatttggacaaaggagggcgagcggaaaaagctgcgccctagatggctcgatgctaggacctattcagacccgttggccctgcgggaattcaaagagtttgctgcagggcgaagaagtgtctctggagacctaatcctggaaatcggcaagctcccacaacaccttactctgcgcgcccagaacgctttagataatttggttatgctgcacaactccgagcagggtgggaaagcctacaggcatgcaatggaagagctccccgacacgattgagaccctgatgcttctggcgctcatagccgtgttgacaggcggagtaactctgttctttttaagcggcaaggggctaggaaagacctcaatcggtctgctctgtgtgacagctagtagcgcccttctgtggatggcatccgtcgaacctcactggattgctgcctctatcattttggagttctttctgatggtgctcctgatccccgaaccagatcggcagcgtacccctcaagacaatcagcttgcatatgttgtgataggcctcctgttcatgatcttgactgtcgccgctaacgagatggggctgttagagacaacgaaaaaggatctaggaattggctacgtagcggccgaaaaccatcagcacgcaaccatgctggacgtggatctccaccccgctagcgcctggactctttacgccgttgcaacaaccgtgatcaccccaatgatgagacatacaattgagaatactacggctaacatctccctgaccgccatagcgaatcaagctgccattttgatgggtctggacaaagggtggcctatctcaaagatggatattggcgtcccgctcctggcacttggatgctattctcaggtgaaccccttaacactgactgccgctgtcctcatgttggtggcacactacgccatcataggcccagggctgcaggcgaaagctaccagggaagcccagaagcgcacagcagccggaatcatgaagaatcctaccgttgacggcattgtggctatcgatctagaccccgtagtgtatgatgccaaatttgagaagcaactgggtcagattatgctccttatcctgtgtactagtcagatattgctgatgcggacgacatgggcactctgcgaatcgattaccctggctactgggccattaaccacactttgggagggaagccctggcaaattctggaacactaccatcgccgtctccatggcgaatatcttccgaggttcttacctggccggcgcagggctcgctttttcactaatgaagagcctgggaggcgggagaaggggaacaggcgcccagggtgagacgttgggggaaaaatggaagcgccaactgaaccagctctccaagagtgagttcaatacctataaacggtctggaattatggaagttgacagaagcgaggcaaaggaaggccttaaacgtggtgagactacaaagcatgctgtgtcaaggggcaccgccaaactgcggtggtttgtcgagcgcaacttggtgaagcccgaagggaaggtaatcgacctgggatgtggccgagggggatggtcctactattgcgccggcctcaaaaaggtgactgaggttaaaggttacacaaaggggggaccgggccacgaagagccaatacctatggcgacctacggctggaatttagtgaaactgcatagtgggaaggatgtcttctttatgcccccagaaaaatgtgacacgcttctgtgcgatattggagagagctctcccaaccctaccatcgaggaaggtagaacactaagggtgctcaagatggtcgagccgtggctgcggggcaatcagttctgtattaagatcttgaacccctatatgccatccgtggttgaaactctggagcgcatgcagagaaaacacgggggaatgctcgtaaggaatcctctttcacgaaacagcacccacgagatgtactgggtgtcgtgcggcacaggtaatatagtctctgctgtgaacatgactagtcggatgctgttaaaccgttttaccatggcacatagaaagcccacatatgaacgcgacgttgatctgggggccggaaccaggcacgtggctgtcgagcctgaagtggccaatttggacatcattggccaacggatcgagaacattaaaaatgaacataagtccacttggcactacgatgaggacaacccatataaaacgtgggcataccacggcagctatgaggtaaagccctcagggtccgcctctagcatggtgaatggagttgtcagactcctgacaaagccttgggatgtgatcccaatggtgacccagattgctatgactgacaccacacccttcggtcagcaacgcgtctttaaagaaaaggttgatacgaggaccccgcgagcgaaacggggcactacacagatcatggaggtgaccgccaagtggctatgggggttccttagtagaaacaaaaagcctaggatatgtactcgcgaagagtttacacgtaaggtacggtccaatgcagctattggagccgtgttcgtcgacgaaaaccagtggaatagcgcaaaagaggccgtggaggacgaaagattttgggatctggttcatagggagcgcgaactccacaagcagggcaaatgcgctacctgcgtgtacaacatgatgggtaagcgagagaaaaagctgggggaattcggaaaggccaaaggctctcgggcgatctggtacatgtggttgggcgcaagattcctggagtttgaggccctcgggttcatgaatgaagaccattggttttcaagggagaacagtctttccggagtcgaaggtgagggcctgcacaagttagggtatatcctgcgcgatattagcaaaataccaggaggcaatatgtacgctgacgatacagccggttgggacactagagtgaccgaggatgacttgcaaaacgaagcaaagatcacggatattatggagcccgaacatgctctcctggccacctctatcttcaaactaacatatcagaataaggtagttcgggtgcagaggcctgctaaaaacgggactgtcatggacgtgatttcgcgtcgagatcagcgcggatcaggccaagtgggcacctacgggcttaacacatttactaatatggaggtccagctgatcagacagatggaaagcgagggaatattcctcccatccgagctggaaacccccaacttggccgagcgggcattagactggctggaaaagcacggtgcggagaggctcaagcgcatggccatcagtggcgatgactgtgttgtgaaaccgattgacgatagatttgctacggcccttacagcactgaatgacatggggaaggtacggaaagatatccctcagtgggaaccctctaagggatggaacgactggcaacaggtgccattctgcagccaccattttcaccagctaattatgaaagatggcagggagatcgtcgtgccttgtcgaaatcaggacgagctggttggtcgtgctagagtgtcccaaggggccggatggtcactccgcgaaaccgcatgcttgggcaagagttatgcccagatgtggcagctgatgtacttccatcggagggatcttagactggcggctaacgccatatgttctgcagtccccgtggactgggtaccaactagccgcacaacctggtccattcacgcccaccatcaatggatgactaccgaggatatgctctcagtttggaatcgggtgtggatcgacgaaaacccctggatggagaataagacacacgtcagctcttgggaagaggtgccttatttaggcaaaagggaggatcagtggtgcgggtccctgatcggattgacggctcgagccacctgggcaactaacattcaggttgctataaatcaggtgagacggctgatcggtaacgaaaattacctcgactacatgacaagtatgaagaggtttaaaaacgagagcgactcggaaggcgccctttggtga

SEQ ID NO: 13461 - RNA, 9879 nt, synthetic construct
  misc_feature 1..9879: note = derived and/or modified CDS sequence (opt3) from DENV-1__KJ189366__SS-prME
  source 1..9879: mol_type = other RNA
agcgtgaccatgctgctcatgcttctgcccacagccttggctttccacttaactacgagaggcggggagcctcatatgatcgtctccaagcaggaaaggggaaaatctctgctatttaagacctcagcaggtgttaacatgtgcacactcattgccatggacctgggcgagctttgtgaagatactatgacctacaaatgcccacggatagcggaggctgaaccggacgatgtggactgttggtgcaatgccacagatacctgggtaacttatgggacatgtagtcaaaccggagagcaccgccgagagaagcgtagcgtggcactggccccccatgtcggcttgggtctcgaaacgagaactgagacctggatgtcctctgaaggggcttggaaacagatccagagggtggagacatgggcactgcggcaccctggattcactgttattgcctttttcctggctcatgccatcggcacctcgattacacagaagggcatcatatttatcctcttaatgctggtgaccccatcaatggcgatgcgctgcgtcgggattggaaacagagacttcgtggagggtcttagcggcgcaacgtgggtagatgttgtgttggaacacgggagttgtgtcactacaatggccaagaataaacccaccctggacatcgagctactcaagactgaagtgacaaaccctgctgtgctgaggaaactttgcattgaggccaagatctccaataccacgaccgattctcggtgtccaacacaaggagaagcaactctggtcgaggagcaggacgctaactttgtttgccgccgaaccttcgtggatagaggctggggtaatgggtgtggattgtttggcaaaggcagcctcctgacatgcgccaagttcaagtgcgtaactaaattagaagggaagatagtgcagtacgagaacctgaaatattccgtcattgtgaccgttcacacaggagaccagcatcaagtgggtaatgaaaccactgagcacggcacgatcgcgacaattaccccccaggcccctacttcagaaatccagctcaccgattacggggcacttacactggactgtagtccaaggaccggattggactttaacgagatggtcctactgactatgaaggagaaaagctggctcgtgcataagcagtggttcctggatcttccgctgccctggacatctggcgcttccacgtcacaagaaacctggaatcggcaggacttgctcgtaacttttaaaacagcccacgctaagaagcaggaggttgtggtcctgggtagccaagaaggggccatgcacaccgcattaacaggcgccactgagatccagaccagtggaacgaccacaattttcgctggccatctgaaatgccgtctaaagatggataaactcactctgaaggggatgtcttatgtgatgtgtaccggatccttcaaacttgaaaaggaggtcgcggagacacagcacggtactgtgttggttcaggtgaagtacgaaggcaccgacgcaccttgcaaaataccatttagcacgcaagatgagaagggggtaacacagaacggacgcctgatcaccgccaatcccattgtcactgacaaagaaaagcctgtgaacatcgagacagagccacccttcggcgaatcgtatatagttgtgggtgctggggagaaagccctcaagctgtcttggtttaagagaggctcctcaattggaaaaatgttcgaagcaaccgccaggggcgctcggcgaatggccatccttggggatactgcatgggactttggaagtatcggtggcgtcttcaccagcgtggggaagctggtacatcagatttttggaacagcgtacggcgtgttgttctccggtgtttcttggacgatgaaaatcgggattggcatactcctgacctggttaggactgaatagccgctcaactagtctatccatgacatgtatcgctgtcggcatggtgaccctctacctgggggtgatggtccaggccgatagcggatgcgttattaactggaagggcagagagcttaaatgtggttctgggatctttgtgacaaacgaagtgcacacttggaccgagcaatataagttccaggcagactcaccgaagaggttgagtgccgctatcggaaaagcctgggaggaaggcgtatgcggtattcggagcgcaacgcgcctggagaatataatgtggaagcagatctccaacgaactcaatcatattctgttagagaacgatatgaaatttacagtcgtggttggcgacgctaatgggatcctggcccagggaaagaaaatgattagacctcaacccatggaacacaagtactcttggaaatcgtggggcaaggcgaagatcataggggccgacatccagaacaccactttcattatcgatggaccagacacccctgagtgtcccgatggccagagggcttggaatatttgggaggtggaagactatggttttggggtcttcacaactaacatctggcttaaattgcgtgatagctacacccagatgtgcgaccaccggctcatgtccgcagccataaaggattcaaaagctgtgcatgccgacatgggatattggattgagagtgaaaagaatgagacatggaaactggcacgagcgtctttcatcgaagttaagacgtgtacctggccaaagagccacactctatggtccaacggcgtgctggagtcagagatgattatccccaaaatatacggtggccctatcagccaacataattatagaccagggtactttacacagaccgccggaccgtggcacctcggcaagctggaacttgatttcgacttgtgcgaggggactacagtagtcgtggatgaacactgcggaaacaggggcccctctctgcgcaccacgactgtgaccggtaaaattatccatgagtggtgttgccggtcctgtacattacctccactcagatttaggggggaggacggatgctggtacggcatggaaattcgccccgtcaaggagaaagaagagaatctggttcgaagtatggtgagcgctggttctggcgaagtagattccttctcacttgggatcctgtgtgtgagtataatgattgaggaggtcatgcggagccgttggtcgagaaagatgttgatgaccggaactctcgccgtgtttctgctactgatcatgggccagctcacatggaacgacctgatcaggctttgcattatggttggggcaaatgcttccgaccgcatgggaatgggcaccacatatttggccctgatggcaactttcaagatgcggcctatgtttgccgtgggtttactcttcagaaggctgacctctcgagaagtccttctgctaacgatcgggctcagcctggtggcttcagttgagttgccaaacagtctggaagagttaggagatggcctcgcgatgggcattatgatgctgaaacttctgacagaatttcaaccccaccagttgtggaccactctcctgtccctaaccttcgtgaagacaactctgtctcttgactacgcctggaaaaccacggcaatggctctcagcatagtctccctgtttccgttgtgtctgtcaacaaccagccagaagactacatggttacctgtactcctggggagtttcggatgcaaaccacttaccatgtttctgatcactgagaacaagatttggggtcgcaagtcttggcccttgaatgagggcatcatggccattgggatcgtgtccatactcctgagctcgctactgaaaaacgatgttcctcttgccggacccctcatcgctggcggtatgctgattgcatgttatgtgatctcagggtctagtgccgacttgtccttagaaaaggcggctgaggtcagctgggaacaggaggccgaacattctggagcaagccactccattctggtggaggtacaagatgacggcacaatgaaaatcaaggatgaggaacgggacgataccctcacgatactgcttaaagccactctgttggctgtgtcaggcgtctacccaatgagtattcctgcaaccctattcgtttggtatttctggcagaagaaaaagcagagaagcggggtgctgtgggacacaccctctccaccggaggtggaaagggccgtcctcgataatggaatctaccgtatcctgcagcgcggtcttttaggccggtcccaagtgggggttggagtatttcaggacggcgtgttccataccatgtggcacgtcacaagaggtgcggtgctgatgtatcaggggaagaggctcgagccttcatgggctagtgttaaaaaggatttgattagctacggaggcggctggcgatttcaggggtcctggaacactggagaggaagtgcaagtcatagccgtggagcccggtaaaaatccaaagaacgtacagaccacgcccggcacattcaaaactcctgaaggggaggtcggagcaatcgccctggactttaagccaggcacctctggttcgcccattgtgaatcgggaagggaagatcgttggactctacggcaacggcgtggtcacaaccagcgggacttatgtgtcagctattgcccaggcaaaagcttcccaagagggacctctgccggagatcgaagacgaggttttcaagaaacgcaatcttaccataatggatctgcacccaggtagtggcaagacaagaaggtacttgcccgccatcgtgcgggaagcgattaaacgaaagctaagaacgctgatcctcgcccctactcgcgtcgtggcatctgagatggctgaagccttaaaggggatgccaattaggtatcagaccacagctgtaaaaagcgagcataccggacgtgagatcgtggacctgatgtgccacgcaacttttacaatgcggcttctgtcccccgttagagtccctaactacaatatgataattatggatgaagcccatttcaccgacccggcctcaatcgctgcgaggggctatatctctacgcgcgtgggtatgggggaggcagccgctatttttatgactgccacacccccaggaagcgtggaagcattccctcagagtaacgccgtcatccaggatgaggaacgagacatacccgagagatcctggaatagcggctacgattggattaccgactttccaggcaagaccgtatggttcgtgccttctatcaaatcagggaacgatattgctaattgtctccggaagaacggaaaaagggttatccaattgtcccgcaagactttcgacacagagtatcagaagaccaaaaacagtgattgggactacgtggtcacaactgacataagcgaaatgggtgcgaattttcgtgccgatagagtgattgacccccggaggtgcctgaagccagttatcctcaaagatggcccggagcgcgtgatcctggcagggcctatgcccgtcacggctgcctcggcagcccagcgaagaggacggattggcaggaaccagaataaggaaggtgaccaatacgtgtatatggggcagccacttaacaatgatgaggaccacgctcattggaccgaggccaaaatgctactggataacatcaatacacccgaaggcattatacctgcgttgttcgagccagaacgcgagaagtctgcagccatcgacggagaatacagattaaggggcgaggctcggaagacttttgtagagctgatgcgtcgcggggatctccccgtgtggctgtcctataaagttgccagcgaaggattccagtactcagaccgaagatggtgctttgatggtgagaggaacaatcaggtccttgaagagaacatggacgtggaaatttggaccaaggagggcgagcggaaaaagctgcgccctagatggctcgatgctaggacatatagtgacccgttggcactgcgggaattcaaagagtttgccgctgggcgaagatctgtgtccggagacctaatcctggaaatcggcaagctcccacaacaccttaccctgcgcgcccagaatgcattagataacttggtcatgctgcacaatagcgagcagggtgggaaagcgtacaggcatgccatggaagagctccccgacactattgagacgctgatgcttctggctctcatagccgttttgaccggcggagtgacactgttctttttatcaggcaaggggctaggaaagactagtatcggtctgctctgtgtaaccgcaagctccgctcttctgtggatggcctctgtggaacctcactggattgcagccagcatcattttggagttctttctgatggtcctcctgatccccgaaccagatcggcagcgtacacctcaagacaaccagcttgcttatgtggttataggcctcctgttcatgatcttgaccgtggcggccaatgagatggggctgttagagactacaaaaaaggatctaggaattggctacgtcgcagctgaaaaccatcagcacgtaacgatgctggacgtggatctccaccccgcctccgcctggaccctttacgcagttgctactacagtgatcaccccaatgatgagacataccattgagaacgccacagcgaatatctcactgactgctatagccaaccaagcagccattttgatgggtctggacaaagggtggcctatctctaagatggatattggcgtcccgctcctggctcttggatgctatagtcaggtgaatcccttaacgctgaccgcagccgtcctcatgttggtggcgcactacgctatcataggcccagggctgcaggccaaagcaacaagggaagcccagaagcgcactgctgccggaatcatgaagaaccctaccgttgacggcattgtggcaatcgatctagaccccgtagtgtatgatgctaaatttgagaagcaactgggtcagattatgctccttatcctgtgtacatcgcagatattgctgatgcggaccacttgggccctctgcgaaagcattacgctggcgacagggccattaaccactctttgggagggatcccctggcaaattctggaataccacaatcgccgtctctatggcaaacatcttccgaggttcatacctggctggcgccgggctcgcatttagcctaatgaagtccctgggaggcgggagaaggggaactggcgctcagggtgagaccttgggggaaaaatggaagcgccaactgaatcagctcagtaagtctgagttcaacacatataaacggagcggaattatggaagttgacagatcagaggccaaggaaggccttaaacgtggtgagacgaccaagcatgccgtgtccaggggcactgcgaaactgcggtggtttgtcgagcgcaatttggtgaagcccgaagggaaggtaatcgacctgggatgtggccgagggggatggagttactattgcgctggcctcaaaaaggtgacagaggttaaaggttacaccaaggggggaccgggccacgaagagccaatacctatggcaacttacggctggaacttagtgaaactgcatagcgggaaggatgtcttctttatgcccccagaaaaatgtgacacacttctgtgcgatattggagagtcttcccccaatcctaccgtggaggaaggtagaacgctaagggtcctcaagatggtggagccgtggctgcggggcaaccagttctgtatcaagattttgaatccctatatgccatcagttgtagaaaccctggagcgcatgcagagaaaacacgggggaatgctcgtgaggaaccctcttagccgaaattcgacacacgagatgtactgggtctcttgcggcactggtaacatcgtgagtgccgttaatatgacctcccggatgctgttaaaccgttttacaatggctcatagaaagcccacttatgaacgcgacgtggatctgggggccggaaccaggcacgtcgcagtggagcctgaagtagccaacttggacataatcggccaacggattgagaatatcaaaaacgaacataagagcacatggcactacgatgaggacaatccatataaaacctgggcttaccacggctcatatgaggtgaagccctccgggtctgcgagcagtatggttaacggagtcgtgagactcctgactaagccttgggatgtgattccaatggtcacgcagatcgccatgacagacaccactcccttcggtcagcaacgcgtttttaaagaaaaggtggataccaggacaccgcgagcaaaacggggcacgacccagattatggaggtaactgctaagtggctatgggggttcctttccagaaataaaaagcctaggatctgtacacgcgaagagtttacccgtaaggtgcggagcaacgccgcagtcggagccgtgttcgttgacgaaaatcagtggaactctgctaaagaggccgtggaggacgaaagattttgggatctggtccatagggagcgcgaactccacaagcagggcaaatgcgcgacttgcgtgtacaatatgatgggtaagcgagagaaaaagctgggggaattcggaaaggcaaaaggctcacgggccatatggtacatgtggttgggcgctagattcctggagtttgaggccctcgggttcatgaacgaagaccattggtttagtagggagaattcccttagcggagtagaaggtgagggcctgcacaagttagggtatattctgcgcgatatctctaaaatcccaggaggcaacatgtacgcagacgatacagctggttgggacaccagagttacagaggatgacttgcaaaatgaagccaagattactgatataatggagcccgaacatgctctcctggccacctcgatcttcaaactaacgtatcagaacaaggtggtccgggtgcagaggcctgcaaaaaatgggaccgtgatggacgtcatttcacgtcgagatcagcgcggaagcggccaagttggcacatacgggcttaacacttttaccaacatggaggtgcagctgatcagacagatggaatccgagggaattttcctcccaagtgagctggaaacacccaatttggcggagcgggccttagactggctggaaaagcacggtgctgagaggctcaagcgcatggccatctctggcgatgactgtgtagtgaaaccgatagacgatagatttgcaactgctcttaccgccctgaacgacatggggaaggtccggaaagatatccctcagtgggaacccagcaagggatggaatgactggcaacaggtgccattctgctcccaccattttcaccagctaattatgaaagatggcagggagatcgttgtgccttgtcgaaaccaggacgagctggtcggtcgtgcaagagtgtcacaaggggccggatggagtctccgcgaaacggcgtgcttgggcaagtcttatgctcagatgtggcagctgatgtacttccatcggagggatcttagactggccgcaaatgccatttgtagcgctgtacccgttgactgggtgccaacatcccgcaccacttggtcaatccacgcccaccatcaatggatgacaaccgaggatatgctcagcgtctggaaccgggtgtggatagaagagaatccctggatggaaaacaagactcacgtttcttcctgggaggaggtgccttatttaggcaaaagggaagaccagtggtgcgggagtctgattggattgaccgcacgagctacatgggccacgaatatccaggtcgcgatcaaccaggtgagacggctgattggtaatgagaactacctcgattacatgaccagcatgaagaggtttaaaaatgaatcggactccgagggcgctctttggtga

SEQ ID NO: 13462 - RNA, 9879 nt, synthetic construct
  misc_feature 1..9879: note = derived and/or modified CDS sequence (opt3) from DENV-1__JN819417__SS-prME
  source 1..9879: mol_type = other RNA
agcgtgaccatgctgctcatgcttctgcccaccgcattggctttccacttaactacgcggggcggggagcctcatatggtcgtttccaagcaggaaaggggaaaatctctgttatttaagacctcagccggtgtgaacatgtgcaccctcatcgcaatggacctgggcgagctttgtgaagatactatgacctacaaatgcccacggattacagaggcggaaccggacgatgtagactgttggtgcaatgctaccgatacttgggtgacatatgggacctgtagtcaaacgggagagcaccgccgagacaagcgtagcgtcgcactggcaccccatgtgggcttgggtctcgagactagaaccgaaacatggatgtcctctgagggggcctggaaacagatacagaaggttgaaacttgggctctgaggcaccctggattcaccgtgatcgcactgtttctcgcccatgctattggcacatcgatcacccagaagggcattatcttcatattactgatgcttgtcacgccatcaatggccatgcggtgcgtggggatcggaaaccgcgattttgtagagggtttgagcggcgcgacttgggttgacgtggtcctggagcacgggagttgtgtgacaaccatggccaagaataagcccactctagatattgaactcctgaaaacagaggtgaccaaccctgccatccttagaaagctgtgcattgaagctaaaatctccaatacgaccacagactctaggtgtccaactcaaggagaggccaccttggtcgaggaacaggatgcaaacttcgtttgccggcgcacatttgtggaccgaggctggggtaatgggtgtggactcttcggcaagggcagcctgttaacttgcgctaagtttaaatgcgtaaccaagctggaggggaaaatagtgcagcacgaaaacctcaagtactccgtcattgtgacagttcataccggagatcagcaccaagtgggtaatgagactacggaacatggcacaatcgccaccattactccccaggcgcctacctcagagatccagcttacagactatggggccctgaccttggactgtagtccaagaactggactagatttcaacgaaatggtcctgctcacaatgaaagaaaagagctggctggtgcacaaacagtggtttcttgacctgccgttgccctggacgtctggcgcatccacctcacacgagacttggaataggcaagatctcctggtaacattcaagaccgctcatgccaagaaacaggaagttgtggtcttaggtagccaggagggggctatgcacacagccctgactggcgcaaccgaaatccaaacgagtggaaccacaactatttttgccggccatctaaagtgccggctcaaaatggacaagctgacccttaaagggatgtcttacgtgatgtgtacaggatccttcaagttggagaaggaagtcgctgagactcagcacggtaccgtgctggttcaggtgaaatatgagggcacggatgcgccttgcaagataccattcagcacacaggacgaaaaaggggtaacccaaaacggacgtctcatcactgcaaatcccattgtcacagataaggagaaacctgtgaacatcgaaaccgagccaccctttggcgagtcgtacatagttgtgggtgccggggaaaaggctctgaaactttcttggttcaaaaagggctcctcaattggaaaaatgtttgaggccactgcacgcggcgccagaaggatggctatcctgggggacaccgcctgggatttcggaagtatcggtggcgtctttacaagcgtggggaagttggtacatcaggtgttcggaacggcatatggcgttctcttttccggtgtctcttggaccatgaaaattgggatcggcattctgttaacttggctgggactaaatagccggtcaacaagtctctccatgacctgtatagcggtgggcatggtgacactgtaccttggggtcatggttcaggctgacagcggatgcgtgatcaactggaagggccgagaattgaagtgtggttctgggattttcgtgactaacgaggtacacacctggacggaacagtacaaatttcaagccgattcaccgaagcgcctgagtgcagccatcggaaaggcttgggaggagggcgtctgcggtatcagaagcgccacaaggctcgaaaatattatgtggaagcagatatccaacgagctgaatcacatcttactggaaaacgacatgaaattcaccgtggttgtgggcgacgcatctgggattcttgctcagggaaagaaaatgatccggcctcagcccatggagcataagtattcgtggaaaagctggggcaaagccaagattatcggggcggatactcaaaataccacatttataatcgacggaccagatactcctgaatgtcccgacgatcagcgcgcctggaacatttgggaggtcgaggactacggcttcggtatctttaccacaaatatttggttgaaactcagagattcctatacgcagatgtgcgaccacaggctgatgtcagctgcaatcaaggatagtaaagccgtgcatgctgacatggggtactggatagaatctgagaagaacgaaacctggaagctagcccgtgccagcttcattgaggttaaaacttgtatctggccaaagtcccacacactgtggtcaaatggagtgctcgaaagcgagatgattatccccaaaatatatggcggtcctatctctcagcacaactaccggccaggctatttcacccaaactgcggggccgtggcatctgggaaaacttgagttggattttgacctgtgcgaaggcacaaccgtagtcgtggatgagcactgcgggaatcgaggaccctccttaagaacgactaccgtgacaggcaaaattatccatgaatggtgttgcaggagttgtaccctccctccactgcgcttccggggtgaggacgggtgctggtacggaatggagattagacccgtcaaggaaaaggaggaaaaccttgttaggagcatggtgtctgccggctccggtgaggtagactcatttagtctgggcatcttgtgtgtgagcataatgattgaagaggtcatgcgctcgcgatggtcccggaaaatgctcatgactgggacactggctgtgttcctactgctcatcatgggacagctgacctggaatgatcttatccgtttgtgcattatggttggcgccaacgcatctgacagaatggggatgggaacaacttacctggctttaatgggcacctttaagatgaggcctatgttcgccgtgggtctcctgtttcgccggcttacgagcagagaggtcctgctactcacaatcgggctgtcattggtggcaagtgttgaactgccaaattccttagaggaactcggagatggcctggccatgggcattatgatgcttaaactgttgaccgagttccagccccaccaactctggactaccctgctatctctgacatttataaagactacccttagcctcgactatgcttggaaaacgatggcgatggtgctgtccatcgtctcattgttcccgctgtgtttaagcacaaccagtcagaagactacatggctccctgtactgcttgggtcttttggatgcaagccactgaccatgttcttgattactgaaaacaaaatctggggtaggaagtcctggcccctcaacgagggcattatggccatcgggatagtgagcatcctgctatcgtcactgcttaaaaatgatgttcctctcgcaggacccctgattgctggcggtatgttgatcgcctgttacgtgatttctgggagttccgccgacttaagcctggagaaggctgcagaaatctcttgggaggaagaggccgaacatagcggaacatcccacaacatactcgtcgaggtgcaggatgacggcaccatgaaaattaaggatgaggaacgagacgatacgctgactatccttctgaaagcgaccttgctagctgtatcaggcgtgtatccaatgagtatccctgccacactgtttgtctggtacttctggcagaagaagaaacaacgcagcggggttctctgggacaccccctctccaccggaggtggaacgggcagtgctggatgacggaatttatagaatacttcagaggggtttactgggccgttcccaggtcggggtgggagttttccaggacggcgtatttcacacaatgtggcatgtgactcgcggtgccgtcctcatgtaccaagggaagcggttggagccttcatgggctagtgtgaaaaaggatctgatcagctatggaggcggctggagattccaggggtcctggaataccggagaggaagttcaggtgattgcagtcgagcccggtaaaaacccaaagaatgtgcagacgacacccggcacttttaagacccctgaaggggaggtaggagccatcgcgctcgacttcaaaccaggcacatctggttcgcccattgtcaacagggaagggaagatcgtgggactgtacggcaatggcgttgtgaccactagcgggacctacgtctcagctatagcccaagcaaaagcctcccaggagggacctcttccggagatcgaagatgaggtgtttaagaaacgaaacctgacaattatggacttgcacccaggtagtggcaagacgcggcgctatctacccgctatcgttagagaagccattaagaggaaactgcggactctcatcttagcacctacccgagtggtcgcttctgagatggccgaagcgctgaaggggatgccaataagataccagacaaccgccgtgaaaagcgagcatactggacgcgagattgtagatcttatgtgccacgcaacattcaccatgaggctgctctcccccgtgcgtgttcctaattataacatgatcatcatggacgaagctcattttacggatccggcctcaattgctgcacggggctacatctctactagagtcggtatgggggaggccgccgctatattcatgacagcgacacccccaggaagcgtggaagcatttcctcaaagtaatgccgtgattcaggacgaggaaagggatatccccgagcgctcctggaacagcggctatgactggattaccgatttcccaggcaagactatctggtttgtcccttctataaaatcagggaatgacattgctaactgtttgcgaaagaatggaaagagagtaatccagctgtcccggaaaacattcgacaccgagtaccagaagaccaagaataacgattgggactatgtggttactacggatatcagtgaaatgggtgccaatttcagggcagaccgcgtgattgatccccgtagatgcctcaagccagtcatcctgaaagacggcccggagcgggtgattcttgccgggcctatgcccgttaccgtggctagcgcggcccaaaggcgcggacgaataggcagaaaccagaataaggaaggtgatcagtacgtctacatggggcagccactaaacaatgacgaggatcacgcacactggacagaggctaagatgctgttggacaacatcaatactcccgaaggcattatccctgccttatttgagccagaacgggagaaatcggcagccatcgatggagaatataggctgcgcggcgaggctagaaagaccttcgtggagctcatgaggagaggggacctgcccgtatggctttcttacaaagtggcctccgaaggatttcaatatagcgatcgtcgctggtgcttcgacggtgagcgaaacaatcaggttctggaagagaacatggacgtcgaaatttggacaaaggagggcgagaggaagaagctcaggcctcggtggttggatgcgcgcacctactcagacccgctggcactaagagaatttaaagagttcgccgctgggaggcggagtatatctggagatctgatcctcgaaattggcaaacttccacagcatctgactttacgagcccagaatgctttggacaacctggtgatgctccacaattccgagcaaggtgggaaggcatatagacatgccatggaggaactgcccgatacgatcgagacccttatgctgctcgctttgattgccgtgctgacaggcggagtcactttatttttcctaagcggcaaagggctgggaaagacctcaatcggtctcctttgtgttatggcaagtagcgcgctgttgtggatggccaacgtggaacctcactggatagctgcctccatcattctggagtttttcctcatggtactgcttatccccgaaccagaccgccagaggacacctcaggataatcagctcgcatacgtggtcattggcctgttgtttatgatcctgaccgtggctgccaacgagatggggttactagagactaccaagaaggacctgggaataggccacgttgcagccgaaaaccatcaccatgctacgatgctcgatgtggaccttcggcccgcgtctgcctggaccctgtatgcagtcgctactacagtaattaccccaatgatgcgtcacaccatcgagaatacaactgccaacattagcttgacggccatcgcaaatcaagctgccatactgatgggtctcgataaagggtggcctatctccaagatggacattggcgtgccgctgcttgcgttaggatgctactcacaggttaaccccctgaccctcacagctgccgtgttgatgctggtcgcacattacgccatcattggcccagggctacaggctaaggcaactagagaagcccaaaagagaaccgcggctggaatcatgaagaatcctacagtggatggcatagtcgccattgacctggaccccgtggtttatgatgcaaaattcgagaagcagctcggtcagatcatgcttctgatcttgtgtacctctcagattctgctcatgcgcactacgtgggccctgtgcgaaagtatcacattagctaccgggccacttactaccctgtgggagggatcgcctggcaaattttggaacacaactatagccgtgagcatggcaaatattttccggggttcctacctcgctggcgccgggctagcgttctctctgatgaagtcattgggaggcgggcgaagaggaaccggcgcccaaggtgagacactgggggaaaagtggaaaaggcagctcaaccagcttagcaagtccgagtttaatacgtataaacgcagtggaatcatggaagtagaccggtctgaggcaaaggaaggcctgaaaagaggtgagaccactaagcacgctgtgagccgtggcacagccaagttgaggtggttcgtcgagcggaacctggttaaacccgaagggaaggtgattgatctcggatgtggccgcgggggatggtcatactattgcgcaggcctgaaaaaggtcaccgaggtgaaaggttacactaaagggggaccgggccacgaggagccaatccctatggctacatatggctggaatctagtaaaacttcattccgggaaggacgtgtttttcacacccccagaaaagtgtgatacgctgctatgcgacataggagagagtagccccaaccctaccatcgaggaaggtcgaacactcagagttctgaaaatggtggagccgtggttgaggggcaatcagttttgtattaagatcctgaacccctacatgccatctgtcgtggaaactctcgagcaaatgcagcggaaacacgggggaatgcttgtccgcaatcctctgtccagaaactcaacccatgagatgtactgggtgagctgcggcacaggtaatattgtttcggccgtaaacatgacttctaggatgttactgaaccgattcaccatggcccaccggaagcccacatatgaaaaagatgtggacttgggggcgggaacccgtcacgtcgctgtggagcctgaagttgcaaatctcgatatcattggccagagaatcgagaacataaagaatgaacataagagtacttggcactacgacgaggataacccatataaaacgtgggcctaccatggctcctatgaggtgaagcccagcgggtcagcttcctctatggtcaatggagtggtacgcctgctaacaaaaccttgggacgtgattccaatggttacccagatcgccatgactgacaccacaccctttggtcaacagagggtcttcaaggaaaaagtggatacgcggaccccgagagcaaagcgcggcactgcccagatcatggaggtgacagctaagtggctttgggggtttctgagcaggaacaaaaagcctcgaatttgtacccgggaagagttcactaaaaaggtcagaagtaatgcggccataggagcagtttttgtggacgaaaaccaatggaactccgctaaagaggccgtagaggatgaaaggttctgggacctcgtgcaccgcgagcgtgaactgcataagcagggcaagtgcgcaacatgcgtctacaacatgatgggtaaacgggagaagaaattgggggaatttggaaaggccaaaggcagcagagctatctggtatatgtggctgggcgccaggttcctcgagttcgaggcgcttgggtttatgaatgaagatcactggttctctcgcgagaactcactgagtggagtggaaggtgagggcttacacaagctggggtacattttgcgagacatctccaaaattccaggaggcaatatgtacgcagatgacaccgccggttgggatacacggatcactgaggacgatctccagaacgaagctaagataaccgacatcatggagcccgaacatgccctgctagcaacgagcatttttaaacttacctatcagaataaagttgtgagagtccaaaggcctgctaagaacgggaacgtgatggatgtaatctctcgcagagaccagcggggatcgggccaggttggcacatacgggctgaatactttcaccaacatggaggtgcagctcattaggcaaatggaatcagagggaatctttctgccaagcgagttggaaacacccaatttagccgagcgtgtcctggactggctcgaaaaacacggtgctgagcgacttaagcgcatggccatatccggcgatgactgtgtggtgaaaccgattgatgacagattcgcaactgcgctgatcgccctaaacgatatggggaaggtccggaaggacatccctcagtgggaacccagtaaaggatggaatgattggcagcaggttccattttgctctcatcacttccaccaactgattatgaaggacggcagggagatagtggtaccttgtcgcaaccaggatgagctcgtgggtagagctcgggtcagccagggggccggatggtccttgagggaaaccgcatgcctgggcaaatcatatgctcagatgtggcaacttatgtactttcatcgacgtgacctgagactcgccgcaaatgccatctgtagtgcggtgcccgttgattgggtgccaacgtctcgcacaacctggagcattcacgctcatcaccagtggatgactacagaggacatgttatccgtctggaaccgggtgtggatcgaagagaatccctggatggaagacaagacccatgtatcaagctgggaggaggttccttatctgggcaaaagggaagatcagtggtgcgggtctttgattggactgactgccagagcaacctgggccacaaacatccaagtggctataaatcaggtccgccggctcatcggtaacgagaattaccttgactatatgacgtccatgaagaggttcaagaacgaaagtgatccagagggcgccctgtggtga

SEQ ID NO: 13463 - RNA, 9879 nt, synthetic construct
  misc_feature 1..9879: note = derived and/or modified CDS sequence (opt3) from DENV-1__FJ687426__SS-prME
  source 1..9879: mol_type = other RNA
agcgtgacaatgctgctcatgcttatgcccacagcactggctttccacttgactacgcgaggaggggagcctcatatgatcgtctccaagcaggaaaggggaaaatctttactgtttaagacctcagccggtgttaacatgtgcacactgattgccatggacctcggagagctgtgtgaagatactatgacctacaaatgcccacggataacagaggcggaaccggacgatgtggactgttggtgcaatgctaccgatacttgggtaacatatgggacctgtagtcagacgggagagcaccgccgagacaagcgtagcgtggcccttgcaccccatgtcggactgggtttggagactagaaccgaaacatggatgtcctctgagggggcctggaaacagatccagagggtggaaacttgggctctccggcaccctggattcaccgttattgcactgtttctggcccatgctatcggcacatcgattacccagaagggcatcatattcatcctcttaatgctggtgacgccatcaatggccatgcgctgcgtcgggattggaagccgggattttgtggagggtcttagtggcgcgacttgggtagacgttgtgttggagcacgggtcctgtgtcacaaccatggcaaaggataaacccactctggacatcgaactgctcaagacagaggtgaccaaccctgccgtgctgaggaaactttgcattgaagctaagatctctaatacgaccacagatagccggtgtccaactcaaggagaggccaccctggtcgaagaacaggacgcaaacttcgtttgccgccgaacatttgtggatagaggctggggtaatgggtgtggattgttcggcaaaggctccctcctgacttgcgctaagtttaagtgcgtaaccaaattagaggggaagatagtgcagtacgaaaacctgaaatattcagtcattgtgacagttcacaccggagaccagcatcaagtgggtaatgagagtactgaacacggcacgacagccaccatcactccccaggcgcctaccacagagattcagctcaccgactacggggcccttactctggattgtagcccaaggacaggattggacttcaacgaaatggtcctactgacgatgaaggagaaatcttggctcgtgcataagcagtggtttctggatcttccgctgccctggacctccggcgcatcaactagccaagagacatggaatcggcaggacttgctcgtaaccttcaaaacagctcacgccaagaagcaggaagttgtggtcctgggtagtcaagagggggctatgcacactgccttaaccggcgcaacggaaatccagacctctggaacaactaccatctttgccggccatctgaaatgccgtctaaagatggataaactcacactgaaggggatgtcctatgtgatgtgtactggcagcttcaaacttgagaaggaagtcgctgagacccagcacggtacggtgttggttcagattaagtacgagggcacagacgcgccttgcaaaataccattctcgacccaagatgaaaagggggtgactcagaacggacgcctgatcacagcaaatcccattgtaaccgacaaagagaagcctgtcaacatcgaagccgagccaccctttggcgagtcttatatagtgattggtgctggggaaaaagccctcaagctgtcctggttcaagaaaggctcaagtatcggaaagatgtttgaggcaactgccagaggcgctaggcggatggccatccttggggataccgcatgggacttcggaagcattggtggcgtttttacatccgtggggaaactggtccatcagatcttcggaacggcgtacggcgtgttgttttctggtgtaagctggaccatgaagattgggataggcgtgctcctgacttggttaggactaaattcacgaagtacatccctaagcatgacctgtatcgctgttggcctcgtcacactgtaccttggggtgatggtgcaggccgattctggatgcgtcattaactggaaaggccgcgaattgaagtgtggttcagggatcttcgttactaatgaggtgcacacctggacggaacaatataagtttcaggcagacagtccgaaaagactgagcgccgctatcggaaaggcctgggaggagggcgtgtgcggtattaggtccgcaacacggctcgaaaacataatgtggaaacagatctctaacgagctgaatcatattttactggaaaacgacatgaagttcaccgtagtcgtgggcgatgttgctgggatccttgcccagggcaaaaagatgattcgccctcaacccatggagtacaaatattcgtggaaaagctggggcaaggcgaaaatcataggggccgacgtgcaaaattccacttttatcattgatggaccaaacacccctgaatgtcccgacgatcagagagcttggaatatctgggaggtcgaggactacggcttcggtatttttacaactaacatctggttgaagctcagggattcatatacccaggtgtgcgaccaccgtctgatgagtgcagccataaaagattctaaggctgttcacgccgacatggggtactggattgaaagcgagaaaaatgaaacatggaagctagcaggagcgtccttcatcgaggtgaagacgtgtatttggccaaaatcacataccctgtggagcaacggcgtactcgaatctgagatgatcatacccaagatctatggtggccctatttcccaacacaattaccggccagggtacttcactcagacagccggaccgtggcatctgggcaaacttgagttggattttgacctgtgcgaagggaccactgtcgtggtggatgagcactgcggaaaccgaggccccagtttaagaacaaccacggtcactggtaagatcattcacgaatggtgttgcaggagctgtaccctccctccactgcgcttcagaggggaagacggatgctggtatggcatggagatcagacccgttaaagaaaaggaggaaaatcttgtgaagtctatggtatccgctggttcaggcgaggtggacagttttagcctggggttgctctgtatatcgattatgatcgaagaggtcatgaggtcccgctggtctcgaaaaatgctgatgacaggaaccctagccgtgttctttctgctcatcatgggccagctgacttggaacgatcttattcggttgtgcatcatggttggggcaaatgctagcgaccgtatgggaatgggcacaacctacctggccttaatggcaacattcaagatgagacctatgtttgccgtgggtctcctgttcaggcgccttacttcacgggaggtcctgctactcaccattgggctgagtttggtggcttccgttgaactgccaaactctttagaggaactcggagatggcctggcgatgggcataatgatccttaaactgttgacggactttcaaagccatcagctctgggccacactgctatccctgaccttcattaagactaccctttcactccactatgcatggaaaacaatggctatggtgctgagcatcgtcagtttgtttcccctgtgtttatctactacctcccagaagacgacatggctcccggtactgcttgggagcctgggatgcaagcctttgaccatgttcctcattgccgagaataaaatctggggtagaaagtcgtggccactgaacgaaggcataatggccgtggggatcgtttcaattctactgtctagtcttctcaaaaacgatgtgcccctggctggacctttgatcgcaggcggtatgttaattgcctgttacgtcatctccgggagctctgcggacctgagcctcgagaaggctgccgaggtgtcctgggaagaggaagcagagcattcaggagccagtcacaatatactggtagaagtgcaggatgacggcactatgaaaattaaggatgaggagagggacgatacacttaccatcctgttgaaagctactctactggcagtcagcggcgtttatcccctctctatcccagccacactgtttgtgtggtacttctggcaaaagaagaaacagcgatccggggtgctttgggacaccccttcacccccagaagtcgagcgcgcggtgttagatgacggaatttatcggataatgcagagaggtctgctcggcaggagtcaggttggggtaggagtgttccaagaaaacgtctttcatacgatgtggcacgtgactcgtggcgctgttttgatgtaccagggtaagcgcctggagccgagctgggcctccgtgaaaaaggacctcatctcttacgggggaggctggcggctgcagggctcgtggaataccggggaggaagtccaggtgattgcagtagagcctggcaaaaatcccaagaatgtccaaacagccccaggtaccttcaagacacccgaaggcgaggtgggggctatcgcccttgattttaaacctggaactagcggctcaccaattgttaacagagaaggtaagatcgtggggctgtatggaaatggcgtcgtgaccacgtccggcacatacgttagtgcaatagctcaggccaaagcgtctcaggaggggcccttgcctgagatcgaagacgaggtgttcaggaagcgaaacctaactattatggatctgcacccgggaagcggtaaaacccggcgctatctcccagccatcgtcagagaagcaattaagaggaagttacggacactgatccttgctcccacccgagtggtagcctccgagatggctgaagcactgaaaggcatgcctataagataccaaactaccgccgtgaagtcagagcatacagggaaagagattgttgacctcatgtgccacgccacgtttactatgcgcttgctgtctccagtcagggtgcccaattataacatgatcatcatggatgaagctcatttcaccgaccctagcagtattgcggcacgtggatacatctccacacgggtgggcatgggtgaggccgctgccatatttatgaccgcaactccgcccgggagcgtcgaagccttcccacagtctaatgctgtaattcaggatgaggaaagagacatccctgagaggtcatggaactccggatatgagtggattacagattttcccggcaagaccgtgtggttcgttccaagtatcaaagcgggcaatgacatagccaactgtctccgcaagaatgggaagcgagtgattcagctgagcagaaaaacgtttgatactgaataccaaaagaccaaaaacaacgactgggactacgtcgtgaccaccgatatctcggagatgggagcaaatttccgggctgacagggttatcgatcctcgccgttgccttaagcccgtgattctaaaagacggtccagaaagagtcatcctggccggcccgatgcctgtgactgtagcatctgccgctcagcggagggggcgcattggacgaaaccacaataaggagggcgatcagtatatatacatgggtcagcccttgaacaatgacgaggatcatgcccactggacagaagcgaagatgttactggacaacatcaataccccagaggggattatccccgcactcttcgaacctgagagagaaaaatccgccgctatcgatggcgagtatcggctgaggggagaggcccgcaagacatttgtggaacttatgagaaggggcgacctgccagtttggctcagctacaaagtcgcttcagaggggttccaatatagtgatcggcgttggtgctttgacggagaacgcaacaatcaggtgttggaggaaaacatggatgtggagatttggactaaggagggtgaaagaaagaagctgagacccaggtggctagacgcacggacgtactctgaccctctggccctccgcgagttcaaagaatttgctgccggcagaaggtccgtcagcggggatcttatactggagatcggaaagttaccgcagcacttgacccagcgggcacaaaatgcgctggacaacctcgttatgctgcataattcagaacagggcggtcgagcctatagacacgctatggaggagcttccagatacaattgaaactctgatgctcttggccctgatcgcagtgttaaccgggggcgtaacactattctttctgagtggaaagggcctcgggaaaaccagcattggacttctgtgtgtgatggcttcctctgtcttgctgtggatggccagcgtggagccccattggatcgcagcctccataatcctcgagttctttctgatggttcttctcattcctgagcccgaccgccagaggactccacaggataaccaactggcttacgtggtcatcggtttgctgttcatgattttaacggtagcggccaatgagatgggcctactggaaaccacaaagaaagacctcgggatcggacacgtggcagttgagaaccaccatcacgctgccatgcttgatgtggacctgcatcctgcctcagcatggactttgtacgctgtcgccaccacaataattacccccatgatgcggcacactatcgaaaacacaacggcgaatatttctctgaccgctatcgccaaccaggcagccatactcatgggcctggataagggttggccaatcagtaaaatggacattggggtgcctcttttagctctgggctgctattcgcaggtcaatccgctcactttgacagcagccgtgctgatgctagttgcgcattacgctatcattggacccggcctgcaagccaaggcaacccgtgaggcccagaagagaaccgctgccgggatcatgaaaaacccaacaatagatggaattgtggcaatcgacctcgatcctgtagtgtatgacgctaagtttgaaaaacagcttggccagatcatgctgttgattctgtgtactagccaaatcctcctgatgaggacgacctgggccttatgcgagtccataacacttgcgactggtcccctgaccacactctgggaggggtctccaggaaagttctggaataccactattgccgtctcaatggcaaacatctttcgcggcagctacctagctggtgccggcctggcattctccttgatgaaaagtctagggggaggccggcgagggacgggagctcagggcgaaacactcggtgagaagtggaagagacagcttaatcagctgtctaaaagcgagttcaacacctataagaggtcagggattatggaagttgaccgctccgaagccaaagagggattgaagcggggcgagactaccaaacacgccgtgagtagaggtacagcgaagctgcgttggtttgtcgaaaggaatctcgtgaagcctgagggcaaagtaatcgatttagggtgtggacggggcgggtggagctactattgcgctggactgaagaaagtgactgaagttaagggctacaccaaaggtgggcccggacacgaggaaccgataccaatggcaacatacggctggaaccttgtgaagctgcattctggcaaagacgtcttctttatccctcccgagaagtgtgatacgctactctgcgacattggggagtcctcaccaaatcccaccatcgaagagggacgcactctgcgagtgttgaagatggtcgaaccttggctgagaggtaaccaattctgtattaaaatcctcaatccgtatatgcccagcgtggttgagacacttgagcagatgcagaggaagcacggcgggatgctggtacggaacccattatcgcgcaattctacccatgaaatgtactgggtgagttgcggaactggcaacattgtctccgccgtgaatatgacaagcagaatgctgttgaacaggtttaccatggctcaccgaaaacctacgtatgagcgggatgttgacctcggtgccgggacccgtcacgtggcagtcgaacccgaggtggccaacctggatatcataggacagagaattgaaaatatcaagcatgagcacaaatcaacatggcattacgacgaggataacccttataagacttgggcttaccacggctcctatgaagtaaagccatctggcagcgcgagttccatggtgaatggggttgtcaaactacttaccaagccctgggacgtgatccctatggtgacacaaattgccatgactgataccacaccattcggacagcagcgcgtctttaaagagaaggttgacaccaggactcccaaagcaaagcggggtacggctcaaataatggaagtgacagccaagtggctgtggggcttcctcagcagaaacaaaaagccgcgcatctgtaccagggaggaatttactcgaaaagtacggtctaatgcagccattggggctgtgttcgtcgacgagaaccagtggaactcagccaaggaggcggtggaagatgacagattttgggatctggttcatagggagcgcgaattgcacaaacagggaaagtgcgcaacctgcgtgtacaacatgatgggcaagcgtgagaaaaagctgggtgagttcgggaaagccaagggaagtcgggctatctggtacatgtggctcggcgccagatttcttgagttcgaggcactgggcttcatgaatgaagaccactggttttccagggagaacagcttatctggggtcgaaggagagggtctgcataaattgggctatattctccgcgatatctcgaagatacctgggggaaatatgtacgctgacgatacagccggctgggacacgcgaatcaccgaggatgacctgcagaacgaagctaaaattactgatatcatggagccagaacacgccctacttgcaaagtcaattttcaagctgacatatcaaaataaagtggtacgggttcagagacccgcgaagaacggtaccgtgatggacgtcatcagcaggcgcgatcagagagggtccggacaggtgggcacttacggcctcaatacatttaccaacatggaggcccaactgatacggcagatggaaagtgaggggattttctctcctaacgagttggaaacaccaaatttagctgagagggtgctggactggctcgaaaaatatggagtcgagcgtcttaagcgaatggccatcagcggtgacgattgtgttgtgaaacccatcgacgatcgctttgcaactgctctgaccgccctaaacgacatgggcaaggtaagaaaggatattccgcagtgggaaccttccaaagggtggaatgactggcagcaagtgcccttctgctcacatcactttcaccagctgataatgaaggatggacgggagatcgtcgtgccatgtaggaaccaggacgagctcgttggccgcgcaagagtgagtcagggtgccgggtggtctttgcgggaaacggcgtgcctgggaaaaagctacgctcaaatgtggcagcttatgtatttccataggcgagatctgcgtctcgccgcaaatgccatttgttccgctgtccctgtggactgggtacccacctcaagaacaacttggagcatccacgcccatcaccagtggatgaccacagaggatatgttatctgtttggaaccgcgtgtggattgaagagaatccatggatggaagacaagactcggatctccagttgggaggacgtcccctacctgggcaaaagggaggatcaatggtgcggcagcttgatagggctgaccgcaagagctacgtgggccacaaacatccaggtggcgattaatcaggttcgccggctcatcggaaacgaaaattactcggactatatgacctccatgaagaggtttaagaacgagtctgaacctgagggtgctctttggtga

SEQ ID NO: 13464 - RNA, 9879 nt, synthetic construct
  misc_feature 1..9879: note = derived and/or modified CDS sequence (opt3) from DENV-1__FJ687428__SS-prME
  source 1..9879: mol_type = other RNA
agcgtgacaatgctgctcatgcttatgcccacagcactggctttccacttgactacgcgaggaggggagcctcatatgatcgtctccaagcaggaaaggggaaaatctttactgtttaagacctcagccggtgttaacatgtgcacactgattgccatggacctcggagagctgtgtgaagatactatgacctacaaatgcccacggataacagaggcggaaccggacgatgtggactgttggtgcaatgctaccgatacttgggtaacatatgggacctgtagtcagacgggagagcaccgccgagacaagcgtagcgtggcccttgcaccccatgtcggactgggtttggagactagaaccgaaacatggatgtcctctgagggggcctggaaacagatccagagggtggaaacttgggctctccggcaccctggattcaccgttattgcactgtttctggcccatgctatcggcacatcgattacccagaagggcatcatattcatcctcttaatgctggtgacgccatcaatggccatgcgctgcgtcgggattggaagccgggattttgtggagggtcttagtggcgcgacttgggtagacgttgtgttggagcacgggtcctgtgtcacaaccatggcaaaggataaacccactctggacatcgaactgctcaagacagaggtgaccaaccctgccgtgctgaggaaactttgcattgaagctaagatctctaatacgaccacagatagccggtgtccaactcaaggagaggccaccctggtcgaggaacaggacgcaaacttcgtttgccgccgaacatttgtggatagaggctggggtaatgggtgtggattgttcggcaaaggctccctcctgacttgcgctaagtttaagtgcgtaaccaaattagaggggaagatagtgcagtacgaaaacctgaaatattcagtcattgtgacagttcacaccggagaccagcatcaagtgggtaatgagagtactgaacacggcacgacagccaccatcactccccaggcgcctaccacagagattcagctcaccgactacggggcccttactctggattgtagcccaaggacaggattggacttcaacgaaatggtcctactgacgatgaaggagaaatcttggctcgtgcataagcagtggtttctggatcttccgctgccctggacctccggcgcatcaactagccaagagacatggaatcggcaggacttgctcgtaaccttcaaaacagctcacgccaagaagcaggaagttgtggtcctgggtagtcaagagggggctatgcacactgccttaaccggcgcaacggaaatccagacctctggaacaactaccatctttgccggccatctgaaatgccgtctaaagatggataaactcacactgaaggggatgtcctatgtgatgtgtactggcagcttcaaacttgagaaggaagtcgctgagacccagcacggtacggtgttggttcagattaagtacgagggcacagacgcgccttgcaaaataccattctcgacccaagatgaaaagggggtgactcagaacggacgcctgatcacagcaaatcccattgtaaccgacaaagagaagcctgtcaacatcgaagccgagccaccctttggcgagtcttatatagtgattggtgctggggaaaaagccctcaagctgtcctggttcaagaaaggctcaagtatcggaaagatgtttgaggcaactgccagaggcgctaggcggatggccatccttggggataccgcatgggacttcggaagcattggtggcgtttttacatccgtggggaaactggtccatcagatcttcggaacggcgtacggcgtgttgttttctggtgtaagctggaccatgaagattgggataggcgtgctcctgacttggttaggactaaattcacgaagtacatccctaagcatgacctgtatcgctgttggcctcgtcacactgtaccttggggtgatggtgcaggccgattctggatgcgtcattaactggaaaggccgcgaattgaagtgtggttcagggatcttcgttactaatgaggtgcacacctggacggaacaatataagtttcaggcagacagtccgaaaagactgagcgccgctatcggaaaggcctgggaggagggcgtgtgcggtattaggtccgcaacacggctcgaaaacataatgtggaaacagatctctaacgagctgaatcatattttactggaaaacgacatgaagttcaccgtagtcgtgggcgatgttgctgggatccttgcccagggcaaaaagatgattcgccctcaacccatggagtacaaatattcgtggaaaagctggggcaaggcgaaaatcataggggccgacgtgcaaaattccacttttatcattgatggaccaaacacccctgaatgtcccgacgatcagagagcttggaatatctgggaggtcgaggactacggcttcggtatttttacaactaacatctggttgaagctcagggattcatatacccaggtgtgcgaccaccgtctgatgagtgcagccataaaagattctaaggctgttcacgccgacatggggtactggattgaaagcgagaaaaatgaaacatggaagctagcaggagcgtccttcatcgaggtgaagacgtgtatttggccaaaatcacataccctgtggagcaacggcgtactcgaatctgagatgatcatacccaagatctatggtggccctatttcccaacacaattaccggccagggtacttcactcagacagccggaccgtggcatctgggcaaacttgagttggattttgacctgtgcgaagggaccactgtcgtggtggatgagcactgcggaaaccgaggccccagtttaagaacaaccacggtcactggtaagatcattcacgaatggtgttgcaggagctgtaccctccctccactgcgcttcagaggggaagacggatgctggtatggcatggagatcagacccgttaaagaaaaggaggaaaatcttgtgaagtctatggtatccgctggttcaggcgaggtggacagttttagcctggggttgctctgtatatcgattatgatcgaagaggtcatgaggtcccgctggtctcgaaaaatgctgatgacaggaaccctagccgtgttctttctgctcatcatgggccagctgacttggaacgatcttattcggttgtgcatcatggttggggcaaatgctagcgaccgtatgggaatgggcacaacctacctggccttaatggcaacattcaagatgagacctatgtttgccgtgggtctcctgttcaggcgccttacttcacgggaggtcctgctactcaccattgggctgagtttggtggcttccgttgaactgccaaactctttagaggaactcggagatggcctggcgatgggcataatgatccttaaactgttgacggactttcaaagccatcagctctgggccacactgctatccctgaccttcattaagactaccctttcactccactatgcatggaaaacaatggctatggtgctgagcatcgtcagtttgtttcccctgtgtttatctactacctcccagaagacgacatggctcccggtactgcttgggagcctgggatgcaagcctttgaccatgttcctcattgccgagaataaaatctggggtagaaagtcgtggccactgaacgaaggcataatggccgtggggatcgtttcaattctactgtctagtcttctcaaaaacgatgtgcccctggctggacctttgatcgcaggcggtatgttaattgcctgttacgtcatctccgggagctctgcggacctgagcctcgagaaggctgccgaggtgtcctgggaagaggaagcagagcattcaggagccagtcacaatatactggtagaagtgcaggatgacggcactatgaaaattaaggatgaggagagggacgatacacttaccatcctgttgaaagctactctactggcagtcagcggcgtttatcccctctctatcccagccacactgtttgtgtggtacttctggcaaaagaagaaacagcgatccggggtgctttgggacaccccttcacccccagaagtcgagcgcgcggtgttagatgacggaatttatcggataatgcagagaggtctgctcggcaggagtcaggttggggtaggagtgttccaagaaaacgtctttcatacgatgtggcacgtgactcgtggcgctgttttgatgtaccagggtaagcgcctggagccgagctgggcctccgtgaaaaaggacctcatctcttacgggggaggctggcggctgcagggctcgtggaataccggggaggaagtccaggtgattgcagtagagcctggcaaaaaccccaagaatgtccaaacagccccaggtaccttcaagacacccgaaggcgaggtgggggctatcgcccttgattttaaacctggaactagcggctcaccaattgttaacagagaaggtaagatcgtggggctgtatggaaatggcgtcgtgaccacgtccggcacatacgttagtgcaatagctcaggccaaagcgtctcaggaggggcccttgcctgagatcgaagacgaggtgttcaggaagcgaaacctaactattatggatctgcacccgggaagcggtaaaacccggcgctatctcccagccatcgtcagagaagcaattaagaggaagttacggacactgatccttgctcccacccgagtggtagcctccgagatggctgaagcactgaaaggcatgcctataagataccaaactaccgccgtgaagtcagagcatacagggaaagagattgttgacctcatgtgccacgccacgtttactatgcgcttgctgtctccagtcagggtgcccaattataacatgatcatcatggatgaagctcatttcaccgaccctagcagtattgcggcacgtggatacatctccacacgggtgggcatgggtgaggccgctgccatatttatgaccgcaactccgcccgggagcgtcgaagccttcccacagtctaatgctgtaattcaggatgaggaaagagacatccctgagaggtcatggaactccggatatgagtggattacagattttcccggcaagaccgtgtggttcgttccaagtatcaaagcgggcaatgacatagccaactgtctccgcaagaatgggaagcgagtgattcagctgagcagaaaaacgtttgatactgaataccaaaagaccaaaaacaacgactgggactacgtcgtgaccaccgatatctcggagatgggagcaaatttccgggctgacagggttatcgatcctcgccgttgccttaagcccgtgattctaaaagacggtccagaaagagtcatcctggccggcccgatgcctgtgactgtagcatctgccgctcagcggagggggcgcattggacgaaaccacaataaggagggcgatcagtatatatacatgggtcagcccttgaacaatgacgaggatcatgcccactggacagaagcgaagatgttactggacaacatcaataccccagaggggattatccccgcactcttcgaacctgagagagaaaaatccgccgctatcgatggcgagtatcggctgaggggagaggcccgcaagacatttgtggaacttatgagaaggggcgacctgccagtttggctcagctacaaagtcgcttcagaggggttccaatatagtgatcggcgttggtgctttgacggagaacgcaacaatcaggtgttggaggaaaacatggatgtggagatttggactaaggagggtgaaagaaagaagctgagacccaggtggctagacgcacggacgtactctgaccctctggccctccgcgagttcaaagaatttgctgccggcagaaggtccgtcagcggggatcttatactggagatcggaaagttaccgcagcacttgacccagcgggcacaaaatgcgctggacaacctcgttatgctgcataattcagaacagggcggtcgagcctatagacacgctatggaggagcttccagatacaattgaaactctgatgctcttggccctgatcgcagtgttaaccgggggcgtaacactattctttctgagtggaaagggcctcgggaaaaccagcattggacttctgtgtgtgatggcttcctctgtcttgctgtggatggccagcgtggagccccattggatcgcagcctccataatcctcgagttctttctgatggttcttctcattcctgagcccgaccgccagaggactccacaggataaccaactggcttacgtggtcatcggtttgctgttcatgattttaacggtagcggccaatgagatgggcctactggaaaccacaaagaaagacctcgggatcggacacgtggcagttgagaaccaccatcacgctgccatgcttgatgtggacctgcatcctgcctcagcatggactttgtacgctgtcgccaccacaataattacccccatgatgcggcacactatcgaaaacacaacggcgaatatttctctgaccgctatcgccaaccaggcagccatactcatgggcctggataagggttggccaatcagtaaaatggacattggggtgcctcttttagctctgggctgctattcgcaggtcaatccgctcactttgacagcagccgtgctgatgctagttgcgcattacgctatcattggacccggcctgcaagccaaggcaacccgtgaggcccagaagagaaccgctgccgggatcatgaaaaacccaacaatagatggaattgtggcaatcgacctcgatcctgtagtgtatgacgctaagtttgaaaaacagcttggccagatcatgctgttgattctgtgtactagccaaatcctcctgatgaggacgacctgggccttatgcgagtccataacacttgcgactggtcccctgaccacactctgggaggggtctccaggaaagttctggaataccactattgccgtctcaatggcaaacatctttcgcggcagctacctagctggtgccggcctggcattctccttgatgaaaagtctagggggaggccggcgagggacgggagctcagggcgaaacactcggtgagaagtggaagagacagcttaatcagctgtctaaaagcgagttcaacacctataagaggtcagggattatggaagttgaccgctccgaagccaaagagggattgaagcggggcgagactaccaaacacgccgtgagtagaggtacagcgaagctgcgttggtttgtcgaaaggaatctcgtgaagcctgagggcaaagtaatcgatttagggtgtggacggggcgggtggagctactattgcgctggactgaagaaagtgactgaagttaagggctacaccaaaggtgggcccggacacgaggaaccgataccaatggcaacatacggctggaaccttgtgaagctgcattctggcaaagacgtcttctttatccctcccgagaagtgtgatacgctactctgcgacattggggagtcctcaccaaatcccaccatcgaagagggacgcactctgcgagtgttgaagatggtcgaaccttggctgagaggtaaccaattctgtattaaaatcctcaatccgtatatgcccagcgtggttgagacacttgagcagatgcagaggaagcacggcgggatgctggtacggaacccattatcgcgcaattctacccatgaaatgtactgggtgagttgcggaactggcaacattgtctccgccgtgaatatgacaagcagaatgctgttgaacaggtttaccatggctcaccgaaaacctacgtatgagcgggatgttgacctcggtgccgggacccgtcacgtggcagtcgaacccgaggtggccaacctggatatcataggacagagaattgaatcaatcaagcatgagcacaaatccacatggcattacgacgaggataatccttataagacttgggcttaccacggctcttatgaagtaaagccaagcggcagtgcgtccagcatggtgaacggggttgtcaaactacttaccaagccctgggacgtgatccctatggtgacacaaattgccatgactgataccacaccattcggacagcagcgcgtctttaaagagaaggttgacaccaggactcccaaagcaaagcggggtacggctcaaataatggaagtgacagccaagtggctgtggggcttcctctctagaaataaaaagccgcgcatctgtaccagggaggaatttactcgaaaagtacggtcaaacgcagccattggggctgtgttcgtcgacgagaatcagtggaacagtgccaaggaggcggtggaagatgacagattttgggatctggttcatagggagcgcgaattgcacaaacagggaaagtgcgcaacctgcgtgtacaatatgatgggcaagcgtgagaaaaagctgggtgagttcgggaaagccaagggatcccgggctatctggtacatgtggctcggcgccagatttcttgagttcgaggcactgggcttcatgaacgaagaccactggtttagcagggaaaattctttatcgggggtcgaaggagagggtctgcataaattgggctatattctccgcgatatctcaaagatacctgggggaaacatgtacgctgacgatacagccggctgggacacgcgaatcaccgaggatgacctgcagaatgaagctaaaattactgatatcatggagccagaacacgccctacttgcaaagagcattttcaagctgacatatcaaaacaaagtggtacgggttcagagacccgcgaagaatggtaccgtgatggacgtcatctccaggcgcgatcagagagggagtggacaggtgggcacttacggcctcaacacatttaccaatatggaggcccaactgatacggcagatggaatctgaggggattttcagccctaacgagttggaaacaccaaacttagctgagagggtgctggactggctcgaaaaatatggagtcgagcgtcttaagcgaatggccatctccggtgacgattgtgttgtgaaacccatcgacgatcgctttgcaactgctctgaccgccctaaatgacatgggcaaggtaagaaaggatattccgcagtgggaaccttcaaaagggtggaacgactggcagcaagtgcccttctgcagtcatcactttcaccagctgataatgaaggatggacgggagatcgtcgtgccatgtaggaatcaggacgagctcgttggccgcgcaagagtgtctcagggtgccgggtggagcttgcgggaaacggcgtgcctgggaaaatcctacgctcaaatgtggcagcttatgtatttccataggcgagatctgcgtctcgccgcaaacgccatttgttcagctgtccctgtggactgggtacccaccagcagaacaacttggtctatccacgcccatcaccagtggatgaccacagaggatatgttatccgtttggaatcgcgtgtggattgaagagaacccatggatggaagacaagactcggatcagtagctgggaggacgtcccctacctgggcaaaagggaggatcaatggtgcggctcgttgatagggctgaccgcaagagctacgtgggccacaaatatccaggtggcgattaaccaggttcgccggctcatcggaaatgaaaactactccgactatatgacctctatgaagaggtttaagaatgagtcagaacctgagggtgctctttggtga

SEQ ID NO: 13465 - RNA, 9879 nt, synthetic construct
  misc_feature 1..9879: note = derived and/or modified CDS sequence (opt3) from DENV-1__FJ687429__SS-prME
  source 1..9879: mol_type = other RNA
agcgtgacaatgctgctcatgcttatgcccacagcactggctttccacttgactacgagaggaggggaacctcatatgatcgtctccaagcaggaaagagggaaatctttactgtttaagacctcagccggtgttaacatgtgcacactgattgccatggacctcggagagctgtgtgaagatactatgacctacaaatgcccacggataacagaggcggaaccggacgatgtggactgttggtgcaatgctaccgatacttgggtaacatatgggacctgtagtcagacgggggagcaccgccgagacaagcgtagcgtggcccttgcaccccatgtcggcctgggtttggagactagaaccgaaacatggatgtcctctgagggggcctggaaacagatccagagggtggaaacttgggctctccggcaccctggattcaccgttattgcactgtttctggcccatgctatcggcacatcgattacccagaagggcatcatattcatcctcttaatgctggtgacgccatcaatggccatgcgctgcgtcgggattggaagcagagattttgtggagggtcttagtggcgcgacttggatcgacgttgttttggagcacgggtcctgtattacaaccatggcaaaggataaacccactctggacatcgaactactcaagacagaggtgaccaaccctgccgtcctgaggaaactttgcatagaagctaagatttctaatacgaccacagatagccggtgtccaactcaaggagaggccaccctggtggaagaacaggacgcaaacttcgtgtgccgccgaacatttgtcgatagaggctggggtaatgggtgtggattgttcggcaaaggctccctcctgacttgcgctaagtttaagtgcgttaccaaattagaggggaagatcgtgcagtacgaaaacctgaaatattcagtaattgtgacagtccacaccggagaccagcatcaagtgggtaatgagagtactgaacacggcacgacagccaccatcactccccaggcgcctaccacagagatccagctcaccgactacggggcccttactctggattgtagcccaaggacaggattggacttcaacgaaatggttctactgacgatgaaggagaaatcttggctcgtgcataagcagtggtttctggatcttccgctgccctggacctccggcgcatcaactagccaagagacatggaatcggcaggacttgctcgtcaccttcaaaacagctcacgccaagaagcaggaagtggtagttctgggtagtcaagagggggctatgcacactgccttaaccggcgcaacggaaattcagacctctggaacaactaccatatttgccggccatctgaaatgccgtctaaagatggataaactcacactgaaggggatgtcctatgtgatgtgtactggcagcttcaaacttgagaaggaagtcgctgagacccagcacggtacggtgttggtccagatcaagtacgagggcacagacgcgccttgcaaaattccattctcgacccaagatgaaaagggggtgactcagaacggacgcctgatcacagcaaatcccatagttaccgacaaagagaagcctgtgaacattgaagccgagccaccctttggcgagtcttatatcgtaatcggtgctggggaaaaagccctcaagctgtcctggttcaagaaaggctcaagtattggaaagatgtttgaggcaactgccagaggcgctaggcggatggccatccttggggataccgcatgggacttcggaagcattggtggcgtctttacatccgtggggaaactggttcatcagatattcggaacggcgtacggcgtgttgttttctggtgtcagctggaccatgaagatcgggattggcgtgctcctgacttggttaggactaaattcacgaagtacatccctaagcatgacctgtatcgctgtaggcctcgtgacactgtaccttggggttatggtccaggccgattctggatgcgtgatcaactggaaaggccgcgaattgaagtgtggttcagggattttcgtgactaatgaggtccacacctggacggaacaatataagtttcaggcagacagtccgaaaagactgagcgccgctataggaaaggcctgggaggagggcgtttgcggtatcaggtccgcaacacggctcgaaaacattatgtggaaacagatctctaacgagctgaatcatattttactggaaaacgacatgaagttcaccgtggtggtaggcgatgtcgctgggatccttgcccagggcaagaagatgatacgccctcaacccatggagtacaaatattcgtggaaaagctggggcaaggcgaagatcattggggccgacgtgcaaaattccacttttatcattgatggaccaaacacccctgaatgtcccgacgatcagagagcttggaatatctgggaggttgaggactacggcttcggtatatttacaactaacatttggttgaagctcagggattcatatacccaggtgtgcgaccaccgtctgatgagtgcagccatcaaagattctaaggctgtccacgccgacatggggtactggattgaaagcgagaaaaatgaaacatggaagctagcacgggcgtccttcatcgaggtgaagacgtgtatatggccaaaatcacataccctgtggagcaacggagttctcgaatctgagatgatcattcccaagatctatggcggtcctatttcccaacacaattaccgaccaggctacttcactcagacagccgggccgtggcatctgggaaaacttgagttggattttgacctgtgcgaaggcaccactgtggtagtcgatgagcactgcgggaacagaggacccagtttaaggacaaccacggtgactggcaagatcatacacgaatggtgttgccgcagctgtaccctccctccactgcggttcagaggtgaggacgggtgctggtatggaatggagattaggcccgtgaaagaaaaggaggaaaatcttgtcaagtctatggtttccgctggctcaggtgaggtggacagttttagcctgggcttgctctgtatctcgatcatgattgaagaggtaatgcgctcccgatggtctcggaaaatgctgatgacagggaccctagccgtgttctttctgctcatcatgggacagctgacttggaacgatcttattcgtttgtgcataatggtcggcgcaaatgctagcgacagaatggggatgggaacaacctacctggccttaatggcaacattcaagatgaggcctatgtttgccgtgggcctcctgttccgccggcttacttcaagagaggttctgctactcaccatcggtctgagtttggtggcttccgtcgaactgccaaactctttagaggaactcggggatggactggcgatgggcattatgatccttaaactgttgacggactttcaaagccatcagctctgggccacactgctatccctgaccttcattaagactaccttttcacttcactatgcatggaaaacaatggctatggtgctcagcatcgttagtctgttccccttgtgtctgtctactacctcccagaagacgacatggttaccggtgctcctgggcagccttgggtgcaagcctctgaccatgtttttgatagccgagaataaaatctggggaaggaagtcgtggccactcaacgaaggtattatggccgtcggcatcgtatcaattctgctatctagtctgcttaaaaacgatgtgcccctcgctgggcctctgatcgcaggaggcatgttgatagcctgttacgttatttccggtagctctgcggacttaagcctggagaaggctgccgaggtgtcctgggaagaggaagcagagcattcaggggccagtcacaatatcctcgtcgaagtgcaggatgacggaactatgaaaatcaaggatgaggagcgagacgatacactgaccattcttctgaaagctactttgctagcagtaagcggcgtgtatcccctgtctataccagccacactcttcgtctggtacttctggcaaaagaagaaacagcgctccggcgttctgtgggacaccccttcacccccagaagtggagcgggcggtgcttgatgacgggatctatagaattatgcagaggggattactgggtcgtagtcaggtcggcgtgggggtttttcaagaaaacgtattccatacgatgtggcacgtgactcgcggagctgtcctcatgtaccagggcaagcggttggagccgagctgggcctccgtgaaaaaggacctgatctcttacggtgggggatggagactccagggctcgtggaataccggcgaggaagttcaggtgattgcagtcgagcctgggaaaaaccccaagaatgtgcaaacagccccaggaacctttaagacacccgaaggtgaggtaggcgctatcgccctggatttcaaacctgggactagcggatcaccaatagtcaacagggaaggcaagatcgtgggtctttatgggaatggagttgtgaccacgtccggcacatacgtcagtgcaattgctcaggccaaagcgtctcaggagggccccctgcctgagatcgaagacgaggtgtttcgaaagcggaacttgactattatggatctacacccggggagcggaaaaacccgcagatatctgccagccatcgttagggaagcaataaagcggaagctccgaacattaattctggctcccaccagagtggtcgcctccgagatggctgaagcacttaaaggtatgcctatccgctaccaaactaccgccgtgaagtcagagcatacaggcaaagagatcgtagacctgatgtgccacgccacgttcactatgaggctcttgtctccagtgcgtgttcccaattataacatgattatcatggatgaagctcattttaccgaccctagcagtatagcggcacgggggtacatttccacaagagtcggaatgggcgaggccgctgccatcttcatgaccgcaactccgcccggtagcgtggaagcctttccacagtctaatgctgtgattcaggatgaggaaagggacatccctgagcgctcatggaactccgggtatgagtggataacagatttccccggaaagaccgtctggtttgtaccaagtattaaagcgggcaatgacatcgccaactgtctgcgaaagaatggcaagagagtgatccagctcagccggaaaacgttcgatactgaataccaaaagaccaagaataacgactgggactacgttgtgaccaccgatatttcggagatgggggcaaatttcagggctgaccgcgtcatcgatcctcgtagatgcctgaagcccgtgattcttaaagacggaccagaacgggttatactagccggtccgatgcctgtgactgtcgcatctgccgctcagaggcgcggccgaatcgggagaaaccacaataaggagggagatcagtatatttacatgggccagcccctgaacaatgacgaggatcatgcccactggacagaagcgaagatgttgttagacaacatcaataccccagagggtatcattcccgcactgtttgaacctgagcgggaaaaatccgccgctatagatggggagtataggctccgcggcgaggccagaaagacattcgtggaactgatgaggcggggagaccttccagtatggctgagctacaaagtggcttcagagggctttcaatatagtgatcgtcgctggtgcttcgacggggaacgaaacaatcaggttctcgaggaaaacatggatgtcgagatctggactaaggagggagaaaggaaaaagttgaggccccggtggctggacgcacgcacgtactctgaccctctagccctgagagagtttaaagagttcgctgccggtaggcggtccgtgagcggcgatctcattcttgagatcgggaagctgccgcagcacttaacccagcgagcacaaaatgcgttggacaacctggtgatgctccataattcagaacagggaggcagagcctatcgccacgctatggaggagctgccagatacaattgaaactcttatgctgctcgccttgatcgcagtcctgaccggtggggttacattatttttcctaagtggcaagggactgggcaaaaccagcatagggctcctttgtgtgatggcttcctctgtactgttgtggatggccagcgtggagccccattggatcgcagcctccattatcctggaatttttcctcatggtcctgcttattcctgagcccgacaggcagcggactccacaggataaccaactcgcttacgtggttatcggactgttgtttatgatactgacggtggcggccaatgagatgggtttactagaaaccacaaagaaagacctgggcattgggcacgtcgcagtagagaaccaccatcacgctgccatgctcgatgtggaccttcatcctgcctcagcatggactctgtacgctgttgccaccacaatcattacccccatgatgcgtcacactatcgaaaacacaacggcgaatatatctttgaccgctatcgccaaccaggcagccattctgatgggactcgataagggctggccaatcagtaaaatggacattggtgtgcctctgcttgctttagggtgctattcgcaggtcaatccgctgactctcacagcagccgtgttgatgctggtcgcgcattacgctatcataggccccggactacaagccaaggcaaccagagaggcccagaagaggaccgctgccggcattatgaaaaacccaacaatcgatgggatcgtggcaattgacctggatcctgttgtgtatgacgctaagttcgaaaaacagctcggacagatcatgcttctgatattgtgtactagccaaattctgctcatgcgcacgacctgggccctgtgcgagtccatcacattagcgactggcccccttaccacactgtgggagggttctccagggaagttttggaataccactattgccgtatcaatggcaaacatcttccggggaagctacctcgctggcgccggtctagcattctccctgatgaaaagtttgggcgggggacgaagaggcacgggggctcagggagaaacactgggcgagaagtggaagaggcagctcaatcagctttctaaaagcgaatttaacacctataagcgctcaggtataatggaggtggaccggtccgaagccaaagaggggctgaagagaggagagactaccaaacacgccgtcagtcgtggcacagcgaagttgaggtggttcgttgaacggaatctggtgaagcctgagggtaaagtcatcgatctcggctgtgggcgcggaggctggagctactattgcgctgggttaaagaaagtgactgaagtaaagggatacaccaaaggcggtcccgggcacgaggaaccgattccaatggcaacatacggatggaacctggtgaaacttcattctggcaaagacgtatttttcatccctcccgagaagtgtgatacgctgctatgcgacattggcgagtcctcaccaaatcccaccatcgaagaggggcgaactctcagagtgctgaagatggtcgaaccttggttgaggggaaaccaattttgtattaaaatcctgaatccgtatatgcccagcgtggtcgagacactcgagcagatgcagcggaagcacggtggcatgcttgtgcgcaacccactgtcgagaaattctacccatgaaatgtactgggttagttgcgggactggaaacatagtatccgccgtgaatatgacaagcaggatgttactgaaccgattcaccatggctcaccggaaacctacgtatgagcgtgatgtcgacttgggcgccggtaccagacacgtggcagttgaacccgaggtggccaacctcgatattatcgggcagcgcatcgaaaatattaagcatgagcacaaatcaacatggcattacgacgaggataacccttataagacttgggcttaccacggatcctatgaagtcaagccatctggcagcgcgagttccatggtgaatggcgtagtgaaactgctaaccaagccctgggacgttatacctatggtcacacaaatcgccatgactgataccacaccatttgggcagcagagggtgttcaaagagaaggtggacacccggactcccaaagcaaagagaggaacggctcaaattatggaagtcacagcccgctggctttggggttttctgagcaggaacaagaaaccgcgaatctgtacccgggaggagttcactagaaaggttaggtctaatgcagccattggcgctgtgtttgtagacgagaaccagtggaactcagccaaagaggcggtggaagatgaccgcttctgggatctcgtccatcgtgagcgggaactgcacaagcaggggaaatgcgcaacctgcgtgtacaacatgatgggaaagagagagaagaaattgggcgaatttggtaaggccaaagggagtagggctatctggtacatgtggctgggagcccgcttcctcgagttcgaggcacttggctttatgaatgaagaccactggttctcccgagagaacagcctgtctggcgttgaaggggagggattacataagctgggttatatattgcgggatatctcgaaaattcctggcgggaatatgtacgctgacgatacagccggatgggacacgagaatcaccgaggatgacctccagaacgaagctaagattactgatatcatggagccagaacacgccctgctagcaaaatcaatatttaaacttacatatcaaaataaggtggtcagggtgcagcgccccgcgaaaaacggcaccgtaatggacgttattagcagacgggatcagaggggttccggacaggtgggaacttacggcctgaatacattcaccaacatggaggcccaactcatccgtcagatggaaagtgagggcatcttttctcctaacgagctggaaacaccaaatttggctgagcgagtcttagactggctggaaaagtatggggtggagcgcctcaaaagaatggccattagcggagacgattgtgtggtcaagcccatagacgatcggttcgcaactgctcttaccgccctgaacgacatgggtaaagttaggaaggatatcccgcagtgggaaccttccaagggctggaatgactggcagcaagtgcccttttgctcacatcacttccaccagctaattatgaaagatgggcgcgagatcgtagtgccatgtagaaaccaggacgagctggtcggacgggcaagggtgagtcagggcgccggttggtctctccgagaaacggcgtgcttgggaaagagctacgctcaaatgtggcagctgatgtattttcatcgtagagatcttcgcctggccgcaaatgccatttgttccgctgttcctgtggactgggtccccacctcacggacaacttggagcatccacgcccatcaccagtggatgaccacagaggatatgctctctgtgtggaacagggtatggatagaagagaatccatggatggaagacaaaactagaatctccagttgggaggacgttccctacttaggaaagcgcgaggatcaatggtgcggcagcctgattggcttgaccgcacgggctacgtgggccacaaacatccaggtggcgattaatcaggtcaggcgactgatcgggaacgaaaattactcggactatatgacctccatgaaaagattcaagaacgagtctgaacctgagggagctctctggtga

SEQ ID NO: 13466 - RNA, 9879 nt, synthetic construct
  misc_feature 1..9879: note = derived and/or modified CDS sequence (opt3) from DENV-1__FJ850068__SS-prME
  source 1..9879: mol_type = other RNA
agcgtgacaatgctgctcatgcttatgcccacagcactggctttccacttgactacgcgaggaggggagcctcatatgatcgtctccaagcaggaaaggggaaaatctttactgtttaagacctcagccggtgttaacatgtgcacattgattgccatggacctcggagagctgtgtgaagatactatgacctacaaatgcccacggattacagaggcggaaccggacgatgtggactgttggtgcaatgctaccgatacttgggtaacatatgggacctgtagtcagacgggagagcaccgccgagacaagcgtagcgtggcccttgcaccccatgtcggactgggtttggagactagaaccgaaacatggatgtcctctgagggggcctggaaacagatccagagggtggaaacttgggctctccggcaccctggattcaccgttattgcactgtttctggcccatgctatcggcacatcgattacccagaagggcatcatattcatcctcttaatgctggtgacgccatcaatggccatgcgctgcgtcgggattggaagccgggattttgtggagggtcttagtggcgcgacttgggtagacgttgtgttggagcacgggtcctgtgtcacaaccatggcaaaggataaacccactctggacatcgaactgctcaagacagaggtgaccaaccctgccgtgctgaggaaactttgcattgaagctaagatctctaatacgaccacagatagccggtgtccaactcaaggagaggccaccctggtcgaagaacaggacgcaaacttcgtttgccgccgaacatttgtggatagaggctggggtaatgggtgtggattgttcggcaaaggctccctcctgacttgcgctaagtttaagtgcgtaaccaaattagaggggaagatagtgcagtacgaaaacctgaaatattcagtcattgtgacagttcacaccggagaccagcatcaagtgggtaatgagagtactgaacacggcacgacagccaccatcactccccaggcgcctaccacagagattcagctcaccgactacggggcccttactctggattgtagcccaaggacaggattggacttcaacgaaatggtcctactgacgatgaaggagaaatcttggctcgtgcataagcagtggtttctggatcttccgctgccctggacctccggcgcatcaactagccaagagacatggaatcggcaggacttgctcgtaaccttcaaaacagctcacgccaagaagcaggaagttgtggtcctgggtagtcaagagggggctatgcacactgccttaaccggcgcaacggaaatccagacctctggaacaactaccatctttgccggccatctgaaatgccgtctaaagatggataaactcacactgaaggggatgtcctatgtgatgtgtactggcagcttcaaacttgagaaggaagtcgctgagacccagcacggtacggtgttggttcagattaagtacgagggcacagacgcgccttgcaaaataccattctcgacccaagatgaaaagggggtgactcagaacggacgcctgatcacagcaaatcccattgtaaccgacaaagagaagcctgtcaacatcgaagccgagccaccctttggcgagtcttatatagtgattggtgctggggaaaaagccctcaagctgtcctggttcaagaaaggctcaagtatcggaaagatgtttgaggcaactgccagaggcgctaggcggatggccatccttggggataccgcatgggacttcggaagcattggtggcgtttttacatccgtggggaaactggtccatcagatcttcggaacggcgtacggcgtgttgttttctggtgtaagctggaccatgaagattgggataggcgtgctcctgacttggttaggactaaattcacgaagtacatccctaagcatgacctgtatcgctgttggcctcgtcacactgtaccttggggtgatggtgcaggccgattctggatgcgtcattaactggaaaggccgcgaattgaagtgtggttcagggatcttcgttactaatgaggtgcacacctggacggaacaatataagtttcaggcagacagtccgaaaagactgagcgccgctatcggaaaggcctgggaggagggcgtgtgcggtattaggtccgcaacacggctcgaaaacataatgtggaaacagatctctaacgagctgaatcatattttactggaaaacgacatgaagttcaccgtagtcgtgggcgatgttgctgggatccttgcccagggcaagaagatgattcgccctcaacccatggagtacaaatattcgtggaaaagctggggcaaggcgaaaatcataggggccgacgtgcaaaattccacttttatcattgatggaccaaacacccctgaatgtcccgacgatcagagagcttggaatatctgggaggtcgaggactacggcttcggtatttttacaactaacatctggttgaagctcagggattcatatacccaggtgtgcgaccaccgtctgatgagtgcagccataaaagattctaaggctgttcacgccgacatggggtactggattgaaagcgagaaaaatgaaacatggaagctagcaggagcgtccttcatcgaggtgaagacgtgtatttggccaaaatcacataccctgtggagcaacggcgtactcgaatctgagatgatcatacccaagatctatggtggccctatttcccaacacaattaccggccagggtacttcactcagacagccggaccgtggcatctgggcaaacttgagttggattttgacctgtgcgaagggaccactgtcgtggtggatgagcactgcggaaaccgaggccccagtttaagaacaaccacggtcactggtaagatcattcacgaatggtgttgcaggagctgtaccctccctccactgcgcttcagaggggaagacggatgctggtatggcatggagatcagacccgttaaagaaaaggaggaaaatcttgtgaagtctatggtatccgctggttcaggcgaggtggacagttttagcctggggttgctctgtatatcgattatgatcgaagaggtcatgaggtcccgctggtctcgaaaaatgctgatgacaggaaccctagccgtgttctttctgctcatcatgggccagctgacttggaacgatcttattcggttgtgcatcatggttggggcaaatgctagcgaccgtatgggaatgggcacaacctacctggccttaatggcaacattcaagatgagacctatgtttgccgtgggtctcctgttcaggcgccttacttcacgggaggtcctgctactcaccattgggctgagtttggtggcttccgttgaactgccaaactctttagaggaactcggagatggcctggcgatgggcataatgatccttaaactgttgacggactttcaaagccatcagctctgggccacactgctatccctgaccttcattaagactaccttttcacttcactatgcatggaaaacaatggctatggtgctcagcatcgtcagtctgttccccttgtgtctgtctactacctcccagaagacgacatggttaccggtactcctggggagccttggatgcaagcctctgaccatgtttttgattgccgagaataaaatctggggtagaaagtcgtggccactcaacgaaggcataatggccgtggggatcgtttcaattctgctatctagtctgcttaaaaacgatgtgcccctcgctggacctctgatcgcaggcggtatgttgattgcctgttacgtcatctccgggagctctgcggacttaagcctggagaaggctgccgaggtgtcctgggaagaggaagcagagcattcaggagccagtcacaatatactcgtagaagtgcaggatgacggcactatgaaaattaaggatgaggagagggacgatacactgaccatccttctgaaagctactttgctagcagtcagcggcgtttatcccctgtctatcccagccacactcttcgtgtggtacttctggcaaaagaagaaacagcgatccggggtgctgtgggacaccccttcacccccagaagtcgagcgcgcggtgcttgatgacggaatttatcggataatgcagagaggtttactgggcaggagtcaggttggggtaggagtgtttcaagaaaacgtcttccatacgatgtggcacgtgactcgtggcgctgttctcatgtaccagggtaagcgcttggagccgagctgggcctccgtgaaaaaggacctgatctcttacgggggaggctggcggctccagggctcgtggaataccggggaggaagtccaggtgattgcagtagagcctggcaagaatcccaagaatgtccaaacagccccaggtacctttaagacacccgaaggcgaggtgggggctatcgccctggatttcaaacctggaactagcggctcaccaattgttaacagagaaggtaagatcgtggggctttatggaaatggcgtcgtgaccacgtccggcacatacgttagtgcaatagctcaggccaaagcgtctcaggaggggcccctgcctgagatcgaagacgaggtgtttaggaagcgaaacttgactattatggatctacacccgggaagcggtaaaacccggcgctatctgccagccatcgtcagagaagcaattaagaggaagctccggacattaatcctggctcccacccgagtggtagcctccgagatggctgaagcacttaaaggcatgcctataagataccaaactaccgccgtgaagtcagagcatacagggaaagagattgttgacctgatgtgccacgccacgttcactatgcgcctcttgtctccagtcagggtgcccaattataacatgatcatcatggatgaagctcattttaccgaccctagcagtattgcggcacgtggatacatctccacacgggtgggcatgggtgaggccgctgccatattcatgaccgcaactccgcccgggagcgtcgaagcctttccacagtctaatgctgtaattcaggatgaggaaagagacatccctgagaggtcatggaactccggatatgagtggattacagatttccccggcaagaccgtgtggtttgttccaagtatcaaagcgggcaatgacatagccaactgtctgcgcaagaatgggaagcgagtgattcagctcagcagaaaaacgttcgatactgaataccaaaagaccaaaaacaacgactgggactacgtcgtgaccaccgatatctcggagatgggagcaaatttccgggctgacagggttatcgatcctcgccgttgcctgaagcccgtgattcttaaagacggtccagaaagagtcatcctagccggcccgatgcctgtgactgtagcatctgccgctcagcggagggggcgcattggacgaaaccacaataaggagggcgatcagtatatatacatgggtcagcccctgaacaatgacgaggatcatgcccactggacagaagcgaagatgttgttagacaacatcaataccccagaggggattatccccgcactgtttgaacctgagagagaaaaatccgccgctatcgatggcgagtatcggctcaggggagaggcccgcaagacattcgtggaactgatgagaaggggcgaccttccagtttggctgagctacaaagtcgcttcagaggggtttcaatatagtgatcggcgttggtgcttcgacggagaacgcaacaatcaggtgctcgaggaaaacatggatgtggagatttggactaaggagggtgaaagaaagaagttgagacccaggtggctggacgcacggacgtactctgaccctctagccctgcgcgagtttaaagagttcgctgccggcagaaggtccgtcagcggggatctcatacttgagatcggaaagctgccgcagcacttaacccagcgggcacaaaatgcgttggacaacctggttatgctccataattcagaacagggcggtcgagcctatagacacgctatggaggagctgccagatacaattgaaactcttatgctgctcgccttgatcgcagtgctgaccgggggcgtaacattatttttcctaagtggaaagggcctggggaaaaccagcattggactcctttgtgtgatggcttcctctgtcctgttgtggatggccagcgtggagccccattggatcgcagcctccataatcctggaatttttcctcatggttctgcttattcctgagcccgaccgccagaggactccacaggataaccaactcgcttacgtggtcatcggtctgttgtttatgattctgacggtagcggccaatgagatgggcttactagaaaccacaaagaaagacctggggatcggacacgtggcagttgagaaccaccatcacgctgccatgctcgatgtggaccttcatcctgcctcagcatggactctgtacgctgtcgccaccacaataattacccccatgatgcggcacactatcgaaaacacaacggcgaatatttctttgaccgctatcgccaaccaggcagccatactgatgggcctcgataagggttggccaatcagtaaaatggacattggggtgcctctgcttgctttaggctgctattcgcaggtcaatccgctgactctcacagcagccgtgttgatgctggttgcgcattacgctatcattggacccggcctacaagccaaggcaacccgtgaggcccagaagagaaccgctgccgggatcatgaaaaacccaacaatagatggaattgtggcaatcgacctggatcctgtagtgtatgacgctaagttcgaaaaacagctcggccagatcatgcttctgattttgtgtactagccaaatcctgctcatgaggacgacctgggccctgtgcgagtccataacattagcgactggtccccttaccacactgtgggaggggtctccaggaaagttttggaataccactattgccgtctcaatggcaaacatcttccgcggcagctacctcgctggtgccggcctagcattctccctgatgaaaagtctagggggaggccggcgagggacgggagctcagggcgaaacactgggtgagaagtggaagagacagctcaatcagctttctaaaagcgaatttaacacctataagaggtcagggattatggaggttgaccgctccgaagccaaagagggactgaagcggggcgagactaccaaacacgccgtgagtagaggtacagcgaagttgcgttggttcgtcgaaaggaatctggtgaagcctgagggcaaagtaatcgatctcgggtgtggacggggcgggtggagctactattgcgctggattaaagaaagtgactgaagttaagggctacaccaaaggtgggcccggacacgaggaaccgataccaatggcaacatacggctggaacctggtgaaacttcattctggcaaagacgtctttttcatccctcccgagaagtgtgatacgctgctatgcgacattggggagtcctcaccaaatcccaccatcgaagagggacgcactctccgagtgctgaagatggtcgaaccttggttgagaggtaaccaattttgtattaaaatcctgaatccgtatatgcccagcgtggttgagacactcgagcagatgcagaggaagcacggcgggatgcttgtacggaacccactgtcgcgcaattctacccatgaaatgtactgggtgagttgcggaactggcaacattgtctccgccgtgaatatgacaagcagaatgttactgaacaggttcaccatggctcaccgaaaacctacgtatgagcgggatgttgacttgggtgccgggacccgtcacgtggcagtcgaacccgaggtggccaacctcgatatcataggacagagaattgaaaatatcaagcatgagcacaaatcaacatggcattacgacgaggataacccttataagacttgggcttaccacggctcctatgaagtaaagccatctggcagcgcgagttccatggtgaatggggttgtcaaactgctaaccaagccctgggacgtgatccctatggtgacacaaattgccatgactgataccacaccatttggacagcagcgcgtcttcaaagagaaggttgacaccaggactcccaaagcaaagcggggtacggctcaaataatggaagtgacagccagatggctttggggctttctgagccgcaacaagaaaccgaggatctgtacccgagaggagttcactcggaaggtaagatctaatgcagccattggggctgtgtttgtcgacgagaaccagtggaactcagccaaagaggcggtggaagatgacaggttctgggatctcgttcatcgcgagcgtgaactgcacaagcagggaaaatgcgcaacctgcgtgtacaacatgatgggcaagcgggagaagaaattgggtgaatttgggaaggccaaaggaagtagagctatctggtacatgtggctgggcgccaggttcctcgagttcgaggcacttggctttatgaatgaagaccactggttctcccgcgagaacagcctgtctggggtcgaaggagagggtttacataagctgggctatattttgcgagatatctcgaaaatacctgggggaaatatgtacgctgacgatacagccggctgggacacgcggatcaccgaggatgacctccagaacgaagctaagattactgatatcatggagccagaacacgccctgctagcaaaatcaatttttaaacttacatatcaaaataaggtggtaagagttcagaggcccgcgaaaaacggtaccgtgatggacgtcatcagccgcagagatcagcgggggtccggacaggtgggcacttacggcctgaatacattcaccaacatggaggcccaactcataaggcagatggaaagtgaggggatattttctcctaacgagctggaaacaccaaatttggctgagcgtgtgttagactggctggaaaagtatggagtcgagcgactcaaacgcatggccatcagcggtgacgattgtgttgtgaagcccatcgacgatagattcgcaactgctcttaccgccctgaacgacatgggcaaagtacggaaggatattccgcagtgggaaccttccaaggggtggaatgactggcagcaagtgcccttttgctcacatcacttccaccagctaataatgaaagatggaagggagatcgtcgtgccatgtcgcaaccaggacgagctggttggcagagcacgggtgagtcagggtgccgggtggtctctcagggaaacggcgtgcttgggaaagagctacgctcaaatgtggcagctgatgtattttcatcgacgtgatcttagactggccgcaaatgccatttgttccgctgtccctgtggactgggtacccacctcacgcacaacttggagcatccacgcccatcaccagtggatgaccacagaggatatgctctctgtttggaaccgggtgtggattgaagagaatccatggatggaagacaaaactaggatctccagttgggaggacgtcccctacttaggcaagagagaggatcaatggtgcggcagcctgatagggttgaccgcacgcgctacgtgggccacaaacatccaggtggcgattaatcaggttcggaggctgatcggaaacgaaaattactcggactatatgacctccatgaaacgattcaagaacgagtctgaacctgagggtgctctctggtga

SEQ ID NO: 13467 - RNA, 9879 nt, synthetic construct
  misc_feature 1..9879: note = derived and/or modified CDS sequence (opt3) from DENV-1__FJ687430__SS-prME
  source 1..9879: mol_type = other RNA
agcgtgaccatgctgctcatgcttatgcccacagccctggctttccacttgactacgagaggcggggaacctcatatgatcgtctccaagcaggaaaggggaaaatctttactgtttaagacctcaacaggtgttaacatgtgcactttaattgccatggacctcggcgaactgtgtgaagataccatgacatacaaatgcccacggataaccgaggccgaaccggacgatgtggactgttggtgcaatgcgactgatacatgggtaacctatgggacgtgtagtcaaactggagagcaccgccgagacaagcgtagcgtggctcttgcaccccatgtcggcctgggtttggagaccagaacagaaacttggatgtcctctgagggggcatggaaacagatccagaaggtggaaacctgggccctcaggcaccctggattcacagttattgctctgtttctggcacatgccatcggcacctcgattacgcagaagggcatcatattcatcctcttaatgctggtgactccatcaatggctatgcggtgcgtcgggattggaagccgcgattttgtggagggtcttagtggcgccacatgggtagacgttgtgttggagcacgggtcctgtgtcaccactatggcgaaagataagcccacactggacatcgaactactcaaaaccgaggtgacgaaccctgcagtgctgagaaaactttgcattgaagccaaaatctctaataccacaactgattccaggtgtccaacccaaggagaggctacactggtcgaagaacaggacgccaacttcgtttgccggcgcacttttgtggatcgaggctggggtaatgggtgtggattgttcggcaagggcagcctcataacctgcgcaaagtttaaatgcgtaacaaagctggaggggaaaattgtgcagtacgaaaacttaaagtattcagtcatcgtgaccgttcacactggagaccagcatcaagtgggtaatgagagtacggaacacggcacaaccgctactattacaccccaagcccctaccaccgagatccagctgactgactacggggcgctcacacttgattgtagcccaagaacgggactggacttcaacgaaatggtcttgctaaccatgaaagagaagtcttggctggtgcataaacagtggtttctcgatctgccgcttccctggacttccggcgcctcaacaagccaagagacctggaataggcaggacctgttggtaacattcaagactgcacacgctaagaaacaggaagttgtggtcctcggtagtcaagagggggccatgcacaccgctctgacgggcgccaccgaaatccagacatctggaactaccacaatttttgcaggccatttaaagtgccggctgaaaatggataagctaactctcaaagggatgtcctatgtgatgtgtaccgggtccttcaagctggagaaggaagtcgccgagacgcagcacggtacaatacttgtgcagatcaaatacgagggcaccgacgctccttgcaagattccattctcgactcaagatgaaaaaggggttacacagaacggacgtttgatcaccgcgaatcccatagtgactgacaaggagaaacctgtaaacattgaagcagagccaccctttggcgagtcttatatcgtcatcggtgccggggaaaaggctctgaagctctcctggttcaaaaagggctcaagtattggaaaaatgtttgaggccaccgcacgcggcgccagaaggatggctatcctgggggatacagcctgggacttcggaagcattggtggcgtgtttacgtccgttgggaaacttgtgcatcagatattcggaaccgcatacggcgtcctgttttctggtgtgagctggactatgaaaatcgggattggcgtattgctcacatggctgggattaaattcacggagtacctccctgagcatgacatgtatcgcggtgggcctagttactctctacctgggggtcatggtgcaggctgattctggatgcgtgatcaactggaagggccgagaacttaagtgtggttcagggattttcgtcaccaatgaggttcacacgtggacagaacaatataaatttcaggccgacagtccgaagcgcttgagcgcagccataggaaaggcttgggaggagggcgtgtgcggtatcagatccgccaccaggctggaaaacattatgtggaagcagatctctaacgagctcaatcatattctgttagaaaacgacatgaaattcactgtggtagtcggcgatgtggcagggatcctggctcagggaaagaaaatgatacggcctcaacccatggagtacaagtattcgtggaaaagctggggcaaggccaagatcattggggcggacgttcagaatgccacctttatcattgatggaccaaacacacctgaatgtcccgacgatcagcgcgcttggaatatctgggaggtggaggactacggcttcggtatatttactaccaacatttggcttaaattgagagattcctatacacaggtctgcgaccacaggctcatgtcagcagccatcaaggatagtaaagctgtgcacgccgacatggggtactggattgaatctgagaagaatgaaacgtggaagctggcacgtgcgagcttcatcgaggttaaaacctgtatatggccaaagtcccatactctatggtcaaacggagtgctggaaagcgagatgatcattcccaaaatctatggcggtcctatttctcaacacaattaccggccaggctacttcacacagaccgccgggccgtggcatctcggaaagctggagcttgattttgacttgtgcgaaggcactacagtagtcgtggatgagcactgcgggaaccgaggaccctccctgagaaccacgactgtgaccggcaaaatcatacacgaatggtgttgcaggagttgtacattacctccactccgcttccggggtgaggacgggtgctggtatggaatggagattagacccgtcaaggaaaaggaggaaaatctggttaaaagcatggtgtctgctggctccggtgaggtagactcatttagtcttggcctgttgtgtatcagcatcatgattgaagaggtgatgaggtcgcgctggtcccgaaagatgctcatgaccgggactctggccgtcttctttctactgatcatgggacagctcacatggaacgatctgattcggctttgcataatggtgggcgcaaatgcttctgacaaaatggggatgggaaccacatacttggccctgatggcaactttcaagatgcgtcctatgtttgccgttggcttactcttcagaaggctgaccagccgcgaggtgcttctgctaacgatcggtctctcactggtcgctagtgtggaattgccaaactccctggaggaattaggggatggactcgcgatgggcattatgatcctgaaacttctgacagactttcaatctcatcagttgtgggccaccctcctgagcctaactttcattaagaccacattttccctgcactatgcatggaagactatggctatggttctttcaatcgtgagcctcttccccctgtgtttgagtaccacgtctcagaaaacaacctggctgccggtcttactcggctccctggggtgcaagcctcttactatgtttctgatagccgagaataaaatctggggaagaaagagctggccattgaacgaaggtattatggccgtaggcatcgtgtcgattctcctgtcatctctactgaaaaacgatgttccccttgctgggcctctcatcgcaggaggcatgctgatagcctgttacgtgattagtggttccagcgcggacttgtctttagagaaggctgccgaggtcagctgggaagaggaagcagagcattccggggcctcacacaatatcctggtggaagtacaggatgacggaacaatgaaaatcaaggatgaggagagagacgataccctcactattctgcttaaggctacactgttggcagtgagtggcgtctatcccctaagcataccagccaccctgttcgtttggtacttctggcagaagaagaaacagaggtctggcgtgctctgggacacgccttcacccccagaagtggagcgagcggtcctggatgacgggatctatcgcattatgcagcggggacttttaggtagaagccaggtgggcgttggggtatttcaagaaaacgtgttccatactatgtggcacgtcaccaggggagctgtgctgatgtaccagggcaagcgtctcgagccgagttgggccagcgttaaaaaggacttgatctcctacggtgggggatggcgcctgcagggctcttggaatacaggcgaggaagtgcaggtcattgcagtggagcctgggaagaaccccaaaaatgtacaaaccgccccaggaacatttaagactcccgaaggtgaggtcggcgctatcgccctcgatttcaaacctgggacctcgggaagcccaatagtgaaccgggaaggcaagatcgttggtctgtatgggaatggagtggtcacgacatcaggcacttacgtgtccgcaattgctcaggccaaagcgagtcaggagggcccccttcctgagatcgaagacgaggtttttagaaagaggaacctgaccattatggatttgcacccggggtctggaaagacacgacggtatctaccagccatcgtgcgcgaagcaataaaaagaaagctgaggaccctcattttagctcccactcgggtcgtggccagcgagatggctgaagcactgaaaggtatgcctatccgataccaaaccacagccgtaaagtccgagcatacgggcaaagagatcgtggaccttatgtgccacgccactttcaccatgagactgctctcaccagttcgcgtccccaattataacatgattatcatggatgaagctcattttacagacccttctagcatagcggcaagggggtacattagtacccgtgtgggaatgggcgaggccgctgccatcttcatgactgcaacaccgcccggttccgtggaagcctttccacagagcaatgctgtcattcaggatgaggaacgggacatccctgagagatcttggaactcagggtatgagtggataaccgatttccccggaaagacggtatggtttgtgccatccattaagagtggcaatgacatcgcgaactgtttgaggaaaaatggcaagcgcgttatccagctgagccgaaaaactttcgatacagaataccaaaagaccaaaaacaacgactgggactacgtggtcaccactgatatttcggagatgggggccaatttcagagcagaccgggtgatcgatcctaggcgctgcctcaagcccgttattctgaaggacggaccagaacgtgtgatacttgctggtccgatgcctgtcacagtggcctctgcagcccagagacggggcaggatcgggcgcaaccacaataaagagggagatcagtatatttacatgggccagcccctaaacaatgacgaggatcatgctcactggaccgaagccaagatgctgttggacaacatcaatacaccagagggtatcattcccgcgttatttgaacctgagcgagaaaaatccgcagccatagatggggagtatagactgcggggcgaggctaggaagactttcgtagaactcatgcgcagaggagacctgccagtgtggcttagctacaaagttgcctcagagggctttcaatatagtgataggcggtggtgcttcgacggggaacgtaacaatcaggtcctggaggaaaacatggatgtggagatctggacgaaggagggagaacgcaaaaagctccgacccagatggttggacgctaggacctactctgaccctctggcactacgggagtttaaggagttcgccgctggtcgcagatccgtgagcggcgatctgattctcgagatcgggaaacttccgcagcacctgacacagagggcccaaaatgcattagacaacttggtcatgctgcataattcagaacagggaggccgggcgtatcgacacgccctcgaggagctgccagatactattgaaacccttatgctgctcgctttgatcgccgttctgacaggtggggtgaccttatttttcctaagtggcagaggactgggcaagactagcatagggctcctttgtgtaatggcatcctctgtgctgttgtggatggctagcgtcgagccccattggatcgccgcatccattatcctggaatttttcctcatggtgctgcttattcctgagcccgaccgccagaggacgccacaggataaccaactcgcctacgttgtgatcggactgttgtttatgatactgaccgtcgctgcgaatgagatgggtttactagaaacaactaaaaaggacctgggcattgggcacgtagccgtggagaaccaccatcacgcatcaatgctcgatgttgaccttcatcctgcttctgcctggaccctgtacgccgtggcaacaaccatcattactcccatgatgcggcacacaatcgaaaacacgaccgctaatataagtttgactgccatcgcgaaccaggctgccattctgatgggactcgataaaggctggccaatctcgaagatggacattggtgtccctctgcttgcattagggtgctatagccaggtgaatccgctgacactcaccgccgctgtcttgatgctggtggcacattacgccatcataggccccggactacaagcgaaggctacccgtgaggcccagaaaagaacagcagccggcattatgaagaacccaactgttgatgggatcgtggctatcgacctggatcctgtagtgtatgacgccaaattcgaaaagcagctcggacagattatgcttctgatcttgtgtacgtcccaaatactgctcatgaggaccacatgggcactgtgcgagtctattactttagctaccggcccccttacaaccctgtgggagggttcaccagggaaattttggaatactacgatcgccgtcagcatggcgaacattttccgcggatcctacctcgccggcgcaggtctagctttcagtctgatgaagtctttgggcgggggacggcgaggcacaggggcccagggagaaaccctgggcgagaagtggaaaagacagctcaatcagcttagcaagtcagaatttaacacttataaaaggtccggtatcatggaggttgaccgcagtgaagcaaaggaggggctgaaacggggagagaccacaaagcacgctgtgagcagaggcactgccaagttgcgttggttcgtcgaaaggaatctggtgaaacctgagggtaaggtaatagatctcggctgtgggcggggaggctggtcttactattgcgccgggctaaagaaggtgaccgaagttaaaggatacacaaagggcggtcccgggcacgaggaaccgatcccaatggcgacgtacggatggaacctggtgaaacttcattccggcaaggacgtctttttcattcctcccgagaagtgtgataccctgctatgcgacatcggcgagtcaagcccaaatcccactattgaagaggggcgcacactccgagtgctgaaaatggtcgaaccttggttgagaggaaaccaattttgtatcaagattctgaatccgtatatgccctcggtggttgagaccctcgagcagatgcagaggaaacacggtggcatgcttgtacggaacccactgtctcgcaatagtactcatgaaatgtactgggtgtcctgcgggacaggaaacatcgtcagcgctgtgaatatgacctcaagaatgttactgaacaggttcacgatggcacaccgaaagcctacctatgagcgggatgttgacttgggcgccggtacacgtcacgtggctgtcgaacccgaggtggccaacctcgatataattgggcagagaatcgaaaatatcaaacatgagcacaagtccacttggcattacgacgaggataacccttataagacctgggcataccacggatcttatgaagtaaaaccaagcggcagtgcctccagcatggtgaatggcgttgtcaagctgctaacaaaaccctgggacgtgattcctatggtgactcaaaccgctatgacagataccactccatttgggcagcagcgcgtcttcaaggagaaagttgacacgaggacacccaaggcgaagcggggaaccgcccaaataatggaagtgactgcaagatggctttggggttttctgtctcgcaacaaaaagccgaggatctgtacccgagaggagttcacacggaaagtaagatcaaatgctgccattggcgcagtgtttgtcgacgagaaccagtggaatagtgccaaggaggctgtggaagatgagaggttctgggacctcgttcatcgcgaacgtgagctgcacaaacaggggaagtgcgccacgtgcgtgtacaacatgatgggaaagcgggagaaaaagttgggcgagtttggtaaagcgaaggggtccagagcaatctggtacatgtggctgggagccaggttcctcgagttcgaagctcttggctttatgaatgaggatcactggttcagccgcgaaaactctctgtcgggcgtcgagggggagggattacataaactgggttatattttgcgagacatctcaaagatacctggcgggaatatgtacgccgatgacaccgcaggatgggatactcggatcacagaagacgatctccagaacgaggctaaaattaccgacatcatggaaccagagcacgccctgctagctaagagcatttttaaacttacttatcaaaataaagtggtaagagttcagaggcccgccaagaacggcacagtgatggatgtcatctcccgcagagaccagcggggtagtggacaggtgggaacctacggcctgaatacattcactaacatggaagcacaactcataaggcagatggagtctgagggcatttttagcccttccgaactggagaccccaaacttggcggaacgtgtgttagattggctggagaaatatggggtcgaacgactcaagcgcatggccatctcaggagacgactgtgttgtgaaacccatcgatgacagattcgctacggcccttaccgcactgaatgatatgggtaaggtacggaaggacattccgcagtgggagcctagtaaaggctggaacgattggcagcaagtgcccttttgctctcatcacttccaccagctaataatgaaggacgggagggagatcgtcgtgccatgtcgcaatcaggatgaactggttggacgggctcgggtgagccagggcgccggttggtccctcagggagacagcatgcttggggaaatcatacgcccaaatgtggcagctgatgtattttcatcgacgtgaccttagactggcggctaacgccatttgtagcgcagtccctgtggattgggtacccacttctcgcaccacatggtccatccacgcccatcaccagtggatgactaccgaagacatgctcagtgtttggaatcgggtgtggattgaggaaaacccatggatggaggataagacgcatatcagctcgtgggaggacgtcccctacttaggaaaaagggaagaccaatggtgcggctccctgataggcttgacagctagagccacctgggcaactaatatccaggtggctattaaccaggttcgccggctgatcgggaatgagaactacctcgattatatgacatctatgaagaggttcaagaatgaatcagaccctgagggagccctttggtga

SEQ ID NO: 13468 - RNA, 9879 nt, synthetic construct
  misc_feature 1..9879: note = derived and/or modified CDS sequence (opt3) from DENV-1__FJ687432__SS-prME
  source 1..9879: mol_type = other RNA
agcgtgaccatgctgctcatgcttatgcccaccgccctggctttccacttgactacgagaggcggggaacctcatatgatcgtctccaagcaggaaaggggaaagtctttactgtttaagacctcaacaggtgttaacatgtgcactctaattgccatggacctcggcgagctgtgtgaagataccatgacatacaagtgcccacggataaccgaggccgaaccggacgatgtggactgttggtgcaatgcgactgatacatgggtaacctatgggacgtgtagtcaaactggagagcaccgccgagacaagcgtagcgtggctcttgcaccccatgtcggcctgggtttggagaccagaacagaaacttggatgtcctctgagggggcatggaagcagatccagaaggtggaaacctgggccctcaggcaccctggattcacagttattgctctgtttctggcacatgccatcggcacctcgattacgcagaagggcatcatattcatcctcttaatgctggtgactccatcaatggctatgcggtgcgtcgggattggaagccgcgattttgtggagggtcttagtggcgccacatgggtagacgttgtgttggagcacgggtcctgtgtcaccactatggcgaaggataagcccacactggacatcgaactactcaaaaccgaggtgacgaaccctgcagtgctgagaaaactttgcattgaagccaaaatctctaataccacaactgattccaggtgtccaacccaaggagaggctacactggtcgaagaacaagacgccaacttcgtttgccggcgcacttttgtggatcgaggctggggtaatgggtgtggattgttcggcaagggcagcctcataacctgcgcaaagtttaaatgcgtaacaaagctggaggggaaaattgtgcagtacgaaaacttaaagtattcagtcatcgtgaccgttcacactggagaccagcatcaagtgggtaatgagagtacggaacacggcacaaccgctactattacaccccaggcccctacaaccgagatccagctgactgactacggggcgctcacacttgattgtagcccaagaacgggactggacttcaacgaaatggtcttgctaaccatgaaagagaagtcttggctggtgcataaacagtggtttctcgatctgccgcttccctggacttccggcgcctcaacaagccaagagacctggaataggcaggacctgttggtaacattcaagactgcacacgctaagaaacaggaagttgtggtcctcggtagtcaagagggggccatgcacaccgctctgacgggcgccaccgaaatccagacatctggaactaccacaatttttgcaggccatttaaagtgccggctgaaaatggataagctaactctcaaagggatgtcctatgtgatgtgtaccgggtccttcaagctggagaaggaagtcgccgagacgcagcacggtacaatacttgtgcagatcaaatacgagggcaccgacgctccttgcaagattccattctcgactcaagatgaaaaaggggttacacagaacggacgtttgatcaccgcgaatcccatagtgactgacaaggagaaacctgtaaacattgaagcagagccaccctttggcgagtcttatatcgtcatcggtgccggggaaaaggctctgaagctctcctggttcaaaaagggctcaagtattggaaaaatgtttgaggccaccgcacgcggcgccagaaggatggctatcctgggggatacagcctgggacttcggaagcattggtggcgtgtttacgtccgttgggaaacttgtgcatcagatattcggaaccgcatacggcgtcctgttttctggtgtgagctggactatgaaaatcgggattggcgtattgctcacatggctgggattaaattcacggagtacctccctgagcatgacatgtatcgcggtgggcctagttactctctacctgggggtcatggtgcaggctgattctggatgcgtgatcaactggaagggccgagaacttaagtgtggttcagggattttcgtcaccaatgaggttcacacgtggacagaacaatataaatttcaggccgacagtccgaagcgcttgagcgcagccataggaaaggcttgggaggagggcgtgtgcggtatcagatccgccaccaggctggaaaacattatgtggaagcagatctctaacgagctcaatcatattctgttagaaaacgacatgaaattcactgtggtagtcggcgatgtggcagggatcctggctcagggaaagaaaatgatacggcctcaacccatggagtacaagtattcgtggaaaagctggggcaaggccaagatcattggggcggacgttcagaatgccacctttatcattgatggaccaaacacacctgaatgtcccgacgatcagcgcgcttggaatatctgggaggtggaggactacggcttcggtatatttactaccaacatttggcttaaattgagagattcctatacacaggtctgcgaccacaggctcatgtcagcagccatcaaggatagtaaagctgtgcacgccgacatggggtactggattgaatctgagaagaatgaaacgtggaagctggcacgtgcgagcttcatcgaggttaaaacctgtatatggccaaagtcccatactctatggtcaaacggagtgctggaaagcgagatgatcattcccaaaatctatggcggtcctatttctcaacacaattaccggccaggctacttcacacagaccgccgggccgtggcatctcggaaagctggagcttgattttgacttgtgcgaaggcactacagtagtcgtggatgagcactgcgggaaccgaggaccctccctgagaaccacgactgtgaccggcaaaatcatacacgaatggtgttgcaggagttgtacattacctccactccgcttccggggtgaggacgggtgctggtatggaatggagattagacccgtcaaggaaaaggaggaaaatctggttaaaagcatggtgtctgctggctccggtgaggtagactcatttagtcttggcctgttgtgtatcagcatcatgattgaagaggtgatgaggtcgcgctggtcccgaaagatgctcatgaccgggactctggccgtcttctttctactgatcatgggacagctcacatggaacgatctgattcggctttgcataatggtgggcgcaaatgcttctgaccgtatggggatgggaaccacatacttggccctgatggcaactttcaaaatgagacctatgtttgccgttggcttactcttcaggcgcctgaccagccgggaggtgcttctgctaacgatcggtctctcactggtcgctagtgtggaattgccaaactccctggaggaattaggggatggactcgcgatgggcattatgatcctgaaacttctgacagactttcaatctcatcagttgtgggccaccctcctgagcctaactttcattaaaaccacattttccctgcactatgcatggaagactatggctatggttctttcaatcgtgagcctcttccccctgtgtttgagtaccacgtctcagaagacaacctggctgccggtcttactcggctccctggggtgcaaacctcttactatgtttctgatagccgagaataagatctggggaagaaaaagctggccattgaacgaaggtattatggccgtaggcatcgtgtcgattctcctgtcatctctactgaagaacgatgttccccttgctgggcctctcatcgcaggaggcatgctgatagcctgttacgtgattagtggttccagcgcggacttgtctttagagaaagctgccgaggtcagctgggaagaggaagcagagcattccggggcctcacacaatatcctggtggaagtacaggatgacggaacaatgaagatcaaagatgaggagagggacgataccctcactattctgcttaaggctacactgttggcagtgagtggcgtctatcccctaagcataccagccaccctgttcgtttggtacttctggcaaaagaaaaagcagcgatctggcgtgctctgggacacgccttcacccccagaagtggagcgcgcggtcctggatgacgggatctatcggattatgcagagaggacttttaggtaggagccaggtgggcgttggggtatttcaagaaaacgtgttccatactatgtggcacgtcacccgtggagctgtgctgatgtaccagggcaaacgcctcgagccgagttgggccagcgttaagaaagacttgatctcctacggtgggggatggcggctgcagggctcttggaatacaggcgaggaagtgcaggtcattgcagtggagcctgggaagaaccccaagaatgtacaaaccgccccaggaacatttaaaactcccgaaggtgaggtcggcgctatcgccctcgatttcaagcctgggacctcgggaagcccaatagtgaacagagaaggcaaaatcgttggtctgtatgggaatggagtggtcacgacatcaggcacttacgtgtccgcaattgctcaggccaaggcgagtcaggagggcccccttcctgagatcgaagacgaggtttttaggaaacgaaacctgaccattatggatttgcacccggggtctggaaagacacggcgctatctaccagccatcgtgagagaagcaataaagaggaaactgcggaccctcattttagctcccactcgagtcgtggccagcgagatggctgaagcactgaagggtatgcctatcagataccaaaccacagccgtaaaatccgagcatacgggcaaggagatcgtggaccttatgtgccacgccactttcaccatgcgcctgctctcaccagttagggtccccaattataacatgattatcatggatgaagctcattttacagacccttctagcatagcggcacgtgggtacattagtacccgggtgggaatgggcgaggccgctgccatcttcatgactgcaacaccgcccggttccgtggaagcctttccacagagcaatgctgtcattcaggatgaggaaagagacatccctgagaggtcttggaactcagggtatgagtggataaccgatttccccggaaaaacggtatggtttgtgccatccattaagagtggcaatgacatcgcgaactgtttgcgcaagaatggcaaacgagttatccagctgagcagaaagactttcgatacagaataccagaagaccaagaacaacgactgggactacgtggtcaccactgatatttcggagatgggggccaatttccgggcagacagggtgatcgatcctcgccgttgcctcaaacccgttattctgaaggacggaccagaaagagtgatacttgctggtccgatgcctgtcacagtggcctctgcagcccagcggaggggccgcatcgggcgaaaccacaataaggagggagatcagtatatttacatgggccagcccctaaacaatgacgaggatcatgctcactggaccgaagccaaaatgctgttggacaacatcaatacaccagagggtatcattcccgcgttatttgaacctgagagagaaaagtccgcagccatagatggggagtatcggctgaggggcgaggctcgcaaaactttcgtagaactcatgagaaggggagacctgccagtgtggcttagctacaaggttgcctcagagggctttcaatatagtgatcggcgttggtgcttcgacggggaacgcaacaatcaggtcctggaggaaaacatggatgtggagatctggacgaaagagggagaacgaaagaaactcagacccaggtggttggacgctcggacctactctgaccctctggcactacgcgagtttaaggagttcgccgctggtagaaggtccgtgagcggcgatctgattctcgagatcgggaaacttccgcagcacctgacacagcgggcccaaaatgcattagacaacttggtcatgctgcataattcagaacagggaggccgagcgtatagacacgccctcgaggagctgccagatactattgaaacccttatgctgctcgctttgatcgccgttctgacaggtggggtgaccttatttttcctaagtggccgcggactgggcaaaactagcatagggctcctttgtgtaatggcatcctctgtgctgttgtggatggctagcgtcgagccccattggatcgccgcatccattatcctggaatttttcctcatggtgctgcttattcctgagcccgacaggcagcggacgccacaggataaccaactcgcctacgttgtgatcggactgttgtttatgatactgaccgtcgctgcgaatgagatgggtttactagaaacaactaagaaagacctgggcattgggcacgtagccgtggagaaccaccatcacgcatcaatgctcgatgttgaccttcatcctgcttctgcctggaccctgtacgccgtggcaacaaccatcattactcccatgatgcgtcacacaatcgaaaacacgaccgctaatataagtttgactgccatcgcgaaccaggctgccattctgatgggactcgataagggctggccaatctcgaaaatggacattggtgtccctctgcttgcattagggtgctatagccaggtgaatccgctgacactcaccgccgctgtcttgatgctggtggcacattacgccatcataggccccggactacaagcgaaggctaccagagaggcccagaagaggacagcagccggcattatgaaaaacccaactgttgatgggatcgtggctatcgacctggatcctgtagtgtatgacgccaagttcgaaaaacagctcggacagattatgcttctgatcttgtgtacgtcccaaatactgctcatgcgcaccacatgggcactgtgcgagtctattactttagctaccggcccccttacaaccctgtgggagggttcaccagggaagttttggaatactacgatcgccgtcagcatggcgaacattttccggggatcctacctcgccggcgcaggtctagctttcagtctgatgaaatctttgggcgggggacgaagaggcacaggggcccagggagaaaccctgggcgagaagtggaagaggcagctcaatcagcttagcaaatcagaatttaacacttataagcgctccggtatcatggaggttgaccggagtgaagcaaaagaggggctgaagagaggagagaccacaaaacacgctgtgagccgtggcactgccaagttgaggtggttcgtcgaacggaatctggtgaagcctgagggtaaagtaatagatctcggctgtgggcgcggaggctggtcttactattgcgccgggttaaagaaagtgaccgaagttaagggatacacaaaaggcggtcccgggcacgaggaaccgatcccaatggcgacgtacggatggaacctggtgaaacttcattccggcaaagacgtctttttcattcctcccgagaagtgtgataccctgctatgcgacatcggcgagtcaagcccaaatcccactattgaagaggggcgaacactcagagtgctgaagatggtcgaaccttggttgaggggaaaccaattttgtatcaaaattctgaatccgtatatgccctcggtggttgagaccctcgagcagatgcagcggaagcacggtggcatgcttgtacgcaacccactgtctagaaatagtactcatgaaatgtactgggtgtcctgcgggacaggaaacatcgtcagcgctgtgaatatgacctcaaggatgttactgaaccgattcacgatggcacaccggaaacctacctatgagcgtgatgttgacttgggcgccggtacaagacacgtggctgtcgaacccgaggtggccaacctcgatataattgggcagcgcatcgaaaatatcaagcatgagcacaaatccacttggcattacgacgaggataacccttataagacctgggcataccacggatcttatgaagtaaagccaagcggcagtgcctccagcatggtgaatggcgttgtcaaactgctaacaaagccctgggacgtgattcctatggtgactcaaaccgctatgacagataccactccatttgggcagcagagggtcttcaaagagaaggttgacacgcggacacccaaagcgaagagaggaaccgcccaaataatggaagtgactgcacgctggctttggggttttctgtctaggaacaagaaaccgcgaatctgtacccgggaggagttcacaagaaaggtaaggtcaaatgctgccattggcgcagtgtttgtcgacgagaaccagtggaatagtgccaaagaggctgtggaagatgagcgcttctgggacctcgttcatcgtgaacgggagctgcacaagcaggggaaatgcgccacgtgcgtgtacaacatgatgggaaagagagaaaagaaattgggcgagtttggtaaggcgaaagggtccagggcaatctggtacatgtggctgggagcccgcttcctcgagttcgaagctcttggctttatgaatgaggatcactggttcagccgagaaaactctctgtcgggcgtcgagggggagggattacataagctgggttatattttgcgggacatctcaaaaatacctggcgggaatatgtacgccgatgacaccgcaggatgggatactagaatcacagaagacgatctccagaacgaggctaagattaccgacatcatggaaccagagcacgccctgctagctaaaagcatttttaaacttacttatcaaaataaggtggtaagggttcagcgccccgccaaaaacggcacagtgatggatgtcatctccagacgggaccagaggggtagtggacaggtgggaacctacggcctgaatacattcactaacatggaagcacaactcatacgtcagatggagtctgagggcatttttagcccttccgaactggagaccccaaacttggcggaacgagtgttagattggctggagaagtatggggtcgaacgcctcaaaagaatggccatctcaggagacgactgtgttgtgaagcccatcgatgaccggttcgctacggcccttaccgcactgaatgatatgggtaaagtaaggaaggacattccgcagtgggagcctagtaagggctggaacgattggcagcaagtgcccttttgctctcatcacttccaccagctaataatgaaagacgggcgcgagatcgtcgtgccatgtagaaatcaggatgaactggttggacgggctagggtgagccagggcgccggttggtccctccgagagacagcatgcttggggaagtcatacgcccaaatgtggcagctgatgtattttcatcgtagagaccttcgcctggcggctaacgccatttgtagcgcagtccctgtggattgggtacccacttctcggaccacatggtccatccacgcccatcaccagtggatgactaccgaagacatgctcagtgtttggaatagggtgtggattgaggaaaacccatggatggaggataaaacgcatatcagctcgtgggaggacgtcccctacttaggaaagagagaagaccaatggtgcggctccctgataggcttgacagctcgcgccacctgggcaactaatatccaggtggctattaaccaggttcggaggctgatcgggaatgagaactacctcgattatatgacatctatgaaacgattcaagaatgaatcagaccctgagggagccctttggtga

SEQ ID NO: 13469 - RNA, 9879 nt, synthetic construct
  misc_feature 1..9879: note = derived and/or modified CDS sequence (opt3) from DENV-1__JQ922547__SS-prME
  source 1..9879: mol_type = other RNA
agcgtgaccatgctgctcatgcttctgcccacagccttggctttccacttaactacgagaggcggggagcctcatatgatcgtctccaagcaggaaaggggaaaatctctgctatttaagacctcagcaggtgttaacatgtgcacactcattgccatggacctgggcgagctttgtgaagatactatgacctacaaatgcccacggataacagaggcggaaccggacgatgtggactgttggtgcaatgctaccgatacttgggtaacatatgggacctgtagtcaaacgggagagcaccgccgagacaagcgtagcgtggccctggcaccccatgtcggcttgggtctcgagactagagccgaaacctggatgtcctctgagggggcttggaaacagatccagaaggtggaaacatgggcactgaggcaccctggattcactgttattgccctgtttctcgctcatgccatcggcacctcgattacacagaagggcatcatattcatcttactgatgcttgtgaccccatcaatggcgatgcggtgcgtcgggattggaaaccgcgattttgtggagggtttgagcggcgcaccctgggtagacgttgtgctggagcacgggagttgtgtcacgactatggccaaaaataagcctacactagatatcgaactcctgaaaaccgaggtgactaacccagctgtgcttagaaagctgtgcattgaagccaaaatctccaatacaaccacggactctaggtgtcccacccaaggagaggcaacattggtcgaagagcaggatgctaactgcgtttgtcggcgcactttcgtggaccgaggctggggtaatgggtgcggactctttggcaagggcagcctgataacctgcgccaagttcaaatgtgtaacaaagttagaggggaaaattgtgcagtacgaaaacctgaagtattccgtcatcgtgactgttcacaccggagatcagcatcaagtgggtaatgagacaaccactcacggcacgacagcgaccattactcctcaggccccaacctcagaaatccagctcacagactacggggcacttaccctggactgcagtccgagaactggattggattttaacgagatggtcctactgacaatgaaagaaaagagctggctcgtgcataaacagtggttcctggaccttcccctgccttggacgtctggcgcttccacctcacaagagacttggaataggcaggatttgctcgtaacatttaagaccgcccacgctaagaaacaggaggttgtggtcctgggtagccaagaaggggccatgcacacagcattaactggcgccaccgagatccagacgagtggaaccacaactattttcgctggccatctgaagtgtcggctaaaaatggacaagctcaccctgaaagggatgtcttatgtgatgtgcacaggatcctttaagcttgaaaaggaggtcgcggaaactcagcacggtaccgtgttggttcaggtgaaatacgagggcacggatgcaccatgtaagatacccttcagcacacaagacgagaaaggggccacccagaacggacgtctgatcactgctaatcctattgtaacagataaggaaaaaccagtcaacatcgaggccgaacccccgttcggcgagtcgtatatagtggttggtgcaggggagaaggccctcaagctgtcttggtttaaaaagggctcctcaattggaaaaatgcttgaagctaccgcccgcggcgcaagaaggatggcgatcctgggggacactgcttgggatttcggaagtatcggtggcgtgtttaccagcatggggaagttggtccatcaggtgttcggaacagcctacggcgtactcttttccggtgtgtcttggacgatgaaaattgggatcggcattctgttaacctggctgggactaaatagccggaacacttcactcagtatgatgtgcatagcagttggcatggtcacactgtaccttggggtgatggtgcaggccgactccggatgtgtcatcaactggaagggccgagagttgctgtgcggtaccgggattttcgttacaaatgaagtgcacacttggaccgatccttataagtttcaagctgaccccagcaaccgcctctctccaatcatcggaaaagcctgtgtgattagagtatgcggcataaggtcagcaacgcggctggagaatatcatgtggaagcagattagtaacgaattaaatcatatcctgcttgagaacgacatgaaattcacagtcgtggttggtgatgtgagcggcattttggctcagggggagaagatgatccgccctcagcccatggaacacaaatactcctggaagtcttggggaaaagccaagataatcggcgcggacgtccaaaataccacttttattatcgatgggccaaacacccccgagtgtcctgacaatcagagagcctggaacatttgggaagtggaggattatggattcggcatctttacaactaatatatggctcaagctgagggactcgtacacccaggtttgcgatcaccgtctaatgagcgctgcaattaaagactccaaggccgtgcatgctgatatgggttattggatcgaatcagagaaaaacgagacatggaagctggcccgggcaagtttcattgaagtaaaaacgtgcacctggccaaagtctcacactctctggagcaatggggtcctggagtccgaaatgatcataccgaagatctacggaggccccatttcacagcataactatcgacctggttactttacacaaaccgcgggcccatggcaccttgggaaattggagctggacttcgatttctgtgaaggaactacagtggtggtcgacgagcactgcggcaatagagggcccagcttaaggaccacgactgttaccggaaagatcattcatgagtggtgttgccgctcttgtacactccctccactgcggtttaaaggcgaagatggttgctggtacgggatggagatcagacccgtgaaggacaaagaagagaaccttgtaaagtccatggtgagtgccggaagcggcgaggtcgactctttctccctgggtttgctctgtatatcaattatgatcgaagaggtgatgaggagtcgctggagcaagaaaatgctgatggttggcaccctagctgtgtttctgctcctgatcatggggcagcttacttggtcggatttgattcgactgtgcatcatggtcggagccaacgcatccgaccggatgggcatggggacaacctatttagctctcatggccacattcaagatgcgtccgatgtttgcagtgggactgcttttccctaaactgacttctagagaagttctactcctgaccattggcttgagcctggtggcctcagtcgagttaccaagttccctcgaagagctgggtgatgggcttgctaagggaataatgatgctgaaattgctcacggactttcagtctcaccaactgtgggcgacactactgagccttaccttcatcaagactaccttttccctccattacgcctggaagacaatggcaatggtactgtcaattgtgagcttgttccccctgtgtttaagtactacctctcagaaaacgacatggctccctgttctgcttggctccctgggctgcaagcccttgccaatgtttctcatcaccgagaataaaatttgggggaggaagagctggcctctgaacgaaggaatcatggctgtgggtatagtctcgatcctactgtcatctcttctcaaaaatgatgtgcccctggccggcccattgattgccgggggaatgttagtagcttgttatgtgatcagtggctccagcgcagacctgtctctcgagaaggccgcggaagtcagctgggaggaagaggctgagcactccggtgcctcacataacattctggttgaagtgcaggatgacgggactcgcaaaatcaaggatgaggaacgggacgatacacttaccatactgttgaaggcaactctactggccgtgagtggagtctacccgatgagcattcctgctacactcttcgtgtggtatttttggcagaaaaagaatcaaagatctggcgttggcctgatcaccccctccccacccgaggtagaaagggcagtgcttgacgatgggatctaccgaattttacagcgcggactgctcggtcggtcacaggtcggcgtgggggttttccaggagggagtgttccacacgatgtggcacgtcactagaggcgccgtgttgatgtatcaaggtaaaaggctggagcctagttgggcgagcgtaaagaaagacctcatatcctacgggggaggctggcgttttcagggctcttggaacaccggggaagaggtccaggtgatcgctgttgaaccaggacgcaatcccaagaacgtgcagacagcccctggtaccttcaagacaccggagggcgaggtcggggcaattccactggactttaaacccggaacttcgggcagccctatcgtgaatcgggaaggtaagattgttgggctttacggaaacggcgtggtcaccacgtcaggcacatatgtgtccgccatcgctagagccaaagcaagtcaagaggggccactgcccgaaatagaggatgaagtattcaggaagcgaaatttgactatcatggacctacatcctggatctggtaaaacccggcgctacctgccggctattgtgagagaggccatcaagaggaagctccggacattaattctggcgcccacccgagttgtcgccagcgagatggcagaagctcttaaaggcgtgccaatcagatatcagactaccgccgtgaagtccgagcacacagggaaagaaatagtcgatctgatgtgccatgctacgtttactatgcgcctcttgtcacctgtaagggtgcccaactacaatatgattatcatggacgaggcacacttcaccgatccagcctctatcgccgctcgtggatatattagcacacgggttggcatgggtgaagcggcagccatctttatgaccgctactcctacagggagtgtggaggccttcccccagtccaacgcaataattcaagacgaggaaagagatatcccagagaggagctggaattctggatacgactggattaccgattttccgggcaagacggtctggttcgtgccttcaatcaaatccggcaacgacatagccaactgcctgaagaagaatgggaaacgcgttattcagctcagtcgaaagacttttgatacagaatatcagaaaaccaagaacaatgactgggactacgtggtcaccactgatatcagcgagatgggagctaacttcagagcggaccgggtgatcgatcccaggcgctgtctgaaaccagtaattcttaaggacggtcccgaacgtgtgatcctagccggccctatgccagttacagtcgcatcggctgcccagagacgggggaggattggacgcaatcaaaacaaggagggcgatcagtacatatatatgggtcagccctctaataacgacgaggatcatgcacactggaccgaagccaaaatgctgttggacaatatcaacacacctgaggggattatcccggctttattcgaaccagagcgagagaagtccgccgcgatcgatggcgaatacagactgcggggagaggcaaggaaaacttttgtggaactcatgcgcagaggcgacctgcccgtgtggcttagctataaggtcgcctcagaggggttccagtacagtgataggcggtggtgctttgacggagaacgtaataaccaagttctggaggagaataaagatgtggaaatttggacgaaggagggtgaacgcaaaaagctccgaacctgttggttggacgctagaacatattctgaccctctggccctaagggagttcaaggaatttgctgcaggccggcgctccgtaagcggggatctgatactcgagatcggaaaacttccccagcacctgactcagaaggcccagaaagctttagacaacttggtgatgctgcataattcagagcaaggcggtaaggcctacagacacgcaatggaagagctcccagataccattgaaacactgatgcttctggcgctcatcgccgtcttgaccgggggcgtgactctgttctttttaagtggaaggggcctagggaaaacgagcattggactgctctgcgttatggcttcctctgtgcttctgtggatggccagcgtcgagcctcattggatcgcagcttccataatcttggaattctttctgatggtactcctgattcccgagccagaccggcagcgaacccctcaggataaccagcttgcctatgtggttatcggtctcctgttcatgattttgacagtggcagccaacgagatgggcctgttagaaactaccaagaaggacctagggatcggacacgtcgctgcggagaatcaccatcacgccacaatgctggatgtggacctcagaccggcatcagcttggaccctttacgccgtcgccactacaataattacgcccatgatgcgccataccatcgaaaacactacagcaaatatttctctgaccgctatcgccaaccaagcggctatattgatgggcctggataaaggttggccaatcagtaagatggacattggggtgcctctcctggcccttggctgttactcgcaggttaatcccttaaccctgacagcagccgtgctcatgttggtagctcactatgcaatcattggaccaggcctgcaggccaaagcgactagggaggctcaaaagcggacggccgcagggatcatgaaaaaccctaccgtggatggaatagtcgccattgacctagatcccgttgtgtacgacgctaagtttgagaagcagctgggccagatcatgctccttatcctgtgcacaagccagattttgctgatgcgtactacctgggccctctgtgaatccatcacactggcaaccggtccgttaactacgctttgggaggggtctccaggaagattctggaatacaaccatagctgtctcaatggccaacatttttaggggcagctatctggcgggtgccggcctcgcattctccctaatgaaaagtctggggggaggccgccgggggactggagctcaaggcgaaaccttgggtgagaagtggaaacgacagctgaatcagctctctaagagcgaattcaacacatacaaaagatcagggatcatggaggtggacaggtccgaggccaaggaaggacttaagcgcggcgagactaccaaacatgcagtaagtcggggtacagctaagctgagatggtttgtggaacgtaatttggttaaacctgagggcaaggtgattgatctggggtgcggaaggggcgggtggagctattactgtgccggactcaaaaaggtcacggaagtgaaaggctataccaagggtgggcccggacacgaggagccaatccccatggccacttacggctggaacttagtcaagctgcactctggcaaagacgtgttctttatacctccggaaaagtgcgatacacttctgtgtgacatcggggagtcctcacccaatccaaccattgaagagggacggactctacgcgttctcaaaatggtagaaccttggctgcgaggtaaccagttctgcatcaagattttgaatccctacatgcctagcgtggtcgagacactggagcaaatgcagagaaaacatggcgggatgctcgtgaggaacccactttcgcggaattctacccacgaaatgtattgggttagttgcggaacgggcaacatcgtgtccgcggtcaacatgaccagccgcatgctgttaaatagatttacaatggctcataggaagcccacttacgagcgagatgtggacctgggtgcagggacccggcacgtagccgtggaacctgaggttgctaacttggatattatcggacagcgtatagagaatattaagaacgaacacaaatcaacatggcattatgacgaggataatccatacaagacttgggcctatcacggctcctacgaagtcaaaccctctggcagcgcaagttccatggtgaacggggtggtcagactcctgaccaagccgtgggacgttatccctatggtgacacagatcgccatgaccgatactacgccattcggacaacagcgcgtatttaaagagaaggtggacacaaggacccccaaggctaaacggggtactgcgcagattatggaagtcaccgccagatggctatggggcttccttagccgcaataagaaacctaggatatgtacacgagaggagtttacgcggaaggtgagatctaacgcagctatcggggccgttttcgtggacgaaaatcaatggaactcagcaaaagaggccgtcgaagatgagaggttttgggacctggtgcatcgcgaacgtgagctccacaagcagggaaagtgcgctacctgtgtatataataaaatgggcaagcgggagaaaaagctgggtgaattcgggaaagccaagggaagtagagcgatttggtacatgtggttgggcgcaaggtttctggagttcgaagccctcggcttcatgaacgaggatcattggttttcccgcgaaaatagcctttctggggttgagggagagggtctgcacaaattaggctacatcctgcgagacatttcgcggatcccagggggaaacatgtatgctgatgacactgccggctgggatacaagaataaccgaagacgatttgcagaatgaggcaaagatcactgacattatggaacccgagcacgctctcctggccacatcaatcttcaagctaacctaccagaacaaagtggtcagggtgcaacgcccggctaagaacggtacagtgatggatgccattagcagacgggaccagagggggtccggacaggtcggcacttatggccttaatacctttctgcataaagaggcacagctcatccgtcaaatggaattcgaggggatatttctgcctagtgaattggagacgcccaacttagcgggacgagttctggattggctcgaacagtacggtgtggagcgccttaagagaatggccatttctggcgacgactgcgtagtgaaaccaatcgatgaccggttcgctaccgccctgacagcactaaatgatatggggaaggtcaggaaggacatccctcagtgggagcccagcaaaggatggggcgattggcagcaagtgccattttgttcccaccatttccaccagctgattatgaaggacgttcgcgaaatagtggtcccctgcagaaaccaggatgagctcgtgggtcgggctagggtatcacagggggccggatggagtttgcgagaaactgcatgtctgggcaaatcttatgcccaaatgtggcagcttatgtactttcaccgtagagacctgcgcctcgcggctaatgccatctgcagcgcagttcctgtggattgggtcccaacctcccggacaacttggtcaattcatgcccaccatcagtggatgaccacggaggacatgttaagcgtgtggaacagggtttggatcgaagagaatccgtggatggaggataagacacacgtgtcttcctgggaagacgtcccctatctgggcaaaagagaggaccaatggtgtgggagtttgattggactgaccgctcgcgccacttgggcaacaaacatccaggtggctataaatcaggtacggaggctcatcggtaacgaaaattaccttgattacatgaccagcatgaagcgattcaagaacgagtcggaccctgaaggcgccctgtggtga

SEQ ID NO: 13470 - RNA, 9879 nt, synthetic construct
  misc_feature 1..9879: note = derived and/or modified CDS sequence (opt3) from DENV-1__EU482567__SS-prME
  source 1..9879: mol_type = other RNA
agcgtgaccatgctgctcatgcttctgcccacagccttggctttccacttaactacgagaggaggggagcctcatatgatcgtctccaagcaggaaaggggaaagtctctgttgtttaagacctcagcaggtattaacatgtgcacactcatagccatggacctgggcgagctttgtgaagatactatgacctacaaatgcccacggatcacagaggcggaaccggacgatgttgactgttggtgcaatgctaccgatacttgggtgacatatgggacctgtagtcaaacgggagagcaccgccgagacaagcgtagcgtagccctggcaccccatgtgggcttgggtctcgagactagaaccgaaacatggatgtcctctgagggggcctggaaacagattcagaaggtcgaaacttgggctctgaggcaccctggattcaccgtgacagcactgtttctcgcccatgctatcggcacctcgattacgcagaagggcatcatattcatcttactgattcttgttactccatcaatggccatgcggtgcgtggggatcggaaaccgcgattttgtcgagggtttgagcggcgcgacatgggtggacgttgttctggagcacgggagttgtgtgaccactatggcaaaagataagcccacactagacattgaactcctgaaaaccgaggtcacgaatcctgccgtgcttagaaagctgtgcatcgaagctaaaatatccaacaccacaactgattctaggtgtccaacccaaggagaggccacattggtggaggaacaggacagcaatttcgtctgccggcgcacttttgttgatcgaggctggggtaacgggtgtggactcttcggcaagggctccctgttaacctgcgcaaagtttaaatgcgtgacaaagctggaggggaaaattgtacagtacgaaaatctcaagtattcagtgatcgtcaccgtgcacactggagaccagcatcaagttggtaacgagacgacagaacacggcaccattgctactatcacaccccaggcccctacaagtgagatccagcttaccgactacggggcgctgactttggattgtagcccaagaacaggactagacttcaatgaaatggtgctgctcacgatgaaagagaagtcttggctggtccataaacagtggtttcttgatctgccgttgccctggacctccggcgcctcaactagccaagagacatggaacaggcaggacctcctggtgaccttcaagacagcacacgctaagaaacaggaagtagttgtgttaggtagtcaagagggggccatgcacactgctctgaccggcgccacggaaattcagacctctggaacaactaccatatttgcaggccatctaaagtgccggctcaaaatggataagctgacacttaaagggatgtcctatgtcatgtgtactggcagcttcaagttggagaaggaagtggccgagacccagcacggtacggtcctggtgcaggttaaatacgagggcacagacgctccttgcaagatcccattctcggcgcaagatgaaaaaggggtgacccagaatggacgtctcattactgcaaaccccatcgtaacagacaaggagaaacctgtcaatatagaaaccgagccaccctttggcgagtcttatattgtggttggtgccggggaaaaggctctgaaactttcctggttcaaaaagggctcaagtatcggaaaaatgtttgaggccactgcacgcggcgccagaaggatggctatcctgggggataccgcctgggacttcggaagcattggtggcgtgtttacatccgcagggaagttggtccatcaggtgttcggagcggcttacggcgtactcttttctggtgtgagctggacgatgaaaatcgggattggcatactgttaacctggctgggactaaactcacggagtacttccctcagcatgacatgtatcgccgttggcatggtcaccctgtaccttggggtggtggtccaggcagattctggatgcgttattaattggaagggccgagaattgaagtgtggttcagggatcttcgtgacaaacgaggtgcacacttggaccgaacaatataaatttcaggccgacagtccgaagcgcctgagcgctgccatcggaaaagcatgggaggagggcgtatgcggtattagatccgctacgaggctcgaaaacataatgtggaagcagatctctaatgagctgaaccatattttactggaaaatgacatgaaattcacagtcgtggttggcgatgccaacgggatccttgcgcagggaaagaaaatgattcggcctcaacccatggagcaccgctactcgtggaaaagctggggcaaggccaagatcataggggctgacatccagaatgcaacctttattatcgatggaccagacactcctgaatgtcccgatgaccagagagcctggaacatttgggaggtggaggattatggcttcggtatctttaccacaaatatatggttgaagctcagggactcctacactcagatgtgcgatcaccgtctgatgtcagctgccattaaagacagtaaggcagtccatgcggatatggggtattggatcgaatctgagaaaaacgaaacctggaagctagcccgggctagcttcattgaggtgaagacatgtatctggccaaaatcccacacgctgtggtcaaatggagttctcgaaagcgagatgataatccccaagatttacggcggtcctatctctcaacataactatcgaccaggctacttcacccagactgccgggccgtggcacctgggaaaacttgagttggactttgatctgtgcgaaggcacaaccgtggtagtcgacgagcactgcgggaatagaggaccctccttaaggactacaaccgtgacgggcaagattatccatgaatggtgttgccgcagttgtactctccctccactgcggttcagaggtgaggacgggtgctggtacggaatggagataaggcccgtgaaagaaaaggaggaaaaccttgtccgcagcatggtttctgcaggctccggtgaggtggattcatttagtctgggcattttgtgtgtaagcatcatgatcgaagaggtgatgcgatcgcggtggtcccgtaagatgctcatgaccgggacactggctgtcttcctactgctcattatgggacagctgacctggaaagaccttatcagattgtgcattatggtgggcgccaatgcatctgataggatggggatgggaactacatatctggccttaatggctacctttaagatgcgccctatgttcgcggttggcctcctgtttcggagacttacaagcagggaggtgctgctactcactataggtctgtcattggtcgccagtgtggaactgccaaactccttagaggaactcggggacggactggcaatgggcatcatgatgcttaaactgttgaccgagttccaaccccaccagctctggacgacactgctatctctgacctttattaatactacccttagcctcgattacgcttggcgaacaatggccatggttctgtccatcatttcattgttcccgctgtgtttaagcactaccagtcagaagacgacatggctccctgtgctgcttggctcttttgggtgcaaaccactgaccatgttcttgatcactgaaaacaagatatggggacgcaagtcctggcccctcaacgagggtatcatggccattggcatcgtcagcattctgctatcgtcactgcttaaaaatgacgtacctctcgctgggcccctgatcgcaggaggcatgttgatagcctgttatgtgatttctggtagttccgcggatttaagcctggagaaggctgccgaagtttcttgggaggaagaggcagaacatagcgggacatcccacaacatcctcgtggaggtccaggacgatggaaccatgaaaatcaaggacgaggaacgggatgacactctgacaattcttctgaaagccaccttgctagctgtgtcaggcgtatacccaatgagtatacctgcaacgctgtttgtgtggtatttctggcaaaagaaaaagcagagaagcggcgtcctctgggatactccctctccaccggaggttgaaagggccgtgctggacgacgggatctaccgtattcttcagcgcggattactgggtcggtcccaggtgggcgtcggggtgttccaagatggagtttttcataccatgtggcacgtaacaagaggcgcggtgctcatgtatcagggtaagaggttggagccttcatgggctagtgtcaaaaaggacctgatcagctacgggggaggctggcgattccagggctcctggaataccggggaggaagtgcaggttattgccgtggagcccggcaagaatccaaagaatgtccaaacaactcccggtacctttaaaacgcctgaaggcgaggtgggggcaatcgccctcgatttcaagccaggaacatctggctcgcccatagtaaaccgggaaggtaagatcgtcgggctgtacggaaatggcgtggttactaccagcggcacatatgtgtcagctattgcccaggcaaaaacctcccaggaggggcctcttccggagatcgaagacgaggtctttaagaaacgcaacctgactattatggatttgcacccaggaagtggtaagaccagaaggtacctacccgctatcgtgcgggaagccataaaacgaaagctgagaacactcattttagcgcctacgcgcgttgtggcctctgagatggcagaagctctgaagggcatgccaatcaggtatcaaactaccgccgtcaaaagcgagcatacagggcgtgagatcgtggaccttatgtgccacgctaccttcactatgcggctgctctcccccgtaagagtgcctaattacaacatgattatcatggatgaagcacattttacagacccggcctcaatagccgctaggggatatatttctacccgcgttggcatgggtgaggcggcagccatcttcatgacggctactcccccagggagcgtcgaagcctttcctcagagtaatgcagtgattcaggatgaggaacgagacatccccgagagatcctggaacagcggatacgattggataacagacttcccaggcaagaccgtgtggtttgtcccttctattaaatcaggcaatgacatcgccaactgtttgcggaagaatgggaaaagggtaatccagctgtcccgcaagaccttcgatactgagtatcaaaagaccaagaacaacgactgggattacgtggttaccacagacattagtgaaatgggagctaatttccgtgcggatagagtgatcgacccccggaggtgcctcaagccagtcattctgaaagatggtccggagcgcgtgatacttgccggccctatgcccgttactgtggcaagcgctgcccagcgaagagggcggatcggaaggaaccagaataaggaaggcgaccagtacgtctatatgggtcaaccactaaacaatgatgaggaccacgcacattggacggaggccaaaatgctgttggataacattaatacccccgaagggatcatccctgctttatttgagccagaacgcgagaagtcggccgcgattgacggcgaatacagactgaggggagaggcacggaagacattcgtggagctcatgcgtcgcggcgatctgcccgtatggctttcttataaagtggcctccgaagggtttcagtacagcgaccgaagatggtgcttcgacggagagaggaacaatcaggttctggaagagaacatggatgtcgaaatatggactaaggagggtgagcggaaaaagctccgccctagatggttggacgctaggacctattcagatccgctggccctacgggaatttaaagagttcgctgcaggccgaagaagtgtgtctggggacctgatcctcgaaattggaaaacttccacagcacctgacattacgcgcccaaaatgctttggataacctggtgatgctccacaattccgagcagggcggtaaagcctacaggcatgcaatggaggaactgcccgacaccatcgagactcttatgctgctcgcgttgattgccgtcctgaccgggggagttacgttatttttcctaagcggaaagggcctggggaagacatcaatcggactcctttgtgtgatggctagtagcgccctgttgtggatggcaaacgtagaacctcactggatagctgcctccatcattctggagtttttcctcatggtgctgcttatccccgaaccagatcggcagcgtactcctcaggacaatcaactcgcatatgtcgtgattggtctgttgtttatgatcctgaccgttgccgctaacgagatgggcttactagagacaaccaaaaaggatctggggataggacatgtggcggccgaaaaccaccaccatgcaactatgctcgacgtcgatcttagacccgcttctgcctggacactgtacgccgtagcaacgaccgtgattactccaatgatgaggcacacaatcgagaataccaccgctaacattagcttgacagccatcgcgaatcaggctgccatactgatgggcctcgacaaaggttggcctatctccaagatggatattggggttccgctgcttgcattaggctgctactcacaggtgaaccccctgactctcacggccgctgtcttgatgctggtggcacattatgccatcattggaccaggcctacaagcgaaagctacccgcgaagcccagaagcggacagcagccgggatcatgaagaatcctactgtcgacggaatagtggctattgacctggatcccgttgtgtacgacgccaaattcgagaagcagctcggccagatcatgcttctgatcttgtgtacctctcaaattctgctcatgcgaacaacctgggcactgtgcgaaagtatcactttagctacgggtccacttacaaccctgtgggaggggtcgcctggaaaattttggaacactaccatagccgtaagcatggcgaatattttcagaggctcctatctcgccggtgcaggcctagctttctctctgatgaagtcactagggggaggcaggcgcgggacaggagcccagggcgagactctgggtgaaaaatggaagcggcagctcaaccagcttagcaagtccgagtttaatacctacaaaagaagtgggatcatggaagtggatcgttctgaggcaagggaaggactgaagcggggcgagacaacgaaacacgctgtcagccgcggtaccgccaagttgcgatggttcgttgagagaaacctggtgaaacccgaaggcaaggtcattgacctcgggtgtggaaggggcgggtggtcatattactgcgccggattaaagaaagtgactgaggtaaagggctatacaaaaggtgggccgggacatgaggagccaatccctatggcgacctacggctggaatctggtgaaactttactccggcaaagatgtatttttcatacccccagaaaagtgtgacactctgctatgcgatatcggggagagtagccccaaccctacaattgaggaaggacggaccctccgcgtgctgaaaatggtcgagccgtggttgagaggtaatcaattttgtatcaagattctgaacccctatatgccatctgtggtcgaaacgctcgagcagatgcagaggaagcacggcgggatgcttgtgcgaaatcctctgtcccggaactcaacccacgagatgtactgggttagctgcggaacaggcaatatcgtatcggctgtgaacatgacttctcgtatgttactgaacagattcaccatggcacatcgcaaacccacatatgaaagggacgtcgatttgggtgccgggactcggcacgtggctgttgagcctgaagtggccaatctcgacattatcggacagagaatagagaacattaagaatgaacataaaagtacctggcactacgatgaggacaacccatataagacatgggcataccacggctcctatgaggtcaaacccagcggctcagcctcctctatggtgaatggggtagtgcgcctgctaaccaagccttgggacgttatcccaatggtcactcaaatcgctatgacggatacaaccccctttggacagcagagggtgttcaaggaaaaagtggacactcgaaccccgcgggcgaagagaggtacagcccaaattatggaggtcacggcaaaatggctttggggctttctgagcaggaacaagaaacctcgcatatgtacccgtgaagagttcactcggaaggttagaagtaatgctgccatcggggcagtgtttgtagatgaaaaccagtggaactccgccaaggaggctgtggaggacgaaaggttctggaacctcgtccatcgcgagcgagaactgcacaaacagggaaagtgcgccacatgcgtgtacaatatgatgggcaaacgggagaagaaattgggtgaatttgggaaggcgaagggaagcagagcaatttggtacatgtggctgggcgccaggttcctcgagttcgaggctcttggctttatgaacgaagatcattggttctctcgcgaaaattcatttagtggggttgaaggagagggtctgcacaaattaggctatatcctgagagacatttccaagatcccagggggaaacatgtacgccgatgacaccgcaggctgggatactcggataacagaggacgatttgcagaatgaagctaaaatcaccgacattatggagcccgaacatgccctcctggctacaagcatcttcaagctaacttatcaaaacaaagtggtcagggtgcagcgtcctgccaagaacggtaccgtaatggatgttatttctcgacgcgaccagagagggtcgggacaggtgggcacgtacggccttaatacctttacaaacatggaggtccaactgatccggcagatggaatcagaggggatattcctcccaagcgagctggaaactcccaatttggcagagagggtgttagactggctggaaaaacacggaaccgagcgcctcaagagaatggcgatttccggtgatgactgtgtggtcaagccggttgatgaacggtttgccacagctcttatcgccctgaacgacatgggcaaagtgaggaaggatatccctcagtgggagcccagtaaagggtggaatgactggcagcaagtaccattctgctctcaccattttcaccagctaattatgaaggatggacgagagatagtggtcccttgtcgtaaccaggacgaactggtgggcagagcacgcgttagccagggtgctgggtggtccctccgggagactgcctgcttgggaaaatcatatgcacaaatgtggcagctgatgtacttccataggagagatcttcgcctggccgcgaatgctatctgtagtgccgtgcccgtcgactgggtgccaacctctcggacgacatggagcattcacgcacaccatcagtggatgaccactgaagatatgctctccgtatggaacagggtttggatcgaggaaaatccctggatggaggacaagacacacgtgtcaagctgggaggaagtcccttatttaggcaagcgagaggaccaatggtgcggctctctgattgggttgaccgccagagctacttgggccaccaacatccaggtggcaataaatcaggttcggaggctgatcggaaacgaaaattacctcgattacatgacatccatgaaacgctttaagaacgagagtgacccagagggtgctctttggtga

SEQ ID NO: 13471 - RNA, 9879 nt, synthetic construct
  misc_feature 1..9879: note = derived and/or modified CDS sequence (opt3) from DENV-1__FJ390378__SS-prME
  source 1..9879: mol_type = other RNA
agcgtgaccatgctgctcatgcttctgcccaccgccttggctttccacttaactacgagaggaggggagcctcatatgatcgtctccaagcaggaaaggggaaaatctctgttgtttaagacctcagcaggtattaacatgtgcacactcatagccatggacctgggcgagctttgtgaagatactatgacctacaaatgcccacggatcacagaggcggaaccggacgatgttgactgttggtgcaatgctaccgatacttgggtgacatatgggacctgtagtcagacgggagagcaccgccgagacaagcgtagcgtagccctggcaccccatgtgggcttgggtctcgagactagaaccgaaacatggatgtcctctgagggggcctggaaacagattcagaaggtcgaaacttgggctctgaggcaccctggattcaccgtgacagcactgtttctcgcccatgctatcggcacctcgattacgcagaagggcatcatattcatcttactgatgcttgttactccatcaatggccatgcggtgcgtggggattggaaaccgcgattttgtcgagggtttgagcggcgcgacatgggtggacgtagttctggagcacgggagttgtgtgaccactatggcaaaagataagcccacactagacatcgaactcctgaaaaccgaggtcacgaatcctgccgtgcttagaaagctgtgcattgaagctaaaatctccaacaccacaactgattctaggtgtccaacccaaggagaggccacattggtggaagaacaggacagcaatttcgtctgccggcgcacttttgttgatcgaggctggggtaacgggtgtggactcttcggcaagggctccctgttaacctgcgcaaagtttaaatgcgtgacaaagctggaggggaaaatagtacagtacgaaaatctcaagtattcagtgattgtcaccgtgcacactggagaccagcatcaagttggtaacgagacgacagaacacggcaccatcgctactattacaccccaggcccctacaagtgagatccagcttaccgactacggggcgctgactttggattgtagcccaagaacaggactagacttcaatgaaatggtgctgctcacgatgaaagagaagtcttggctggtccataaacagtggtttcttgatctgccgttgccctggacctccggcgcctcaactagccaagagacatggaacaggcaggacctcctggtgaccttcaagacagcacacgctaagaaacaggaagtagttgtgttaggtagtcaagagggggccatgcacactgctctgaccggcgccacggaaatccagacctctggaacaactaccatttttgcaggccatctaaagtgccggctcaaaatggataagctgacacttaaagggatgtcctatgtcatgtgtactggcagcttcaagttggagaaggaagtggccgagacccagcacggtacggtcctggtgcaggttaaatacgagggcacagacgctccttgcaagataccattctcggcgcaagatgaaaaaggggtgacccagaatggacgtctcatcactgcaaaccccattgtaacagacaaggagaaacctgtcaatatcgaaaccgagccaccctttggcgagtcttatatagtggttggtgccggggaaaaggctctgaaactttcctggttcaaaaagggctcaagtattggaaaaatgtttgaggccactgcacgcggcgccagaaggatggctatcctgggggataccgcctgggacttcggaagcatcggtggcgtgtttacatccgtcgggaagttggtgcatcaggtattcggagcagcgtacggcgtgctcttttctggtgttagctggacgatgaaaattgggatcggcattctgttaacctggctgggactaaactcacggagtacttccctcagcatgacatgtatagctgtcggcatggtgaccctgtaccttggggtgatggtccaggccgattctggatgcgttatcaattggaagggccgagaattgaagtgtggttcagggattttcgtgacaaacgaggtgcacacttggaccgaacaatataaatttcaggcagacagtccgaagcgcctgagcgccgctatcggaaaagcctgggaggagggcgtatgcggtatcagatccgcaacgaggctcgaaaacattatgtggaagcagatatctaatgagctgaaccatatcttactggaaaatgacatgaaattcacagtcgtggttggcgatgctaacgggattcttgcccagggaaagaaaatgatccggcctcaacccatggagcaccgctactcgtggaaaagctggggcaaggcgaagattatcggggccgacatacaaaattccacctttatcattgatggaccagacactcctgaatgtcccgatgaccagagagcttggaacatctgggaggtggaggattatggcttcggtatttttaccacaaatatctggttgaagctcagggactcatacactcagatgtgcgatcaccgtctgatgagtgcagccataaaagactctaaggctgtccatgccgatatggggtattggattgaaagcgagaaaaacgaaacctggaagctagcacgggcgtccttcatcgaggtgaagacatgtatttggccaaaatcacacacgctgtggagcaatggagttctcgaatctgagatgatcatacccaagatctacggcggtcctatttcccaacataactatcgaccaggctacttcacccagactgccgggccgtggcacctgggaaaacttgagttggactttgatctgtgcgaaggcacaaccgtggtagtcgacgagcactgcgggaatagaggacccagtttaaggactacaaccgtgacgggcaagatcattcatgaatggtgttgccgcagctgtactctccctccactgcggttcagaggtgaggacgggtgctggtacggaatggagatcaggcccgtgaaagaaaaggaggaaaaccttgtccgctctatggtttccgctggctcaggtgaggtggatagttttagcctgggcatattgtgtgtatcgattatgatcgaagaggtgatgcgatcccggtggtctcgtaagatgctcatgaccgggacactggccgtcttcctactgctcatcatgggacagctgacctggaatgaccttattagattgtgcatcatggtgggcgcaaacgctagcgataggatggggatgggaactacatatctggccttaatggcaacctttaaaatgcgccctatgttcgccgttggcctcctgtttcggagacttacatcaagggaggtgctgctactcactattggtctgagtttggtcgcttccgtggaactgccaaattctttagaggaactcggggacggactggcgatgggcataatgatgcttaagctgttgaccgagttccaaccccaccagctctggacgacactgctaagcctgacctttatcaaaactaccctttccctcgattacgcctggcgaacaatggcaatggttctgtcaattgtgagcttgttcccgctgtgtttaagtactacctctcagaagacgacatggctccctgtcctgcttggctcctttgggtgcaaaccactgaccatgttcttgatcactgaaaacaagatttggggacgcaagagctggcccctcaacgagggtatcatggctataggcatcgtatcgattctgctatcatctctgcttaaaaatgacgtgcctctcgccgggcccctgatcgccggaggcatgttgattgcttgttatgttatcagtggttccagcgcagatttatctctggagaaggccgcggaagtgagctgggaggaagaggctgaacattccgggacatcacacaacatactcgtcgaggtgcaggacgatggaaccatgaaaattaaggacgaggaacgggatgacactctgacaatccttctgaaagccaccttgctagcagtaagtggcgtgtacccaatgagcatccctgccacgctgtttgtctggtatttctggcaaaagaaaaagcagagatctggcgttctctgggatactccctccccaccggaggtggaaagggctgtgctggacgacgggatttaccgtatacttcagcgcggattactgggtcggtcacaggtcggcgtgggggttttccaagatggagtatttcataccatgtggcacgtgacaagaggcgcagtcctcatgtatcagggtaagaggttggagcctagttgggccagcgtgaaaaaggacctgatctcctacgggggaggctggcgattccagggctcttggaataccggggaggaagttcaggtgattgcggtcgagcccggcaagaacccaaagaatgtgcaaacaactcccggtacctttaaaacgcctgaaggcgaggtaggggctatcgccctcgatttcaagccaggaacatcgggcagccccattgtcaaccgggaaggtaagatcgtggggctgtacggaaatggcgttgtgactacctcaggcacatatgtctccgcaatagcccaggctaaaaccagtcaggaggggcctcttccggagatcgaagaggaagtgtttaagaaacgcaacctgactattatggacttgcacccaggatctggtaagaccagaaggtacctacccgccatcgttcgggaggcaattaaacgaaagctgagaacactcatcttagctcctacgcgcgtggtcgccagcgaaatggcggaggccctgaagggcatgccaataaggtatcaaactaccgcagtgaaatccgagcatacagggcgtgaaattgtagatcttatgtgccacgctaccttcactatgcggctgctctcacccgtgagagttcctaattacaacatgatcatcatggacgaggcccattttacagatccggcttctattgcagccaggggatatatcagcacccgcgtcggcatgggtgaagccgctgcgatattcatgacggcaactcccccagggagtgtggaggcctttcctcagtccaatgctgtgattcaggacgaagaacgagatatccccgagagaagctggaactctggatacgactggattacagatttcccaggcaagaccgtctggtttgtaccttcaatcaaatccggcaatgacatagccaactgtttgcggaagaatgggaaaagggtgattcagctgagtcgcaagaccttcgacactgaatatcaaaagacacgtaacaacgattgggactacgttgtgaccacagatatcagcgagatgggagcaaatttcagagccgaccgggtcatcgatcccaggcgctgcctcaaaccagtgattctgaaggacggtccggaacgagttatccttgctggccctatgcccgtgactgtcgcgtcggccgcacagagacgggggaggattggacgcaaccagaataaagagggcgatcagtacgtgtatatgggtcaaccactaaacaatgacgaggatcacgctcattggacggaagccaagatgctgttggacaacataaatacccccgaggggatcattcctgcattatttgaaccagagagagaaaaatctgccgctatcgatggcgagtacaggctgcggggagaggcccgtaagacattcgtagaactcatgcgccgaggcgacctgcccgtgtggctttcctataaggttgcgagcgaggggtttcagtactcagatagaaggtggtgcttcgacggagaacggaacaatcaggtcctggaggaaaacatggacgtggagatctggactaaagagggtgaacgcaagaaactcagacctaggtggttggatgcacggacctatagtgacccgctggccctacgagagtttaaggagttcgctgccggcagacgctctgtgtccggggatctgattctcgagataggaaaacttccacagcacctgacattaagggctcaaaatgcattggacaacctggtcatgctccacaatagcgaacagggcggtaaggcctaccggcatgctatggaggagctgcccgataccatcgaaactcttatgctgctcgccttgattgcagttctgaccgggggagtgacgttatttttcctatcaggaaaaggcctggggaagacaagtatcggactcctttgtgtaatggcgagctccgccctgttgtggatggctaacgtggagcctcactggattgccgcatctatcatactggaatttttcctcatggtcctgcttatccccgagccagaccgtcagagaactcctcaggataatcaactcgcttatgtggttattggtctgttgtttatgatcctgaccgtggccgcaaacgagatgggcttactagaaacaaccaagaaagacctggggattggatacgtcgccgctgagaaccagcatcacgcgactatgctcgatgtagaccttaggcccgccagcgcatggacactgtacgctgtggccacgaccgttatcactccaatgatgcgccacacaatagaaaataccaccgccaacatttccttgacagcaatcgctaatcaggccgcgattctgatgggcctcgataagggttggcctatctcaaaaatggacataggggtgccgctgcttgctttaggctgctattctcaagtcaaccccctgactctcacggccgcagtgttgatgctggtcgcccattacgctatcattggaccaggcctacaggcaaaggccacccgggaggcgcagaaacgaacagctgccgggatcatgaagaatcctactgtggatggaattgttgcaatcgacctggaccccgtggtatatgatgccaagttcgaaaaacagctcggccaaataatgcttctgattttgtgtaccagtcagatcctgctcatgagaacaacctgggctctgtgcgagtcgatcactttagccacgggtccacttacaaccctgtgggaggggagccctggaaagttttggaacactaccattgcagtgtccatggctaatatcttcaggggctcttacctcgccggtgcgggcctagccttctcactgatgaaaagcctagggggaggccgccgggggacaggagcacagggcgaaactctgggtgagaagtggaagagacagctcaaccaactttccaagagtgaatttaatacctataagcgttctgggataatggaggtcgacaggagcgaagctaaagagggactgaagcggggcgagacaacgaaacacgccgtttcacgcggtaccgcaaagttgcgatggttcgtggaaagaaacctggtcaaacccgagggcaaggtgattgatctcgggtgtggaaggggcgggtggtcctactattgcgctggattaaagaaagtaactgaagtgaagggctacacaaaaggtgggccgggacatgaggaaccaatccctatggccacctacggctggaatctggttaaactttatagtggcaaagacgtgtttttcactcccccagagaagtgtgatacactgctatgcgacattggggagagctctcccaaccctaccatcgaagagggacggacgctccgcgtcctgaaaatggtggaaccgtggttgagaggtaatcagttttgtataaagatcctgaacccctacatgccatccgtcgtggagaccctcgagcagatgcagaggaagcacggcgggatgcttgttcgaaatcctctgtcacggaacagcacacatgaaatgtattgggtatcgtgcggaactggcaatattgtgtctgccgtcaacatgaccagtcgtatgttactgaacagattcacaatgactcaccgcaaacccacctacgagagggatgtggacttgggtgcggggacacggcacgttgctgtggaacctgaggtcgcaaatctcgatatcattggacaaagaatcgaaaacattaagaatgagcataaatccacctggcactatgacgaggataacccatacaagacttgggcctatcatggcagctacgaagtgaaaccctcaggctccgcttctagcatggtaaatggggtggttcgcctgctaacgaagccttgggacgtcatcccaatggtgacacagatagccatgaccgacactaccccctttggacagcaaagggtgttcaaggagaaagtcgatacacgaacgccgcgggcaaagagaggtaccgcccagattatggaagttactgctaaatggctttggggctttctgagtaggaacaagaaacctcgcatctgtacacgtgaggagttcacccggaaggtgagatccaatgcggccatcggggcagtatttgtggacgagaaccagtggaatagcgctaaggaggccgtcgaagatgagaggttctgggacctcgtgcaccgcgaacgagagctgcacaaacagggaaagtgcgcaacttgcgtttacaacatgatgggcaaacgggaaaagaaattgggtgagtttgggaaggccaagggatctagagctatttggtatatgtggctgggcgccaggttcctcgagttcgaagcgcttggctttatgaatgaggatcattggttctcacgcgaaaacagtttttccggggtggagggagagggtctgcacaaattaggctacatactgagagacatcagcaagattccagggggaaatatgtatgcagatgacacagccggctgggatacccggatcacagaagacgatttgcaaaacgaggctaaaattactgacatcatggaacccgagcatgccctcctggcaacctctatattcaagctaacgtaccagaataaagtcgtgagggtacagcgtcctgctaagaacggtaccgttatggatgtgatctcgcgacgcgaccagagagggtcaggacaagtcggcacatatggccttaacacttttaccaatatggaagtgcagctgattcggcagatggagagcgaggggatcttcctcccatccgaactggagacacccaacttggccgaaagggtgttaaattggctggagaaacacggaactgaacgcctcaagagaatggctattagtggtgacgattgtgtcgttaagccggtggacgatcggtttgccaccgcacttatcgcgctgaacgacatgggcaaagtaaggaaggatatacctcagtgggagccctctaaagggtggaatgactggcaacaggtgccattctgcagccatcactttcaccagctaattatgaaggatggacgagagatcgtcgtgccttgtcgtaaccaggacgaactggttggcagagcccgcgtgtcccaaggtgctgggtggtcactccgggagacggcctgcttgggaaaaagttacgcacagatgtggcagctgatgtatttccataggagagatcttcgcctggctgccaatgcaatctgttctgccgtccccgtggactgggtaccaacaagccggaccacttggtccattcacgcgcatcaccaatggatgacaaccgaagatatgctctcagtttggaacagggtgtggatagaggaaaatccctggatggaggacaagactcacgtcagctcttgggaggaagtgccttacttaggcaagcgagaggaccagtggtgcggctccctgatcgggttgaccgctagagccacatgggcaacgaacattcaggttgccatcaatcaggtgcggaggctgattggaaacgaaaattacctcgattatatgaccagtatgaaacgctttaagaacgagagcgacccagagggtgctctttggtga

SEQ ID NO: 13472 - RNA, 9879 nt, synthetic construct
  misc_feature 1..9879: note = derived and/or modified CDS sequence (opt3) from DENV-1__FJ205872__SS-prME
  source 1..9879: mol_type = other RNA
agcgtgaccatgctgctcatgcttctgcccaccgccttggctttccacttaactacgagaggaggggagcctcatatgatcgtctccaagcaggaaaggggaaagtctctgctatttaagacctcagctggtattaacatgtgcacactcatagccatggacctgggcgagctttgtgaagatactatgacctacaagtgcccacggatcacagaggcggaaccggacgatgttgactgttggtgcaatgctaccgatacttgggtgacatatgggacctgtagtcagacgggagagcaccgccgagacaagcgtagcgtagccctggcaccccatgtgggcttgggtctcgagactagaaccgaaacatggatgtcctctgagggggcctggaaacagattcagaaggtcgaaacttgggctctgaggcaccctggattcaccgtgacagcatttttcctggcccatgctatcggcacctcgattacgcagaagggcatcatatttatcctcttaatgctggttactccatcaatggccatgcggtgcgtggggattggaaaccgcgatttcgtcgagggtcttagcggcgcgacatgggtggacgtagttttggagcacgggagttgtgtgaccactatggcaaaagataagcccacactggacatcgaactactcaaaaccgaggtcacgaatcctgccgtgctgagaaaactttgcattgaagctaaaatctccaacaccacaactgattctaggtgtccaacccaaggagaggccacactggtggaagaacaggacagcaattttgtctgccggcgcactttcgttgatcgaggctggggtaacgggtgtggattgtttggcaagggctccctcctgacctgcgcaaagttcaaatgcgtgacaaagttagaggggaaaatagtacagtacgaaaatctgaagtattcagtgattgtcaccgtgcacactggagaccagcatcaagttggtaacgagacgacagaacacggcaccatcgctactattacaccccaggcccctacaagtgagatccagctcaccgactacggggcgcttactctggattgtagcccaagaacaggattggactttaatgaaatggtgctactgacgatgaaagagaagtcttggctcgtccataaacagtggttcctggatcttccgctgccctggacctccggcgcctcaactagccaagagacatggaacaggcaggacttgctcgtgacctttaagacagcacacgctaagaaacaggaagtagttgtgctgggtagtcaagagggggccatgcacactgctttaaccggcgccacggaaatccagacctctggaacaactaccattttcgcaggccatctgaagtgccggctaaaaatggataagctcacactgaaagggatgtcctatgtcatgtgtactggcagcttcaaacttgagaaggaagtggccgagacccagcacggtacggtcttggtgcaggttaaatacgagggcacagacgctccttgcaagataccattttcggcgcaagatgaaaaaggggtgacccagaatggacgtctgatcactgcaaaccccattgtaacagacaaggagaaacctgtcaatatcgaaaccgagccacccttcggcgagtcttatatagtggttggtgccggggaaaaggctctcaagctgtcctggtttaaaaagggctcaagtattggaaaaatgttcgaggccactgcacgcggcgccagaaggatggctatccttggggataccgcctgggactttggaagcatcggtggcgtgttcacatccgtcgggaagctggtgcatcaggtatttggagcagcgtacggcgtgttgttctctggtgttagctggacgatgaaaattgggatcggcattctcctgacctggttaggactgaactcacggagtacttccctaagcatgacatgtatagctgtcggcatggtgaccctctacctgggggtgatggtccaggccgattctggatgcgttatcaattggaagggccgagaacttaagtgtggttcagggatttttgtgacaaacgaggtgcacacttggaccgaacaatataaattccaggcagacagtccgaagcgcttgagcgccgctatcggaaaagcctgggaggagggcgtatgcggtatcagatccgcaacgaggctggaaaacattatgtggaagcagatatctaatgagctcaaccatatcctgttagaaaatgacatgaaatttacagtcgtggttggcgatgctaacgggattctggcccagggaaagaaaatgatccggcctcaacccatggagcaccgctactcgtggaaaagctggggcaaggcgaagattatcggggccgacatacaaaattccaccttcatcattgatggaccagacactcctgaatgtcccgatgaccagagagcttggaacatctgggaggtggaggattatggctttggtattttcaccacaaatatctggcttaagttgagggactcatacactcagatgtgcgatcaccgtctcatgagtgcagccataaaagactctaaggctgtccatgccgatatggggtattggattgaaagcgagaaaaacgaaacctggaagctggcacgggcgtccttcatcgaggtgaagacatgtatttggccaaaatcacacacgctatggagcaatggagttctggaatctgagatgatcatacccaagatctacggcggtcctatttcccaacataactatcgaccaggctactttacccagactgccgggccgtggcacctcggaaaactggagcttgacttcgatttgtgcgaaggcacaaccgtggtagtcgacgagcactgcgggaatagaggacccagtctgaggactacaaccgtgacgggcaagatcattcatgaatggtgttgccgcagctgtactttacctccactccggtttagaggtgaggacgggtgctggtacggaatggagatcaggcccgtgaaagaaaaggaggaaaacctggtccgctctatggtttccgctggctcaggtgaggtggatagtttcagccttggcatactgtgtgtatcgattatgatcgaagaggtgatgcgatcccggtggtctcgtaagatgttgatgaccgggacactcgccgtctttctgctactgatcatgggacagctcacctggaatgacctgattagactttgcatcatggtgggcgcaaacgctagcgataggatggggatgggaactacatatttggccctgatggcaaccttcaaaatgcgccctatgtttgccgttggcttactcttccggagactgacatcaagggaggtgcttctgctaactattggtctcagtctggtcgcttccgtggaattgccaaattctctggaggaattaggggacggactcgcgatgggcataatgatgctgaaacttctgaccgagtttcaaccccaccagttgtggacgacactcctgagcctaaccttcatcaaaactaccctgtcccttgattacgcctggcgaacaatggcaatggttctctcaattgtgagcctgtttccgttgtgtctgagtactacctctcagaagacgacatggttacctgtcctcctgggctccttcgggtgcaaaccacttaccatgtttctgatcactgaaaacaagatttggggacgcaagagctggcccttgaacgagggtatcatggctataggcatcgtatcgattctcctgtcatctctactgaaaaatgacgtgcctcttgccgggcccctcatcgccggaggcatgctgattgcttgttatgttatcagtggttccagcgcagatttgtctttagagaaggccgcggaagtgagctgggaggaagaggctgaacattccgggacatcacacaacatactggtcgaggtgcaggacgatggaaccatgaaaattaaggacgaggaacgggatgacactctcacaatcctgcttaaagccaccctgttggcagtaagtggcgtgtacccaatgagcatccctgccacgctattcgtctggtatttctggcaaaagaaaaagcagagatctggcgttctgtgggatactccctccccaccggaggtggaaagggctgtgctcgacgacgggatttaccgtatactgcagcgcggacttttaggtcggtcacaggtcggcgtgggggtttttcaagatggagtattccataccatgtggcacgtgacaagaggcgcagtcctgatgtatcagggtaagaggctcgagcctagttgggccagcgtgaaaaaggacttgatctcctacgggggaggctggcgatttcagggctcttggaataccggggaggaagttcaggtgattgcggtcgagcccggcaagaacccaaagaatgtgcaaacaactcccggtaccttcaaaacgcctgaaggcgaggtaggggctatcgccctggattttaagccaggaacatcgggcagccccattgtcaaccgggaaggtaagatcgtggggctctacggaaatggcgttgtgactacctcaggcacatatgtctccgcaatagcccaggctaaaaccagtcaggaggggcctctgccggagatcgaagaggaagtgttcaagaaacgcaaccttactattatggacctgcacccaggatctggtaagaccagaaggtacttgcccgccatcgttcgggaggcaattaaacgaaagctaagaacactgatcctcgctcctacgcgcgtggtcgccagcgaaatggcggaggccttaaagggcatgccaataaggtatcaaactaccgcagtgaaatccgagcatacagggcgtgaaattgtagatctgatgtgccacgctacctttactatgcggcttctgtcacccgtgagagttcctaattacaacatgatcatcatggacgaggcccatttcacagatccggcttctattgcagccaggggatatatcagcacccgcgtcggcatgggtgaagccgctgcgatatttatgacggcaactcccccagggagtgtggaggccttccctcagtccaatgctgtgattcaggacgaagaacgagatatccccgagagaagctggaactctggatacgactggattacagattttccaggcaagaccgtctggttcgtaccttcaatcaaatccggcaatgacatagccaactgtctccggaagaatgggaaaagggtgattcagttgagtcgcaagaccttcgacactgaatatcaaaagacacgtaacaacgattgggactacgttgtgaccacagatatcagcgagatgggagcaaattttagagccgaccgggtcatcgatcccaggcgctgcctgaaaccagtgattctcaaggacggtccggaacgagttatcctggctggccctatgcccgtgactgtcgcgtcggccgcacagagacgggggaggattggacgcaaccagaataaagagggcgatcagtacgtgtatatgggtcaaccacttaacaatgacgaggatcacgctcattggacggaagccaagatgctactggacaacataaatacccccgaggggatcattcctgcattgttcgaaccagagagagaaaaatctgccgctatcgatggcgagtacaggttacggggagaggcccgtaagacatttgtagaactgatgcgccgaggcgacctccccgtgtggctgtcctataaggttgcgagcgaggggttccagtactcagatagaaggtggtgctttgacggagaacggaacaatcaggtccttgaggaaaacatggacgtggagatctggactaaagagggtgaacgcaagaaactgagacctaggtggctcgatgcacggacctatagtgacccgttggccctgcgagagttcaaggaatttgctgccggcagacgctctgtgtccggggatctaattctggagataggaaaactcccacagcaccttacactgagggctcaaaatgcattagacaacttggtcatgctgcacaatagcgaacagggcggtaaggcctaccggcatgctatggaggagctccccgataccatcgaaactctgatgcttctggccctcattgcagcgttgaccgggggagttacgctgttctttttatcaggaaaaggcctagggaagacaagtatcggactgctctgtgtgatggccagctccgcacttctgtggatggccaacgtagagcctcactggattgcagcttctatcatattggagttctttctgatggtgctcctgatccccgagccagaccgtcagagaactcctcaggataatcaacttgcctatgtcgtgattggtctcctgttcatgatcttgaccgttgcagccaacgagatgggcctgttagaaacaaccaagaaagacctagggattggatacgtggctgcggagaaccagcatcacgccactatgctggatgtcgacctcaggcccgcaagcgcttggacactttacgccgtagccacgaccgtgatcactccaatgatgcgccacacaatagaaaataccaccgcaaacatttccctgacagctatcgccaatcaggcggctattttgatgggcctggataagggttggcctatctcaaaaatggacataggggttccgctcctggcccttggctgctattctcaagtgaaccccttaactctgacggcagccgtcctcatgttggtggctcattacgcaatcattggaccaggcctgcaggccaaggcgacccgggaggctcagaaacgaacagccgcagggatcatgaagaatcctactgtcgatggaattgtggccatcgacctagaccccgttgtgtatgatgctaagtttgaaaaacagctgggccaaataatgctccttattctgtgtaccagtcagatcttgctgatgagaacaacctgggccctctgcgagtcgatcactctggcaacgggtccattaacaaccctttgggaggggagccctggaaagttctggaacactaccattgctgtatccatggccaatatcttcaggggctcttacctggcgggtgccggcctcgcattttcactaatgaaaagcctagggggaggccgccgggggacaggagctcagggcgaaactttgggtgagaagtggaaaagacagctgaaccaactctccaagagtgagttcaatacctataagcgttctgggataatggaagtggacaggagcgaagccaaagagggacttaagcggggcgagacaacgaaacacgcagtctcacgcggtaccgctaagctgcgatggtttgttgaaagaaacttggtgaaacccgagggcaaggtcattgatctggggtgtggaaggggcgggtggtcctactattgcgccggactcaagaaagtgactgaagtaaagggctacacaaaaggtgggccgggacatgaggaaccaatccctatggccacctacggctggaatttagtgaagctgtatagtggcaaagacgttttctttactcccccagagaagtgtgatacacttctgtgcgacattggggagagctctcccaaccctaccatcgaagagggacggacgctacgcgtgctcaaaatggtcgaaccgtggctgagaggtaatcagttctgtataaagatcttgaacccctacatgccatccgtggtcgagaccctggagcagatgcagaggaagcacggcgggatgctcgtgcgaaatcctctttcacggaacagcacacatgaaatgtattgggtttcgtgcggaactggcaatattgtatctgcggtgaacatgaccagtcgtatgctgttaaacagatttacaatgactcaccgcaaacccacctacgagagggatgtcgacctgggtgctgggacacggcacgtggcagttgaacctgaggtggccaatttggatatcattggacaaagaatcgaaaacattaagaatgagcataaatccacctggcactatgacgaggataacccatacaagacttgggcttatcatggcagctacgaagtcaaaccctcaggctccgcctctagcatggtgaatggggtagtgcgcctcctgacgaagccttgggacgttatcccaatggtcacacagatagcaatgaccgacactacccccttcggacagcaaagggtgtttaaggagaaagtggatacacgaacgccgcgggccaagagaggtaccgctcagattatggaagtcactgcgaaatggctatggggcttccttagtaggaacaagaaacctcgcatctgtacacgtgaggaatttacccggaaggttagatccaatgccgcaatcggggctgtgttcgtagacgagaaccagtggaatagcgccaaggaggcagtggaagatgagaggttttgggacctggtccaccgcgaacgagagctccacaaacagggaaagtgcgccacttgcgtgtacaacatgatgggcaaacgggaaaagaaactgggtgagttcgggaaggctaagggatctagagccatttggtatatgtggttgggcgcgaggttcctggagtttgaagcactcggcttcatgaatgaggatcattggttttcacgcgaaaacagtttctccggggttgagggagagggtcttcacaaactgggctacatattaagagacatcagcaagattccagggggaaatatgtatgccgatgacacagctggctgggatacccggatcacagaagacgatctgcaaaacgaggccaaaattactgacatcatggaacccgagcatgcattgctcgctacctctatatttaagctgacgtaccagaataaagtggtcagggtgcagcgtcctgccaagaacggtaccgtaatggatgttatctcgcgacgcgaccagagagggtcaggacaagtgggcacatatggcctaaacactttcaccaatatggaagtccagcttattcggcagatggagagcgaggggatctttctgccatccgaactcgagacacccaacctggctgaaagggtgttgaattggttagagaaacacggaactgaacgcctgaagagaatggccattagtggtgacgattgtgtggtcaagccggttgacgatcggttcgcaaccgcgctcatcgcccttaacgacatgggcaaagtgaggaaggatatacctcagtgggagccctctaaagggtggaatgactggcaacaggtaccattttgcagccatcacttccaccagctgattatgaaggatggacgagagatcgtggtcccttgtcgtaaccaggacgagctggtgggcagagctcgcgtttcccaaggtgccgggtggtcactgcgggagacggcatgcctcggaaaaagttacgctcagatgtggcagttgatgtattttcataggagagatctgcgccttgccgcaaatgccatctgttctgcggtgcccgtcgactgggtgccaacaagccggaccacttggtccattcacgctcatcaccaatggatgacaaccgaagatatgctgtcagtatggaacagggtttggatagaggaaaatccctggatggaggacaagactcacgtgagctcttgggaggaagtcccttacctcggcaagcgagaggaccagtggtgcggctccttaatcgggctgaccgccagagcaacatgggccacgaacattcaggtggctatcaatcaggttcggaggttgattggaaacgaaaattacctggattatatgaccagtatgaaacgcttcaagaacgagagcgacccagagggtgccctctggtga

SEQ ID NO: 13473 - RNA, 9879 nt, synthetic construct
  misc_feature 1..9879: note = derived and/or modified CDS sequence (opt3) from DENV-1__FJ205873__SS-prME
  source 1..9879: mol_type = other RNA
agcgtgaccatgctgctcatgcttctgcccacagccttggctttccacttaactacgagaggcggggaacctcatatgatcgtctccaagcaggaaagaggaaaatctctgttatttaagacctcagcaggtattaacatgtgcacactcatagccatggacctgggcgagctttgtgaagatactatgacctacaaatgcccacggatcacagaggcggaaccggacgatgttgactgttggtgcaatgctaccgatacttgggtgacatatgggacctgtagtcagacgggagagcaccgccgagacaagcgtagcgtagccctggcaccccatgtgggcttgggtctcgagactagaaccgaaacatggatgtcctctgagggggcctggaaacagattcagaaggtcgaaacttgggctctgaggcaccctggattcaccgtgacagcactgtttctcgcccatgctatcggcacctcgattacgcagaagggcatcatattcatcttactgatgcttgttactccatcaatggccatgcggtgcgtggggattggaaaccgcgattttgtcgagggtttgagcggcgcgacatgggtggacgtagttctggagcacgggagttgtgtgaccactatggcaaaagataagcccacattggacatcgaactcctgaaaaccgaggtcacgaatcctgccgtgcttagaaagctgtgcattgaagctaaaatctccaacaccacaactgattctaggtgtccaacccaaggagaggccacattggtggaagaacaagacagcaatttcgtctgccggcgcacttttgttgatcgaggctggggtaacgggtgtggactcttcggcaagggctccctgttaacctgcgcaaagtttaaatgcgtgacaaagctggaggggaaaatagtacagtacgaaaatctcaagtattcagtgattgtcaccgtgcacactggagaccagcatcaagttggtaacgagacgacagaacacggcaccatcgctactattaccccacaagcccctacaagtgagatccagcttaccgactacggggcgctgactttggattgtagcccaagaacaggactagacttcaatgaaatggtgctgctcacgatgaaagagaagtcttggctggtccataaacagtggtttcttgatctgccgttgccctggacctccggcgcctcaactagccaagagacatggaacaggcaggacctcctggtgaccttcaagacagcacacgctaagaaacaggaagtagttgtgttaggtagtcaagagggggccatgcacactgctctgaccggcgccacggaaatccagacctctggaacaactaccatttttgcaggccatctaaagtgccggctcaaaatggataagctgacacttaaagggatgtcctatgtcatgtgtactggcagcttcaagttggagaaggaagtggccgagacccagcacggtacggtcctggtgcaggttaaatacgagggcacagacgctccttgcaagataccattctcggcgcaagatgaaaaaggggtgacccagaatggacgtctcatcactgcaaaccccattgtaacagacaaggagaaacctgtcaatatcgaaaccgagccaccctttggcgagtcttatatagtggttggtgccggggaaaaggctctgaaactttcctggttcaaaaagggctcaagtattggaaaaatgtttgaggccactgcacgcggcgccagaaggatggctatcctgggggataccgcctgggacttcggaagcatcggtggcgtgtttacatccgtcgggaagttggtgcatcaggtattcggagcagcgtacggcgtgctcttttctggtgttagctggacgatgaaaattgggatcggcattctgttaacctggctgggactaaactcacggagtacttccctcagcatgacatgtatagctgtcggcatggtgaccctgtaccttggggtgatggtccaggccgattctggatgcgttatcaattggaagggccgagaattgaagtgtggttcagggattttcgtgacaaacgaggtgcacacttggaccgaacaatataaatttcaggcagacagtccgaagcgcctgagcgccgctatcggaaaagcctgggaggagggcgtatgcggtatcagatccgcaacgaggctcgaaaacattatgtggaagcagatatctaatgagctgaaccatatcttactggaaaatgacatgaaattcacagtcgtggttggcgatgctaacgggattcttgcccagggaaagaaaatgatccggcctcaacccatggagcaccgctactcgtggaaaagctggggcaaggcgaaaattatcggggccgacatacaaaattccacctttatcattgatggaccagacactcctgaatgtcccgatgaccagagagcttggaacatctgggaggtggaggattatggcttcggtatttttaccacaaatatctggttgaagctcagggactcatacactcagatgtgcgatcaccgtctgatgagtgcagccataaaagactctaaggctgtccatgccgatatggggtattggattgaaagcgagaaaaacgaaacctggaagctagcacgggcgtccttcatcgaggtgaagacatgtatttggccaaaatcacacacgctgtggagcaatggagttctcgaatctgagatgatcatacccaagatctacggcggtcctatttcccaacataactatcgaccaggctacttcacccagactgccgggccgtggcacctgggaaaacttgagttggactttgatctgtgcgaaggcacaaccgtggtagtcgacgagcactgcgggaatagaggacccagtttaaggactacaaccgtgacgggcaagatcattcatgaatggtgttgccgcagctgtactctccctccactgcggttcagaggtgaggacgggtgctggtacggaatggagatcaggcccgtgaaagaaaaggaggaaaaccttgtccgctctatggtttccgctggctcaggtgaggtggatagttttagcctgggcatattgtgtgtatcgattatgatcgaagaggtgatgcgatcccggtggtctcgtaagatgctcatgaccgggacactggccgtcttcctactgctcatcatgggacagctgacctggaatgaccttattagattgtgcatcatggtgggcgcaaacgctagcgataggatggggatgggaactacatatctggccttaatggcaacctttaaaatgcgccctatgttcgccgttggcctcctgtttcggaaacttacatcaagagaggtgctgctactcactattggtctgagtttggtcgcttccgtggaactgccaaattctttagaggaactcggggacggactggcgatgggcataatgatgcttaaactgttgaccgagttccaaccccaccagctctggacgacactgctaagcctgacctttatcaagactaccctttccctcgattacgcctggaggacaatggcaatggttctgtcaattgtgagcttgttcccgctgtgtttaagtactacctctcagaaaacgacatggctccctgtcctgcttggctcctttgggtgcaagccactgaccatgttcttgatcactgaaaacaagatttggggacgaaaaagctggcccctcaacgagggtatcatggctataggcatcgtatcgattctgctatcatctctgcttaagaatgacgtgcctctcgccgggcccctgatcgccggaggcatgttgattgcttgttatgttatcagtggttccagcgcagatttatctctggagaaagccgcggaagtgagctgggaggaagaggctgaacattccgggacatcacacaacatactcgtcgaggtgcaggacgatggaaccatgaagattaaagacgaggaacgcgatgacactctgacaatccttctgaaggccaccttgctagcagtaagtggcgtgtacccaatgagcatccctgccacgctgtttgtctggtatttctggcagaagaagaagcagcggtctggcgttctctgggatactccctccccaccggaggtggaaagagctgtgctggacgacgggatttacaggatacttcagcgtggattactgggtcgctcacaggtcggcgtgggggttttccaagatggagtatttcataccatgtggcacgtgacacggggcgcagtcctcatgtatcagggtaaaagattggagcctagttgggccagcgtgaagaaagacctgatctcctacgggggaggctggaggttccagggctcttggaataccggggaggaagttcaggtgattgcggtcgagcccggaaagaaccccaagaatgtgcaaacaactcccggtacctttaagacgcctgaaggcgaggtaggggctatcgccctcgatttcaagccaggaacatcgggcagccccattgtcaaccgagaaggtaaagtggttgggctgtacggaaatggcgtggtcactacctcaggcacatatgtgtccgcaatcgcccaggctaagaccagtcaggaggggcctcttccggagatagaagaggaagtttttaaaaagcggaacctgactatcatggacttgcacccaggatctggtaaaacccgcagatacctacccgccattgtgagggaggcaatcaagcggaagctgcgaacactcattttagctcctacgagagtcgtggccagcgaaatggcggaggccctgaaaggcatgccaatccgctatcaaactaccgcagtaaagtccgagcatacagggagggaaatagtggatcttatgtgccacgctaccttcactatgcgtctgctctcacccgttcgggtccctaattacaacatgattatcatggacgaggcccattttacagatccggcttctatcgcagccagaggatatattagcaccagggtgggcatgggtgaagccgctgcgatcttcatgacggcaactcccccagggagtgtggaggcctttcctcagtccaatgctgtcatacaggacgaagaacgcgatattcccgagcgaagctggaactctggatacgactggatcacagatttcccaggcaaaaccgtatggtttgtgccttcaattaagtccggcaatgacatcgccaactgtttgaggaagaatgggaagcgggttatacagctgagtaggaagaccttcgacactgaatatcagaagacgcgcaacaacgattgggactacgtggtcaccacagatattagcgagatgggagcaaatttccgtgccgacagagtgatcgatccccggaggtgcctcaagccagttatcctgaaagacggtccggaacgcgtgattcttgctggccctatgcccgtcactgtggcgtcggccgcacagcgaagagggcggatcggaaggaaccagaataaggagggcgatcagtacgtatatatgggtcaaccactaaacaatgacgaggatcacgctcattggacggaagccaaaatgctgttggacaacattaatacccccgaggggataatccctgcattatttgaaccagagcgcgaaaagtctgccgctattgatggcgagtacagactgaggggagaggcccggaagacattcgtggaactcatgcgtcgcggcgacctgcccgtttggctttcctataaagtcgcgagcgaggggtttcagtactcagatcgaagatggtgcttcgacggagaaaggaacaatcaggtgctggaggaaaacatggacgtggagatctggactaaggagggtgaacggaaaaagctccgccctagatggttggatgcaaggacctatagtgacccgctggccctacgggagtttaaagagttcgctgccggccgaagatctgtctccggggatctgatcctcgagattggaaaacttccacagcacctgacattacgcgctcaaaatgcattggacaacctggttatgctccacaatagcgaacagggcggtaaagcctacaggcatgctatggaggagctgcccgataccatagaaactcttatgctgctcgccttgatcgcagtgctgacagggggagtaaccttatttttcctatcaggaaagggcctggggaagacaagtattggactcctttgtgtgatggcgagctccgccctgttgtggatggctaacgtcgagcctcactggatcgccgcatctattatcctggaatttttcctcatggtgctgcttatacccgagccagaccggcagcgtactcctcaggataatcaactcgcttatgttgtgatcggtctgttgtttatgattctgaccgtcgccgcaaacgagatgggcttactagaaacaaccaaaaaggacctggggatcggacatgtagccgctgagaaccagcaccacgcgactatgctcgatgtggaccttagacccgccagcgcatggacactgtacgctgttgccacgaccgtgattactccaatgatgaggcatacaatcgaaaataccaccgccaacatatccttgacagcaattgctaatcaggccgcgatcctgatgggcctcgataaaggttggcctatttcaaagatggacatcggggtcccgctgcttgctttaggctgctactctcaagtgaaccccctgactctcacggccgcagtcttgatgctggtggcccactatgctataatcggaccaggcctacaggcaaaagccacccgcgaggcgcagaagcggacagctgccgggattatgaagaatcctactgttgatggaatcgtggcaattgacctggaccccgtagtgtacgatgccaaattcgaaaagcagctcggccaaatcatgcttctgatattgtgtaccagtcagattctgctcatgcgaacaacctgggctctgtgcgagtcgatcactttagccacgggtccacttacaaccctgtgggaggggagccctggaaaattttggaacactaccatcgcagtctccatggctaatattttcagaggctcttatctcgccggtgcgggcctagccttctcactgatgaaaagcctagggggaggcaggcgcgggacaggagcacagggcgaaactctgggtgagaaatggaagcggcagctcaaccaactttccaagagtgaatttaatacctacaaaagatctgggatcatggaggttgaccgtagcgaagctaaggagggactgaaaaggggcgagacaacgaagcatgccgtgtcacggggtaccgcaaaattgcgctggttcgtcgaacgaaacctggtgaagcccgagggcaaggtaatagatctcgggtgtggaagaggcgggtggtcctattactgcgctggactaaagaaggtgactgaagttaaaggctatacaaagggtgggccgggacacgaggaaccaattcctatggccacctacggctggaatctggtgaaactttacagtggcaaggacgtctttttcactcccccagagaaatgtgatacactgctatgcgacatcggggagagctctcccaaccctaccattgaagagggaaggacgctccgggtgctgaagatggtcgaaccgtggttgcgcggtaatcagttttgtatcaagatactgaacccctatatgccatccgtggttgagaccctcgagcagatgcagagaaaacatggcgggatgcttgtaaggaatcctctgtcacgaaacagcacacacgaaatgtactgggtgtcgtgcggaactggcaatatcgtctctgccgtgaacatgaccagtcggatgttactgaaccgtttcacaatgactcacagaaagcccacctatgagcgcgatgttgacttgggtgcggggacaaggcatgtggctgtcgaacctgaggtggcaaatctcgatattatcggacaacggattgaaaacatcaaaaatgagcacaagtccacctggcattacgacgaggataacccatataaaacttgggcctaccacggcagctatgaagtaaagccctcaggctccgcttctagcatggtgaatggggttgtcagactgctaacgaagccttgggacgtgattccaatggtgacacagatcgccatgaccgacactaccccctttggacagcaacgcgtcttcaaagagaaggttgatacaaggacgccgcgagcaaaacggggtaccgcccagataatggaagtgactgctaagtggctttggggctttctgagtagaaacaaaaagcctaggatttgtacacgcgaggagttcacccgtaaggtacggtccaatgcggccatcggggcagtgtttgtcgacgagaaccagtggaatagcgctaaagaggccgtggaagatgagagattctgggacctcgttcacagggaacgcgagctgcataagcagggaaaatgcgcaacttgcgtgtacaacatgatgggcaagcgagagaaaaagttgggtgagtttgggaaggccaaaggatctcgggctatctggtacatgtggctgggcgccagattcctcgagttcgaagcgcttggctttatgaatgaggatcactggttctcaagggaaaacagtttttccggggtcgagggagagggtctgcataagttaggctatattctgcgcgacataagcaaaatcccagggggaaatatgtacgcagatgacacagccggctgggataccagaattacagaagacgatttgcaaaacgaggctaagatcactgacattatggaacccgagcacgccctcctggcaacctctatcttcaaactaacgtatcagaataaggtggtacgggttcagaggcctgctaaaaacggtaccgtgatggatgtcatatcgcgtcgagaccagcgcgggtcaggacaagtgggcacatacggccttaacacttttaccaatatggaagtgcagctgatcagacagatggagagcgaggggattttcctcccatccgaactggagacacccaacttggccgaacgggtcttaaattggctggagaagcatggaactgaaaggctcaagcgcatggctatcagtggtgacgattgtgttgtgaaaccggtagacgatagatttgccaccgcacttattgcgctgaacgacatgggcaaggtgcggaaagatatccctcagtgggagccctctaaggggtggaatgactggcaacaggtcccattctgcagccaccactttcatcagctaataatgaaagatggaagggagattgtggttccttgtcgaaaccaggacgaactggtgggccgtgccagagtctcccaaggtgctgggtggtcactccgcgagacggcctgcttgggaaagagttatgcacagatgtggcagctgatgtacttccaccggagggatcttagactggctgccaatgcaatctgttctgccgtgcccgtagactgggttccaacaagccgcaccacttggtccatccatgcgcaccaccaatggatgacaaccgaagatatgctctcagtgtggaaccgggtctggattgaggaaaatccctggatggaggacaagactcatgtgagctcttgggaggaagttccttatttaggcaaaagggaggaccagtggtgcggctccctgatagggttgaccgctcgagccacatgggcaacgaacatccaggtggccattaatcaggtcagacggctgatcggaaacgaaaattacctcgattacatgaccagtatgaagaggtttaaaaacgagagcgacccagagggtgctctttggtga

SEQ ID NO: 13474 - RNA, 9879 nt, synthetic construct
  misc_feature 1..9879: note = derived and/or modified CDS sequence (opt3) from DENV-1__FJ390379__SS-prME
  source 1..9879: mol_type = other RNA
agcgtgaccatgctgctcatgcttctgcccacagccttggctttccacttaactacgagaggcggggagcctcatatgatcgtctccaagcaggaaaggggaaaatctctgctatttaagacctcagcaggtattaacatgtgcacactcatagccatggacctgggcgagctttgtgaagatactatgacctacaaatgcccacggatcacagaggcggaaccggacgatgttgactgttggtgcaatgctaccgatacttgggtgacatatgggacctgtagtcaaacgggagagcaccgccgagacaagcgtagcgtagccctggcaccccatgtgggcttgggtctcgagactagaaccgaaacatggatgtcctctgagggggcctggaaacagattcagaaggtcgaaacttgggctctgaggcaccctggattcaccgtgacagcactgtttctcgcccatgctatcggcacctcgattacgcagaagggcatcatattcatcttactgatgcttgttactccatcaatggccatgcggtgcgtggggattggaaaccgcgattttgtcgagggtttgagcggcgcgacatgggtggacgtagttctggagcacgggagttgtgtgaccactatggcaaaagataagcccacactagacatcgaactcctgaaaaccgaggtcacgaatcctgccgtgcttagaaagctgtgcattgaagctaaaatctccaacaccacaactgattctaggtgtccaacccaaggagaggccacattggtggaagagcaggacagcaatttcgtctgccggcgcacttttgttgatcgaggctggggtaacgggtgtggactcttcggcaagggctccctgttaacctgcgcaaagtttaaatgcgtgacaaagctggaggggaaaatagtacagtacgaaaatctcaagtattcagtgattgtcaccgtgcacactggagaccagcatcaagttggtaacgagacgacagaacacggcaccatcgctactattaccccccaggcccctacaagtgagatccagcttaccgactacggggcgctgactttggattgtagcccaagaacaggactagacttcaatgaaatggtgctgctcacgatgaaagagaagtcttggctggtccataaacagtggtttcttgatctgccgttgccctggacctccggcgcctcaactagccaagagacatggaacaggcaggacctcctggtgaccttcaagacagcacacgctaagaaacaggaagtagttgtgttaggtagtcaagagggggccatgcacactgctctgaccggcgccacggaaatccagacctctggaacaactaccatttttgcaggccatctaaagtgccggctcaaaatggataagctgacacttaaagggatgtcctatgtcatgtgtactggaagcttcaagttggagaaggaagtggccgagacccagcacggtacggtcctggtgcaggttaaatacgagggcacagacgctccttgcaagataccattctcggcgcaagatgaaaaaggggtgacccagaatggacgtctcatcactgcaaaccccattgtaacagacaaggagaaacctgtcaatatcgaaaccgagccaccctttggcgagtcttatatagtggttggtgccggggaaaaggctctgaagctttcctggttcaaaaagggctcaagtattggaaaaatgtttgaggccactgcacgcggcgccagaaggatggctatcctgggggataccgcctgggacttcggaagcatcggtggcgtgtttacatccgtcgggaagttggtgcatcaggtattcggagcagcgtacggcgtgctcttttctggtgttagctggacgatgaaaattgggatcggcattctgttaacctggctgggactaaactcacggagtacttccctcagcatgacatgtatagctgtcggcatggtgaccctgtaccttggggtgatggtccaggccgattctggatgcgttatcaattggaagggccgagaattgaagtgtggttcagggattttcgtgacaaacgaggtgcacacttggaccgaacaatataaatttcaggcagacagtccgaagcgcctgagcgccgctatcggaaaagcctgggaggagggcgtatgcggtatcagatccgcaacgaggctcgaaaacattatgtggaagcagatatctaatgagctgaaccatatcttactggaaaatgacatgaaattcacagtcgtggttggcgatgctaacgggattcttgcccagggacggaagatgatccgccctcaacccatggagcacagatactcgtggaaaagctggggcaaggcgaagattatcggggccgacatacagaattccacctttatcattgatggaccagacactcctgaatgtcccgatgaccagagggcttggaacatctgggaggtggaggattatggcttcggtatttttaccacaaatatctggttgaaactccgtgactcatacactcagatgtgcgatcaccggctgatgagtgcagccataaaggactctaaagctgtccatgccgatatggggtattggattgaaagcgagaagaacgaaacctggaaactagcacgagcgtccttcatcgaggtgaagacatgtatttggccaaagtcacacacgctgtggagcaatggagttctcgaatctgagatgatcatacccaaaatctacggcggtcctatttcccaacataactatagaccaggctacttcacccagactgccgggccgtggcacctgggaaagcttgagttggactttgatctgtgcgaaggcacaaccgtggtagtcgacgagcactgcgggaataggggacccagtttacgcactacaaccgtgacgggcaaaatcattcatgaatggtgttgccggagctgtactctccctccactgagattcaggggtgaggacgggtgctggtacggaatggagatccgccccgtgaaggaaaaagaggaaaaccttgtccgatctatggtttccgctggctcaggtgaggtggatagttttagcctgggcatattgtgtgtatcgattatgatcgaagaggtgatgcggtcccgttggtctagaaagatgctcatgaccgggacactggccgtcttcctactgctcatcatgggacagctgacctggaatgaccttattaggttgtgcatcatggtgggcgcaaacgctagcgatcgcatggggatgggaactacatatctggccttaatggcaacctttaagatgcggcctatgttcgccgttggcctcctgtttagaaggcttacatcacgagaggtgctgctactcactattggtctgagtttggtcgcttccgtggaactgccaaattctttagaggaactcggggacggactggcgatgggcataatgatgcttaaactgttgaccgagttccaaccccaccagctctggacgacactgctaagcctgacctttatcaagactaccctttccctcgattacgcctggcgcacaatggcaatggttctgtcaattgtgagcttgttcccgctgtgtttaagtactacctctcagaaaacgacatggctccctgtcctgcttggctcctttgggtgcaagccactgaccatgttcttgatcactgaaaacaaaatttggggacggaagagctggcccctcaacgagggtatcatggctataggcatcgtatcgattctgctatcatctctgcttaagaatgacgtgcctctcgccgggcccctgatcgccggaggcatgttgattgcttgttatgttatcagtggttccagcgcagatttatctctggagaaagccgcggaagtgagctgggaggaagaggctgaacattccgggacatcacacaacatactcgtcgaggtgcaggacgatggaaccatgaagattaaagacgaggaaagagatgacactctgacaatccttctgaaggccaccttgctagcaatcagtggcgtatacccaatgagcattcctgccacgctgtttgtgtggtatttctggcaaaaaaagaaacagaggtctggcgtcctctgggatactccctccccaccggaggttgaacgtgctgtgctggacgacgggatataccgcatccttcagcggggattactgggtagatcacaggtgggcgtcggggtgttccaagatggagtttttcataccatgtggcacgtaacaaggggcgcagtgctcatgtatcagggtaagcgattggagcctagttgggccagcgtcaagaaagacctgatttcctacgggggaggctggcggttccagggctcttggaataccggggaggaagtgcaggttatcgcggtggagcccggaaagaacccaaaaaatgtccaaacaactcccggtacctttaagacgcctgaaggcgaggtgggggctattgccctcgatttcaaaccaggaacatcgggcagccccatcgtaaaccgcgaaggtaagatagtcgggctgtacggaaatggcgtggttactacctcaggcacatatgtgtccgcaatcgcccaggctaagaccagtcaggaggggcctcttccggagattgaagaggaagtctttaaaaagagaaacctgactatcatggacttgcacccaggatctggtaaaaccaggcggtacctacccgccattgtgcgagaggcaatcaagagaaaactgcgcacactcatattagctcctacgagggttgtggccagcgaaatggcggaggccctgaagggcatgccaattcgttatcaaactaccgcagtcaagtccgagcatacagggcgggaaatcgtggatcttatgtgccacgctaccttcactatgagactgctctcacccgtaagggtgcctaattacaacatgatcattatggacgaggcccattttacagatccggcttctatcgcagcccgcggatatataagcacccgagttggcatgggtgaagccgctgcgattttcatgacggcaactcccccagggagtgtcgaggcctttcctcagtccaatgctgtgatccaggacgaagagagagatattcccgagcggagctggaactctggatacgactggatcacagatttcccaggcaaaaccgtgtggtttgtcccttcaataaagtccggcaatgacattgccaactgtttgaggaaaaatgggaagcgcgtaatccagctgagtcgtaaaaccttcgacactgaatatcaaaagacaagaaacaacgattgggactacgtggttaccacagatatcagcgagatgggagcaaatttccgggccgacagggtgattgatccccgccgatgcctcaagccagtcatcctgaaagacggtccggaaagagtgattcttgctggccctatgcccgttactgtggcgtcggccgcacagcggagggggcgcataggaagaaaccagaataaggagggcgatcagtacgtctatatgggtcaaccactaaacaatgacgaggatcacgctcattggacggaagccaaaatgctgttggacaacatcaatacccccgaggggattatccctgcattatttgaaccagagagggaaaagtctgccgctatcgatggcgagtaccggctgcgtggagaggcccgcaaaacattcgtggaactcatgcgaagaggcgacctgcccgtatggctttcctataaggtggcgagcgaggggtttcagtactcagataggcggtggtgcttcgacggagaacgcaacaatcaggttctggaggaaaacatggacgtcgagatttggactaaggagggtgaaagaaaaaagctcaggcctcggtggttggatgcacgaacctatagtgacccgctggccctaagagagtttaaagaattcgctgccggccgcaggtctgtgtccggggatctgatactcgagatcggaaagcttccacagcacctgacattacgggctcaaaatgcattggacaacctggtgatgctccacaatagcgaacagggcggtaaagcctaccgtcatgctatggaggagctgcccgataccattgaaactcttatgctgctcgccttgatcgcagtcctgacggggggcgttaccttatttttcctatcaggaaagggcctggggaaaacaagtattggactcctttgtgtgatggcgagctccgccctgttgtggatggctaacgtagagcctcactggatcgccgcatctataatcctggaatttttcctcatggtgctgcttattcccgagccagacagacagaggactcctcaggataatcaactcgcttatgtcgtgatcggtctgttgtttatgattctgaccgttgccgcaaacgagatgggcttactagaaacaaccaagaaggacctggggatcggacatgtggccgctgagaaccagcaccacgcgactatgctcgatgtcgaccttcgccccgccagcgcatggacactgtacgctgtagccacgaccgtgataactccaatgatgcggcatacaattgaaaataccaccgccaacatctccttgacagcaattgctaatcaggccgcgatcctgatgggcctcgataaaggttggcctatatcaaagatggacatcggggttccgctgcttgctttaggctgctactctcaagtgaaccccctgactctcacggccgcagtcttgatgctggtggcccactatgctattatcggaccaggcctacaggcaaaagccacccgagaggcgcagaagagaacagctgccgggattatgaaaaatcctactgtcgatggaatcgtggcaatagacctggaccccgttgtgtacgatgccaagttcgaaaagcagctcggccaaattatgcttctgatcttgtgtaccagtcagatcctgctcatgaggacaacctgggctctgtgcgagtcgattactttagccacgggtccacttacaaccctgtgggaggggagccctggaaaattttggaacactaccatcgcagtatccatggctaatatattccgcggctcttatctcgccggtgcgggcctagccttctcactgatgaagagcttggggggaggccggagagggacaggagcacagggcgaaactctgggtgagaaatggaagcgtcagctcaaccaactttccaaaagtgaatttaatacctacaagaggtctgggattatggaggtggaccggagcgaagctaaggagggactgaaacgcggcgagacaacgaagcatgccgtctcacgaggtaccgcaaaattgagatggttcgttgaaaggaacctggtgaagcccgagggcaaagtcatcgatctcgggtgtggacggggcgggtggtcctattactgcgctggattaaagaaggtgactgaagtaaaaggctatacaaagggtgggccgggacacgaggaaccagtgcctatggccacctacggctggaatctggttaaactttacagtggcaaggacgtgtttttcactcccccagagaaatgtgatacactgctatgcgacattggggagagctctcccaaccctaccatcgaagagggacgcacgctcagagtcctgaagatggtggaaccgtggttgaggggtaatcagttttgtataaaaatcctgaacccctatatgccatccgtcgtggagaccctcgagcagatgcagcgaaagcatggcgggatgcttgttcggaatcctctgtcacgtaacagcacacacgaaatgtactgggtatcgtgcggaactggcaatattgtgtctgccgtcaacatgaccagtagaatgttactgaaccgcttcacaatgactcacaggaagcccacctatgagcgggatgtggacttgggtgcggggacaagacatgttgctgtggaacctgaggtcgcaaatctcgatatcattggacaacgcatcgaaaacattaaaaatgagcacaagtccacctggcattacgacgaggataacccatataaaacttgggcctaccacggcagctatgaagtgaagccctcaggctccgcttctagcatggtaaatggggtggttaggctgctaacgaaaccttgggacgtcatcccaatggtgacacagatagccatgaccgacactaccccctttggacagcaacgagtgttcaaggagaaggtcgatacacggacgccgagagcaaaaaggggtaccgcccagattatggaagttactgctaagtggctttggggctttctgagtcgcaacaaaaagcctcgtatctgtacacgggaggaattcaccagaaaagtgaggtccaatgcggccatcggggcagtatttgtggacgagaaccagtggaatagcgctaaggaggccgtcgaagatgagcgcttctgggacctcgtgcaccgagaacgggagctgcataagcagggaaaatgcgcaacttgcgtttacaacatgatgggcaagagagaaaaaaagttgggtgagtttgggaaagccaagggatctagggctatttggtacatgtggctgggcgcccgcttcctcgagttcgaagcgcttggctttatgaatgaggatcactggttctcaagagaaaacagtttttccggggtggagggagagggtctgcataagttaggctatatactgcgggacatcagcaaaattccagggggaaatatgtacgcagatgacacagccggctgggataccaggatcacagaagacgatttgcaaaacgaggctaagattactgacatcatggaacccgagcacgccctcctggcaacctctatattcaaactaacgtatcagaataaggtcgtgcgtgtacagcgacctgctaaaaacggtaccgttatggatgtgatctcgcgcagagaccagcgggggtcaggacaagtcggcacatacggccttaacacttttaccaatatggaagtgcagctgattaggcagatggagagcgaggggatcttcctcccatccgaactggagacacccaacttggccgaacgcgtgttagactggctggagaagcatggaactgaaagactcaaacggatggctattagtggtgatgactgtgtcgttaagccggtggatgacaggtttgccaccgcacttatcgcgctgaatgatatgggcaaggtacgaaaagacatacctcagtgggagccctctaaggggtggaacgattggcaacaggtgccattctgcagccaccactttcatcagctaattatgaaagacggacgtgagatcgtcgtgccttgtagaaatcaggatgaactggttggccgcgcccgggtgtcccaaggtgctgggtggtcactcagggagacggcctgcttgggaaagagttatgcacagatgtggcagctgatgtacttccacagacgcgaccttcggctggctgccaacgcaatctgttctgccgtccccgtggattgggtaccaacaagcaggaccacttggtccattcatgcgcaccaccaatggatgacaaccgaagacatgctctcagtttggaatcgagtgtggatagaggaaaacccctggatggaggacaaaactcatgtcagctcttgggaggaagtgccttatttaggcaagagagaggatcagtggtgcggctccctgatcgggttgaccgctcgggccacatgggcaacgaatattcaggttgccatcaaccaggtgaggcgcctgattggaaatgaaaactacctcgactacatgaccagtatgaagcgttttaaaaatgagagcgatccagagggtgctctttggtga

SEQ ID NO: 13475 - RNA, 9879 nt, synthetic construct
  misc_feature 1..9879: note = derived and/or modified CDS sequence (opt3) from DENV-1__FJ390380__SS-prME
  source 1..9879: mol_type = other RNA
agcgtgaccatgctgctcatgcttctgcccaccgccttggctttccacttaactacgagaggaggggagcctcatatgatcgtctccaagcaggaaaggggaaagtctctgctatttaagacctcagcaggtattaacatgtgcacactcatagccatggacctgggcgagctttgtgaagatactatgacctacaagtgcccacggatcacagaggcggaaccggacgatgttgactgttggtgcaatgctaccgatacttgggtgacatatgggacctgtagtcagacgggagagcaccgccgagacaagcgtagcgtagccctggcaccccatgtgggcttgggtctcgagactagaaccgaaacatggatgtcctctgagggggcctggaaacagattcagaaggtcgaaacttgggctctgaggcaccctggattcaccgtgacagcactgtttctcgcccatgctatcggcacctcgattacgcagaagggcatcatattcatcttactgatgcttgttactccatcaatggccatgcggtgcgtggggattggaaaccgcgattttgtcgagggtttgagcggcgcgacatgggtggacgtagttctggagcacgggagttgtgtgaccactatggcaaaagataagcccacactagacatcgaactcctgaaaaccgaggtcacgaatcctgccgtgcttagaaagctgtgcattgaagctaaaatctccaacaccacaactgattctaggtgtccaacccaaggagaggccacattggtggaagaacaggacagcaatttcgtctgccggcgcacttttgttgatcgaggctggggtaacgggtgtggactcttcggcaagggctccctgttaacctgcgcaaagtttaaatgcgtgacaaagctggaggggaaaatagtacagtacgaaaatctcaagtattcagtgattgtcaccgtgcacactggagaccagcatcaagttggtaacgagacgacagaacacggcaccatcgctactattacaccccaggcccctacaagtgagatccagcttaccgactacggggcgctgactttggattgtagcccaagaacaggactagacttcaatgaaatggtgctgctcacgatgaaagagaagtcttggctggtccataaacagtggtttcttgatctgccgttgccctggacctccggcgcctcaactagccaagagacatggaacaggcaggacctcctggtgaccttcaagacagcacacgctaagaaacaggaagtagttgtgttaggtagtcaagagggggccatgcacactgctctgaccggcgccacggaaatccagacctctggaacaactaccatttttgcaggccatctaaagtgccggctcaaaatggataagctgacacttaaagggatgtcctatgtcatgtgtactggcagcttcaagttggagaaggaagtggccgagacccagcacggtacggtcctggtgcaggttaaatacgagggcacagacgctccttgcaagataccattctcggcgcaagatgaaaaaggggtgacccagaatggacgtctcatcactgcaaaccccattgtaacagacaaggagaaacctgtcaatatcgaaaccgagccaccctttggcgagtcttatatagtggttggtgccggggaaaaggctctgaaactttcctggttcaaaaagggctcaagtattggaaaaatgtttgaggccactgcacgcggcgccagaaggatggctatcctgggggataccgcctgggacttcggaagcatcggtggcgtgtttacatccgtcgggaagttggtgcatcaggtattcggagcagcgtacggcgtgctcttttctggtgttagctggacgatgaaaattgggatcggcattctgttaacctggctgggactaaactcacggagtacttccctcagcatgacatgtatagctgtcggcatggtgaccctgtaccttggggtgatggtccaggccgattctggatgcgttatcaattggaagggccgagaattgaagtgtggttcagggattttcgtgacaaacgaggtgcacacttggaccgaacaatataaatttcaggcagacagtccgaagcgcctgagcgccgctatcggaaaagcctgggaggagggcgtatgcggtatcagatccgcaacgaggctcgaaaacattatgtggaagcagatatctaatgagctgaaccatatcttactggaaaatgacatgaaattcacagtcgtggttggcgatgctaacgggattcttgcccagggaaagaaaatgatccggcctcaacccatggagcaccgctactcgtggaaaagctggggcaaggcgaagattatcggggccgacatacaaaattccacctttatcattgatggaccagacactcctgaatgtcccgatgaccagagagcttggaacatctgggaggtggaggattatggcttcggtatttttaccacaaatatctggttgaagctcagggactcatacactcagatgtgcgatcaccgtctgatgagtgcagccataaaagactctaaggctgtccatgccgatatggggtattggattgaaagcgagaaaaacgaaacctggaagctagcacgggcgtccttcatcgaggtgaagacatgtatttggccaaaatcacacacgctgtggagcaatggagttctcgaatctgagatgatcatacccaagatctacggcggtcctatttcccaacataactatcgaccaggctacttcacccagactgccgggccgtggcacctgggaaaacttgagttggactttgaactgtgcgagggcacaaccgtggtagtcgatgaacactgcgggaatagaggacccagtttaaggactacaaccgtgacgggcaagatcattcatgagtggtgttgccgcagctgtactctccctccactgcggttcagaggtgaggacgggtgctggtacggaatggaaatcaggcccgtgaaagagaaggaagagaaccttgtccgctctatggtttccgctggctcaggtgaagtggacagttttagcctgggcatattgtgtgtatcgattatgatcgaggaggtgatgcgatcccggtggtctcgtaagatgctcatgaccgggacactggtcgtgttctttctactgatcatgggacagctcacctggaatgatctgattagactttgcatcatggttggcgccaacgcaagcgacaggatggggatgggaactacatatttggctctgatggccaccttcaaaatgcgccctatgtttgcagtgggcttactcttccggagactgacatcaagggaagtccttctgctaactattggtctcagtctggtggcctccgttgagttgccaaattctctggaagagttaggggatggactcgctatgggcataatgatgctgaaacttctgaccgaatttcaaccccaccagttgtggacgacactcctgagcctaaccttcatcaaaactaccctgtcccttgactacgcgtggcgaacaatggccatggtgctctcaattgtcagcctgtttccgttgtgtctgagtactacctctcagaagacgacatggttacctgtactcctgggctccttcgggtgcaaaccacttaccatgtttctgatcactgagaacaagatttggggacgcaagagctggcccttgaacgagggtatcatggcaataggcatcgtgtcgattctcctgtcatctctactgaaaaatgatgttcctcttgctgggcccctcatcgccggaggcatgctgattgcctgttatgtgatcagtggttccagcgctgacttgtctttagaaaaggcagccgaggtcagctgggaagaggaagcggagcattccgggacatcacacaacatactggtggaggtacaggatgacggaaccatgaaaattaaggatgaggaacgggacgatactctcacaatcctgcttaaagctaccctgttggccgtgagtggcgtctacccaatgagcatccctgcaacgttcttcgtttggtatttttggcaaaagaaaaagcagagatctggcgtgctatgggacactccctccccaccggaagtggagagggccgtcctggatgacgggatttaccgtatactccagcgcggactgcttggtcggtcacaggtgggcgttggggtattccaagacggagtgtttcataccatgtggcacgtcacaagaggcgctgtgttaatgtatcagggtaagaggctggagcctagttgggcaagcgttaaaaaggatctcatctcctacgggggaggctggcgattccagggctcttggaataccggggaagaggtgcaggtcattgccgtggaacccggcaagaacccaaagaatgtacaaacaactcccggtacctttaaaacgcctgagggcgaagtcggggcgatcgctttggacttcaagccaggaacatcgggcagccccattgtgaaccgggagggtaagatcgttgggctgtacggaaatggcgtggtcactacctcaggcacatatgtgtccgccatagcacaggccaaaaccagtcaggaggggcctctcccggaaatcgaggaagaggtttttaagaaacgcaacctgactattatggatcttcacccaggatctggtaagaccagaaggtacctgcccgctatcgtgcgggaagccattaaacgaaagttgagaacactaatcctggcacctacgcgcgtcgtggctagcgagatggccgaggcgctcaagggcatgccaataaggtatcaaactaccgccgtaaaatccgaacatacagggcgtgagattgtggacttaatgtgccacgcaaccttcactatgcggctgctttcacccgttagagtccctaattacaacatgatcatcatggatgaagctcattttacagacccggcctctattgctgcaaggggatatatcagcacccgcgtgggcatgggtgaggccgccgctatattcatgacggcgactcccccagggagtgtggaagcatttcctcagtccaatgccgtcattcaggatgaggagcgagacatccccgaaagaagctggaactctggatacgattggattacagacttcccaggcaagaccgtatggttcgtgccttcaatcaaatccggcaatgatatagctaactgtctgcggaagaatgggaaaagggttattcagctcagtcgcaagacctttgacactgagtatcaaaagacacgtaacaacgactgggattacgtggtcaccacagacatcagcgaaatgggagccaatttcagagcagatcgggtgatcgaccccaggcgctgcttgaaaccagttattctgaaggatggtccggagcgagtgatcctcgccggccctatgcccgtcactgtggcttcggcggcccagagacgggggaggattggacgcaaccagaataaagagggcgaccagtacgtatatatgggtcaaccactgaacaatgatgaagaccacgcacattggacggaggctaagatgcttctagataacataaatacccccgaagggatcattcctgccctgtttgagccagaaagagagaaatctgcagccatcgacggcgagtacaggttgcggggagaagctcgtaagacattcgtggagttaatgcgccgaggcgatctgcccgtttggctctcctataaggtcgccagcgaagggtttcagtactcagacagaaggtggtgcttcgatggagagcggaacaatcaggtgctggaagagaacatggacgtggagatctggactaaagaaggtgagcgcaagaaacttagacctaggtggctggacgcgcggacctatagtgatccgctcgcattgcgagaatttaaggagttcgccgctggcagacgctctgtctccggggacctgattctagaaataggaaaactgccacagcacctcacacttagggcccaaaatgctctggataacttagttatgttgcacaatagcgagcagggcggtaaggcataccggcatgccatggaggaactgcccgacaccatcgagactctcatgctgcttgctctgattgccgtgctcaccgggggagtaacgttgtttttcctgtcaggaaaaggcttagggaagacaagtatcggactactgtgtgtgatggcaagctccgcgctcctttggatggccaacgtcgaacctcactggattgctgcctctatcatactggagtttttcttgatggtgctgctcatccccgagccagatcgtcagagaactcctcaggacaatcaactggcatatgttgtgattggtcttctctttatgatcctgaccgtcgctgccaacgaaatgggcttgctggagacaaccaagaaagatttagggattggacatgtagcagccgaaaaccagcaccacgctactatgctagacgtggatctgaggcccgcgagcgcctggacactctacgcagttgctacgaccgtgatcactccaatgatgcgccatacaatagagaataccaccgccaacatttcccttacagccatcgcaaatcaggctgccattctgatgggcttggacaagggttggcctatctcaaaaatggatataggggtcccgctgctcgcgctgggctgctactctcaagtgaacccccttactttaacggctgccgtcctgatgctcgtggcacactatgccatcattggaccaggcttgcaggctaaggcaacccgggaagcccagaaacgaacagcggctgggatcatgaagaatcctactgttgacggaattgtggccatcgatctggaccccgtagtgtacgacgcaaagttcgagaaacagctaggccaaataatgctgctcattctttgtaccagtcagatcctgttgatgagaacaacctgggccctgtgcgagtcgatcactctcgctacgggtccactgacaaccttatgggaagggagccctggaaagttctggaacactaccattgccgtctccatggcaaatatctttaggggctcttatcttgctggtgccggcctggcgttctcactcatgaaaagcctagggggaggccgccgggggacaggagcccagggcgagactctgggtgaaaagtggaaaagacagttgaaccaactgtccaagagtgagtttaatacctacaagcgttctgggataatggaagttgataggagcgaggcaaaagagggactcaagcggggcgaaacaacgaaacatgctgtgtcacgcggtaccgccaaacttcgatggttcgtcgagagaaacctggtgaaacccgaaggcaaggtaattgacttggggtgtggaaggggcgggtggtcctattactgcgcaggactgaagaaagtgactgaggttaagggctatacaaaaggtgggccgggacacgaggaaccaatccctatggctacctacggctggaatctcgtgaagttatacagtggcaaagatgtctttttcactcccccagagaagtgtgacacactgctttgcgatattggggaaagctctcccaaccctaccatcgaggaaggacggacgctgcgcgtgctaaaaatggtcgagccgtggctcagaggtaatcagttttgtataaagatcctgaacccctatatgccatccgtggttgagaccttggaacagatgcagaggaagcatggcgggatgctggtacgaaatcctctctcacggaacagcacacacgagatgtactgggtgtcgtgcggaactggcaatattgtctctgccgtgaacatgaccagtcgtatgcttctgaacagattcacaatgactcaccgcaaacccacctatgaaagggacgttgatttaggtgccgggacacggcatgtggcggtcgagcctgaagtggctaatctggacatcattggacaaagaatcgagaacattaagaatgagcacaaatccacctggcattacgatgaagacaacccatataagacttgggcataccacggcagctatgaggtaaaaccctcaggctccgcctctagcatggtgaatggggttgtccgcttgctcacgaagccttgggatgtgatcccaatggtgacacagatagctatgaccgacactaccccctttggacagcaaagggtcttcaaggaaaaagttgacacacgaacgccgcgggccaagagaggtaccgcacagattatggaggtgactgccaaatggctgtggggctttctaagtaggaacaagaaacctcgcatctgtacacgtgaagagttcacccggaaggtaagatccaatgctgcgatcggggccgtgtttgtcgatgagaaccagtggaatagcgcaaaggaagctgtggaggacgaaaggttctgggatcttgttcaccgcgagcgagaactgcataaacagggaaagtgcgccacttgcgtgtacaacatgatgggcaaacgggagaagaaactcggtgagttcgggaaggcaaagggatctagagccatttggtacatgtggctgggcgctaggtttttggagttcgaggccctgggctttatgaatgaagaccactggttctcacgcgagaacagtttttccggggtcgagggagaaggtctccataaacttggctatatactgagagatatcagcaagattccagggggaaatatgtacgcggacgatacagcaggctgggacacccggatcacagaggatgacttacaaaacgaagccaaaattactgatatcatggagcccgaacacgctctgttggccacctctatattcaagctcacgtatcagaataaagtggtaagggttcagcgtcctgcaaagaacggtaccgtgatggacgtcatctcgcgacgcgatcagagagggtcaggacaagtgggcacatacggcctgaacacttttaccaatatggaggtgcagctaattcggcagatggagagcgaagggatcttccttccatccgagctggaaacacccaacctcgctgagagggtcctgaattggttggaaaaacatggaactgagcgcttaaagagaatggccattagtggtgacgactgtgttgtgaagccggtagatgaccggtttgctaccgccctgatcgcactcaacgatatgggcaaagtgaggaaggacatacctcagtgggagccctctaaagggtggaatgattggcaacaggtcccattctgcagccaccactttcatcagcttattatgaaggacggacgagaaatcgtggttccttgtcgtaaccaggatgagctggtgggcagagcgcgcgtctcccaaggtgccgggtggtcactacgggaaacggcttgcctgggaaaaagttatgcccagatgtggcagctcatgtacttccacaggagagacttgcgcctggcagctaatgccatctgttctgcagtgcccgtagattgggttccaacaagccggaccacttggtccattcatgcccaccaccaatggatgacaaccgaggacatgctttcagtgtggaacagggtctggatagaagagaatccctggatggaggataagactcatgtgagctcttgggaagaggttccttatctgggcaagcgagaagaccagtggtgcggctccctcatcgggttaaccgcgagagctacatgggccacgaacattcaggtggcaatcaatcaggtccggaggctgattggaaacgagaattacttggactacatgaccagtatgaaacgctttaagaacgagagcgatccagaaggtgccctgtggtga

SEQ ID NO: 13476 - RNA, 9879 nt, synthetic construct
  misc_feature 1..9879: note = derived and/or modified CDS sequence (opt3) from DENV-1__FJ205874__SS-prME
  source 1..9879: mol_type = other RNA
agcgtgaccatgctgctcatgcttctgcccacagtcttggccttccacttaactacgagaggcggggagcctcatatgatcgttggaaagcaggaaaggggtaaatccctgctatttaagacctctgctggcgtgaacatgtgcacactcattgcaatggacctgggggagctttgtgaagatactatgacctacaaatgcccacggataacagaggccgaaccggacgatgtagactgttggtgcaatgcgaccgatacttgggtgacatatggaacctgttcacaaacgggcgagcaccgccgagacaagcgtagtgtcgctctggccccccatgtgggtttggggctcgagactagaaccgaaacatggatgagctccgagggagcatggaaacagatccagaaggttgaaacttgggccctgaggcaccctggcttcaccgtgattgcttttttcctggcacatgccatcggcacatctattacccagaaggggatcatatttatcctcttaatgctggtcacgccatcgatggctatgcggtgcgtgggaattggtaaccgcgatttcgtagagggcctttcaggggccacttgggttgacgtggtcttggagcacggaagctgtgtgacaaccatggcgaaaaataagcccactctggatatcgaactactcaaaacagaggtgaccaaccctgcagtcctgagaaagctttgcattgaagccaaaatcagtaatacgaccacagactccaggtgtccaactcaaggcgaggctaccctggttgaagagcaggatgccaactttgtgtgccggcgcacattcgtagaccgaggttgggggaatggatgtggcttgtttggcaaggggtctctcctgacttgcgcaaagttcaaatgcgtgaccaagttagagggaaaaatagtccagtacgaaaacctgaagtatagcgtgattgttacagtgcacaccggtgatcagcatcaagtcggcaatgagactacggaacacgggacaatcgctaccattactccccaggcccctacctccgagatccagctcacagactacggagcgcttaccctggactgttcaccaagaactggcttggattttaacgaaatggtgctactgacaatgaaagagaagagttggctcgtacataaacagtggttcctggaccttccgctgccctggacgagcggtgcctctacctcccaagagacttggaataggcaggatttgctcgttacatttaagaccgcacacgctaagaaacaggaagtggtcgtgctggggtcacaagagggcgccatgcacacagctttaactggagccaccgaaatccagacgagcggcaccacaactattttcgcagggcatctgaagtgccggctaaaaatggacaagctcaccctgaaaggaatgagttatgtcatgtgtacaggttctttcaagcttgagaaggaagtggccgagactcagcacggcaccgttttggtgcaggtaaaatacgaggggacggatgctccttgcaagataccactgtccacacaagacgaaaaaggagtcacccagaacggccgtctcatcactgcgaatcccattgtgacagataaggagaaacctgttaacatcgaaaccgagccaccctttggtgagagctatataattgtgggggcaggcgaaaaggccctgaagctttcgtggttcaaaaagggatcttccatcggcaaaatgtttgaggctactgcccgcggggcaagaaggatggccatcctgggagacaccgcttgggatttcggttcaattggcggggtctttacaagtgtgggaaagttggtacatcaggtgttcggcacggcctacggtgttctctttagcggggtctcctggaccatgaaaatcggcattggaatactgttaacttggctgggcctaaattctcggagcgcatcactcagtatgacatgtatcgcggtggggatggtgaccctgtaccttggagtcatggttcaggctgactccggctgcgtgattaactggaagggtcgagaattgaagtgtgggagcggaatcttcgtgacaaacgaggtacacacttggaccgaacaatataaatttcaggccgattctccgaagcgcctgtcagcagccatcggcaaagcttgggaggagggtgtctgcggcgtgagaagtgccacgaggctcgaaaatattatgtggaagcagataagcaacgagctgaatcatatcttactggaaaacgacatgaaattcacagttgtggtcggggacgcaaatggaattcttgctcagggcaagaaaatgatccggcctcaacccatggagcacaagtactcctggaagtcttgggggaaagccaagattatcggagcggatatacagaacaccacttttatcattgacggcccagatacccctgaatgtcccgacgatcagcgcgcctggaatatctgggaggtggaggactatggtttcgggatttttacaactaacatctggttgaaactcagagattcgtacacccagatgtgcgaccacaggctgatgagcgctgcaataaaggattccaaagccgttcatgctgacatgggatattggattgaatcagagaagaatgaaacatggcgtctagcccgggcaagtttcatcgaggtgaagacgtgtatttggccaaaatctcacaccctgtggagcaacggcgtactcgaatccgagatgatcatacccaagatctacggtggccctatttcacaacataattatcgaccagggtacttcactcagacagcgggaccgtggcacctgggcaaacttgagttggattttgacctgtgcgaagggaccactgtcgtggtggatgagcactgcggaaacagaggccccagcttaaggacaaccacggtcactggtaagatcattcatgaatggtgttgccgctcttgtaccctccctccactgcggttcagaggggaggacggatgctggtacggcatggagatcaggcccgttaaagaaaaggaggaaaatcttgtgcgctccatggtaagtgccggtagcggcgaggtggactctttttccctggggatattgtgtctctcaattatgatcgaagaggtcatgcgaagtcggtggagccgtaagatgctgatgacaggaaccctagctgtgttcctgctcctgatcatgggccagcttacttggaacgatttgattagactgtgcatcatggttggggccaatgcatcggacaggatgggaatgggcacaacctatttagctctcatggccacatttaaaatgcgccctatgttcgcagtgggtctgctttttcggagactgacttccagggaggtcctactcctgaccattgggttgtctctggtggccagcgttgaattaccaaactcactcgaggaactgggagatggccttgctatgggcataatgatgctgaagttgctcacggagttccaaccccaccagctgtggacaaccctactgagtcttacttttatcaaaaccacactctccctggactacgcgtggaagactatggccatggtgttgtctattgtcagcctgttcccgttatgtctctccaccacgtcacagaaaacaacctggctgcctgtacttctggggagctttggatgcaagccattgactatgttcctcatcacagaaaacaagatttggggtcgaaaaagttggcccctgaatgagggcatcatggcaatagggatcgtgtctattctactgtccagccttctcaagaacgatgttcctctggctggacccttgatcgccggcggtatgttaattgcctgttatgtgatctcggggtcatctgctgacctgagtctcgagaaagcagccgaagtctcctgggaggaagaggcggaacatagcggaacctctcacaatatactggtggaggtacaggatgacggcactatgaagattaaagatgaggaacgcgacgatacacttaccatcctgttgaaggctacgctactggccgtgagcggcgtctacccaatgtccatccctgcaactctctttgtttggtatttctggcaaaaaaagaagcagcggtcaggggtgctgtgggacacccccagtccaccggaggtggaaagagccgtccttgatgacggaatttacaggatattacagcgtggtctgctcggccgcagccaggtgggggttggagtattccaagacggcgtgtttcatacaatgtggcacgtcacccggggtgctgtgttgatgtatcaggggaaaagactggagccttcttgggcatccgttaagaaagatctcatctcatacggaggcggctggaggttccaggggagttggaacacaggagaggaagtgcaggtcattgccgtggagcccggtaagaatccaaaaaacgtacaaactacccccggcacgtttaagacacctgaaggggaggtcggagcggtggctctggacttcaagccaggcactagcggttcccccatcgttaatcgagaagggaaaattgtgggactttacggcaacggcgtcgtgaccacatctgggacctatgtttcggccatcgcacaggccaaggctagccaggagggacctctgccggagatagaagatgaggtgtttaaaaagcggaatttgactatcatggacctacacccaggttcaggcaaaacccgcagatacctgcccgccattgtcagggaagcaatcaagcggaagctccgaacattaattctggctcctacgagagtggtagcctccgagatggcggaagcccttaaagggatgccaatccgctatcaaactaccgcagtgaagagtgagcatacaggaagggagatagttgatctgatgtgccacgctaccttcactatgcgtctcttgtctcccgtccgggtgcctaactacaatatgattatcatggacgaagcccattttacagatccggctagcatcgcagccagaggctatatttccaccagggtgggtatgggggaggccgctgcgatcttcatgacggcaactcccccaggatcagtcgaagcctttcctcagtctaacgctgtaatacaggacgaggaacgcgatattcccgagcgaagctggagttccggctacgactggatcacagatttcccaggcaaaaccgtgtggtttgttcctagcattaagtctgggaatgacatcgccaactgtctgagaaaaaatggaaagcgggtgatacagctctcaaggaagaccttcgacactgagtatcaaaaaacaaagaacaacgattgggactacgtcgtgaccacagatatttccgaaatgggtgcaaatttccgcgccgaccgtgttatcgatcccagacggtgcctgaaaccagtgatccttaaggacggcccggagagggtcattctagctgggcctatgcccgtgactgtagcgagtgccgcacagcgccgaggaagaatcggccggaaccagaataaagaaggtgatcagtacgtgtatatggggcaaccactgaacaatgacgaggatcacgctcattggacggaggccaagatgttgttagacaacattaatacccccgaaggcataatccctgcactgtttgagccagaaagggagaagagcgccgctattgatggagaataccgcctcagaggcgaggccaggaaaacattcgttgagctgatgaagcggggggaccttcccgtctggctgtcgtataaagtggcgtctgaaggatttcagtactccgatcgtcgctggtgcttcgacggtgagcgaaacaatcaggtgctcgaagagaacatggacgtcgaaatctggactaaggagggcgagagaaaaaagttgaggcctcggtggctggatgcacgcacctatagcgacccgctagccctgagagaatttaaagagttcgctgccgggaggcggtcagttagtggagatctcatccttgaaattggcaagctgccacagcacttaacattgcgagctcaaaatgcactggacaacctcgtgatgctgcacaattctgagcagggtgggaaggcctacagacatgctatggaagagcttcccgataccatagagactctgatgctcttggccctgatcgcagtattaacgggcggagtgatgctatttttcctgtccggcaaagggctcggaaagaccagcattggtcttctgtgtgtcatggcgtcaagtgccttgctgtggatggctagcgtggaacctcactggatcgccgcatccattatcctcgagtttttcctgatggttcttctcatacccgaaccagaccgccagaggacacctcaggataaccaactggcttatgtggtcatcggcttgctgtttatgattttaactgtagccgcaaatgagatggggctactggagaccacaaaaaaggacctcggaatcggccatgtggccgctgaaaaccaccaccatgttaccatgcttgatgtggacctgcggcccgcgtctgcctggactttgtacgcagtcgctacaacggtgattaccccaatgatgcgtcacactatcgagaacacaaccgccaatataagcctgaccgccattgcaaaccaggctgccatcctcatgggtctggataaagggtggcctatttccaagatggacatcggcgtcccgcttttagcgctgggatgctactcacaggtgaatcccctcacattgactgctgccgttctgatgctagtggcacattatgccataatcggcccagggctgcaagctaaggcaacgagagaagcccagaaaaggaccgcggctggaattatgaagaaccctacagtagatggcatcgtggccattgacctcgaccccgtcgtttacgatgcaaaattcgagaagcagcttggtcagatcatgctgttgatactgtgtacttctcaaattctcctgatgcgcaccacatgggccttatgcgaaagtatcacccttgctactgggccactgacgacactctgggagggatcgcctggcaaattttggaataccactatcgccgtgagcatggcaaacattttccggggttcctatctagctggcgccgggctggcgttctctttgatgaagtcactgggaggcgggcgaagaggaaccggcgcccagggtgagacactcggggaaaagtggaaaaggcagcttaatcagctgagcaagtccgagtttaacacttacaaacgcagtggaatcatggaagtcgaccggtctgaggcaaaggaaggcttgaaaagaggtgagaccacaaagcacgctgtgagccgtggcacggccaagctgaggtggttcgtagagcggaatctcgtgaaacccgaagggaaggttatagatttaggatgtggccgcgggggatggtcatattactgcgcaggcctgaaaaaggtgaccgaggtcaaaggttatactaaggggggaccgggccatgaagagccaattcctatggctacatacggctggaaccttgtgaaactgcactccgggaaggacgtctttttcacccccccagaaaagtgtgatactctactctgcgacatcggagagagtagccccaatcctacaattgaggaaggtcgaaccctgagagtgttgaaaatggttgagccgtggctgaggggcaaccaattttgtatcaagatactcaatccctacatgccatctgtagtggaaacgcttgagcagatgcagcggcgccacgggggaatgctggtcagaaaccctttatccaggaattcaacccatgagatgtattgggtgagctgcggcacaggtaacatcgtttcggccgtgaatatgacttctcgaatgctgttgaaccggttcaccatggcccaccgtaaacccacatacgaaagagatgtcgacctcggggcgggaactcgccatgtggctgtagagcctgaagtggcaaacctgggcattatcggccagaggattgagaatatcaagaacgaacacaaaagtacctggcactatgatgaggacaatccatacaagacatgggcctatcatgggtcctacgaggttaagcccagcggatcagcttcctctatggtcaacggtgtggtgcggctacttaccaaaccttgggatgtcattccaatggttactcaaatcgccatgacggacacaaccccctttggccagcagagagtgttcaaggaaaaagtagacactcgcaccccgagggcaaagcgagggacagcccaaataatggaggtgacggctaaatggctgtgggattttctcagccggaataagaagcctagaatttgtaccagggaagagttcatccgcaaagtccgtagtaacgcggccatcggagcagtgtttgttgacgaaaatcagtggaactccgctaaggaggccgtggaggatgaacggttctgggacctggtccacagagagagggaattgcataaacagggcaagtgcgcaacttgcgtgtataatatgatgggtaaacgcgagaagaagctgggggaatttggaaaagccaagggcagccgagctatttggtacatgtggctcggcgcccggttccttgagttcgaggcgctggggtttatgaacgaagatcactggttctctagagagaattcattaagtggagtagaaggtgagggcctgcataaattggggtacatactcagggacatctccaagattccaggaggcaacatgtatgcagatgacacagccggttgggatacccgcatcactgaggacgatctgcagaatgaagctaaaattacagacatcatggagcccgaacacgccctacttgcaaccagcatatttaagctgacataccaaaacaaagttgtgagagtccagcggcctgctaagaatgggactgtgatggatgtgatctctaggcgtgaccagcgaggatcgggccaggtcggcacctatgggctcaacacgttcaccaacatggaggttcaactgattcgccagatggaatcagagggaatctttttgccaagcgagttagaaacaactaatctggccgagagagtgctcgactggcttgaaaagcacggtgtagagcggctgaaaaggatggctatttccggcgatgactgtgtggtcaagcccatcgatgaccgcttcgccaccgcactaatagcgctgaacgatatggggaaagtgagaaaggacattccgcagtgggaacctagtaaaggatggaatgattggcagcaagttcccttttgctctcatcacttccatcagctcatcatgaaggacggccgggagatcgtggtcccatgtaggaaccaggatgagttggtgggtcgagcccgtgtaagccagggggctggatggtccctgagagaaacagcctgccttggcaagtcatacgcacaaatgtggcagctgatgtattttcaccgccgggacctcaggttagctgccaatgcaatttgtagtgccgttcctgtggattgggtccccacttctagaaccacgtggagcatacacgcgcatcaccagtggatgacaaccgaggacatgctgtccgtgtggaaccgcgtttggatcgaagagaatccatggatggaagacaaaactcatgtgtcaagctgggaggaggtcccctacttgggcaagcgggaagatcaatggtgcgggtctctgattggactcacagctagggccacctgggcaactaacatccaggtggccattaatcaggtacgaagacttatcggtaacgagaattatctggactacatgacctccatgaaacggttcaagaacgaaagtgatcctgagggcgctctatggtga

SEQ ID NO: 13477 - RNA, 9879 nt, synthetic construct
  misc_feature 1..9879: note = derived and/or modified CDS sequence (opt3) from DENV-1__FJ205875__SS-prME
  source 1..9879: mol_type = other RNA
agcgtgaccatgctgctcatgcttctgcccacagccttggctttccacttaactacgagaggcggggagcctcatatgatcgtctccaagcaggaaaggggaaaatctctgctatttaagacctcagcaggtattaacatgtgcacactcatagccatggacctgggcgagctttgtgaagatactatgacctacaaatgcccacggatcacagaggcggaaccggacgatgttgactgttggtgcaatgctaccgatacttgggtgacatatgggacctgtagtcaaacgggagagcaccgccgagacaagcgtagcgtagccctggcaccccatgtgggcttgggtctcgagactagaaccgaaacatggatgtcctctgagggggcctggaaacagattcagaaggtcgaaacttgggctctgaggcaccctggattcaccgtgatcgcactgtttctcgcccatgctattggcacatcgatcacccagaagggcataatcttcattttactgatgcttgttacgccatcaatggccatgcggtgcgtggggatcggaaaccgcgattttgtcgagggtttgagcggcgcgacttgggtggacgtagttctggagcacgggagttgtgtgacaaccatggcaaaagataagcccactctagacattgaactcctgaaaacagaggtcaccaatcctgccatccttagaaagctgtgcatagaagctaaaatttccaacacgaccacagattctaggtgtccaactcaaggagaggccaccttggtggaagagcaggacgcaaatttcgtgtgccggcgcacatttgtcgatcgaggctggggtaacgggtgtggactcttcggcaagggcagcctgttaacttgcgctaagtttaaatgcgttaccaagctggaggggaaaatcgtgcagtacgaaaatctcaagtattccgtaattgtgacagtccacaccggagaccagcatcaagtgggtaacgagactacggaacacggcacaatcgccaccatcactccccaggcgcctacctcagagattcagcttacagactacggggccctgaccttggattgtagtccaagaactggactagacttcaatgaaatggttctgctcacaatgaaagagaagagctggctggtgcataaacagtggtttcttgatctgccgttgccctggacgtctggcgcatccacctcacaagagacttggaacaggcaggacctcctggtcacattcaagaccgctcacgccaagaaacaggaagtggtagttttaggtagccaagagggggctatgcacacagccctgactggcgcaaccgaaatacagacgagtggaaccacaactatctttgccggccatctaaagtgccggctcaaaatggataagctgacccttaaagggatgtcttatgtgatgtgtacaggatccttcaagttggagaaggaagtcgctgagactcagcacggtaccgtgctggtccaggtgaaatacgagggcacggacgcgccttgcaagattccattcagcacacaagatgaaaaaggggttacccagaatggacgtctcatcactgcaaaccccatagtgacagacaaggagaaacctgtaaatattgaaaccgagccaccctttggcgagtcgtatatcgtcgtgggtgccggggaaaaggctctgaagctttcttggttcaaaaagggctcctcaatcggaaaaatgtttgaggccactgcacgcggcgccagaaggatggctattctgggggataccgcctgggacttcggaagtatcggtggcgtttttacaagcgtggggaagttggtccatcaggtgttcggaacggcatacggcgtactcttttccggtgtgtcttggaccatgaaaattgggataggcatcctgttaacttggctgggactaaacagccggtcaacaagtctctccatgacctgtattgcggttggcatggtcacactgtaccttggggtgatggtgcaggctgatagcggatgcgtcatcaattggaagggccgagaattgaagtgtggttctgggatcttcgttactaacgaggtgcacacctggacggaacaatataaatttcaggccgactcaccgaagcgcctgagtgcagccattggaaaagcttgggaggagggcgtgtgcggtataagaagcgccacaaggctcgaaaacatcatgtggaagcagatttccaatgagctgaaccatatcttactggaaaatgacatgaaattcaccgtagtcgtgggcgatgcaaacgggattcttgctcagggaaagaaaatgatccggcctcaacccatggagcacaagtactcttggaagtcgtggggcaaagccaagataatcggggcggacattcagaatactacctttatcattgatggaccagacacacctgaatgtcccgatgaccagcgcgcctggaacatctgggaggttgaggattatggcttcggtatatttactaccaatatttggttgaaactcagagacagctacacacagatgtgcgatcacaggctgatgtccgctgcaatcaaggactcaaaagccgtgcatgctgatatggggtattggattgaaagtgagaagaacgaaacgtggaagctagcccgtgcatctttcatcgaggtcaaaacctgtatatggccaaagagccacactctgtggtccaatggagtgctcgaatcagagatgatcattcccaaaatctacggcggtcctattagccaacataactatcggccaggctacttcacacagaccgcggggccgtggcacctgggaaagcttgagttggactttgatctgtgcgaaggcactacagttgtggtagacgagcactgcgggaatcgaggaccctctttaagaaccacgactgtcaccggcaaaatcatacatgaatggtgttgcaggtcctgtacactccctccactgcgcttccggggtgaggacgggtgctggtacggaatggagattagacccgtgaaggaaaaggaggaaaaccttgtgaggagtatggtcagcgccggctctggtgaggttgattccttttcactgggcatcttgtgtgtgagtatcatgattgaagaggtaatgcgcagccgatggtcgaaaaagatgctcatgaccgggactctggctgtgttcctactgctcatcatgggacagctgacatggaatgaccttattcggttgtgcataatggtcggcgccaacgcatccgatcgtatggggatgggaaccacatatctggctttaatggccacttttaaaatgagacctatgttcgcagtgggcctcctgtttaggcgccttacctctcgggaggttctgctactcacgatcggtctgagcttggtggcctcagtcgaactgccaaatagtttagaggaactcggggacggactggctatgggcattatgatgcttaagctgttgacagagttccaaccccaccagctctggaccactctgctatccctgacctttatcaaaacaactctttctctcgattacgcgtggagaaccatggccatggtgctgagcattgtttccttgttcccgctgtgtttatcaacgacaagccagaagaccacttggctccctgtgctgcttggcagttttgggtgcaagccactgacaatgttcttgatcaccgaaaacaaaatatggggaaggaagtcttggcccctcaacgagggtatcatggcaattggcatcgtctccattctgctaagctcgctgcttaaaaatgacgtacctctcgctgggcccctgatcgccggaggcatgttgatagcctgttatgtgatttcaggttctagtgctgatttatccctggagaaggcagccgaagttagctgggaggaagaggcggaacattctgggactagccacaacatcctcgtggaggtccaggacgatggaacaatgaaaatcaaggacgaggaacgagatgacaccctgacgattcttctgaaagctactttgctagccgtgtccggcgtatacccaatgtcaatacctgcaaccctgtttgtgtggtatttctggcaaaagaagaaacagcgcagtggcgtcctctgggatacacccagcccaccggaggttgaacgggccgtgctggacgacgggatctacagaattcttcagaggggattactgggtcgttctcaggtgggcgtcggggtgttccaagatggagtttttcataccatgtggcacgtaacacgcggcgctgtgctcatgtatcagggtaagcggttggagccttcctgggcatcagtcaaaaaggacctgatcagttacgggggaggctggagattccagggcagctggtccactggggaggaagtgcaggttattgccgtggagcccggaaaaaatccaaagaacgtccaaaccacgcccggtacatttaagactcctgaaggcgaggtgggggcgatcgctctcgatttcaaaccaggaacctctggctcgcccatagtaaatagggaaggtaagatcgtcgggctgtacggaaacggcgtggttacaaccagcggcacttatgtgtcagccattgcacaggccaaaacctcccaggaggggcctcttccggagatcgaagacgaggtctttaagaaacgaaatctgacaattatggatttgcacccaggaagtggtaagacgcggcgctacctacccgctatcgtgagagaagccataaagaggaaactgcggactctcattttagcacctacccgagttgtggcttctgagatggccgaagcgctgaagggcatgccaatcagatatcaaacaaccgccgtcaaaagcgagcatactgggcgcgagatcgtggaccttatgtgccacgcaacattcaccatgaggctgctctcccccgtacgtgtgcctaactacaatatgattatcatggatgaagctcattttacggacccggcctcaatagctgcacggggatatatttctactagagttggcatgggtgaggccgccgctatcttcatgacagcgacccccccagggagcgtcgaagcatttcctcagagtaacgccgtgattcaggatgaggaaagggacatccccgagcgctcctggaatagcggatacgattggataaccgacttcccaggcaagactgtgtggtttgtcccttctattaaatcaggcaacgacatcgctaattgtttgcgaaagaacgggaagagagtaatccagctgtcccggaaaacattcgataccgagtatcaaaagacaaaaaataacgactgggattacgtggttactacggacattagtgaaatgggagccaacttcagggcagatcgcgtgatcgacccccgtagatgcctcaagccagtcattctgaaagatggtccggagcgggtgatacttgccggccctatgcccgttaccgtggctagcgcggcccagaggcgcgggcgaatcggaagaaatcagaacaaggaaggcgaccagtacgtctatatgggtcaaccactaaataacgatgaggaccacgcacattggacagaggctaagatgctgttggataatattaacactcccgaagggatcatccctgccttatttgagccagaacgggagaaatcggcagccattgacggcgaatacaggctgcgcggagaggctagaaagaccttcgtggagctcatgaggcggggcgatctgcccgtatggctttcttataaagtggcctccgaagggtttcagtacagcgaccgtcgctggtgcttcgacggagagcgaaataaccaggttctggaagagaatatggatgtcgaaatatggacaaaggagggtgagagaaaaaagctcaggcctcggtggttggacgcgcgcacctattcagatccgctggcactaagagaatttaaagagttcgccgctggcaggcggagtgtgtctggggacctgatcctcgaaattggaaagcttccacagcacctgactttacgagcccaaaacgctttggataatctggtgatgctccacaactccgagcagggcggtaaggcatacagacatgccatggaagagctgcccgacacgatcgagacccttatgctgctcgctttgattgccgtcctgacagggggcgttactttatttttcctaagcggaaaaggcctggggaagacctcaatcggactcctttgtgtgatggcaagtagcgcgctgttgtggatggccaatgtagaacctcactggatagctgcctccatcattctggagtttttcctcatggtgctgcttatccccgaaccagatcgccagaggacacctcaggacaaccaactcgcatatgtcgtgattggtctgttgtttatgatcctgaccgttgctgccaatgagatgggcttactagagactacaaaaaaggatctggggataggacatgtggcagccgaaaaccaccaccatgctacgatgctcgacgtcgatcttcggcccgcgtctgcctggaccctgtacgcagtagctactacagtgattaccccaatgatgcgtcacaccatcgagaacacaactgccaatattagcttgacggccatcgcaaaccaggctgccatactgatgggcctcgacaaaggttggcctatctccaagatggatattggggttccgctgcttgcgttaggctgctactcacaggtgaatcccctgaccctcacagctgccgtcttgatgctggtggcacattatgccatcattggaccaggcctacaagctaaggcaactagagaagcccagaaaaggaccgcggctgggatcatgaagaaccctacagtcgacggaatagtggccattgacctggatcccgttgtgtacgacgcaaaattcgagaagcagctcggccagatcatgcttctgatcttgtgtacctctcaaattctgctcatgcgcactacgtgggccctgtgcgaaagtatcacattagctaccggtccacttactaccctgtgggaggggtcgcctggaaaattttggaatacaactatagccgtaagcatggcaaacattttccggggctcctatctcgctggtgccggcctagcgttctctctgatgaagtcattggggggaggccgaagagggaccggagcccagggcgagacactgggtgaaaagtggaaaaggcagctcaatcagcttagcaagtccgagtttaacacgtacaaacgcagtgggatcatggaagtggatcggtctgaggcaaaggaaggactgaaaagaggcgagaccactaagcacgctgtcagccgtggtacagccaagttgaggtggctggttgagcggaatctcgtgaaacccgaaggcaaggtcattgacttagggtgtggacgcggcgggtggtcatattactgcgcaggactgaaaaaggtgaccgaggtaaaaggctatactaagggtgggccgggacatgaagagccaatccctatggctacatacggctggaaccttgtgaaactgtactccggcaaggatgttttctttacccccccagaaaagtgtgacacgctactctgcgatataggggagagtagccccaatcctaccatcgaggaaggacgaacactgagagtgttgaaaatggtcgagccgtggctgaggggtaaccaattctgtattaagatcctcaatccctatatgccatctgtggtcgaaactcttgagcagatgcagcggaaacacggcgggatgctggtgcgcaaccctttatccagaaattcaacccacgagatgtactgggttagctgcggaacaggcaacattgtatcggccgtgaatatgacttctaggatgctgttgaaccgatttaccatggtccatcggaagcccacatatgaacgtgacgtggatctcggtgccgggaccagacacgttgcggtggagcctgaagtcgctaacctggacatcattggacagcgcatcgagaatataaaaaacgaacataagagtacttggcactacgatgaggacaatccatataagacgtgggcataccacggctcctatgaggtgaaacccagcggctcagcctcctctatggtaaacggggtggttaggctacttacaaagccttgggacgtcattccaatggtgacccaaatcgctatgactgataccacacccttcggacagcagcgggtgtttaaagaaaaggtcgacacgagaaccccgcgcgccaaaaggggtactgcacaaatcatggaggttacagccaagtggctgtggggcttcctcagccgaaataagaaacctcggatttgtaccagagaagagtttactaggaaggtgcgcagtaacgctgcgataggggccgtattcgtggatgaaaatcagtggaactccgcaaaagaggctgtcgaggacgaacgtttttgggatctggtgcatcgggagagagaattgcacaagcagggaaaatgcgccacatgcgtttacaatatgatgggcaagagggagaagaaactgggtgaattcgggaaggcaaaaggaagccgcgccatctggtacatgtggctcggcgctcgatttcttgagttcgaggccctgggcttcatgaacgaagaccattggttttctcgggagaattcattcagtggggtggaaggagatggtttacacaagctgggctatattttgagagacatctccaaaattccagggggaaacatgtacgcggatgacaccgcaggctgggatacaaggatcactgaggacgatctccagaatgaggccaagataaccgacatcatggaacccgagcatgctctgctagccacgagcatttttaaacttacctatcaaaacaaggtcgtgcgcgtacagagacctgcaaagaatggtacagttatggacgtgatctctcggagggatcagcgtgggtcgggacaggtcggcacttacggcctgaacaccttcacaaacatggaagctcaactcattcgacagatggagtcagaagggatctttctgccaagcgagttggagactcccaatttagccgaacgcgtgctggactggctcgagaaacacggaaccgaaagacttaagcggatggctatatccggtgatgactgtgtggtcaaaccggttgatgacaggttcgccacggcactgacagcgctaaacgatatgggcaaggtgcgcaaagacattcctcagtgggagcccagtaaggggtggaatgattggcagcaagtaccattttgctctcaccatttccaccagctgatcatgaaggacggaagagaaatcgtggtcccttgtcggaaccaggatgagctcgtgggcagggcccgagttagccagggtgctgggtggtccttgcgtgagaccgcctgcctgggaaaatcatatgcacaaatgtggcagcttatgtactttcatagacgcgacctgcggctcgctgccaatgcaatttgtagtgccgtgcccgtcgactgggtgccaacttctaggacaacctggagcatacacgcgcaccatcagtggatgactaccgaagatatgttatccgtatggaacagagtttggatcgaggaaaatccctggatggaggacaagacacacgtgtcaagctgggaagaggtcccttatctgggcaaacgcgaggatcaatggtgcggctctttgattgggctgacggctcgggccacctgggcaactaacatccaggtggccattaatcaggttaggcgactcatcggaaacgaaaattaccttgactacatgacatccatgaagagattcaaaaacgagagtgatccagaaggtgctctgtggtga

SEQ ID NO: 13478 - RNA, 9879 nt, synthetic construct
  misc_feature 1..9879: note = derived and/or modified CDS sequence (opt3) from DENV-1__FJ410173__SS-prME
  source 1..9879: mol_type = other RNA
agcgtgaccatgctgctcatgcttctgcccacagccttggctttccacttaactacgagaggcggggagcctcatatgatcgtctccaagcaggaaaggggaaaatctctgctatttaagacctcagcaggtattaacatgtgcacactcatagccatggacctgggcgagctttgtgaagatactatgacctacaaatgcccacggatcacagaggcggaaccggacgatgttgactgttggtgcaatgctaccgatacttgggtgacatatgggacctgtagtcaaacgggagagcaccgccgagacaagcgtagcgtagccctggcaccccatgtgggcttgggtctcgagactagaaccgaaacatggatgtcctctgagggggcctggaaacagattcagaaggtcgaaacttgggctctgaggcaccctggattcaccgtgacagcactgtttctcgcccatgctatcggcacctcgattacgcagaagggcatcatattcatcttactgatgcttgttactccatcaatggccatgcggtgcgtggggattggaaaccgcgattttgtcgagggtttgagcggcgcgacatgggtggacgtagttctggagcacgggagttgtgtgaccactatggcaaaagataagcccacactagacatcgaactcctgaaaaccgaggtcacgaatcctgccgtgcttagaaagctgtgcattgaagctaaaatctccaacaccacaactgattctaggtgtccaacccaaggagaggccacattggtggaagagcaggacagcaatttcgtctgccggcgcacttttgttgatcgaggctggggtaacgggtgtggactcttcggcaagggctccctgttaacctgcgcaaagtttaaatgcgtgacaaagctggaggggaaaatagtacagtacgaaaatctcaagtattcagtgattgtcaccgtgcacactggagaccagcatcaagttggtaacgagacgacagaacacggcaccatcgctactattaccccccaggcccctacaaccgagatccagcttactgactacggggcgctgacattggattgtagtccaagaacgggactagacttcaatgaaatggtgctgctcaccatgaaagagaagagctggctggtccataaacagtggtttcttgatctgccgttgccctggacttctggcgcctccacatcacaagagacctggaacaggcaggacctcctggtgacattcaagactgcacacgctaagaaacaggaagtagttgtgttaggtagccaagagggggccatgcacaccgctctgacgggcgccaccgaaatccagacaagtggaactaccacaatttttgcaggccatctaaagtgccggctcaaaatggataagctgactcttaaagggatgtcttatgtcatgtgtaccggatccttcaagttggagaaggaagtggccgagacgcagcacggtacagtcctggtgcaggttaaatacgagggcaccgacgctccttgcaagataccattcagcgcgcaagatgaaaaaggggtgactcagaatggacgtctcatcacagcaaaccccattgtaaccgacaaggagaaacctgtcaatatcgaaactgagccaccctttggcgagtcgtatatagtggttggtgccggggaaaaggctctgaagctttcttggttcaaaaagggctcctcaattggaaaaatgtttgaggccaccgcacgcggcgccagaaggatggctatcctgggggatacagcctgggacttcggaagtatcggtggcgtgtttacgagcgtcgggaagttggtgcatcaggtattcggagcagcgtacggcgtgctcttttccggtgtttcttggaccatgaaaattgggatcggcattctgttaacttggctgggactaaacagccggtcaacaagtctctccatgacctgtatagctgtcggcatggtgacactgtaccttggggtgatggtccaggccgatagcggatgcgttatcaattggaagggccgagaattgaagtgtggttctgggattttcgtgactaacgaggtgcacacctggacggaacaatataaatttcaggcagactcaccgaagcgcctgagtgccgctatcggaaaagcctgggaggagggcgtatgcggtatcagaagcgcaacaaggctcgaaaacattatgtggaagcagatatccaatgagctgaaccatatcttactggaaaatgacatgaaattcaccgtcgtggttggcgatgctaacgggattcttgcccagggaaagaaaatgatccggcctcaacccatggagcaccgctactcttggaagtcgtggggcaaggcgaaaattatcggggccgacatacagaatagcacttttatcattgatggaccagacacccctgaatgtcccgatgaccagagagcttggaacatctgggaggtggaggattatggcttcggtatttttacaactaatatctggttgaagctcagggactcctacacccagatgtgcgatcaccgtctgatgtcagcagccataaaagacagtaaggctgtccatgccgatatggggtattggattgaatctgagaaaaacgaaacatggaagctagcacgggcgagcttcatcgaggtgaagacgtgtatttggccaaaatcccacaccctgtggtcaaatggagttctcgaaagcgagatgatcatacccaagatctacggcggtcctatttctcaacataactatcgaccaggctacttcactcagacagccgggccgtggcacctgggaaaacttgagttggactttgatctgtgcgaaggcaccactgtggtagtcgacgagcactgcgggaatagaggaccctccttaaggacaaccacggtgactggcaagatcattcatgaatggtgttgccgcagttgtaccctccctccactgcggttcagaggtgaggacgggtgctggtacggaatggagatcaggcccgtgaaagaaaaggaggaaaaccttgtccgcagcatggtttctgctggctccggtgaggtggattcatttagtctgggcatattgtgtgtaagcattatgatcgaagaggtgatgcgatcgcggtggtcccgtaagatgctcatgacagggaccctggccgtcttcctactgctcatcatgggacagctgacttggaatgaccttattagattgtgcatcatggtgggcgcaaacgcttctgataggatggggatgggaacaacctatctggccttaatggcaacatttaaaatgcgccctatgttcgccgttggcctcctgtttcggagacttactagcagggaggtgctgctactcaccattggtctgtcattggtcgctagtgtggaactgccaaattccttagaggaactcggggacggactggcgatgggcataatgatgcttaagctgttgacggagttccaaccccaccagctctggacaaccctgctatctctgacttttatcaaaaccacacttagcctcgattacgcctggcgaactatggcaatggttctgtccattgtgtcattgttcccgctgtgtttaagcaccacgagtcagaagacaacctggctccctgtcctgcttggctcttttgggtgcaaaccactgactatgttcttgatcacagaaaacaagatttggggacgcaagtcctggcccctcaacgagggtatcatggctataggcatcgtaagcattctgctatcgtcactgcttaaaaatgacgtgcctctcgccgggcccctgatcgccggaggcatgttgattgcttgttatgttatctctggtagttccgcagatttaagcctggagaaggccgcggaagtgtcttgggaggaagaggctgaacatagcgggacctcccacaacatactcgtcgaggtgcaggacgatggaactatgaaaattaaggacgaggaacgggatgacacactgaccatccttctgaaagccacgttgctagcagtatcaggcgtgtacccaatgagtatccctgccacttttttcgtctggtatttctggcaaaagaaaaagcagagaagcggcgttctgtgggataccccctctccaccggaggtggaaagggctgtgctcgacgacgggatttaccgtatactgcagcgcggacttttaggtcggtcccaggtcggcgtgggggtttttcaagatggagtattccatacaatgtggcacgtgaccagaggcgcagtcctgatgtatcagggtaagaggctcgagccttcatgggccagtgtgaaaaaggacttgatcagctacgggggaggctggcgatttcagggctcctggaatacaggggaggaagttcaggtgattgcggtcgagcccggaaaaaacccaaagaatgtgcaaactacccccggtacgttcaaaacacctgaaggcgaggtaggggctatcgccctggattttaagccaggaacttctggctcgcccattgtcaaccgggaaggtaagatcgtggggctctacggaaatggcgttgtgaccacaagcggcacctatgtctcagcaatagcccaggctaaaacttcccaggaggggcctctgccggagatcgaagaggaagtgttcaagaaacgcaaccttaccattatggacctgcacccaggaagtggtaagacaagaaggtacttgcccgccatcgttcgggaggcaattaaacgaaagctaagaacgctgatcctcgctcctactcgcgtggtcgcctctgaaatggcggaggccttaaagggcatgccaataaggtatcaaaccacagcagtgaaaagcgagcataccgggcgtgaaattgtagatctgatgtgccacgctacttttacaatgcggcttctgtcccccgtgagagttcctaattacaacatgatcatcatggacgaggcccatttcaccgatccggcttcaattgcagccaggggatatatctctacgcgcgtcggcatgggtgaagccgctgcgatatttatgactgcaacacccccagggagcgtggaggccttccctcagagtaatgctgtgattcaggacgaagagcgagatatccccgagagatcctggaacagcggatacgactggattaccgattttccaggcaagaccgtctggttcgtaccttctatcaaatcaggcaatgacatagccaactgtctccggaagaatgggaaaagggtgattcagttgtcccgcaagactttcgacacagaatatcaaaagacccgtaacaacgattgggactacgttgtgacaactgatatcagtgagatgggagcaaattttagagccgaccgggtcatcgatcccaggcgctgcctgaaaccagtgattctcaaggacggtccggaacgagttatcctggctggccctatgcccgtgacggtcgcgagcgccgcacagagacgggggaggattggacgcaaccagaataaagagggcgatcagtacgtgtatatgggtcaaccacttaacaatgacgaggatcacgctcattggaccgaagccaagatgctactggacaacataaatacacccgaggggatcattcctgcattgttcgaaccagagagagaaaaatcggccgctatcgatggcgagtacaggttacggggagaggcccgtaagacttttgtagaactgatgcgccgaggcgacctccccgtgtggctgtcttataaggttgcgtccgaggggttccagtacagcgatagaaggtggtgctttgacggagaacggaacaatcaggtccttgaggaaaacatggacgtggagatctggaccaaagagggtgaacgcaagaaactgagacctaggtggctcgatgcacggacatattcagacccgttggccctgcgagagttcaaggaatttgctgccggcagacgcagtgtgtctggggatctaattctggagataggaaaactcccacagcaccttaccctgagggctcaaaatgcattagacaacttggtcatgctgcacaattccgaacagggcggtaaggcctaccggcatgctatggaggagctccccgatactatcgaaacgctgatgcttctggccctcattgcagttttgaccgggggcgtgacactgttctttttaagcggaaaaggcctagggaagacttcaatcggactgctctgtgtaatggcgagtagcgcccttctgtggatggctaacgtggagcctcactggattgccgcatccatcatattggaattctttctgatggtcctcctgatccccgagccagaccgtcagagaacccctcaggataatcaacttgcttatgtggttattggtctcctgttcatgatcttgacagtggccgcaaacgagatgggcctgttagaaaccactaagaaagacctagggattggacatgtcgccgctgagaaccagcaccacgcgacaatgctggatgtagacctcaggcccgcctctgcatggacgctttacgctgtggccaccactgttatcacaccaatgatgcgccataccatagaaaataccacagccaacattagcctgactgcaatcgctaatcaggccgcgattttgatgggcctggataagggttggcctatctccaaaatggacataggggtgccgctcctggctcttggctgctactcacaagtcaaccccttaacgctgaccgccgcagtgctcatgttggtcgcccactatgctatcattggaccaggcctgcaggcaaaggccacacgggaggcgcagaaacgaactgctgccgggatcatgaagaatcctaccgtggatggaattgttgcaatcgacctagaccccgtggtatacgatgccaagtttgaaaaacagctgggccaaataatgctccttattctgtgtacatctcagatcttgctgatgagaaccacttgggctctctgcgagagtatcacgctggccacaggtccattaaccactctttgggaggggtcgcctggaaagttctggaacaccacaattgcagtgagcatggctaatatcttcaggggctcctatctggccggtgcgggcctcgccttttctctaatgaaatcactggggggaggccgccgggggactggagcacagggcgaaaccttgggtgagaagtggaaaagacagctgaaccaactcagcaagtccgaattcaatacatacaagcgtagtgggataatggaggtcgacaggtctgaagctaaagagggacttaagcggggcgagacgaccaaacatgccgttagccgcggtactgcaaagctgcgatggtttgtggaaagaaacttggtcaaacccgagggcaaggtgattgatctggggtgtggaaggggcgggtggtcatattactgcgctggactcaagaaagtaacagaagtgaagggctataccaaaggtgggccgggacacgaggaaccaatccctatggccacttacggctggaatttagttaagctgtactccggcaaagacgtgttctttacacccccagagaagtgtgatacccttctgtgcgacattggggagagtagccccaaccctacgatcgaagagggacggaccctacgcgtcctcaaaatggtggaaccgtggctgagaggtaatcagttctgtataaagatcttgaacccctatatgccatctgtcgtggagacactggagcagatgcagaggaagcatggcgggatgctcgttcgaaatcctctttcccggaactcaactcacgaaatgtactgggtaagctgcggaaccggcaatattgtgtcggccgtcaacatgacatctcgtatgctgttaaacagatttactatgacccaccgcaaacccacatatgagagggatgtggacctgggtgcggggacccggcatgttgctgtggaacctgaggtcgcaaatttggatatcattggacaaagaatcgaaaacattaagaatgagcacaaaagtacttggcattacgacgaggataacccatataagacgtgggcctaccacggctcctatgaagtgaaacccagcggctcagcttcctctatggtaaatggggtggttcgcctcctgacaaagccttgggacgtcatcccaatggtgacccagatagccatgactgacaccacacccttcggacagcaaagggtgtttaaggagaaagtcgatacgcgaaccccgcgggcaaagagaggtactgcccagattatggaagttacagctaaatggctatggggcttccttagcaggaacaagaaacctcgcatctgtacccgtgaggaatttactcggaaggtgagaagtaatgcggccatcggggcagtattcgtggacgagaaccagtggaattccgctaaggaggccgtcgaagatgagaggttttgggacctggtgcaccgcgaacgagagctccataaacagggaaagtgcgcaacatgcgtttacaacatgatgggcaaacgggaaaagaaactgggtgagttcgggaaggccaagggaagcagagctatttggtacatgtggttgggcgccaggttcctggagtttgaagcgctcggcttcatgaatgaggatcactggttttctcgcgaaaactcattcagtggggtggagggagagggtcttcataaactgggctatatattaagagacatctccaagattccagggggaaatatgtacgcagatgacaccgccggctgggatacacggatcactgaagacgatctgcaaaacgaggctaaaattaccgacatcatggaacccgagcacgccttgctcgcaacgagcatatttaagctgacctatcagaataaagtcgtgagggtacagcgtcctgctaagaacggtacagttatggatgtgatctctcgacgcgaccagagagggtcgggacaagtcggcacttacggcctaaacaccttcacaaatatggaagtgcagcttattcggcagatggagtcagaggggatctttctgccaagcgaactcgagactcccaacctggccgaaagggtgttgaattggttagagaaacatggaaccgaacgcctgaagagaatggctatttccggtgacgattgtgtcgttaagccggtggacgatcggttcgccacggcactcatcgcgcttaacgacatgggcaaagtaaggaaggatatacctcagtgggagcccagtaaagggtggaatgactggcaacaggtgccattttgctctcaccacttccatcagctgattatgaaggatggacgagagatcgtcgtgccttgtcgtaaccaggacgaactagttggcagagcccgcgtgagccaaggtgctgggtggtccctgcgggagacagcctgcctcggaaaatcatatgcacagatgtggcagttgatgtactttcacaggagagatctgcgccttgctgccaatgcaatctgtagtgccgtccccgtggactgggtaccaacctctcggactacatggagcattcatgcgcaccaccaatggatgaccactgaagatatgctgtccgtttggaacagggtgtggatagaggaaaatccctggatggaggacaagacccatgtctcaagctgggaggaagtgccttatctcggcaagcgagaggaccagtggtgcggctctttaatcgggctgacagctagagccacgtgggcaaccaacattcaggttgccatcaatcaggtgcggaggttgattggaaacgaaaattacctggattacatgacttccatgaaacgcttcaagaacgagagtgacccagagggtgctctctggtga

SEQ ID NO: 13479 - RNA, 9879 nt, synthetic construct
  misc_feature 1..9879: note = derived and/or modified CDS sequence (opt3) from DENV-1__FJ410174__SS-prME
  source 1..9879: mol_type = other RNA
agcgtgaccatgctgctcatgcttctgcccacagccttggctttccacttaactacgagaggaggggaacctcatatgatagtctccaagcaggaaaggggaaaatctctgttatttaagacctcagcaggtattaacatgtgcacactcatagccatggacctgggcgagctttgtgaagatactatgacctacaaatgcccacggatcacagaggcggaaccggacgatgttgactgttggtgcaatgctaccgatacttgggtgacatatgggacctgtagtcaaacgggagagcaccgccgagacaagcgtagcgtagccctggcaccccatgtgggcttgggtctcgagactagaaccgaaacatggatgtcctctgagggggcctggaaacagattcagaaggtcgaaacttgggctctgaggcaccctggattcaccgtgacagcactgtttctcgcccatgctatcggcacctcgattacgcagaagggcatcatattcatcttactgatgcttgttactccatcaatggccatgcggtgcgtggggattggaaaccgcgattttgtcgagggtttgagcggcgcgacatgggtggacgtagttctggagcacgggagttgtgtgaccactatcgcaaaagataagcccacactagacattgaactcctgaaaaccgaggtcacgaatcctgccgtgcttagaaagctgtgcatcgaagctaaaatatccaacaccacaactgattctaggtgtccaacccaaggagaggccacattggtggaagaacaggacagcaatttcgtctgccggcgcacttttgttgatcgaggctggggtaacgggtgtggactcttcggcaagggctccctgttaacctgcgcaaagtttaaatgcgtgacaaagctggaggggaaaattgtacagtacgaaaatctcaagtattcagtgatcgtcaccgtgcacactggagaccagcatcaagttggtaacgagacgacagaacacggcaccattgctactatcacaccccaggcccctacaagtgagatccagcttaccgactacggggcgctgactttggattgtagcccaagaacaggactagacttcaatgaaatggtgctgctcacgatgaaagagaagtcttggctggtccataaacagtggtttcttgatctgccgttgccctggacctccggcgcctcaactagccaagagacatggaacaggcaggacctcctggtgaccttcaagacagcacacgctaagaaacaggaagtagttgtgttaggtagtcaagagggggccatgcacactgctctgaccggcgccacggaaattcagacctctggaacaactaccatatttgcaggccatctaaagtgccggctcaaaatggataagctgacacttaaagggatgtcctatgtcatgtgtactggcagcttcaagttggagaaggaagtggccgagacccagcacggtacggtcctggtgcaggttaaatacgagggcacagacgctccttgcaagatcccattctcggcgcaagatgaaaaaggggtgacccagaatggacgtctcattactgcaaaccccatcgtaacagacaaggagaaacctgtcaatatagaaaccgagccaccctttggcgagtcttatattgtggttggtgccggggaaaaggctctgaaactttcctggttcaaaaagggctcaagtatcggaaaaatgtttgaggccactgcacgcggcgccagaaggatggctatcctgggggataccgcctgggacttcggaagcattggtggcgtgtttacatccgtcgggaagttggtgcatcaggtattcggagcagcgtacggcgtgctcttttctggtgttagctggacgatgaaaatcgggattggcatactgttaacctggctgggactaaactcacggagtacttccctcagcatgacatgtatcgctgtcggcatggtgaccctgtaccttggggtgatggtccaggccgattctggatgcgttattaattggaagggccgagaattgaagtgtggttcagggatcttcgtgacaaacgaggtgcacacttggaccgaacaatataaatttcaggcagacagtccgaagcgcctgagcgccgctatcggaaaagcctgggaggagggcgtatgcggtattagatccgcaacgaggctcgaaaacataatgtggaagcagatctctaatgagctgaaccatattttactggaaaatgacatgaaattcacagtcgtggttggcgatgctaacgggatccttgcccagggaaagaaaatgattcggcctcaacccatggagcaccgctactcgtggaaaagctggggcaaggcgaaaatcataggggccgacatccagaataccacttttattatcgatggaccagacacccctgaatgtcccgatgaccagagagcttggaacatttgggaggtggaggattatggcttcggtatctttacaactaatatatggttgaagctcagggactcctacacccagatgtgcgatcaccgtctgatgtcagcagccattaaagacagtaaggctgtccatgccgatatggggtattggatcgaatctgagaaaaacgaaacatggaagctagcacgggcgagcttcattgaggtgaagacgtgtatctggccaaaatcccacaccctgtggtcaaatggagttctcgaaagcgagatgataatccccaagatttacggcggtcctatctctcaacataactatcgaccaggctacttcactcagacagccgggccgtggcacctgggaaaacttgagttggactttgatctgtgcgaaggcaccactgtggtagtcgacgagcactgcgggaatagaggaccctccttaaggacaaccacggtgactggcaagattatccatgaatggtgttgccgcagttgtaccctccctccactgcggttcagaggtgaggacgggtgctggtacggaatggagataaggcccgtgaaagaaaaggaggaaaaccttgtccgcagcatggtttctgctggctccggtgaggtggattcatttagtctgggcattttgtgtgtaagcatcatgatcgaagaggtgatgcgatcgcggtggtcccgtaagatgctcatgacagggaccctggccgtcttcctactgctcattatgggacagctgacttggaatgaccttatcagattgtgcattatggtgggcgcaaacgcttctgataggatggggatgggaataacatatctggccttaatggcaacctttaaaatgcgccctatgttcgccgttggcctcctgtttcggagacttacaagcagggaggtgctgctactcactatcggtctgtcattggtcgctagtgtggaactgccaaattccttagaggaactcggggacggactggcgatgggcattatgatgcttaagctgttgaccgagttccaaccccaccagctctggacgacactgctatctctgacctttatcaaaactacccttagcctcgattacgcctggcgaacaatggcaatggttctgtccattgtgtcattgttcccgctgtgtttaagcactaccagtcagaagacgacatggctccctgtcctgcttggctcttttgggtgcaaaccactgaccatgttcttgatcactgaaaacaagatatggggacgcaagtcctggcccctcaacgagggtatcatggctattggcatcgtaagcattctgctatcgtcactgcttaaaaatgacgtgcctctcgccgggcccctgatcgccggaggcatgttgatagcttgttatgttatttctggtagttccgcagatttaagcctggagaaggccgcggaagtgtcttgggaggaagaggctgaacatagcgggacatcccacaacatcctcgtcgaggtgcaggacgatggaaccatgaaaatcaaggacgaggaacgggatgacactctgacaattcttctgaaagccaccttgctagcagtatcaggcgtgtacccaatgagtatacctgccacgctgtttgtctggtatttctggcaaaagaaaaagcagagaagcggcgttctctgggatactccctctccaccggaggtggaaagggctgtgctggacgacgggatctaccgtattcttcagcgcggattactgggtcggtcccaggtcggcgtgggggttttccaagatggagtatttcataccatgtggcacgtgacaagaggcgcagtcctcatgtatcagggtaagaggttggagccttcatgggccagtgtgaaaaaggacctgatcagctacgggggaggctggcgattccagggctcctggaataccggggaggaagttcaggtgattgcggtcgagcccggcaagaatccaaagaatgtgcaaacaactcccggtacctttaaaacgcctgaaggcgaggtaggggctatcgccctcgatttcaagccaggaacatctggctcgcccatagtcaaccgggaaggtaagatcgtggggctgtacggaaatggcgttgtgactaccagcggcacatatgtctcagcaattgcccaggctaaaacctcccaggaggggcctcttccggagatcgaagaggaagtgtttaagaaacgcaacctgactattatggacttgcacccaggaagtggtaagaccagaaggtacctacccgccatcgttcgggaggcaataaaacgaaagctgagaacactcattttagctcctacgcgcgtggtcgcctctgaaatggcggaggccctgaagggcatgccaatcaggtatcaaactaccgcagtgaaaagcgagcatacagggcgtgaaatcgtagatcttatgtgccacgctaccttcactatgcggctgctctcccccgtgagagttcctaattacaacatgattatcatggacgaggcccattttacagatccggcttcaatagcagccaggggatatatttctacccgcgtcggcatgggtgaagccgctgcgatcttcatgacggcaactcccccagggagcgtggaggcctttcctcagagtaatgctgtgattcaggacgaagaacgagatatccccgagagatcctggaacagcggatacgactggataacagatttcccaggcaagaccgtctggtttgtaccttctattaaatcaggcaatgacatcgccaactgtttgcggaagaatgggaaaagggtgatccagctgtcccgcaagaccttcgacactgaatatcaaaagaccaagaacaacgattgggactacgttgtgaccacagatattagtgagatgggagcaaatttccgtgccgacagagtcatcgatccccggaggtgcctcaagccagtgattctgaaagacggtccggaacgcgttatacttgctggccctatgcccgtgactgtcgcgagcgccgcacagcgaagagggcggatcggaaggaaccagaataaggagggcgatcagtacgtgtatatgggtcaaccactaaacaatgacgaggatcacgctcattggacggaagccaaaatgctgttggacaacattaatacccccgaggggatcatccctgcattatttgaaccagagcgcgaaaagtcggccgctattgatggcgagtacagactgaggggagaggcccggaagacattcgtagaactcatgcgtcgcggcgacctgcccgtgtggctttcttataaagttgcgtccgaggggtttcagtacagcgatcgaagatggtgcttcgacggagaaaggaacaatcaggtcctggaggaaaacatggacgtggagatatggactaaggagggtgaacggaaaaagctccgccctagatggttggatgcaaggacctattcagacccgctggccctacgggagtttaaagagttcgctgccggccgaagaagtgtgtctggggatctgatcctcgagattggaaaacttccacagcacctgacattacgcgctcaaaatgcattggacaacctggtcatgctccacaattccgaacagggcggtaaagcctacaggcatgctatggaggagctgcccgataccatcgaaactcttatgctgctcgccttgattgcagttctgaccgggggagtgacgttatttttcctaagcggaaagggcctggggaagacatcaatcggactcctttgtgtaatggcgagtagcgccctgttgtggatggctaacgtggagcctcactggatagccgcatccatcattctggaatttttcctcatggtcctgcttatccccgagccagaccggcagcgtactcctcaggataatcaactcgcttatgtggttattggtctgttgtttatgatcctgaccgtggccgcaaacgagatgggcttactagaaacaaccaaaaaggacctggggataggacatgtcgccgctgagaaccagcaccacgcgactatgctcgatgtagaccttagacccgcctctgcatggacactgtacgctgtggccacgaccgttattactccaatgatgaggcatacaatcgaaaataccaccgccaacattagcttgacagcaatcgctaatcaggccgcgatactgatgggcctcgataaaggttggcctatctccaagatggacattggggtgccgctgcttgctttaggctgctactcacaagtcaaccccctgactctcacggccgcagtgttgatgctggtcgcccactatgctatcattggaccaggcctacaggcaaaagccacccgcgaggcgcagaagcggacagctgccgggatcatgaagaatcctactgtggatggaatagttgcaattgacctggaccccgtggtatacgatgccaaattcgaaaagcagctcggccaaatcatgcttctgatcttgtgtacctctcagattctgctcatgcgaacaacctgggctctgtgcgagagtatcactttagccacgggtccacttacaaccctgtgggaggggtcgcctggaaaattttggaacactaccatagcagtgagcatggctaatattttcagaggctcctatctcgccggtgcggccctagcattctctctgatgaagtcattgggcgggggaaggcgcggcacaggggctcagggagaaactctgggcgagaaatggaagcggcagctcaaccaacttagcaagtccgaatttaatacctacaaaagaagtggtatcatggaggtcgaccgttctgaagccaaggaggggctgaaaaggggagagacaacgaagcatgcagttagccggggcaccgctaaattgcgctggttcgtggaacgaaacctggtcaagcccgagggtaaggtgattgatctcggctgtgggagaggaggctggtcatattactgcgccgggctaaagaaggtaactgaagtgaaaggatatacaaagggcggtccggggcacgaggaaccaatccctatggccacctacggatggaatctggttaaactttactccggcaaggacgtgtttttcactcccccagagaaatgtgatacactgctatgcgacataggcgagagtagccccaaccctaccatcgaagaggggaggacgctccgggtcctgaagatggtggaaccgtggttgcgcggaaatcagttttgtattaagatcctgaacccctatatgccatctgtcgtggagaccctcgagcagatgcagagaaaacatggtggcatgcttgttaggaatcctctgtcccgaaactcaacacacgaaatgtactgggtaagctgcgggactggaaatattgtgtcggcggtcaacatgacctctcggatgttactgaaccgtttcacaatgactcacagaaagcccacctatgagcgcgatgtggacttgggcgctggtacaaggcatgttgcagtggaacctgaggtcgccaatctcgatatcattgggcaacggatcgaaaacatcaaaaatgagcacaagagtacctggcattacgacgaggataacccatataaaacttgggcttaccacggatcctatgaagtgaagcccagcggctcagcctcctctatggtaaatggcgtggttagactgctaacgaagccttgggacgtcattccaatggtgacacagatcgcaatgaccgacactaccccctttgggcagcaacgcgtgttcaaagagaaggtcgatacaaggacgccgcgagccaaacggggaaccgctcagatcatggaagttactgcgaagtggctttggggttttctgagcagaaacaaaaagcctaggatttgtacacgcgaggagttcacccgtaaggtgcggagtaatgccgcaataggcgctgtatttgtggacgagaaccagtggaactccgccaaagaggcagtcgaagatgagagattctgggacctcgtgcacagggaacgcgagctgcataagcaggggaaatgcgccacttgcgtttacaacatgatgggaaagcgagagaaaaagttgggcgagtttggtaaggctaaagggagccgggccatctggtacatgtggctgggagcgagattcctcgagttcgaagcacttggctttatgaatgaggatcactggttctctagggaaaactcatttagtggcgtggagggggagggactgcataagttaggttatattctgcgcgacatctccaaaattccaggcgggaatatgtacgccgatgacacagctggatgggataccagaatcacagaagacgatttgcaaaacgaggccaagataactgacatcatggaagcagagcacgctctcctggccaccagcattttcaaactaacgtatcagaataaggtcgtgcgggtacagaggcccgctaaaaacggcaccgttatggatgtgatctctcgtcgagaccagcgcggttcggggcaagtcggaacatacggccttaacacttttaccaatatggaagtgcagctgattagacagatggagtcagagggcatcttcctccctagcgaactggagacaccaaacttggccgaacgggtgttagactggctggagaagcatgggactgaaaggctcaagcgcatggcaatatccggagatgactgtgtcgttaaacccgtggatgacagatttgcgaccgcccttattgctctgaatgatatgggtaaggtacggaaagacatcccgcagtgggagcctagtaagggctggaacgattggcaacaggtgcccttctgctctcaccactttcatcagctaatcatgaaagacgggagggagattgtcgtgccatgtcgaaatcaggatgaactggttggacgtgccagagtgagccaaggcgcaggttggtccctccgcgagacggcttgcttggggaagtcatatgcccagatgtggcagctgatgtacttccaccggagggaccttagactggcagccaacgcgatatgtagtgctgtccctgtggattgggtacccacatctcgcaccacttggagcatccatgcccaccaccaatggatgacaaccgaagacatgctctccgtttggaatcgggtgtggattgaggaaaacccatggatggaggacaagactcatgtctcaagctgggaggaagtgccctatttaggaaaaagggaggatcagtggtgcggctctctgatcggcttgaccgcacgagccacatgggctacgaatattcaggttgccatcaaccaggtgagacggctgatagggaatgaaaactacctcgactacatgacctccatgaagaggtttaaaaatgagagtgatcctgagggagcactttggtga

SEQ ID NO: 13480 - RNA, 9879 nt, synthetic construct
  misc_feature 1..9879: note = derived and/or modified CDS sequence (opt3) from DENV-1__FJ410175__SS-prME
  source 1..9879: mol_type = other RNA
agcgtgaccatgctgctcatgcttctgcccaccgccttggctttccacttaactacgagaggaggggaacctcatatgatcgtctccaagcaggaaaggggaaaatctctgttatttaagacctcagcaggtattaacatgtgcacactcatagccatggacctgggagagctttgtgaagatactatgacctacaaatgcccacggatcacagaggcggaaccggacgatgttgactgttggtgcaatgctaccgatacttgggtgacatatgggacctgtagtcaaacgggagagcaccgccgagacaagcgtagcgtagccctggcaccccatgtgggcttgggtctcgagactagaaccgaaacatggatgtcctctgagggggcctggaaacagattcagaaggtcgaaacttgggctctgaggcaccctggattcaccgtgacagcactgtttctcgcccatgctatcggcacctcgattacgcagaagggcatcatattcatcttactgatgcttgttactccatcaatggccatgcggtgcgtggggattggaaaccgcgattttgtcgagggtttgagcggcgcgacatgggtggacgtagttctggagcacgggagttgtgtgaccactatggcaaaagataagcccacattggacatcgaactcctgaaaaccgaggtcacgaatcctgccgtgcttagaaagctgtgcattgaagctaaaatctccaacaccacaactgattctaggtgtccaacccaaggagaggccacattggtggaagaacaggacagcaatttcgtctgccggcgcacttttgttgatcgaggctggggtaacgggtgtggactcttcggcaagggctccctgttaacctgcgcaaagtttaaatgcgtgacaaagctggaggggaaaatagtacagtacgaaaatctcaagtattcagtgattgtcaccgtgcacactggagaccagcatcaagttggtaacgagacgacagaacacggcaccatcgctactattacaccccaggcccctacaagtgagatccagcttaccgactacggggcgctgactttggattgtagcccaagaacaggactagacttcaatgaaatggtgctgctcacgatgaaagagaagtcttggctggtccataaacagtggtttcttgatctgccgttgccctggacctccggcgcctcaactagccaagagacatggaacaggcaggacctcctggtgaccttcaagacagcacacgctaagaaacaggaagtagttgtgttaggtagtcaagagggggccatgcacactgctctgaccggcgccacggaaatccagacctctggaacaactaccatttttgcaggccatctaaagtgccggctcaaaatggataagctgacacttaaagggatgtcctatgtcatgtgtactggcagcttcaagttggagaaggaagtggccgagacccagcacggtacggtcctggtgcaggttaaatacgagggcacagacgctccttgcaagataccattctcggcgcaagatgaaaaaggggtgacccagaatggacgtctcatcactgcaaaccccattgtaacagacaaggagaaacctgtcaatatcgaaaccgagccaccctttggcgagtcttatatagtggttggtgccggggaaaaggctctgaaactttcctggttcaaaaagggctcaagtattggaaaaatgtttgaggccactgcacgcggcgccagaaggatggctatcctgggggataccgcctgggacttcggaagcatcggtggcgtgtttacatccgtcgggaagttggtgcatcaggtattcggagcagcgtacggcgtgctcttttctggtgttagctggacgatgaaaattgggatcggcattctgttaacctggctgggactaaactcacggagtacttccctcagcatgacatgtatagctgtcggcatggtgaccctgtaccttggggtgatggtccaggccgattctggatgcgttatcaattggaagggccgagaattgaagtgtggttcagggattttcgtgacaaacgaggtgcacacttggaccgaacaatataaatttcaggcagacagtccgaagcgcctgagcgccgctatcggaaaagcctgggaggagggcgtatgcggtatcagatccgcaacgaggctcgaaaacattatgtggaagcagatatctaatgagctgaaccatatcttactggaaaatgacatgaaattcacagtcgtggttggcgatgctaacgggattcttgcccagggaaagaaaatgatccggcctcaacccatggagcaccgctactcgtggaaaagctggggcaaggcgaagattatcggggccgacatacagaataccacttttatcattgatggaccagacacccctgaatgtcccgatgaccagagagcttggaacatctgggaggtggaggattatggcttcggtatttttacaactaatatctggttgaagctcagggactcctacacccagatgtgcgatcaccgtctgatgtcagcagccataaaagacagtaaggctgtccatgccgatatggggtattggattgaatctgagaaaaacgaaacatggaagctagcacgggcgagcttcatcgaggtgaagacgtgtatttggccaaaatcccacaccctgtggtcaaatggagttctcgaaagcgagatgatcatacccaagatctacggcggtcctatttctcaacataactatcgaccaggctacttcactcagacagccgggccgtggcacctgggaaaacttgagttggactttgatctgtgcgaaggcaccactgtggtagtcgacgagcactgcgggaatagaggaccctccttaaggacaaccacggtgactggcaagatcattcatgaatggtgttgccgcagttgtaccctccctccactgcggttcagaggtgaggacgggtgctggtacggaatggagatcaggcccgtgaaagaaaaggaggaaaaccttgtccgcagcatggtttctgctggctccggtgaggtggattcatttagtctgggcatattgtgtgtaagcattatgatcgaagaggtgatgcgatcgcggtggtcccgtaagatgctcatgacagggaccctggccgtcttcctactgctcatcatgggacagctgacttggaatgaccttattagattgtgcatcatggtgggcgcaaacgcttctgataggatggggatgggaacaacctatctggccttaatggcaacatttaaaatgcgccctatgttcgccgttggcctcctgtttcggagacttactagcagggaggtgctgctactcaccattggtctgtcattggtcgctagtgtggaactgccaaattccttagaggaactcggggacggactggcgatgggcataatgatgcttaagctgttgacggagttccaaccccaccagctctggacaaccctgctatctctgacttttatcaaaaccacacttagcctcgattacgcctggcgaactatggcaatggttctgtccattgtgtcattgttcccgctgtgtttaagcaccacgagtcagaagacaacctggctccctgtcctgcttggctcttttgggtgcaaaccactgactatgttcttgatcacagaaaacaagatttggggacgcaagtcctggcccctcaacgagggtatcatggctataggcatcgtaagcattctgctatcgtcactgcttaaaaatgacgtgcctctcgccgggcccctgatcgccggaggcatgttgattgcttgttatgttatctctggtagttccgcagatttaagcctggagaaggccgcggaagtgtcttgggaggaagaggctgaacatagcgggacctcccacaacatactcgtcgaggtgcaggacgatggaactatgaaaattaaggacgaggaacgggatgacacactgaccatccttctgaaagccacgttgctagcagtatcaggcgtgtacccaatgagtatccctgccactctgtttgtctggtatttctggcaaaagaaaaagcagagaagcggcgttctctgggataccccctctccaccggaggtggaaagggctgtgctggacgacgggatttaccgtatacttcagcgcggattactgggtcggtcccaggtcggcgtgggggttttccaagatggagtatttcatacaatgtggcacgtgaccagaggcgcagtcctcatgtatcagggtaagaggttggagccttcatgggccagtgtgaaaaaggacctgatcagctacgggggaggctggcgattccagggctcctggaatacaggggaggaagttcaggtgattgcggtcgagcccggcaagaatccaaagaatgtgcaaactacccccggtacgtttaaaacacctgaaggcgaggtaggggctatcgccctcgatttcaagccaggaacttctggctcgcccattgtcaaccgggaaggtaagatcgtggggctgtacggaaatggcgttgtgaccacaagcggcacctatgtctcagcaatagcccaggctaaaacttcccaggaggggcctcttccggagatcgaagaggaagtgtttaagaaacgcaacctgaccattatggacttgcacccaggaagtggtaagacaagaaggtacctacccgccatcgttcgggaggcaattaaacgaaagctgagaacgctcatcttagctcctactcgcgtggtcgcctctgaaatggcggaggccctgaagggcatgccaataaggtatcaaaccacagcagtgaaaagcgagcataccgggcgtgaaattgtagatcttatgtgccacgctactttcacaatgcggctgctctcccccgtgagagttcctaattacaacatgatcatcatggacgaggcccattttaccgatccggcttcaattgcagccaggggatatatctctacgcgcgtcggcatgggtgaagccgctgcgatattcatgactgcaacacccccagggagcgtggaggcctttcctcagagtaatgctgtgattcaggacgaagaacgagatatccccgagagatcctggaacagcggatacgactggattaccgatttcccaggcaagaccgtctggtttgtaccttctatcaaatcaggcaatgacatagccaactgtttgcggaagaatgggaaaagggtgattcagctgtcccgcaagactttcgacacagaatatcaaaagaccaaaaacaacgattgggactacgttgtgacaactgatatcagtgagatgggagcaaatttccgtgccgacagagtcatcgatccccggaggtgcctcaagccagtgattctgaaagacggtccggaacgcgttatccttgctggccctatgcccgtgacggtcgcgagcgccgcacagcgaagagggcggattggaaggaaccagaataaggagggcgatcagtacgtgtatatgggtcaaccactaaacaatgacgaggatcacgctcattggaccgaagccaaaatgctgttggacaacataaatacacccgaggggatcattcctgcattatttgaaccagagcgcgaaaagtcggccgctatcgatggcgagtacagactgaggggagaggcccggaagactttcgtagaactcatgcgtcgcggcgacctgcccgtgtggctttcttataaagttgcgtccgaggggtttcagtacagcgatcgaagatggtgcttcgacggagaaaggaacaatcaggtcctggaggaaaacatggacgtggagatctggaccaaggagggtgaacggaaaaagctccgccctagatggttggatgcaaggacatattcagacccgctggccctacgggagtttaaagagttcgctgccggccgaagaagtgtgtctggggatctgattctcgagataggaaaacttccacagcacctgaccttacgcgctcaaaatgcattggacaacctggtcatgctccacaattccgaacagggcggtaaagcctacaggcatgctatggaggagctgcccgatactatcgaaacgcttatgctgctcgccttgattgcagttctgaccgggggcgtgacattatttttcctaagcggaaagggcctggggaagacttcaatcggactcctttgtgtaatggcgagtagcgccctgttgtggatggctaacgtggagcctcactggattgccgcatccatcatactggaatttttcctcatggtcctgcttatccccgagccagaccggcagcgtacccctcaggataatcaactcgcttatgtggttattggtctgttgtttatgatcctgacagtggccgcaaacgagatgggcttactagaaaccactaaaaaggacctggggattggacatgtcgccgctgagaaccagcaccacgcgacaatgctcgatgtagaccttagacccgcctctgcatggacgctgtacgctgtggccaccactgttatcacaccaatgatgaggcataccatagaaaataccacagccaacattagcttgactgcaatcgctaatcaggccgcgattctgatgggcctcgataaaggttggcctatctccaagatggacataggggtgccgctgcttgctttaggctgctactcacaagtcaaccccctgacgctcaccgccgcagtgttgatgctggtcgcccactatgctatcattggaccaggcctacaggcaaaagccacacgcgaggcgcagaagcggactgctgccgggatcatgaagaatcctaccgtggatggaattgttgcaatcgacctggaccccgtggtatacgatgccaaattcgaaaagcagctcggccaaataatgcttctgattttgtgtacatctcagatcctgctcatgcgaaccacttgggctctgtgcgagagtatcacgttagccacaggtccacttaccactctgtgggaggggtcgcctggaaaattttggaacaccacaattgcagtgagcatggctaatatcttcagaggctcctatctcgccggtgcgggcctagccttctctctgatgaagtcactagggggaggcaggcgcgggactggagcacagggcgaaaccctgggtgagaaatggaagcggcagctcaaccaacttagcaagtccgaatttaatacatacaaaagaagtgggataatggaggtcgaccgttctgaagctaaggagggactgaaaaggggcgagacgaccaagcatgccgttagccggggtactgcaaaattgcgctggttcgtggaacgaaacctggtcaagcccgagggcaaggtgattgatctcgggtgtggaagaggcgggtggtcatattactgcgctggactaaagaaggtaacagaagtgaaaggctataccaagggtgggccgggacacgaggaaccaatccctatggccacttacggctggaatctggttaaactttactccggcaaggacgtgtttttcacacccccagagaaatgtgataccctgctatgcgacattggggagagtagccccaaccctacgatcgaagagggaaggaccctccgggtcctgaagatggtggaaccgtggttgcgcggtaatcagttttgtataaagatcctgaacccctatatgccatctgtcgtggagacactcgagcagatgcagagaaaacatggcgggatgcttgttaggaatcctctgtcccgaaactcaactcacgaaatgtactgggtaagctgcggaaccggcaatattgtgtcggccgtcaacatgacatctcggatgttactgaaccgtttcactatgacccacagaaagcccacatatgagcgcgatgtggacttgggtgcggggaccaggcatgttgctgtggaacctgaggtcgcaaatctcgatatcattggacaacggatcgaaaacattaaaaatgagcacaagagtacttggcattacgacgaggataacccatataaaacgtgggcctaccacggctcctatgaagtgaagcccagcggctcagcttcctctatggtaaatggggtggttagactgctaacaaagccttgggacgtcatcccaatggtgacccagatagccatgactgacaccacaccctttggacagcaacgcgtgttcaaagagaaggtcgatacgaggaccccgcgagcaaaacggggtactgcccagattatggaagttacagctaagtggctttggggctttctgagcagaaacaaaaagcctaggatctgtacccgcgaggagttcactcgtaaggtgcggagtaatgcggccatcggggcagtatttgtggacgagaaccagtggaactccgctaaagaggccgtcgaagatgagagattctgggacctcgtgcacagggaacgcgagctgcataagcagggaaaatgcgcaacatgcgtttacaacatgatgggcaagcgagagaaaaagttgggtgagtttgggaaggccaaaggaagccgggctatttggtacatgtggctgggcgccagattcctcgagttcgaagcgcttggctttatgaatgaggatcactggttctctagggaaaactcatttagtggggtggagggagagggtctgcataagttaggctatatactgcgcgacatctccaaaattccagggggaaatatgtacgcagatgacaccgccggctgggatacaagaatcactgaagacgatttgcaaaacgaggctcggattaccgacatcatggaacccgagcacgccctcctggcaacgagcatattcaagctaacctatcagaataaagtcgtgagggtacagcgtcctgctaagaacggtacagttatggatgtgatctctcgacgcgaccagagagggtcgggacaagtcggcacttacggccttaacacctttacaaatatggaagtgcagctgattcggcagatggagtcagaggggatcttcctcccaagcgaactggagactcccaacttggccgaaagggtgttagactggctggagaaacatggaaccgaacgcctcaagagaatggctatttccggtgatgactgtgtcgttaagccggtggatgaccggtttgccacggcacttatcgcgctgaatgatatgggcaaagtaaggaaggacatacctcagtgggagcccagtaaagggtggaacgattggcaacaggtgccattctgctctcaccactttcatcagctaattatgaaggacggacgagagatcgtcgtgccttgtcgtaatcaggatgaactggttggcagagcccgcgtgagccaaggtgctgggtggtccctccgggagacagcctgcttgggaaaatcatatgcacagatgtggcagctgatgtacttccacaggagagaccttcgcctggctgccaacgcaatctgtagtgccgtccccgtggattgggtaccaacctctcggactacatggagcattcatgcgcaccaccaatggatgaccactgaagacatgctctccgtttggaatagggtgtggatagaggaaaacccctggatggaggacaagacccatgtctcaagctgggaggaagtgccttatttaggcaagcgagaggatcagtggtgcggctctctgatcgggttgacagctagagccacgtgggcaaccaatattcaggttgccatcaaccaggtgcggaggctgattggaaatgaaaactacctcgactacatgacttccatgaaacgctttaagaatgagagtgatccagagggtgctctttggtga

SEQ ID NO: 13481 - RNA, 9879 nt, synthetic construct
  misc_feature 1..9879: note = derived and/or modified CDS sequence (opt3) from DENV-1__FJ562105__SS-prME
  source 1..9879: mol_type = other RNA
agcgtgaccatgctgctcatgcttctgcccacagtcttggccttccacttaactacgagaggcggggagcctcatatgatcgttggaaagcaggaaaggggtaaatccctgctatttaagacctctgctggcgtgaacatgtgcacactcattgcaatggacctgggggagctttgtgaagatactatgacctacaaatgcccacggataacagaggccgaaccggacgatgtagactgttggtgcaatgcgaccgatacttgggtgacatatggaacctgttcacaaacgggcgagcaccgccgagacaagcgtagtgtcgctctggccccccatgtgggtttggggctcgagactagaaccgaaacatggatgagctccgagggagcatggaaacagatccagaaggttgaaacttgggccctgaggcaccctggcttcaccgtgattgcttttttcctggcacatgccatcggcacatctattacccagaaggggatcatatttatcctcttaatgctggtcacgccatcgatggctatgcggtgcgtgggaattggtaaccgcgatttcgtagagggcctttcaggggccacttgggttgacgtggtcttggagcacggaagctgtgtgacaaccatggcgaaaaataagcccactctggatatcgaactactcaaaacagaggtgaccaaccctgcagtcctgagaaagctttgcattgaagccaaaatcagtaatacgaccacagactccaggtgtccaactcaaggcgaggctaccctggttgaagagcaggatgccaactttgtgtgccggcgcacattcgtagaccgaggttgggggaatggatgtggcttgtttggcaaggggtctctcctgacttgcgcaaagttcaaatgcgtgaccaagttagagggaaaaatagtccagtacgaaaacctgaagtatagcgtgattgttacagtgcacaccggtgatcagcatcaagtcggcaatgagactacggaacacgggacaatcgctaccattactccccaggcccctacctccgagatccagctcacagactacggagcgcttaccctggactgttcaccaagaactggcttggattttaacgaaatggtgctactgacaatgaaagagaagagttggctcgtacataaacagtggttcctggaccttccgctgccctggacgagcggtgcctctacctcccaagagacttggaataggcaggatttgctcgttacatttaagaccgcacacgctaagaaacaggaagtggtcgtgctggggtcacaagagggcgccatgcacacagctttaactggagccaccgaaatccagacgagcggcaccacaactattttcgcagggcatctgaagtgccggctaaaaatggacaagctcaccctgaaaggaatgagttatgtcatgtgtacaggttctttcaagcttgagaaggaagtggccgagactcagcacggcaccgttttggtgcaggtaaaatacgaggggacggatgctccttgcaagataccactgtccacacaagacgaaaaaggagtcacccagaacggccgtctcatcactgcgaatcccattgtgacagataaggagaaacctgttaacatcgaaaccgagccaccctttggtgagagctatataattgtgggggcaggcgaaaaggccctgaagctttcgtggttcaaaaagggatcttccatcggcaaaatgtttgaggctactgcccgcggggcaagaaggatggccatcctgggagacaccgcttgggatttcggttcaattggcggggtctttacaagtgtgggaaagttggtacatcaggtgttcggcacggcctacggtgttctctttagcggggtctcctggaccatgaaaatcggcattggaatactgttaacttggctgggcctaaattctcggagcgcatcactcagtatgacatgtatcgcggtggggatggtgaccctgtaccttggagtcatggttcaggctgactccggctgcgtgattaactggaagggtcgagaattgaagtgtgggagcggaatcttcgtgacaaacgaggtacacacttggaccgaacaatataaatttcaggccgattctccgaagcgcctgtcagcagccatcggcaaagcttgggaggagggtgtctgcggcgtgagaagtgccacgaggctcgaaaatattatgtggaagcagataagcaacgagctgaatcatatcttactggaaaacgacatgaaattcacagttgtggtcggggacgcaaatggaattcttgctcagggcaagaaaatgatccggcctcaacccatggagcacaagtactcctggaagtcttgggggaaagccaagattatcggagcggatatacagaacaccacttttatcattgacggcccagatacccctgaatgtcccgacgatcagcgcgcctggaatatctgggaggtggaggactatggtttcgggatttttacaactaacatctggttgaaactcagagattcgtacacccagatgtgcgaccacaggctgatgagcgctgcaataaaggattccaaagccgttcatgctgacatgggatattggattgaatcagagaagaatgaaacatggaagctagcccgtgcaagtttcatcgaggtgaaaacgtgtatttggccaaagtctcacaccctgtggagcaacggcgtactcgaatccgagatgatcatacccaaaatctacggtggccctatttcacaacataattatcggccagggtacttcactcagacagcgggaccgtggcacctgggcaagcttgagttggattttgacctgtgcgaagggaccactgtcgtggtggatgagcactgcggaaaccgaggccccagcttaagaacaaccacggtcactggtaaaatcattcatgaatggtgttgcaggtcttgtaccctccctccactgcgcttccggggggaggacggatgctggtacggcatggagatcagacccgttaaggaaaaggaggaaaatcttgtgaggtccatggtaagtgccggtagcggcgaggtggactctttttccctggggatattgtgtctctcaattatgatcgaagaggtcatgcgcagtcgatggagccggaaaatgctgatgacaggaaccctagctgtgttcctgctcctgatcatgggccagcttacttggaacgatttgattcgtctgtgcatcatggttggggccaatgcatcggacagaatgggaatgggcacaacctatttagctctcatggccacatttaagatgaggcctatgttcgcagtgggtctgctttttcgccggctgacttccagagaggtcctactcctgaccattgggttgtctctggtggccagcgttgaattaccaaactcactcgaggaactgggagatggccttgctatgggcataatgatgctgaaattgctcacggagttccaaccccaccagctgtggacaaccctactgagtcttacttttatcaagaccacactctccctggactacgcgtggaaaactatggccatggtgttgtctattgtcagcctgttcccgttatgtctctccaccacgtcacagaagacaacctggctgcctgtacttctggggagctttggatgcaagccattgactatgttcctcatcacagaaaacaaaatttggggtaggaagagttggcccctgaatgagggcatcatggcaatagggatcgtgtctattctactgtccagccttctcaaaaacgatgttcctctggctggacccttgatcgccggcggtatgttaattgcctgttatgtgatctcggggtcatctgctgacctgagtctcgagaaggcagccgaagtctcctgggaggaagaggcggaacatagcggaacctctcacaatatactggtggaggtacaggatgacggcactatgaaaattaaggatgaggaacgagacgatacacttaccatcctgttgaaagctacgctactggccgtgagcggcgtctacccaatgtccatccctgcaactctctttgtttggtatttctggcaaaagaagaaacagcgctcaggggtgctgtgggacacccccagtccaccggaggtggaacgggccgtccttgatgacggaatttacagaatattacagaggggtctgctcggccgtagccaggtgggggttggagtattccaagacggcgtgtttcatacaatgtggcacgtcacccgcggtgctgtgttgatgtatcaggggaagcggctggagccttcttgggcatccgttaaaaaggatctcatctcatacggaggcggctggagattccaggggagttggaacacaggagaggaagtgcaggtcattgccgtggagcccggtaaaaatccaaagaacgtacaaactacccccggcacgtttaagacacctgaaggggaggtcggagcggtggctctggacttcaaaccaggcactagcggttcccccatcgttaatagggaagggaagattgtgggactttacggcaacggcgtcgtgaccacatctgggacctatgtttcggccatcgcacaggccaaagctagccaggagggacctctgccggagatagaagatgaggtgtttaagaaacgaaatttgactatcatggacctacacccaggttcaggcaagacccggcgctacctgcccgccattgtcagagaagcaatcaagaggaaactccggacattaattctggctcctacgcgagtggtagcctccgagatggcggaagcccttaaggggatgccaatcagatatcaaactaccgcagtgaaaagtgagcatacaggacgcgagatagttgatctgatgtgccacgctaccttcactatgaggctcttgtctcccgtccgtgtgcctaactacaatatgattatcatggacgaagcccattttacagatccggctagcatcgcagcccggggctatatttccaccagagtgggtatgggggaggccgctgcgatcttcatgacggcaactcccccaggatcagtcgaagcctttcctcagtctaacgctgtaatacaggacgaggaaagggatattcccgagcgcagctggaatagtggctacgactggatcacagatttcccaggcaagaccgtgtggtttgttccttccattaaaagcgggaacgacatcgccaattgtctgcgaaagaacggaaagagagtgatacagctctctcggaaaaccttcgacactgagtatcaaaagacaaaaaacaatgattgggactacgtcgtgaccacagatatttcagaaatgggtgcaaacttcagggccgaccgcgttatcgatccccgtagatgcctgaagccagtgatccttaaagacggcccggagcgggtcattctagctgggcctatgcccgtgactgtagcgtccgccgcacagaggcgcggacgaatcggcagaaatcagaacaaggaaggtgatcagtacgtgtatatggggcaaccactgaataacgacgaggatcacgctcattggacggaggccaagatgttgttagacaatattaacacccccgaaggcataatccctgcactgtttgagccagaacgggagaaaagtgccgctattgatggagaatacaggctccgcggcgaggccagaaagacattcgttgagctgatgaggcggggggaccttcccgtctggctgagctataaagtggcgtcggaaggatttcagtactctgatcgtcgctggtgcttcgacggtgagcgaaataaccaggtgctcgaagagaatatggacgtcgaaatctggactaaggagggcgagagaaaaaagttgaggcctcggtggctggatgcacgcacctattccgacccgctagccctgagagaatttaaagagttcgctgccgggaggcggagcgtttcaggagatctcatccttgaaattggcaagctgccacagcacttaacattgcgagctcaaaacgcactggacaatctcgtgatgctgcacaacagtgagcagggtgggaaggcctacagacatgctatggaagagcttcccgataccatagagactctgatgctcttggccctgatcgcagtattaacgggcggagtgatgctatttttcctgtctggcaaagggctcggaaagacctccattggtcttctgtgtgtcatggcgagctcagccttgctgtggatggctagtgtggaacctcactggatcgccgcaagcattatcctcgagtttttcctgatggttcttctcatacccgaaccagaccgccagaggacacctcaggataatcaactggcttatgtggtcatcggcttgctgtttatgattttaactgtagccgcaaacgagatggggctactggagaccacaaaaaaggacctcggaatcggccatgtggccgctgaaaaccaccaccatgttaccatgcttgatgtggacctgcggcccgcgtccgcctggactttgtacgcagtcgctacaacggtgattaccccaatgatgcgtcacactatcgagaatacaaccgccaacatatctctgaccgccattgcaaatcaggctgccatcctcatgggtctggataaagggtggcctattagcaagatggacatcggcgtcccgcttttagcgctgggatgctactcccaggtgaaccccctcacattgactgctgccgttctgatgctagtggcacattatgccataatcggcccagggctgcaagctaaggcaacgagagaagcccagaaaaggaccgcggctggaattatgaagaatcctacagtagatggcatcgtggccattgacctcgaccccgtcgtttacgatgcaaaattcgagaagcagcttggtcagatcatgctgttgatactgtgtacttcacaaattctcctgatgcgcaccacatgggccttatgcgaatctatcacccttgctactgggccactgacgacactctgggagggaagtcctggcaaattttggaacaccactatcgccgtgtcgatggcaaatattttccggggtagctatctagctggcgccgggctggcgttctccttgatgaagtctctgggaggcgggcgaagaggaaccggcgcccagggtgagacactcggggaaaagtggaaaaggcagcttaaccagctgtcaaagagcgagtttaatacttacaaacgctccggaatcatggaagtcgaccggagtgaggcaaaggaaggcttgaaaagaggtgagaccacaaagcacgctgtgtctcgtggcacggccaagctgaggtggttcgtagagcggaacctcgtgaaacccgaagggaaggttatagatttaggatgtggccgcgggggatggagctattactgcgcaggcctgaaaaaggtgaccgaggtcaaaggttatactaaggggggaccgggccatgaagagccaattcctatggctacatacggctggaatcttgtgaaactgcactcagggaaggacgtctttttcacccccccagaaaagtgtgatactctactctgcgacatcggagagtccagtcccaaccctacaattgaggaaggtcgaaccctgagagtgttgaaaatggttgagccgtggctgggcgggaatcaattttgtatcaagatactcaacccctacatgccaagcgtagtggaaacgcttgagcagatgcagaggaaacacggaggcatgctggtccggaatcctttatctcgcaactccacccatgagatgtattgggtgtcatgcggtacagggaatatcgttagcgccgtgaacatgacttcgagaatgctgttgaacaggttcaccatggcccaccgaaagcccacatacgaacgggatgtcgacctcggagcgggcactcgtcatgtggctgtagagcctgaagtggcaaatctgggcattatcgggcagagaattgagaacatcaaaaatgaacacaagtctacctggcactatgatgaggacaacccatacaagacatgggcctatcatggaagttacgaggttaaaccctccggtagcgcttcatccatggtcaatggcgtggtgcgcctacttaccaagccttgggatgtcattccaatggttactcaaatcgccatgacggacacaaccccctttgggcagcagagggtgttcaaagaaaaggtagacactcggaccccgagagcaaaacgcggaacagcccaaataatggaggtgacggctaagtggctgtgggattttctctctaggaacaagaaacctcgaatttgtacccgggaagagttcatcagaaaggtcaggagcaatgcggccatcggcgcagtgtttgttgacgaaaaccagtggaatagtgctaaagaggccgtggaggatgaacgcttctgggacctggtccaccgtgagcgggaattgcataagcagggtaaatgcgcaacttgcgtgtataacatgatggggaagagagagaagaaactgggagaatttggcaaggccaaaggctccagggctatttggtacatgtggctcggggcccgcttccttgagttcgaggcgctgggatttatgaatgaagatcactggttcagccgagagaactctttatcaggtgtagaaggcgaggggctgcataagttgggatacatactccgggacatcagtaaaattccaggcggtaatatgtatgcagatgacacagccgggtgggataccagaatcactgaggacgatctgcagaacgaagctaagattacagacatcatggagcccgaacacgccctacttgcaacctccatatttaaactgacataccaaaataaggttgtgagggtccagcgccctgctaagaacggaactgtgatggatgtgatcagcagacgggaccagaggggctctggccaggtcgggacctatggactcaacacgttcaccaatatggaggttcaactgattcgtcagatggaatcggagggtatctttttgccatcagagttagaaacaactaacctggccgagcgagtgctcgactggcttgaaaaacacggcgtagagcgcctgaagagaatggctattagcggggatgactgtgtggtcaaacccatcgatgaccggttcgccaccgcactaatagcgctgaatgatatgggaaaggtgaggaaagacattccgcagtgggaaccttccaagggctggaacgattggcagcaagttcccttttgcagtcatcacttccatcagctcatcatgaaggacggtcgcgagatcgtggtcccatgtagaaatcaggatgagttggtggggcgggccagggtatctcagggagctggctggagcctgcgagaaacagcctgccttggcaaatcctacgcacaaatgtggcagctgatgtattttcaccgtagagacctccgcttagctgccaacgcaatttgttcagccgttcctgtggattgggtccccactagtcggaccacgtggtctatacacgcgcatcaccagtggatgacaaccgaggacatgctgagcgtgtggaatagggtttggatcgaagagaacccatggatggaagacaagactcatgtgtcctcatgggaggaggtcccctacttggggaaaagagaagatcaatggtgcggaagcctgattggtctcacagctcgcgccacctgggcaactaatatccaggtggccattaaccaggtacggaggcttatcggcaatgagaactatctggactacatgacctctatgaagcgattcaaaaatgaatccgatcctgagggggctctatggtga

SEQ ID NO: 13482 - RNA, 9879 nt, synthetic construct
  misc_feature 1..9879: note = derived and/or modified CDS sequence (opt3) from DENV-1__FJ562106__SS-prME
  source 1..9879: mol_type = other RNA
agcgtgacaatgctgctcatgcttctgcccacagcattggctttccacttaactacgcggggcggggagcctcatatgatcgtctccaagcaggaaagaggaaagtctctgctatttaagacctcagctggtgttaacatgtgcacactcattgccatggacctgggcgagctttgtgaagatactatgacctacaaatgcccacggataacagaggcggaaccggacgatgtggactgttggtgcaatgctaccgatacttgggtaacatatgggacctgtagtcaaacgggagagcaccgccgagacaagcgtagcgtggccctggcaccccatgtcggcttgggtctcgagactagaaccgaaacatggatgtcctctgagggggcctggaaacagatccagaaggtggaaacttgggctctgaggcaccctggattcaccgttattgcactgtttctcgcccatgctatcggcacatcgattacccagaagggcatcatattcatcttactgatgcttgtgacgccatcaatggccatgcggtgcgtcgggattggaaaccgcgattttgtggagggtttgagcggcgcgacttgggtagacgttgtgctggagcacgggagttgtgtcacaaccatggccaagaataagcccactctagatatcgaactcctgaaaacagaggtgaccaaccctgccgtgcttcggaagctgtgcattgaagctaaaatctccaatacgaccacagactctaggtgtccaactcaaggagaggccaccttggtcgaggaacaggatgcaaacttcgtttgccggcgcacatttgtggaccgaggctggggtaatgggtgtggactcttcggcaagggcagcctgttaacttgcgctaagtttaaatgcgtaaccaagctggaggggaaaatagtgcagtacgaaaacctcaagtattccgtcattgtgacagttcacaccggagatcagcatcaagtgggtaatgagactacggaacacggcacaatcgccaccattactccccaggcgcctacctcagagatccagcttacagactacggggccctgaccttggactgtagtccaagaactggactagatttcaacgaaatggtcctgctcacaatgaaagaaaagagctggctggtgcataaacagtggtttcttgacctgccgttgccctggacgtctggcgcatccacctcacaagagacttggaataggcaggatctcctggtaacattcaagaccgctcacgccaagaaacaggaagttgtggtcttaggtagccaagagggggctatgcacacagccctgactggcgcaaccgaaatccagacgagtggaaccacaactatttttgccggccatctaaagtgccggctcaaaatggacaagctgacccttaaagggatgtcttatgtgatgtgtacaggatccttcaagttggagaaggaagtcgctgagactcagcacggtaccgtgctggttcaggtgaaatacgagggcacggatgcgccttgcaagataccattcagcacacaagacgaaaaaggggtaacccagaacggacgtctcatcactgcaaatcccattgtcacagataaggagaaacctgtgaacatcgaaaccgagccaccctttggcgagtcgtatataatggttggtgccggggaaaaggctctgaaactttcttggttcaaaaagggctcctcaattggaaaaatgtttgaggccactgcacgcggcgccagaaggatggctatcctgggggacaccgcctgggatttcggaagtatcggtggcgtgtttacaagcgtcgggaagttggtgcatcaggtattcggaacggcatacggcgtgctcttttccggtgtttcttggaccatgaaaattgggatcggcattctgttaacttggctgggactaaatagccggtcagcgagtctctccatgacatgtatagctgtcggcatggtgaccctgtaccttggggtgatggtccaggccgacagcggatgcgttatcaactggaagggccgagaattgaagtgtggttctgggattttcgtgacaaacgaggtgcacacttggaccgaacaatataaatttcaggcagattcaccgaagcgcctgagtgccgctatcggaaaagcctgggaggagggcgtatgcggtatcagaagcgcaacgaggctcgaaaatattatgtggaagcagatatccaacgagctgaatcatatcttactggaaaacgacatgaaattcacagtcgtggttggcgacgctaatgggattcttgcccagggaaagaaaatgatccggcctcaacccatggagcacaagtactcttggaagtcgtggggcaaagcgaagattatcggggccgatatacagaacaccacttttatcattgacggaccagatacccctgaatgtcccgacgatcagcgcgcttggaatatctgggaggtggaggactatggcttcggtatttttacaactaacatctggttgaaactcagagatagctacacccagatgtgcgaccacaggctgatgtccgcagccattaaaaattcaaaagctgtccatgccgatatggggtattggatagaaagtgagaagaacgaaacatggaagctagcacgtgcgtctttcatcgaggtgaaaacgtgtatttggccaaagagccacaccctgtggtccaatggagttctcgaatcagagatgatcatacccaaaatctacggcggtcctattagccaacataactatcggccaggctacttcactcagacagccgggccgtggcacctgggaaaacttgagttggactttggcctgtgcgaagggaccactgtggtagtcgatgagcactgcggaaatcgaggcccctctttaagaacaaccacggtgactggtaaaatcattcatgaatggtgttgcaggtcctgtaccctccctccactgcgcttcagaggggaagacggatgctggtacggcatggagatcagacccgtgaaggaaaaggaggaaaaccttgtcaggagtatggttagcgctggttctggcgaggtggattccttttcactggggatattgtgtgtaagtattatgatcgaagaggtgatgcgcagccgatggtcgcggaaaatgctcatgacaggaaccctggccgtcttcctactgctcatcatgggccagctgacttggaatgaccttattcgtttgtgcatcatggtgggggcaaacgcttccgacagaatgggaatgggcacaacctatctggccttaatggcaacatttaagatgaggcctatgttcgccgttggtctcctgtttcgccggcttacttctagagaggtgctgctactcaccattgggctgagcttggtcgcttcagtggaactgccaaacagtttagaggaactcggagatggcctggcgatgggcataatgatgcttaaactgttgacggagttccaaccccaccagctctggacaaccctgctatccctgacttttatcaagaccacattctctcttgactacgcctggaaaactatggcaatggttctcagcattgtgtccctgtttccgttgtgtctgtcaaccacgagccagaagacaacctggttacctgtcctcctggggagtttcggatgcaagccacttactatgtttctgatcacagaaaataaaatttggggtaggaagtcttggcccttgaacgagggcatcatggctatagggatcgtatccattctcctgagctcgctactgaaaaatgatgtgcctcttgccggacccctcatcgccggcggtatgctgattgcttgttatgttatctcagggtctagtgcagacttgtccttagagaaggccgcggaagtgagctgggaggaagaggctgaacattctggaaccagccacaacatactggtcgaggtgcaggatgacggcactatgaaaattaaggatgaggaacgagacgatacactcaccatcctgcttaaagccacgctgttggcagtatccggcgtgtacccaatgtcaatccctgccactctattcgtctggtatttctggcaaaagaagaaacagcgcagtggggttctgtgggacacccccagcccaccggaggtggaacgggctgtgctcgatgacggaatttacagaatactgcagaggggtcttttaggccgttctcaggtcggggtgggagtttttcaagatggcgtattccatacaatgtggcacgtgacccgcggtgcagtcctgatgtatcaggggaagcggctcgagccttcctgggcctcagtgaaaaaggacttgatcagttacggaggcggctggagatttcaggggagctggaatacaggagaggaagttcaggtgattgcggtcgagcccggtaaaaacccaaagaatgtgcaaactacccccggcacgttcaagacacctgaaggggaggtaggagctatcgccctggactttaaaccaggcacttccggttctcccattgtcaacagggaagggaagatcgtgggactctacggcaatggcgttgtgaccacatcggggacctatgtcagcgcaatagcccaggctaaagcctcacaggagggacctctgccggagatcgaagatgaggtgttcaagaaacgaaaccttactattatggacctgcacccaggttccggcaagacccggcgctacttgcccgcaatcgttagagaagctattaagaggaaactacggacactgatcctcgcccctacgcgagtggtcgcgagtgagatggccgaagcattaaaggggatgccaataagatatcaaactaccgctgtgaaatctgagcatacaggacgcgagattgtagatctgatgtgccacgccacctttactatgaggcttctgagccccgtgcgtgttcctaattacaacatgatcatcatggacgaagctcatttcacagatccggcatccattgccgcccggggctatatctcaaccagagtcggtatgggggaggctgcggcaatatttatgacggccactcccccaggatctgtggaggctttccctcagagcaatgccgtgattcaggacgaagaaagggatatccccgagcgcagttggaactccggctacgactggattacagattttccaggcaagaccgtctggttcgtacctagcatcaaatctgggaatgacatagcaaactgtctccgaaagaacggaaagagagtgattcagttgtcacggaaaaccttcgatactgagtatcaaaagaccaagaataacgactgggactacgttgtgaccacagatatctccgaaatgggtgccaattttagggctgaccgcgtcatcgatccccgtagatgcctgaagccagtgattctcaaagacggcccggagcgggttatcctggcggggcctatgcccgtgactgtcgccagtgcagctcagaggcgcggacgaattggcagaaaccagaataaggaaggtgatcagtacgtgtatatggggcaaccacttaacaatgacgaggatcacgcccattggacggaggcaaagatgctactggacaacataaatacccccgaaggcatcattcctgccttgttcgagccagaacgggagaaaagcgctgccatcgatggagaatacaggttacgcggcgaggcgagaaagacatttgtagagctgatgaggagaggggacctccccgtgtggctgtcgtataaagttgcatctgaaggattccagtactccgatcgtcgctggtgctttgacggtgagcgaaacaatcaggtccttgaagagaacatggatgtggaaatctggactaaggagggcgagaggaagaagctgaggcctcggtggctcgacgcccgcacctatagcgacccgttggctctgagagagttcaaagagtttgccgctgggaggcggtcagtgagtggagatctaattctggaaataggcaagctcccacagcaccttacactgcgagcacaaaatgccttagacaacttggtcatgctgcacaattctgagcagggtgggaaggcttacagacatgccatggaggaactccccgataccatcgagactctgatgcttctggcactcattgcggttttgacgggcggagtgaccctgttctttttatccggcaaagggctaggaaagacaagcatcggtctgctctgtgtaatggcctcaagtgcacttctgtggatggccagcgtggaacctcactggattgcagcttccatcatattggagttctttctgatggtcctcctgatccccgaaccagaccgccagaggactcctcaggataaccaacttgcctatgtggttattggcctcctgttcatgatcttgaccgtggcagccaacgagatggggctgttagagacaaccaaaaaggacctaggaattggccatgtcgctgcggaaaatcaccaccatgccactatgctggatgtagacctccggcccgcatctgcttggacactttacgccgtggccacgaccgttatcactccaatgatgcgtcacacaatagagaacaccaccgcaaatattagcctgacagctatcgccaaccaggcggctattttgatgggtctggataaagggtggcctatctccaagatggacataggcgtgccgctcctggcccttggatgctactcacaggtcaatcccttaactctgacggcagccgtgctcatgttggtcgctcattatgcaatcattggcccagggctgcaagccaaggcgaccagagaagctcagaaaaggacagccgcaggaatcatgaagaaccctactgtggatggcattgttgccatcgacctagatcccgtggtatacgacgctaaatttgagaagcagctgggtcagataatgctccttattctgtgtacctctcaaatcttgctgatgcgcacaacctgggccctctgcgaaagtatcactctggcaacggggccattaacaaccctttgggagggatcgcctggcaaattctggaatactaccattgctgtgagcatggccaacatcttccggggttcctatctggcgggcgccgggctcgcattttctctaatgaagtcactgggaggcgggcgaagaggaacaggcgctcagggtgagactttgggggaaaagtggaaaaggcagctgaatcagctcagcaagtccgagttcaacacctacaaacgcagtggaataatggaagtcgaccggtctgaggccaaggaaggccttaaaagaggtgagacaacgaagcacgcagttagccgtggcaccgctaagctgaggtggtttgtggagcggaatttggtcaaacccgaagggaaggtgattgatctgggatgtggccgcgggggatggtcatattactgcgccggcctcaaaaaggtaactgaggtgaaaggttatacaaaagggggaccgggccatgaggagccaatccctatggccacctacggctggaacttagttaaactgcactccgggaaggacgtgttctttactcccccagaaaagtgtgatacacttctgtgcgacattggagagagtagccccaatcctaccatcgaggaaggtcgaacgctaagagtcctcaaaatggtggagccgtggctgaggggcaaccaattctgtataaagatcttgaatccctacatgccatctgtcgtggaaaccctggagcagatgcagcggaaacacgggggaatgctcgttcgcaaccctctttccagaaattcaacacatgagatgtattgggtaagctgcggcactggtaacattgtgtcggcggtcaacatgacctctaggatgctgttaaatcgatttacaatggctcaccggaagcccacttacgaacgtgatgtggacctgggggcaggaaccagacatgttgccgtggagcctgaagtcgctaacttggatatcattggccagcgcatcgagaatattaaaaacgaacacaagagtacatggcactatgacgaggataatccatacaagacctgggcctatcatggctcctacgaggtgaaacccagcgggtcagcatcctctatggtaaacggagtggttaggctcctgactaagccttgggacgtcatcccaatggtgacgcaaatagccatgacagataccactcccttcggtcagcagcgggtgtttaaagaaaaggtcgacaccagaacaccgcgcgctaaaaggggcacggcgcaaattatggaggttaccgccaagtggctatgggggttccttagccgaaataagaaacctcggatctgtactagagaagagtttacaaggaaggtgcgcagtaacgcagctatcggagccgtattcgtggacgaaaatcagtggaactccgcaaaagaggccgtcgaggatgaacgtttttgggacctggtgcaccgggagagagaactccataagcagggcaaatgcgctacctgcgtttataatatgatgggtaagagggagaagaaactgggggagttcggaaaggccaaaggcagccgcgcgatttggtacatgtggttgggcgcacgattcctggagtttgaggccctcgggttcatgaacgaagatcactggttttctcgggaaaattcacttagtggagtggaaggtgagggcctgcataagttagggtacatactgagagacatctccaaaattccaggaggcaacatgtatgctgatgacactgccggttgggatacaaggatcaccgaggacgatttgcagaatgaagcaaagattacagacatcatggagcccgaacacgctctcctggccactagcatattcaaactaacctaccaaaacaaggtcgtgcgcgtacagagacctgctaagaacgggacggttatggatgtgatctctcggagggaccagcgtggatcgggccaggtcggcacctatgggcttaatacatttactaacatggaggtgcaactgattcgacagatggaatcagagggaatcttcctcccatgtgagctggaaacccccaatttggccgagcgcgtgttagattggctggaaaaacacggtgcagagagactcaagcggatggcgattagcggcgacgactgcgtcgttaaaccgatcgatgacaggtttgccacagctcttatagccctgaacgatatggggaaggtgcgcaaagacattcctcagtgggaaccctccaagggatggaatgattggcagcaagtaccattctgtagtcatcactttcatcagctaatcatgaaggacggcagagagatcgtggtcccttgccggaaccaggatgagctggtgggtagggcacgagtttctcagggggctggatggagcctccgtgaaactgcctgtttgggcaaatcctacgcacaaatgtggcagctgatgtatttccacagacgcgaccttcggctggccgcgaatgctatttgctcagccgtgcccgtcgattgggtgccaaccagtaggacgacatggtctatacacgcacatcaccagtggatgaccactgaggacatgctcagcgtatggaacagagtttggatcgaagagaatccctggatggaagataagacacatgtgtcctcatgggaggaggtcccttacttaggcaaacgcgaagaccaatggtgtgggagcctgattggattgaccactcgggccacctgggctacaaacatccaggtggccattaatcaggttaggcgactgatcggtaacgagaattatctcgactacatgacgtctatgaagagatttaaaaacgaatccgatccagagggcgcactttggtga

SEQ ID NO: 13483 - RNA, 9879 nt, synthetic construct
  misc_feature 1..9879: note = derived and/or modified CDS sequence (opt3) from DENV-1__FJ410179__SS-prME
  source 1..9879: mol_type = other RNA
agcgtgaccatgctgctcatgcttctgcccaccgccttggctttccacttaactacgagaggaggggagcctcatatgatcgtctccaagcaggaaaggggaaaatctctgttgtttaagacctcagcaggtattaacatgtgcacactcatagccatggacctgggcgagctttgtgaagatactatgacctacaaatgcccacggatcacagaggcggaaccggacgatgttgactgttggtgcaatgctaccgatacttgggtgacatatgggacctgtagtcagacgggagagcaccgccgagacaagcgtagcgtagccctggcaccccatgtgggcttgggtctcgagactagaaccgaaacatggatgtcctctgagggggcctggaaacagattcagaaggtcgaaacttgggctctgaggcaccctggattcaccgtgacagcactgtttctcgcccatgctatcggcacctcgattacgcagaagggcatcatattcatcttactgatgcttgttactccatcaatggccatgcggtgcgtggggattggaaaccgcgattttgtcgagggtttgagcggcgcgacatgggtggacgttgttctggagcacgggagttgtgtgaccactatggcaaaagataagcccacactagacatcgaactcctgaaaaccgaggtcacgaatcctgccgtgcttagaaagctgtgcattgaagctaaaatctccaacaccacaactgattctaggtgtccaacccaaggagaggccacattggtggaagaacaggacagcaatttcgtctgccggcgcacttttgttgatcgaggctggggtaacgggtgtggactcttcggcaagggctccctgttaacctgcgcaaagtttaaatgcgtgacaaagctggaggggaaaatagtacagtacgaaaatctcaagtattcagtgattgtcaccgtgcacactggagaccagcatcaagttggtaacgagacgacagaacacggcaccatcgctactattacaccccaggcccctacaagtgagatccagcttaccgactacggggcgctgactttggattgtagcccaagaacaggactagacttcaatgaaatggtgctgctcacgatgaaagagaagtcttggctggtccataaacagtggtttcttgatctgccgttgccctggacctccggcgcctcaactagccaagagacatggaacaggcaggacctcctggtgaccttcaagacagcacacgctaagaaacaggaagtagttgtgttaggtagtcaagagggggccatgcacactgctctgaccggcgccacggaaatccagacctctggaacaactaccatttttgcaggccatctaaagtgccggctcaaaatggataagctgacacttaaagggatgtcctatgtcatgtgtactggcagcttcaagttggagaaggaagtggccgagacccagcacggtacggtcctggtgcaggttaaatacgagggcacagacgctccttgcaagataccattctcggcgcaagatgaaaaaggggtgacccagaatggacgtctcatcactgcaaaccccattgtaacagacaaggagaaacctgtcaatatcgaaaccgagccaccctttggcgagtcttatatagtggttggtgccggggaaaaggctctgaaactttcctggttcaaaaagggctcaagtattggaaaaatgtttgaggccactgcacgcggcgccagaaggatggctatcctgggggataccgcctgggacttcggaagcatcggtggcgtgtttacatccgtcgggaagttggtgcatcaggtattcggagcagcgtacggcgtgctcttttctggtgttagctggacgatgaaaattgggatcggcattctgttaacctggctgggactaaactcacggagtacttccctcagcatgacatgtatagctgtcggcatggtgaccctgtaccttggggtgatggtccaggccgattctggatgcgttatcaattggaagggccgagaattgaagtgtggttcagggattttcgtgacaaacgaggtgcacacttggaccgaacaatataaatttcaggcagacagtccgaagcgcctgagcgccgctatcggaaaagcctgggaggagggcgtatgcggtatcagatccgcaacgaggctcgaaaacattatgtggaagcagatatctaatgagctgaaccatatcttactggaaaatgacatgaaattcacagtcgtggttggcgatgctaacgggattcttgcccagggaaagaaaatgatccggcctcaacccatggagcaccgctactcgtggaaaagctggggcaaggcgaagattatcggggccgacatacaaaattccacctttatcattgatggaccagacactcctgaatgtcccgatgaccagagagcttggaacatctgggaggtggaggattatggcttcggtatttttaccacaaatatctggttgaagctcagggactcatacactcagatgtgcgatcaccgtctgatgagtgcagccataaaagactctaaggctgtccatgccgatatggggtattggattgaaagcgagaaaaacgaaacctggaagctagcacgggcgtccttcatcgaggtgaagacatgtatttggccaaaatcacacacgctgtggagcaatggagttctcgaatctgagatgatcatacccaagatgtacggcggtcctatctcccaacataactatcgaccaggctacttcacccagactgccgggccgtggcacctgggaaaacttgagttggactttgatctgtgcgaaggcacaaccgtggtagtcgacgagcactgcgggaatagaggacccagtttaaggactacaaccgtgacgggcaagattatccatgaatggtgttgccgcagctgtactctccctccactgcggttcagaggtgaggacgggtgctggtacggaatggagattaggcccgtgaaagaaaaggaggaaaaccttgtccgctctatggtttccgctggctcaggtgaggtggatagttttagcctgggcatcttgtgtgtatcgataatgattgaagaggtgatgcgatcccggtggtctcgtaagatgctcatgaccgggacactggccgtcttcctactgctcatcatgggacagctgacctggaatgaccttatcagattgtgcattatggtgggcgcaaacgctagcgataggatggggatgggaactacatatctggccttaatggcaacctttaaaatgcgccctatgttcgccgttggcctcctgtttcggagacttacatcaagggaggtgctgctactcactatcggtctgagtttggtcgcttccgtggaactgccaaattctttagaggaactcggggacggactggcgatgggcattatgatgcttaagctgttgaccgagttccaaccccaccagctctggacgacactgctaagcctgacctttataaaaactaccctttccctcgattacgcctggcgaacaatggcaatggttctgtcaatcgtgagcttgttcccgctgtgtttaagtactacctctcagaagacgacatggctccctgtcctgcttggctcctttgggtgcaaaccactgaccatgttcttgattactgaaaacaagatctggggacgcaagagctggcccctcaacgagggtattatggctatcggcatagtatcgatcctgctatcatctctgcttaaaaatgacgtgcctctcgccgggcccctgattgccggaggcatgttgatcgcttgttatgttattagtggttccagcgcagatttatctctggagaaggccgcggaagtgagctgggaggaagaggctgaacattccgggacatcacacaacatcctcgtcgaggtgcaggacgatggaaccatgaaaataaaggacgaggaacgggatgacactctgacaattcttctgaaagccaccttgctagcaatcagtggcgtatacccaatgagcatccctgccacgctgtttgtgtggtatttctggcaaaagaaaaagcagagatctggcgtcctctgggatactccctccccaccggaggttgaaagggctgtgctggacgacgggatttaccgtatacttcagcgcggattactgggtcggtcacaggtgggcgtcggggtgttccaagatggagtttttcataccatgtggcacgtaacaagaggcgcagtgctcatgtatcagggtaagaggttggagcctagttgggccagcgtcaaaaaggacctgatctcctacgggggaggctggcgattccagggctcttggaataccggggaggaagtgcaggttattgcggtggagcccggcaagaacccaaagaatgtccaaacaactcccggtacctttaaaacgcctgaaggcgaggtgggggctatcgccctcgatttcaagccaggaacatcgggcagccccattgtaaaccgggaaggtaagatcgtcgggctgtacggaaatggcgtggttactacctcaggcacatatgtgtccgcaatagcccaggctaaaaccagtcaggaggggcctcttccggagatcgaagaggaagtctttaagaaacgcaacctgactattatggacttgcacccaggatctggtaagaccagaaggtacctacccgccatcgtgcgggaggcaattaaacgaaagctgagaacactcatcttagctcctacgcgcgttgtggccagcgaaatggcggaggccctgaagggcatgccaataaggtatcaaactaccgcagtcaaatccgagcatacagggcgtgaaattgtggatcttatgtgccacgctaccttcactatgcggctgctctcacccgtaagagtgcctaattacaacatgatcatcatggacgaggcccattttacagatccggcttctattgcagccaggggatatatcagcacccgcgttggcatgggtgaagccgctgcgatattcatgacggcaactcccccagggagtgtcgaggcctttcctcagtccaatgctgtgattcaggacgaagaacgagatatccccgagagaagctggaactctggatacgactggattacagatttcccaggcaagaccgtgtggtttgtcccttcaatcaaatccggcaatgacatagccaactgtttgcggaagaatgggaaaagggtaattcagctgagtcgcaagaccttcgacactgaatatcaaaagacacgtaacaacgattgggactacgtggttaccacagatatcagcgagatgggagcaaatttcagagccgaccgggtgatcgatcccaggcgctgcctcaaaccagtcattctgaaggacggtccggaacgagtgatccttgctggccctatgcccgttactgtggcgtcggccgcacagagacgggggaggattggacgcaaccagaataaagagggcgatcagtacgtctatatgggtcaaccactaaacaatgacgaggatcacgctcattggacggaagccaagatgctgttggacaacataaatacccccgaggggatcattcctgcattatttgaaccagagagagaaaaatctgccgctatcgatggcgagtacaggctgcggggagaggcccgtaagacattcgtggaactcatgcgccgaggcgacctgcccgtatggctttcctataaggtggcgagcgaggggtttcagtactcagatagaaggtggtgcttcgacggagaacggaacaatcaggttctggaggaaaacatggacgtcgagatctggactaaagagggtgaacgcaagaaactcagacctaggtggttggatgcacggacctatagtgacccgctggccctacgagagtttaaggagttcgctgccggcagacgctctgtgtccggggatctgattctcgagataggaaaacttccacagcacctgacattaagggctcaaaatgcattggacaacctggtgatgctccacaatagcgaacagggcggtaaggcctaccggcatgctatggaggagctgcccgataccatcgaaactcttatgctgctcgccttgattgcagtcctgaccgggggagttacgttatttttcctatcaggaaaaggcctggggaagacaagtatcggactcctttgtgtgatggcgagctccgccctgttgtggatggctaacgtagagcctcactggattgccgcatctatcatactggaatttttcctcatggtgctgcttatccccgagccagaccgtcagagaactcctcaggataatcaactcgcttatgtcgtgattggtctgttgtttatgatcctgaccgttgccgcaaacgagatgggcttactagaaacaaccaagaaagacctggggattggacatgtggccgctgagaaccagcaccacgcgactatgctcgatgtcgaccttaggcccgccagcgcatggacactgtacgctgtagccacgaccgtgatcactccaatgatgcgccatacaatagaaaataccaccgccaacatttccttgacagcaatcgctaatcaggccgcgattctgatgggcctcgataagggttggcctatctcaaaaatggacataggggttccgctgcttgctttaggctgctactctcaagtgaaccccctgactctcacggccgcagtcttgatgctggtggcccactatgctatcattggaccaggcctacaggcaaaggccacccgggaggcgcagaaacgaacagctgccgggatcatgaagaatcctactgtcgatggaattgtggcaatcgacctggaccccgttgtgtacgatgccaagttcgaaaaacagctcggccaaataatgcttctgattttgtgtaccagtcagatcctgctcatgagaacaacctgggctctgtgcgagtcgatcactttagccacgggtccacttacaaccctgtgggaggggagccctggaaagttttggaacactaccattgcagtatccatggctaatatcttcaggggctcttatctcgccggtgcgggcctagccttctcactgatgaaaagcctagggggaggccgccgggggacaggagcacagggcgaaactctgggtgagaagtggaagagacagctcaaccaactttccaagagtgaatttaatacctacaagcgttctgggataatggaggtggacaggagcgaagctaaagagggactgaagcggggcgagacaacgaaacatgccgtctcacgcggtaccgcaaagttgcgatggttcgttgaaagaaacctggtgaaacccgagggcaaggtcattgatctcgggtgtggaaggggcgggtggtcctattactgcgctggattaaagaaagtgactgaagtaaagggctatacaaaaggtgggccgggacacgaggaaccaatccctatggccacctacggctggaatctggtgaaactttacagtggcaaagacgtatttttcactcccccagagaagtgtgatacactgctatgcgacattggggagagctctcccaaccctaccatcgaagagggacggacgctccgcgtgctgaaaatggtcgaaccgtggttgagaggtaatcagttttgtataaagatcctgaacccctatatgccatccgtggtcgagaccctcgagcagatgcagaggaagcatggcgggatgcttgtgcgaaatcctctgtcacggaacagcacacacgaaatgtactgggtttcgtgcggaactggcaatattgtatctgccgtgaacatgaccagtcgtatgttactgaacagattcacaatgactcaccgcaaacccacctatgagagggatgtcgacttgggtgcggggacacggcatgtggctgttgaacctgaggtggcaaatctcgatatcattggacaaagaatcgaaaacattaagaatgagcacaaatccacctggcattacgacgaggataacccatataagacttgggcctaccacggcagctatgaagtcaaaccctcaggctccgcttctagcatggtgaatggggtagtgcgcctgctaacgaagccttgggacgttatcccaatggtcacacagatagccatgaccgacactaccccctttggacagcaaagggtgttcaaggagaaagtggatacacgaacgccgcgggcaaagagaggtaccgcccagattatggaagtcactgctaaatggctttggggctttctgagtaggaacaagaaacctcgcatctgtacacgtgaggagttcacccggaaggttagatccaatgcggccatcggggcagtgtttgtagacgagaaccagtggaatagcgctaaggaggccgtggaagatgagaggttctgggacctcgtccaccgcgaacgagagctgcataaacagggaaagtgcgcaacttgcgtgtacaacatgatgggcaaacgggaaaagaaattgggtgagtttgggaaggccaagggatctagagctatttggtacatgtggctgggcgccaggttcctcgagttcgaagcgcttggctttatgaatgaggatcactggttctcacgcgaaaacagtttttccggggttgagggagagggtctgcataaattaggctatatactgagagacatcagcaagattccagggggaaatatgtacgcagatgacacagccggctgggatacccggatcacagaagacgatttgcaaaacgaggctaaaattactgacatcatggaacccgagcacgccctcctggcaacctctatattcaagctaacgtatcagaataaagtggtcagggtgcagcgtcctgctaagaacggtaccgtaatggatgttatctcgcgacgcgaccagagagggtcaggacaagtgggcacatacggccttaacacttttaccaatatggaagtccagctgattcggcagatggagagcgaggggatcttcctcccatccgaactggagacacccaacttggccgaaagggtgttagactggctggagaaacatggaactgaacgcctcaagagaatggctattagtggtgatgactgtgtggtcaagccggttgatgaccggtttgccaccgcacttatcgcgctgaatgatatgggcaaagtgaggaaggacatacctcagtgggagccctctaaagggtggaacgattggcaacaggtaccattctgcagccaccactttcatcagctaattatgaaggacggacgagagatcgtggtcccttgtcgtaatcaggatgaactggtgggcagagcccgcgtttcccaaggtgctgggtggtcactccgggagacggcctgcttgggaaaaagttatgcacagatgtggcagctgatgtacttccacaggagagaccttcgcctggctgccaacgcaatctgttctgccgtgcccgtcgattgggtgccaacaagccggaccacttggtccattcatgcgcaccaccaatggatgacaaccgaagacatgctctcagtatggaatagggtttggatagaggaaaacccctggatggaggacaagactcatgtgagctcttgggaggaagtcccttatttaggcaagcgagaggatcagtggtgcggctccctgatcgggttgaccgctagagccacatgggcaacgaatattcaggtggccatcaaccaggttcggaggctgattggaaatgaaaactacctcgactacatgaccagtatgaaacgctttaagaatgagagcgatccagagggtgctctttggtga

SEQ ID NO: 13484 - RNA, 9879 nt, synthetic construct
  misc_feature 1..9879: note = derived and/or modified CDS sequence (opt3) from DENV-1__FJ410181__SS-prME
  source 1..9879: mol_type = other RNA
agcgtgaccatgctgctcatgcttctgcccaccgccttggctttccacttaactacgagaggaggggagcctcatatgatcgtctccaagcaggaaaggggaaaatctctgttatttaagacctcagttggtattaacatgtgcacactcatagcaatggacctgggagagctttgtgaagatactatgacctacaaatgcccacggatcacagaggccgaaccggacgatgtggactgttggtgcaatgcgaccgatacttgggtaacatatgggacctgtagtcaaacgggagagcaccgccgagacaagcgtagcgtggctctggcaccccatgtcggcttgggtctcgagactagaaccgaaacatggatgtcctctgagggggcatggaaacagattcagaaggtggaaacttgggccctgaggcaccctggattcaccgttacagctctgtttctcgcacatgccatcggcacctcgattacgcagaagggcatcatattcatcttactgatgcttgtgactccatcaatggctatgcggtgcgtcgggattggaaaccgcgattttgtggagggtttgagcggcgccacatgggtagacgttgtgctggagcacgggagttgtgtcaccactatggcgaaagataagcccacattggacatcgaactcctgaaaaccgaggtgacgaatcctgcagtgcttagaaagctgtgcattgaagccaaaatctccaacaccacaactgattctaggtgtccaacccaaggagaggctacattggtcgaggaacaggacagcaatttcgtttgccggcgcacttttgtggatcgaggctggggtaacgggtgtggactcttcggcaagggctccctgttaacctgcgccaagtttaaatgcgtaacaaagctggaggggaaaatagtgcagtacgaaaatctcaagtattcagtcattgtgaccgttcacactggagaccagcatcaagtgggtaacgagacgacagaacacggcaccatcgcaactattacaccccaggctcctacaagtgagatccagcttaccgactacggggccctgactttggattgtagcccaagaacaggactagacttcaatgaaatggtcctgctcacgatgaaagagaagtcttggctggtgcataaacagtggtttcttgatctgccgttgccctggacctccggcgcgtcaactagccaagagacatggaacaggcaggacctcctggtaaccttcaagacagcccacgcaaagaaacaggaagttgtggtcttaggtagtcaagagggggctatgcacactgccctgaccggcgctacggaaatccagacctctggaacaactaccatttttgccggccatctaaagtgccggctcaaaatggataagctgacacttaaagggatgtcctatgtgatgtgtactggcagcttcaagttggagaaggaagtcgcagagacccagcacggtacggtgctggttcaggtgaaatacgagggcacagacgccccttgcaagataccattctcggctcaagatgaaaaaggggtaacccagaatggacgtctcatcactgcgaaccccattgtcacagacaaggagaaacctgtgaatatcgaaaccgagccaccctttggcgagtcttatatagttattggtgcaggggaaaaggccctgaaactttcctggttcaaaaagggctcaagtatcggaaaaatgtttgaggctactgcccgcggcgcaagaaggatggccatcctgggggataccgcttgggacttcggaagcattggtggcgtgtttacatccgtcgggaagttggtgcatcaggtattcggagccgcatacggcgtgctcttttctggtgttagctggacgatgaaaatcgggattggcatactgttaacctggctgggactaaactcacggagtacttccctcagcatgacatgtatcgcggtcggcatggtgaccctgtaccttggggtgatggtccaggctgattctggatgcgttattaattggaagggccgagaattgaagtgtggttcagggatcttcgtgacaaacgaggtgcacacttggaccgaacaatataaatttcaggccgacagtccgaagcgcctgagcgcagccatcggaaaggcttgggaggagggcgtatgcggtattagatccgccacgaggctcgaaaacataatgtggaagcagatctctaatgagctgaaccatattttactggaaaatgacatgaaattcacagtcgtggttggcgatgcaaacgggatccttgctcagggaaagaaaatgattcggcctcaacccatggagcaccgctactcgtggaaaagctggggcaaggccaaaatcataggggcggacatccagaataccacttttattatcgatggaccagacacccctgaatgtcccgatgaccagagagcctggaacatttgggaggtggaggattatggcttcggtatctttacaactaatatatggttgaagctcagggactcctacacccagatgtgcgatcaccgtctgatgtcagctgcaattaaagacagtaaggccgtccatgctgatatggggtattggatcgaatctgagaaaaacgaaacatggaagctagcccgggccagcttcattgaggtgaagacgtgtatctggccaaaatcccacaccctgtggtcaaatggagttctcgaaagcgagatgataatccccaagatttacggcggtcctatctctcaacataactatcgaccaggctacttcactcagacagcggggccgtggcacctgggaaaacttgagttggactttgatctgtgcgaaggcaccactgtggtagtcgacgagcactgcgggaatagaggaccctccttaaggacaaccacggtgactggcaagattatccatgaatggtgttgccgcagttgtaccctccctccactgcggttcagaggtgaggacgggtgctggtacggaatggagataaggcccgtgaaagaaaaggaggaaaaccttgtccgcagcatggtttctgccggctccggtgaggtggattcatttagtctgggcattttgtgtgtaagcatcatgatcgaagaggtgatgcgatcgcggtggtcccgtaagatgctcatgacagggaccctggctgtcttcctactgctcattatgggacagctgacttggaatgaccttatcagattgtgcattatggtgggcgccaacgcatctgataggatggggatgggaacaacctatctggctttaatggccacatttaaaatgcgccctatgttcgcagttggcctcctgtttcggagacttactagcagggaggtgctgctactcaccataggtctgtcattggtcgccagtgtggaactgccaaattccttagaggaactcggggacggactggctatgggcatcatgatgcttaagctgttgacggagttccaaccccaccagctctggacaaccctgctatctctgacttttattaaaaccacacttagcctcgattacgcgtggcgaactatggccatggttctgtccatcgtgtcattgttcccgctgtgtttaagcaccacgagtcagaagacaacctggctccctgtcctgcttggctcttttgggtgcaaaccactgactatgttcttgattacagaaaacaagatctggggacgcaagtcctggcccctcaacgagggtataatggcaatcggcattgtaagcatcctgctatcgtcactgcttaaaaatgacgtgcctctcgctgggcccctgattgccggaggcatgttgatcgcctgttatgttatatctggtagttccgctgatttaagcctggagaaggcagccgaagtgtcttgggaggaagaggcggaacatagcgggacctcccacaacattctcgtcgaggtgcaggacgatggaactatgaaaatcaaggacgaggaacgggatgacacactgaccatccttctgaaagctacgttgctagccgtatcaggcgtgtacccaatgagtattcctgcaactctgtttgtctggtatttctggcaaaagaaaaagcagagaagcggcgttctctgggataccccctctccaccggaggtggaaagggccgtgctggacgacgggatataccgtatccttcagcgcggattactgggtcggtcccaggtcggcgtgggggttttccaagatggagtatttcatacaatgtggcacgtgaccagaggcgctgtcctcatgtatcagggtaagaggttggagccttcatgggcaagtgtgaaaaaggacctgattagctacgggggaggctggcgattccagggctcctggaatacaggggaggaagttcaggtgatcgccgtcgagcccggcaagaatccaaagaatgtgcaaactacccccggtacgtttaaaacacctgaaggcgaggtaggggcgattgctctcgatttcaagccaggaacttctggctcgcccatcgtcaaccgggaaggtaagatagtggggctgtacggaaatggcgttgtgaccacaagcggcacctatgtctcagccatcgcacaggccaaaacttcccaggaggggcctcttccggagattgaagacgaggtgtttaagaaacgcaacctgaccatcatggatttgcacccaggaagtggtaagacaagaaggtacctacccgctattgttcgggaagccatcaaacgaaagctgagaacgctcatattagcacctactcgcgtggtcgcttctgagatggccgaagcgctgaagggcatgccaattaggtatcaaaccacagccgtgaaaagcgagcataccgggcgtgagatcgtagaccttatgtgccacgcaactttcacaatgcggctgctctcccccgtgagagttcctaattacaacatgatcattatggatgaagctcattttaccgacccggcctcaatcgctgcaaggggatatatatctacgcgcgtcggcatgggtgaggccgccgctattttcatgactgcgacacccccagggagcgtggaagcatttcctcagagtaatgccgtgatccaggatgaggaacgagacattcccgagagatcctggaacagcggatacgattggatcaccgacttcccaggcaagaccgtctggtttgtaccttctataaaatcaggcaatgacattgctaactgtttgcggaagaatgggaaaagggtgatccagctgtcccgcaagactttcgatacagagtatcaaaagaccaaaaacaacgactgggattacgttgtgacaactgacatcagtgaaatgggagccaatttccgtgcagatagagtcattgacccccggaggtgcctcaagccagtgatcctgaaagatggtccggagcgcgttattcttgccggccctatgcccgtgacggtcgctagcgcggcccagcgaagagggcggataggaaggaaccagaataaggaaggcgaccagtacgtgtatatgggtcaaccactaaacaatgatgaggaccacgcacattggaccgaggctaaaatgctgttggataacatcaatacacccgaagggattatccctgccttatttgagccagaacgcgagaagtcggcagccatcgacggcgaatacagactgaggggagaggctcggaagactttcgtagagctcatgcgtcgcggcgatctgcccgtgtggctttcttataaagttgcctccgaagggtttcagtacagcgaccgaagatggtgcttcgacggagagaggaacaatcaggtcctggaagagaacatggatgtggaaatttggaccaaggagggtgagcggaaaaagctccgccctagatggttggacgcgaggacatattcagatccgctggcactacgggaatttaaagagttcgccgctggccgaagaagtgtgtctggggacctgatactcgaaatcggaaaacttccacagcacctgaccttacgcgcccaaaatgctttggataacctggtcatgctccacaattccgagcagggcggtaaagcatacaggcatgccatggaggaactgcccgacactattgagacgcttatgctgctcgctttgatcgccgttctgaccgggggcgtgacattatttttcctaagcggaaagggcctggggaagacttcaattggactcctttgtgtaatggcaagtagcgcgctgttgtggatggccaacgtggaacctcactggatcgctgcctccataatcctggagtttttcctcatggtcctgcttattcccgaaccagatcggcagcgtacccctcaggacaatcaactcgcatatgtggttatcggtctgttgtttatgattctgacagtggctgccaacgagatgggcttactagagaccactaaaaaggatctggggatcggacatgtcgcagccgaaaaccagcaccacgctacaatgctcgacgtagatcttagacccgcgtctgcctggacgctgtacgcagtggctaccactgttataacaccaatgatgaggcataccattgagaataccacagccaacatcagcttgactgccattgcaaatcaggctgccatcctgatgggcctcgacaaaggttggcctatatccaagatggatatcggggtgccgctgcttgcgttaggctgctactcacaagtcaaccccctgacgctcaccgctgccgtgttgatgctggtcgcacactatgccattatcggaccaggcctacaggctaaagcaacacgcgaagcccagaagcggactgcggctgggattatgaagaatcctaccgtggacggaatcgttgccatagacctggatcccgtggtatacgacgcaaaattcgagaagcagctcggccaaattatgcttctgatcttgtgtacatctcagatcctgctcatgcgaaccacttgggccctgtgcgaaagtattacgttagctacaggtccacttaccactctgtgggaggggtcgcctggaaaattttggaacaccacaatcgccgtgagcatggcaaatatattcagaggctcctatctcgctggtgccggcctagcgttctctctgatgaagtcactagggggaggcaggcgcgggactggagcccagggcgagaccctgggtgaaaaatggaagcggcagctcaaccaacttagcaagtccgagtttaatacatacaaaagaagtgggattatggaagtcgatcgttctgaggcaaaggaaggactgaaaaggggcgagacgaccaagcatgctgttagccggggtactgccaaattgcgctggttcgtggagcgaaacctggtcaagcccgaaggcaaggtgatcgacctcgggtgtggaagaggcgggtggtcatattactgcgcaggactaaagaaggtaacagaggtgaaaggctataccaagggtgggccgggacacgaggaaccaattcctatggctacttacggctggaatctggttaaactttactccggcaaggatgtgtttttcacacccccagaaaaatgtgacaccctgctatgcgatatcggggagagtagccccaaccctacgatagaggaaggaaggaccctccgggtcctgaagatggtggagccgtggttgcgcggtaatcagttttgtatcaagattctgaacccctatatgccatctgtcgtggaaacactcgagcagatgcagagaaaacatggcgggatgcttgttaggaatcctctgtcccgaaactcaactcacgagatgtactgggtaagctgcggaaccggcaatatcgtgtcggccgtcaacatgacatctcggatgttactgaaccgtttcactatggcccacagaaagcccacctatgaacgcgacgtggatttgggtgcggggacaaggcatgttgctgtggagcctgaagtcgcaaatctcgacattatcggacaacggattgagaacatcaaaaatgaacacaagagtacctggcattacgatgaggacaacccatataaaacttgggcctaccacggctcctatgaggtgaagcccagcggctcagcttcctctatggtaaatggggtggttagactgctaacgaagccttgggacgtcataccaatggtgacacagattgccatgaccgatactaccccctttggacagcaacgcgtgttcaaagaaaaggtcgacacaaggacgccgcgagcaaaacggggtaccgcccagatcatggaggttactgctaagtggctttggggctttctgagcagaaacaaaaagcctaggatctgtacacgcgaagagttcacccgtaaggtgcggagtaatgcggccattggggcagtatttgtggatgaaaaccagtggaactccgctaaagaggccgtcgaggacgaaagattctgggatctcgtgtacagggagcgcgaactgcacaagcagggaaaatgcgcaacttgcgtttacaacatgatgggcaagcgagagaaaaagttgggtgaatttgggaaggccaaaggaagccgggctatatggtatatgtggctgggcgccagattcctcgagttcgaggcgcttggctttatgaatgaagaccattggttctctagggagaactcatttagtggggtggaaggagagggtctgcacaagttaggctacatcctgcgcgatatttccaaaatcccagggggaaatatgtatgcagacgatacagccggctgggacaccagaattacagaggatgacttgcaaaacgaagctaagatcactgatataatggagcccgaacatgccctcctggcaaccagcatcttcaaactaacgtaccagaataaggtcgtgcgggtacagaggcctgctaaaaacggtaccgttatggacgtgatttctcgtcgagaccagcgcgggtcgggacaagtcggcacatatggccttaacacttttaccaatatggaggtgcagctgatcagacagatggaatcagaggggattttcctcccaagcgagctggaaacacccaacttggccgagcgggtgttagattggctggaaaagcacggaactgagaggctcaagcgcatggctatctccggtgacgattgtgtcgttaaaccggtggacgatagatttgccaccgcacttatagcgctgaatgacatgggcaaggtacggaaagatattcctcagtgggaacccagtaaggggtggaacgactggcaacaggtgccattctgctctcatcactttcaccagctaatcatgaaagatggaagggagatcgtcgtgccttgtcgaaatcaggacgagctggttggccgtgccagagtgagccaaggtgctgggtggtccctccgcgaaacggcctgcttgggaaagtcatacgcacagatgtggcagctgatgtatttccatcggagggatcttagactggctgccaacgcaatttgtagtgccgtccccgtggactgggtaccaacatctcgcaccacttggagcatacacgcgcatcaccaatggatgacaaccgaggacatgctctccgtttggaatcgggtgtggatcgaagagaacccctggatggaagataagactcacgtctcaagctgggaggaggtgccttacttaggcaaaagggaagaccagtggtgcggctctctgattgggttgaccgctcgagccacatgggcaacgaatatccaggttgccattaaccaggtgagacggctgatcggaaatgagaactacctcgattatatgacctccatgaagaggtttaaaaatgaaagtgacccagagggtgctctttggtga

SEQ ID NO: 13485 - RNA, 9879 nt, synthetic construct
  misc_feature 1..9879: note = derived and/or modified CDS sequence (opt3) from DENV-1__FJ547086__SS-prME
  source 1..9879: mol_type = other RNA
agcgtgaccatgctgctcatgcttctgcccacagcattggctttccacttaactacgagaggcggggaacctcatatgatcgtctccaagcaggaaagaggaaaatctctgctgtttaagacctcagccggtgttaatatgtgcacactcattgccatggacctgggcgagctttgtgaagatactatgacctacaaatgcccacggataacagaggcggaaccggacgatgtggactgttggtgcaatgctaccgatacttgggtaacatatgggacctgtagtcaaacgggagagcaccgccgagacaagcgtagcgtggccctggcaccccatgtcggcttgggtctcgagactagaaccgaaacatggatgtcctctgagggggcctggaaacagatccagaaggtggaaacttgggctctgaggcaccctggattcaccgttattgcatttttcctggcccatgctatcggcacatcgattacccagaagggcatcatatttatcctcttaatgctggtgacgccatcaatggccatgcggtgcgtcgggattggaaaccgcgatttcgtggagggtcttagcggcgcgacttgggtagacgttgtgttggagcacgggagttgtgtcacaaccatggccaagaataagcccactctggatatcgaactactcaaaacagaggtgaccaaccctgccgtgctgagaaaactttgcattgaagctaaaatctccaatacgaccacagactctaggtgtccaactcaaggagaggccaccctggtcgaagaacaggatgcaaactttgtttgccggcgcacattcgtggaccgaggctggggtaatgggtgtggattgtttggcaagggcagcctcctgacttgcgctaagttcaaatgcgtaaccaagttagaggggaaaatagtgcagtacgaaaacctgaagtattccgtcattgtgacagttcacaccggagatcagcatcaagtgggtaatgagactacggaacacggcacaatcgccaccattactccccaggcgcctacctcagagatccagctcacagactacggggcccttaccctggactgtagtccaagaactggattggattttaacgaaatggtcctactgacaatgaaagaaaagagctggctcgtgcataaacagtggttcctggaccttccgctgccctggacgtctggcgcatccacctcacaagagacttggaataggcaggatttgctcgtaacatttaagaccgctcacgccaagaaacaggaagttgtggtcctgggtagccaagagggggctatgcacacagccttaactggcgcaaccgaaatccagacgagtggaaccacaactattttcgccggccatctgaagtgccggctaaaaatggacaagctcaccctgaaagggatgtcttatgtgatgtgtacaggatccttcaaacttgagaaggaagtcgctgagactcagcacggtaccgtgttggttcaggtgaaatacgagggcacggatgcgccttgcaagataccatttagcacacaagacgaaaaaggggtaacccagaacggacgtctgatcactgcaaatcccattgtcacagataaggagaaacctgtgaacatcgaaaccgagccacccttcggcgagtcgtatataatggttggtgccggggaaaaggctctcaagctgtcttggtttaaaaagggctcctcaattggaaaaatgttcgaggccactgcacgcggcgccagaaggatggctatccttggggacaccgcctgggattttggaagtatcggtggcgtgttcacaagcgtcgggaagctggtgcatcaggtatttggaacggcatacggcgtgttgttctccggtgtttcttggaccatgaaaattgggatcggcattctcctgacttggttaggactgaatagccggtcagcgagtctatccatgacatgtatagctgtcggcatggtgaccctctacctgggggtgatggtccaggccgacagcggatgcgcaatcaactggaagggccgagaacttaagtgtggttctgggatttttgttacaaacgaggtgcacacttggaccgaacaatataaattccaggccgattcaccgaagcgcttgagtgctgccatcggaaaagcatgggaggagggcgtgtgcggtatcagaagcgctacgaggctggaaaatattatgtggaagcagatatccaacgagctcaatcatatcctgttagaaaacgacatgaaatttacagtagtcgtgggcgacgccaatgggattctggcgcagggaaagaaaatgatccggcctcaacccatggagcacaagtactcttggaagtcgtggggcaaagccaagattatcggggctgatatacagaacaccactttcatcattgacggaccagatacccctgaatgtcccgacgatcagcgcgcatggaatatctgggaggttgaggactatggctttggtattttcacaactaacatctggcttaaattgagagatagctacacccagatgtgcgaccacaggctcatgtccgccgctataaaggattcaaaagccgtgcatgcagacatggggtattggattgaaagtgagaagaatgaaacatggaagctggcgcgtgcctctttcatcgaggtcaaaacgtgtatttggccaaagagccacaccctatggtccaacggagtgctggaatcagagatgatcatacccaaaatctacggcggtcctattagccaacataattatcggccaggctactttactcagacagctgggccgtggcacctcggaaagctggagcttgatttcgacttgtgcgaaggcaccactgttgtggtagatgagcactgcgggaaccgaggaccctctctgagaacaaccacggtcactggcaaaatcattcatgaatggtgttgcaggtcctgtaccttacctccactccgctttcggggtgaggacgggtgctggtacggaatggagatcagacccgtgaaggaaaaggaggaaaatctggtgaggagtatggtcagcgccggctctggtgaggttgactccttctcacttggcatactgtgtgtgagtattatgatcgaagaggtaatgcgcagccgatggtcgcggaaaatgttgatgacagggaccctcgcagtgtttctgctactgatcatgggacagctcacttggaacgatctgattcgtctttgcatcatggtcggcgctaatgcctccgacagaatggggatgggaacaacctatttggcactgatggccacattcaagatgaggcctatgtttgctgtgggcttactcttccgccggctgacttctagagaggttcttctgctaaccattggtctcagcctggtggcgtcagtcgaattgccaaacagtctggaggaattaggggatggactcgccatgggcataatgatgctgaaacttctgacggagtttcaaccccaccagttgtggacaaccctcctgtccctaactttcatcaagaccacactgtctcttgactacgcatggaaaactatggctatggtgctcagcattgtttccctgtttccgttgtgtctgtcaaccacgagccagaagacaacctggttacctgtgctcctgggcagtttcgggtgcaagccacttactatgtttctgatcacagaaaacaaaatttggggaaggaagtcttggcccttgaatgagggtatcatggccataggcatcgtctccattctcctgagctcgctactgaaaaacgatgtacctcttgccgggcccctcatcgctggaggcatgctgattgcatgttatgtgatctcaggttctagtgccgacttgtccttagagaaggcggctgaagttagctgggaggaagaggccgaacattctgggaccagccacaatatactggtggaggtccaggatgacggaactatgaaaattaaggatgaggaacgagacgatacactcaccatcctgcttaaagcaacgctgttggccgtgtccggcgtatacccaatgtcaatccctgctactctattcgtgtggtatttctggcaaaagaagaaacagcgcagtggcgtcctgtgggacacccccagcccaccggaggttgaacgggcagtgctcgatgacgggatttacagaatactgcagaggggacttttaggtcgttctcaggtgggcgtcggggtgtttcaagacggagttttccatacaatgtggcacgtaacccgcggcgccgtgctgatgtatcagggtaagcggctcgagccttcctgggcgtcagtcaaaaaggatttgatcagttacgggggaggctggagatttcagggcagctggaacacaggggaggaagtgcaggttattgctgtggagcccggcaagaatccaaagaacgtccaaactacccccggtacgttcaagacacctgaaggcgaggtgggggccatcgcactggactttaaaccaggaacttccggctctcccattgtaaatagggaaggtaagatcgtcgggctctacggaaacggcgtggttaccacatcgggcacctatgtgagcgccatagctcaggccaaagcatcacagcaagggcctctgccggagatcgaggatgaagtcttcaagaaacgaaatcttactattatggacctgcacccaggatccggtaagacccggcgctacttgcccgctatcgtgagagaggccattaagaggaaactacggacactgatcctcgcgcctacgcgagttgtggccagtgaaatggcagaggctttaaagggcatgccaataagatatcagactaccgccgtcaaatctgaacatacagggcgcgagattgtggatctgatgtgccacgctacctttactatgaggcttctgagccccgtacgtgtgcctaactacaatatgatcatcatggacgaggcacatttcacagatccggcctccattgccgctcggggatatatctcaaccagagttggcatgggtgaagcggcagccatatttatgacggctactcccccagggtctgtcgaggccttccctcagagcaacgcagtgattcaggacgaagagagggatatccccgaacgcagttggaactccggatacgactggattacagattttccaggcaagaccgtgtggttcgtccctagcatcaaatctggcaacgacatagccaattgtctccgaaagaacgggaagagagtaattcaattgtcacggaaaaccttcgacactgagtatcagaagaccaaaaataatgattgggactacgtggttaccacagatatctccgagatgggagctaactttagggcggaccgcgtgatcgatccccgtagatgcctgaagccagtcattctcaaagacggtccggaacgggtgatcctggccggccctatgcccgttactgtggcaagtgctgcccagaggcgcgggcgaattggaagaaatcagaacaaggagggcgatcaatacgtctatatgggtcagccacttaataacgacgaagatcacgcacattggacggaggccaagatgctactggacaatataaacacccccgaggggatcattcctgctttgttcgaaccagagcgggagaaaagcgccgcgatcgatggcgagtacaggttacgcggagaagcaagaaagacatttgtggagctgatgaggcggggcgacctccccgtatggctgtcgtataaagtggcctctgaggggttccagtactccgatcgtcgctggtgctttgacggagaacgaaataaccaggttcttgaggaaaatatggacgtcgagatctggactaaggaaggtgagaggaaaaagctgaggcctcggtggctcgatgctcgcacctatagcgacccgttggccctgagagagttcaaagaatttgctgcaggcaggcggtcagtgagtggggatctaattctggagataggaaagctcccacaacaccttacactgcgagcccagaacgctttagacaatttggtgatgctgcacaactctgaacagggcggtaaggcctacagacatgcaatggaggaactccccgataccatcgagactctgatgcttctggcgctcattgccgtcttgaccgggggagttacgctgttctttttatccggaaaaggcctagggaagacaagcatcggactgctctgtgtgatggcttcaagtgcccttctgtggatggcaagcgtagagcctcactggattgctgcctccatcatattggagttctttctgatggtgctcctgatccccgagccagaccgccagaggactcctcaagataatcagcttgcatatgtcgtgattggtctcctgttcatgatcttgaccgttgccgctaacgaaatgggcctgttagagacaaccaaaaaggacctagggattggacatgtggcggccgagaaccaccaccatgcaactatgctggatgtcgacctccggcccgcttctgcctggacactttacgccgtagcaacgaccgtgatcactccaatgatgcgtcacacaatagaaaataccaccgctaacattagcctgacagccatcgcgaatcaggctgccattttgatgggcctggataaaggttggcctatctccaagatggacataggggttccgctcctggcacttggctgctactcacaagtgaaccccttaactctgacggccgctgtcctcatgttggtggcacattatgccatcattggaccaggcctgcaggcgaaggctaccagagaggcccagaaaaggacagcagccgggatcatgaagaatcctactgtcgatggaattgtggctatcgacctagaccccgttgtgtacgatgccaaatttgaaaagcagctgggccaaataatgctccttattctgtgtacctctcagatcttgctgatgcgcacaacctgggcactctgcgagagtatcactctggctacgggtccattaacaaccctttgggaagggtcgcctggaaaattctggaacactaccattgccgtaagcatggcgaatatcttccggggctcctatctggccggtgcaggcctcgctttttctctaatgaagtcactagggggaggccgaagagggacaggagcccagggcgagactttgggtgagaagtggaaaaggcagctgaaccaactcagcaagtccgagttcaatacctacaaacgcagtgggataatggaggtggaccggtctgaagcaaaggagggacttaaaagaggcgaaacaacgaagcacgctgtcagccgtggtaccgccaagctgaggtggtttgttgagcggaacttggtgaaacccgagggcaaggtcattgatctggggtgtggacgcggcgggtggtcatattactgcgccggactcaaaaaggtgactgaagtaaaaggctatacaaagggtgggccgggacatgaggaaccaatccctatggcgacctacggctggaatttagtgaaactgcactccggcaaggacgttttctttactcccccagagaagtgtgatacacttctgtgcgacattggggaaagtagccccaaccctaccatcgaggagggacgaacgctaagagtgctcaaaatggtcgaaccgtggctgaggggtaatcagttctgtataaagatcttgaacccctacatgccatctgtggtcgagaccctggaacagatgcagcggaaacacggcgggatgctcgtgcgcaatcctctttccagaaactcaacacatgagatgtattgggttagctgcggaactggcaatattgtatcggctgtgaacatgacctctaggatgctgttaaaccgatttacaatggcacaccggaagcccacttacgagcgtgatgtcgacctgggtgccgggaccagacatgtggctgttgaacctgaggtggccaatttggatatcattggacaacgcatcgaaaacattaaaaatgagcacaagagtacatggcactatgacgaagataacccatacaagacctgggcatatcatggctcctacgaggtcaaacccagcggctcagcctcctctatggtgaatggggtagtgaggctcctgactaagccttgggacgttatcccaatggtcacgcagatagctatgacagacaccactcccttcggacagcaacgggtgtttaaagagaaggtggataccagaacaccgcgcgcgaaaaggggtacggcccagattatggaagtcaccgcaaagtggctatggggcttccttagccgaaacaagaaacctcggatctgtactagagaggaatttacaaggaaggttcgcagtaatgctgccatcggggcagtgttcgtagacgagaaccagtggaactccgccaaagaagctgtggaggatgagcgtttttgggacctggtccaccgggaaagagagctccataagcagggaaaatgcgcaacatgcgtgtataacatgatgggcaagagggaaaagaaactgggtgagttcgggaaggcgaaaggaagccgcgcaatttggtacatgtggttgggcgcccgattcctggaatttgaggctctcggcttcatgaatgaggatcactggttttctcgggaaaactcacttagtggggttgagggagaaggtctgcataagttaggctacatactgagagacatctccaaaattccagggggaaatatgtatgccgatgacactgcaggctgggatacaaggatcaccgaggacgatttgcaaaacgaggctaagattacagacatcatggaacccgagcacgccctcctggctactagcatattcaaactaacctaccagaataaggtggtccgcgtgcagagacctgccaagaacggtacggtaatggatgttatctctcggagggaccagcgtgggtcgggacaagtgggcacctatggccttaacacatttactaatatggaagtccagctgattcgacagatggagtcagaagggatcttcctcccatgtgagctggagacccccaacttggcagaacgcgtgttagactggctggagaaacacggagcggaaagactcaagcggatggccattagcggtgatgactgcgtggtcaaaccgatcgatgacaggtttgctacagcccttatagcactgaatgatatgggcaaggttcgcaaagacattcctcagtgggagccctccaaggggtggaacgattggcaacaggtgccattctgtagtcatcactttcatcagctaatcatgaaggacggaagagaaatcgtagtgccttgccggaatcaggatgagctggtcggcagggctcgagtgtctcaaggtgccgggtggagcctccgtgagactgcatgtttgggaaaatcctacgcccagatgtggcagctgatgtatttccacagacgcgaccttcggctggcggctaacgccatttgctcagcagttcccgtggattgggtcccaaccagtaggacgacatggtctatacacgcccatcaccaatggatgaccactgaagacatgctcagcgtgtggaatagagtatggatcgaggaaaacccctggatggaggacaagacacatgtttcctcatgggaagaggtgccttacttaggcaaacgcgaggatcagtggtgtggcagcctgattgggttgaccgctcgggccacttgggcaaccaatatccaggtcgctattaaccaggtgaggcgactgatcggaaatgaaaactatctcgactacatgacatctatgaagagatttaaaaatgagtccaacccagaaggtgccctttggtga

SEQ ID NO: 13486 - RNA, 9879 nt, synthetic construct
  misc_feature 1..9879: note = derived and/or modified CDS sequence (opt3) from DENV-1__FJ410183__SS-prME
  source 1..9879: mol_type = other RNA
agcgtgaccatgctgctcatgcttctgcccaccgccttggctttccacttaactacgagaggaggggagcctcatatgatcgtctccaagcaggaaaggggaaagtctctgctgtttaagacctcagcaggtattaacatgtgcacactcatagccatggacctgggagagctttgtgaagatactatgacctacaaatgcccacggatcaccgaggcggaaccggacgatgttgactgttggtgcaatgctaccgatacttgggtgacctatgggacctgtagtcaaacgggagagcaccgccgagacaagcgtagcgtagccctggcaccccatgtgggcttgggtctcgagactagaaccgaaacatggatgtcctctgagggggcctggaaacagattcagaaggtcgaaacttgggctctgaggcaccctggattcaccgtgacagcatttttcctggcccatgctatcggcacctcgattacgcagaagggcatcatatttatcctcttaatgctggttactccatcaatggccatgcggtgcgtggggattggaaaccgcgatttcgtcgagggtcttagcggcgcgacatgggtggacgtagttttggagcacgggagttgtgtgaccactatggcaaaagataagcccacactggacatcgaactactcaaaaccgaggtcacgaatcctgccgtgctgagaaaactttgcattgaagctaaaatctccaacaccacaactgattctaggtgtccaacccaaggagaggccacactggtggaagaacaggacagcaattttgtctgccggcgcactttcgttgatcgaggctggggtaacgggtgtggattgtttggcaagggctccctcctgacctgcgcaaagttcaaatgcgtgacaaagttagaggggaaaatagtacagtacgaaaatctgaagtattcagtgattgtcaccgtgcacactggagaccagcatcaagttggtaacgagacgacagaacacggcaccatcgctactattacaccccaggcccctacaagtgagatccagctcaccgactacggggcgcttactctggattgtagcccaagaacaggattggactttaatgaaatggtgctactgacgatgaaagagaagtcttggctcgtccataaacagtggttcctggatcttccgctgccctggacctccggcgcctcaactagccaagagacatggaacaggcaggacttgctcgtgacctttaagacagcacacgctaagaaacaggaagtagttgtgctgggtagtcaagagggggccatgcacactgctttaaccggcgccacggaaatccagacctctggaacaactaccattttcgcaggccatctgaagtgccggctaaaaatggataagctcacactgaaagggatgtcctatgtcatgtgtactggcagcttcaaacttgagaaggaagtggccgagacccagcacggtacggtcttggtgcaggttaaatacgagggcacagacgctccttgcaagataccattttcggcgcaagatgaaaaaggggtgacccagaatggacgtctgatcactgcaaaccccattgtaacagacaaggagaaacctgtcaatatcgaaaccgagccacccttcggcgagtcttatatagtggttggtgccggggaaaaggctctcaagctgtcctggtttaaaaagggctcaagtattggaaaaatgttcgaggccactgcacgcggcgccagaaggatggctatccttggggataccgcctgggactttggaagcatcggtggcgtgttcacatccgtcgggaagctggtgcatcaggtatttggagcagcgtacggcgtgttgttctctggtgttagctggacgatgaaaattgggatcggcattctcctgacctggttaggactgaactcacggagtacttccctaagcatgacatgtatagctgtcggcatggtgaccctctacctgggggtgatggtccaggccgattctggatgcgttatcaattggaagggccgagaacttaagtgtggttcagggatttttgtgacaaacgaggtgcacacttggaccgaacaatataaattccaggcagacagtccgaagcgcttgagcgccgctatcggaaaagcctgggaggagggcgtatgcggtatcagatccgcaacgaggctggaaaacattatgtggaagcagatatctaatgagctcaaccatatcctgttagaaaatgacatgaaatttacagtcgtggttggcgatgctaacgggattctggcccagggaaagaaaatgatccggcctcaacccatggagcaccgctactcgtggaaaagctggggcaaggcgaagattatcggggccgacatacagaataccactttcatcattgatggaccagacacccctgaatgtcccgatgaccagagagcttggaacatctgggaggtggaggattatggctttggtattttcacaactaatatctggcttaagttgagggactcctacacccagatgtgcgatcaccgtctcatgtcagcagccataaaagacagtaaggctgtccatgccgatatggggtattggattgaatctgagaaaaacgaaacatggaagctggcacgggcgagcttcatcgaggtgaagacgtgtatttggccaaaatcccacaccctatggtcaaatggagttctggaaagcgagatgatcatacccaagatgtacggcggtcctacttctcaacataactatcgaccaggctactttacacagaccgccgggccgtggcacctcggaaaactggagcttgacttcgatttgtgcgaaggcactacagtggtagtcgacgagcactgcgggaatagaggaccctccctgaggaccacgactgtgaccggcaagatcattcatgaatggtgttgccgcagttgtacattacctccactccggtttagaggtgaggacgggtgctggtacggaatggagatcaggcccgtgaaagaaaaggaggaaaacctggtccgcagcatggtttctgctggctccggtgagatggattcattcagtcttggcattctgtgtgtgagcatcatgatagaagaggtaatgcgatcgcggtggtcccgtaagatgttgatgaccgggactctcgccgtgtttctgctactgattatgggacagctcacatggaatgacctgatcagactttgcatcatggtcggcgcaaacgcttctgataggatggggatgggaaccacatatttggccctgatggcaactttcaaaatgcgccctatgtttgccgtgggcttactcttccggagactgaccagcagggaggttcttctgctaacgattggtctctcactggtggctagtgtcgaattgccaaattccctggaggaattaggggacggactcgcgatgggcatcatgatgctgaaacttctgacagagtttcaaccccaccagttgtggaccactctcctgtctctaaccttcattaaaacaactctgagccttgattacgcctggcgaaccatggcaatggtgctctccatagtttcactgtttccgttgtgtctgagcacgacaagtcagaagaccacttggttacctgtgctcctgggctctttcgggtgcaaaccacttacaatgtttctgatcaccgaaaacaagatttggggacgcaagtcctggcccttgaacgagggtatcatggctattggcatcgtcagcatactcctgtcgtcactactgaaaaatgacgtacctcttgccgggcccctcatcgccggaggcatgctgattgcttgttatgtgatctctggtagttccgcagatttgagcttagagaaggccgcggaagtttcttgggaggaagaggctgaacatagcgggacttcccacaacattctggtggaggtccaggacgatggaacaatgaaaatcaaggacgaggaacgggatgacaccctcacgatactgcttaaagccactctgttggcagtgtcaggcgtatacccaatgagtattcctgccaccctattcgtgtggtatttctggcaaaagaaaaagcagagaagcggcgtcctgtgggatacaccctctccaccggaggttgaaagggctgtgctcgacgacgggatctaccgtatcctgcagcgcggacttttaggtcggtcccaggtgggcgtcggggtgtttcaagatggagttttccataccatgtggcacgtaacaagaggcgcagtgctgatgtatcagggtaagaggctcgagccttcatgggccagtgtcaaaaaggacttgattagctacgggggaggctggcgatttcagggctcctggaatactggggaggaagtgcaggttatagcggtggagcccggcaagaacccaaagaatgtccaaaccacgcccggtacattcaaaactcctgaaggcgaggtgggggctatcgccctggattttaagccaggaacctctggctcgcccattgtaaaccgggaaggtaagatcgtcgggctctacggaaatggcgtggttacaaccagcggcacttatgtgtcagcaattgcccaggctaaaacctcccaggaggggcctctgccggagatcgaagacgaggtcttcaagaaacgcaaccttacaataatggatctgcacccaggaagtggtaagacgagaaggtacttgcccgccatcgtgcgggaagcaattaaacgaaagctaagaactctgatcctcgctcctacccgcgttgtggcctctgagatggcggaagccttaaagggcatgccaattaggtatcaaacaaccgcagtcaaaagcgagcatactgggcgtgagatcgtggacctgatgtgccacgctacatttaccatgcggcttctgtcccccgtaagagtgcctaattacaacatgataattatggatgaagcccatttcacggacccggcttcaatcgcagccaggggatatatctctactcgcgttggcatgggtgaggccgctgcgatttttatgacagcaacacccccagggagcgtcgaagccttccctcagagtaatgctgtgatccaggatgaggaacgagacatacccgagagatcctggaacagcggatacgattggattaccgactttccaggcaagactgtgtggttcgtcccttctatcaaatcaggcaatgacattgccaactgtctccggaagaatgggaaaagggtaatccagttgtcccgcaagacattcgataccgagtatcaaaagactaagaacaacgactgggattacgtggttactacggacataagtgaaatgggagcaaattttcgtgccgatagagtgattgacccccggaggtgcctgaagccagtcatcctcaaagatggtccggagcgcgtgatcctggctggccctatgcccgttaccgtggcgagcgccgcacagcgaagagggcggattggaaggaaccagaataaggaaggcgaccagtacgtctatatgggtcaaccacttaacaatgatgaggaccacgctcattggacagaggccaaaatgctactggataacatcaatactcccgaagggattatacctgcattgttcgagccagaacgcgagaagtcggccgctatcgacggcgaatacagattaaggggagaggcccggaagacctttgtggagctgatgcgtcgcggcgatctccccgtatggctgtcttataaagtggcgtccgaagggttccagtacagcgaccgaagatggtgctttgacggagagaggaacaatcaggttcttgaagagaacatggatgtcgaaatttggacaaaggagggtgagcggaaaaagctgcgccctagatggctcgacgcaaggacctattcagatccgttggccctgcgggagttcaaagagtttgctgccggccgaagaagtgtgtctggggacctaatcctggaaatcggaaagctcccacagcaccttactctgcgcgctcaaaatgcattagataacttggtgatgctgcacaattccgagcagggcggtaaagcctacaggcatgctatggaagaactccccgacacgattgagaccctgatgcttctggccctcatagcagtcttgacagggggcgttactctgttctttttaagcggaaagggcctagggaagacctcaatcggactgctctgtgtgatggcgagtagcgcccttctgtggatggctaacgtagaacctcactggattgccgcatccatcattttggagttctttctgatggtgctcctgatccccgaaccagatcggcagcgtacacctcaggacaatcaacttgcttatgtcgtgataggtctcctgttcatcattttgaccgttgccgcaaacgagatgggcctgttagagactactaagaaggatctagggatcggacatgtggccgctgaatctcagcaccacgcgacgatgctggacgtcgatctcagacccgccagcgcatggaccctttacgctgtagccactacagtgattaccccaatgatgaggcataccatcgagaacacaactgccaatatatccctgacggcaattgctaaccaggccgcgatcttgatgggcctggacaaaggttggcctatttcaaagatggatatcggggttccgctcctggctcttggctgctactctcaagtgaatcccttaaccctgacagccgcagtcctcatgttggtggcccactatgctataatcggaccaggcctgcaggcaaaagccactcgcgaagcgcagaagcggaccgctgccgggattatgaagaaccctacagtcgacggaatcgtggcaattgacctagatcccgttgtgtacgacgccaaatttgagaagcagctgggccaaatcatgctccttatactgtgtaccagtcagattttgctgatgcgaactacgtgggctctctgcgaatcgatcacactggccaccggtccattaactaccctttgggaggggagccctggaaaattctggaatacaactatcgcagtatccatggctaacattttcagaggctcttatctggccggtgcgggcctcgccttttcactaatgaaaagcctagggggaggcaggcgcgggaccggagcacagggcgagacattgggtgaaaaatggaagcggcagctgaatcaactctccaagagtgagttcaacacgtacaaaagatctgggatcatggaagtggatcgtagcgaggctaaggaaggacttaaaaggggcgagaccactaagcatgccgtctcacggggtacagcaaaactgcgctggtttgttgagcgaaatttggtgaagcccgaaggcaaggtcatagacctggggtgtggaagaggcgggtggtcctattactgcgctggactcaaaaaggtgaccgaggtaaaaggctatactaagggtgggccgggacacgaggaaccaattcctatggccacatacggctggaacttagtgaaactgtacagtggcaaggatgttttctttacacccccagaaaaatgtgacacgcttctgtgcgatatcggggagagctctcccaatcctaccattgaggaaggaaggacactacgggtgctcaagatggtcgagccgtggctgcgcggtaaccagttctgtatcaagatattgaatccctatatgccatccgtggtcgaaactctggagcagatgcagagaaaacatggcgggatgctcgtgaggaaccctctttcacgaaatagcacccacgagatgtactgggtttcgtgcggaacaggcaacatcgtatctgccgtgaatatgacaagtcggatgctgttaaaccgttttaccatggcgcacagaaagcccacatatgaacgcgacgtcgatctgggtgctgggaccaggcatgtggcagttgagcctgaagtggccaacttggacattatcggacaacggattgagaatatcaaaaacgaacacaagtccacttggcattacgatgaggacaatccatataaaacgtgggcttaccacggcagctatgaggtcaagccctcaggctccgcctctagcatggtgaacggggtagtgagactcctgacaaagccttgggacgttattccaatggtcacccagatcgcaatgactgataccacacccttcggacagcaacgcgtgtttaaagaaaaggtggacacgaggaccccgcgagccaaacggggtactgctcagataatggaggtcacagcgaagtggctatggggcttccttagtagaaataaaaagcctaggatttgtacccgcgaagagtttactcgtaaggttcggtccaacgccgcaatcggggctgtgttcgtagatgaaaatcagtggaacagcgccaaagaggcagtggaggacgaaagattttgggatctggtccacagggagcgcgaactccataagcagggaaaatgcgccacatgcgtgtacaatatgatgggcaagcgagagaaaaagctgggtgagttcgggaaggctaaaggatctcgggccatctggtacatgtggttgggcgcgagattcctggagtttgaggcactcggcttcatgaacgaagaccactggttttcaagggagaatagtttctccggggttgaaggagagggtcttcataagctgggctatattttacgcgatataagcaaaatcccagggggaaacatgtacgccgacgataccgctggctgggacacaagaattactgaggatgacctgcaaaatgaagccaagatcaccgatattatggagcccgaacacgcattgctcgctacgtctatctttaaactgacctatcagaacaaggtggtccgggtgcagaggcctgccaaaaatggtacagtaatggacgttatatcgcgtcgagaccagcgcgggtcaggacaagtgggcacttacggcctaaacaccttcacaaacatggaggtccagcttatcagacagatggaaagcgaggggatttttctgccatccgagctcgaaactcccaatctggctgagcgggtgttggattggttagaaaagcatggaaccgagaggctgaagcgcatggccatcagtggtgacgattgtgtggtcaaaccggttgacgatagattcgcaacggcgctcattgcccttaacgacatgggcaaggtgcggaaagatatccctcagtgggaaccctctaaggggtggaatgactggcaacaggtaccattttgcagccaccacttccatcagctgataatgaaagatggaagggagattgtggtcccttgtcgaaaccaggacgagctagtgggccgtgctagagtttcccaaggtgccgggtggtcactgcgcgaaacagcatgcctcggaaagagttatgctcagatgtggcagttgatgtactttcaccggagggatctgagacttgccgcaaatgccatctgttctgcggtgcccgtcgactgggtgccaaccagccgcactacatggtccatccatgctcaccaccaatggatgaccactgaggacatgctgtcagtatggaaccgggtttggattgaagagaatccctggatggaagataagacccatgtgagctcttgggaggaggtcccttatctcggcaaaagggaagaccagtggtgcggctccttaatagggctgacagcccgagcaacgtgggccaccaacatccaggtggctattaatcaggttagacggttgatcggaaacgagaattacctggattacatgacaagtatgaagaggttcaaaaacgaaagcgacccagagggtgccctctggtga

SEQ ID NO: 13487 - RNA, 9879 nt, synthetic construct
  misc_feature 1..9879: note = derived and/or modified CDS sequence (opt3) from DENV-1__FJ410184__SS-prME
  source 1..9879: mol_type = other RNA
agcgtgaccatgctgctcatgcttctgccaactgccttggctttccacttaactacgagaggcggggagcctcatatgatcgtctccaagcaagaaaggggaaaatctctgctatttaagacctcagcaggtattaacatgtgcactctcatagccatggacctgggcgagctttgtgaagatactatgacctacaaatgcccacggatcacagaggcggaaccggacgatgttgactgttggtgcaatgctaccgatacttgggtgacatatgggacctgtagtcaaacgggagagcaccgccgagacaagcgtagcgtagccctggcaccccatgtgggcttgggtctcgagactagaaccgaaacatggatgtcctctgagggggcctggaaacagattcagaaggtcgaaacttgggctctgaggcaccctggattcaccgtgatcgcactgtttctcgcccatgctattggcacatcgatcacccagaagggcattatcttcattttactgatgcttgttacgccatcaatggccatgcggtgcgtggggatcggaaaccgcgattttgtcgagggtttgagcggcgcgacttgggtggacgtagttctggagcacgggagttgtgtgacaaccatggcaaaagataagcccactctagacattgaactcctgaaaacagaggtcaccaatcctgccgtgcttagaaagctgtgcatcgaagctaaaatatccaacacgaccacagattctaggtgtccaactcaaggagaggccaccttggtggaggaacaagacgcaaatttcgtctgccggcgcacatttgttgatcgaggctggggtaacgggtgtggactcttcggcaagggcagcctgttaacttgcgctaagtttaaatgcgtgaccaagctggaggggaaaattgtacagtacgaaaatctcaagtattccgtgatcgtcacagtgcacaccggagaccagcatcaagttggtaacgagactacggaacacggcacaattgccaccatcactccccaggcgcctacctcagagatccagcttacagactacggggccctgaccttggattgtagtccaagaactggactagacttcaatgaaatggtgctgctcacaatgaaagaaaagagctggctggtccataaacagtggtttcttgatctgccgttgccctggacgtctggcgcatccacctcacaagagacttggaacaggcaggacctcctggtgacattcaagaccgctcacgccaagaaacaggaagtagttgtgttaggtagccaagagggggctatgcacacagccctgactggcgcaaccgaaattcagacgagtggaaccacaactatatttgccggccatctaaagtgccggctcaaaatggataagctgacccttaaagggatgtcttatgtcatgtgtacaggatccttcaagttggagaaggaagtggctgagactcagcacggtaccgtcctggtgcaggttaaatacgagggcacggacgcgccttgcaagatcccattcagcgcacaagatgaaaaaggggtgacacagaatggacgtctcattaccgccaaccccatcgtaactgacaaggagaaacctgtcaatatagaaacagagccaccctttggcgagtcgtatattgtggttggtgctggggaaaaggccctgaaactttcttggttcaaaaagggctcctcaatcggaaaaatgtttgaggcaaccgcccgcggcgctagaaggatggccatcctgggggatactgcatgggacttcggaagtattggtggcgtgtttaccagcgtcgggaagttggtgcatcaggtattcggaacagcgtacggcgtgctcttttccggtgtttcttggacgatgaaaatcgggattggcatactgttaacctggctgggactaaacagccggtcaacaagtctctccatgacatgtatcgctgtcggcatggtgaccctgtaccttggggtgatggtccaggccgatagcggatgcgttattaattggaagggccgagaattgaagtgtggttctgggatcttcgtgacaaacgaggtgcacacttggaccgaacaatataaatttcaggcagactcaccgaagcgcctgagtgccgctatcggaaaagcctgggaggagggcgtatgcggtattagaagcgcaacgaggctcgaaaacataatgtggaagcagatctccaatgagctgaaccatattttactggaaaatgacatgaaattcacagtcgtggttggcgatgctaacgggatccttgcccagggaaagaaaatgattcggcctcaacccatggagcaccgctactcttggaagtcgtggggcaaggcgaaaatcataggggccgacatccagaataccacttttattatcgatggaccagacacccctgaatgtcccgatgaccagagagcttggaacatttgggaggtggaggattatggcttcggtatctttacaactaatatatggttgaagctcagggacagctacacccagatgtgcgatcaccgtctgatgtccgcagccattaaagactcaaaggctgtccatgccgatatggggtattggatcgaaagtgagaaaaacgaaacatggaagctagcacgggcgtctttcattgaggtgaagacgtgtatctggccaaaaagccacaccctgtggtccaatggagttctcgaatcagagatgataatccccaagatttacggcggtcctatcagccaacataactatcgaccaggctacttcactcagacagccgggccgtggcacctgggaaaacttgagttggactttgatctgtgcgaaggcaccactgtggtagtcgacgagcactgcgggaatagaggaccctctttaaggacaaccacggtgactggcaagattatccatgaatggtgttgccgctcctgtaccctccctccactgcggttcagaggtgaggacgggtgctggtacggaatggagataaggcccgtgaaagaacgcgaggaaaaccttgtcaagagtatggttagcgctggcctgggtgaggtggattctttttccttgggcattctctgtgtatcaatcatgatcgaagaggtgatgcgaagtcggtggagccgtaagatgctgatgacagggaccctagccgtcttcctgctcctgattatgggacagcttacttggaatgacttgatcagactgtgcattatggtgggcgcaaacgcttcggataggatggggatgggaacaacctatttagccctcatggcaacatttaaaatgcgccctatgttcgccgttggcctgctttttcggagactgacttccagggaggtgctactcctgaccataggtttgtctctggtcgctagcgtggaattaccaaattcactcgaggaactgggggacggacttgcgatgggcatcatgatgctgaagttgctcacggagttccaaccccaccagctgtggacaaccctactgagtcttacttttattaaaaccacactctccctggattacgcctggaagactatggcaatggttttgtctatcgtgagcctgttcccgttatgtctctccaccacgtcacagaaaacaacctggctgcctgtccttctgggcagcttggggtgcaagccactcactatgtttctgattacagaaaacaagatctggggacgaaaaagttggcccctaaacgagggtataatggctatcggcattgtatctatcctgctttccagcctcctgaagaatgacgtgcctttggccgggcccttaattgccggaggcatgctgatcgcttgttatgttatatcgggttcatctgcagatctcagtctggagaaagccgcggaagtgtcctgggaggaagaggctgaacatagcgggacctctcacaacattcttgtcgaggtgcaggacgatggaactatgaagatcaaagacgaggaacgcgatgacacactgaccatcttgctaaaggccacgctgctcgcagtaagcggcgtgtacccaatgtccattcctgccactctgttcgtctggtatttttggcagaagaagaagcagcggtcaggcgttctttgggatacccccagtccaccggaggtggaaagagctgtgttagacgacgggatatacaggatcctgcagcgtggactcttgggtcgcagccaggtcggcgtgggggttttccaagatggagtattccatacaatgtggcacgtgacccggggcgcagtcctgatgtatcagggtaaaagactcgagccttcttgggcctccgtgaagaaagacctgatttcatacgggggaggctggaggtttcagggcgcgtggaatacaggggaggaagttcaggtgatcgctgtcgagcccggaaagaaccccaaaaatgtgcaaactacccccggtacgttcaagacacctgaaggcgaggtaggggccattgcacttgattttaagccaggaacaagtggcagccccatcgtcaaccgagaaggtaaaatagtggggctgtacggaaatggcgttgtgaccacatccggcacctatgtctctgccatcgctcaggccaagacttcgcaggaggggagcttgcctgagattgaagacgaggtgttcaaaaagcggaacctaaccatcatggatctgcacccgggatcaggtaaaacacgcagatacctcccagcaattgttagggaagctatcaagcggaagttacgaacgctgatacttgcccccactagagtggtcgcgtccgagatggccgaagcactgaaaggcatgcctattcgctatcaaaccacagctgtgaagagtgagcataccgggagggagatcgtagacctcatgtgccacgccacttttacaatgcgtttgctgtctccagtgcgggttcccaattacaacatgatcattatggatgaagctcatttcaccgaccctgcaagcatcgccgccagaggatatatatccacgagggtcggcatgggtgaggctgcggcaatttttatgactgccacaccgcccgggtcagtggaggctttcccacagtctaatgccgtgatccaggatgaagaacgcgacattcctgagcgaagctggaacagtggatacgattggatcaccgactttcccggcaaaaccgtctggttcgtaccatccataaagagcggcaatgacattgcaaactgtctcaggaaaaatgggaagcgggtgatccagctgtctaggaagacttttgatacagagtatcagaaaaccaagaacaacgactgggattacgttgtgacaactgacatctcagaaatgggagccaatttccgcgctgatcgtgtcattgaccctagacggtgccttaaacccgtgatcctaaaggatggtccagagagggttattctggcgggcccgatgcctgtgacggtcgcctccgcagctcagcgccgagggagaataggacggaaccagaataaagaaggcgaccagtacgtgtatatgggtcaacccttgaacaatgatgaggaccacgcccattggaccgaggcaaagatgttactggataacatcaatacaccagaagggattatccccgccctcttcgagcctgaaagggagaagagtgctgccatcgacggcgaataccgcctgagaggagaggcgaggaaaacttttgtagagcttatgcggcgtggcgatctgccagtgtggctcagctataaggttgcatcggaagggttccagtactctgaccgccgatggtgctttgacggagagagaaacaatcaggtcttggaagagaacatggatgtggaaatttggaccaaagagggtgagaggaagaaactgcggccccgctggctagacgccagaacatattccgatcctctggctctcagggagttcaaggagtttgccgctggccggcgaagcgtgtcaggggaccttatactggaaatcggaaaattaccgcagcacttgaccctgagagcacaaaatgccctcgataacctggtcatgcttcacaatagtgagcagggcggtaaggcttaccgccatgccatggaggaactgccagacactattgagacgctcatgttgctggcattaatcgcggttctaaccgggggcgtgacactgttctttctctctggaaagggccttgggaaaacttccattggactgttgtgtgtaatggccagctcagctctgctctggatggccagtgtggaaccccactggatcgcagctagcataatcctggagttctttcttatggtcctcctgattcctgaacccgataggcagcggaccccacaggacaaccaattggcctatgtggttatcggtctgttattcatgattctaacagtggcagccaatgagatgggcctgctcgagaccactaagaaagatcttgggatcggatacgtcgctgcggaaaaccatcaccacgccacaatgctggacgtagatttgcgtcctgcatccgcttggacgctgtacgccgtggccaccactgttataacacccatgatgagacataccattgagaacaccacagcaaatatctctctcactgctattgccaaccaggcggctatcctgatgggccttgacaagggttggccaataagcaaaatggatatcggggtgcctttactggccctcggctgctattcccaggtcaatccgttgacgctgaccgcagccgtgctaatgctggtcgctcactacgcaattatcggacccggcctccaagccaaggcgacaagggaagctcagaagcgcactgccgcagggattatgaaaaacccaaccgtggacggaatcgttgccatagaccttgatcctgtggtatatgacgctaagtttgagaaacagctgggccagattatgttgctgatcctctgtacatcacaaatcctgttaatgcggaccacttgggccctttgcgaatctattacgctggcaacaggtcccctcaccactctatgggaggggagtccaggaaagttctggaataccacaatcgctgtgtcgatggccaacatatttcgaggcagctacctggcgggtgccggcttggcattctccctgatgaaatctctcgggggaggcagaagggggactggagctcagggcgagacccttggtgaaaagtggaagcgccagctgaatcagttgtcaaaaagcgagttcaacacatataagcggtccgggattatggaagtcgatagaagtgaggccaaagaaggactgaagcgtggcgagacgaccaaacatgcagtttctaggggtactgctaagctccggtggtttgtggagcgcaatttagtcaagcctgaaggcaaagtgatcgacctggggtgtggacgaggcgggtggagctactattgcgccggacttaagaaagtaacagaggtgaagggctacaccaaaggtgggcccggacacgaggaaccgattccaatggccacttacggctggaacctggttaagctacattcaggcaaagatgtgttctttacacctcccgaaaagtgtgacaccctcctgtgcgatatcggggagtccagtccaaatcccacgatagaggaaggaagaaccttgagggtcctgaagatggtggagccttggctccggggtaaccaattctgtatcaaaattcttaatccgtatatgcccagcgtcgtggaaacactggagcagatgcagcgcaagcacggcgggatgttagttagaaacccactgtctagaaattccactcacgagatgtactgggtatcatgcggaaccggcaacatcgtgagcgcggtcaatatgacatcgcgaatgttgctcaaccggtttactatggctcatcgtaaacctacctatgaaagagacgtggatctgggtgcagggacacgccacgttgccgtggagcccgaagtcgctaacctagacattatcggacagaggattgagaatatcaagaacgaacataaatctacctggcactacgatgaggacaatccttataagacttgggcctaccacggcagttatgaggtgaagccatccggcagcgcatcatccatggtaaacggggtggttcggcttctgacgaaaccctgggacgtcatacctatggtgacacaaattgccatgaccgatactaccccattcggacagcagagagtgtttaaggaaaaagtcgacacacgcacgcccagggctaagcgaggtaccgcgcaaatcatggaggttactgccaaatggctctggggcttcctgtctcggaataagaagccgagaatctgtacaagggaagagtttacccgcaaagtgcgtagcaacgcagctattggggccgtattcgtggatgaaaatcagtggaacagtgcaaaggaggccgtcgaggacgaacggttttgggatttggtgcatagagagagggaactgcacaaacagggaaagtgcgctacttgcgtttacaatatgatgggcaaacgcgagaagaagctcggtgagttcgggaaagccaagggatcccgagcgatatggtacatgtggcttggcgcacggtttctggagttcgaggccttaggcttcatgaacgaagaccattggtttagcagagaaaattctttctcaggggtggaaggagagggtctgcacaaattgggctatatcctcagggatattagtaagatccctgggggaaacatgtacgctgacgatacagccggctgggacacccgcattacagaggatgacctgcagaatgaagcaaaaatcactgatataatggagccagaacatgctctacttgccacctccatctttaagctgacgtatcaaaacaaagtcgtgagagtacagcggcccgctaagaatggtaccgttatggacgtgattagcaggcgtgaccagcgagggtctggacaggtcggcacatacggcctcaacactttcaccaacatggaggtgcaactgatccgccagatggaatcggaggggatatttttgccttcagagttagaaacaccaaatctggccgagagagtgctcgattggcttgaaaagcacggaactgagcggctgaaaaggatggcaatcagcggtgacgattgtgtcgttaagcccgtggacgatcgcttcgcgaccgccctaatagctctgaacgacatgggcaaagtaagaaaggatattccgcagtgggaaccttccaaagggtggaatgactggcagcaagtgcccttttgcagtcaccatttccaccagctcatcatgaaggatggacgggagatcgtcgtgccatgtaggaaccaggacgagttggttggccgagcccgtgtgtctcagggtgcagggtggagcctgagagaaacggcttgccttggaaagtcctatgcccaaatgtggcagctgatgtactttcatcgccgggatctcaggttagcagccaatgcgatttgttcagctgtccctgtggactgggtacccacaagtagaaccacttggtctatacacgcccaccatcagtggatgacaaccgaggacatgctgagcgtttggaaccgcgtgtggatcgaagagaatccatggatggaagataaaactcacgtctcctcatgggaggaggtgccctatttgggcaagcgggaagaccaatggtgcggcagcctgattgggctcaccgcaagggccacatgggctacgaacatccaggttgccattaatcaggtgcgaagacttatcggaaacgagaattacctggattacatgacctctatgaaacggttcaagaacgaatccgaccctgagggtgcactatggtga

SEQ ID NO: 13488 - RNA, 9879 nt, synthetic construct
  misc_feature 1..9879: note = derived and/or modified CDS sequence (opt3) from DENV-1__FJ410185__SS-prME
  source 1..9879: mol_type = other RNA
agcgtgacaatgctgctcatgcttctgcccacagccttggctttccacttaactacgagaggaggggaacctcatatgatcgtctccaagcaggaaaggggaaaatctctgttatttaagacctcagttggtattaacatgtgcacactcatagcaatggacctgggagagctttgtgaagatactatgacctacaaatgcccacggatcacagaggccgaaccggacgatgtggactgttggtgcaatgcgaccgatacttgggtaacatatgggacctgtagtcaaacgggagagcaccgccgagacaagcgtagcgtggctctggcaccccatgtcggcttgggtctcgagactagaaccgaaacatggatgtcctctgagggggcatggaaacagattcagaaggtggaaacttgggccctgaggcaccctggattcaccgttatcgctctgtttctcgcacatgccattggcacatcgatcacccagaagggcataatcttcattttactgatgcttgtgacgccatcaatggctatgcggtgcgtcgggatcggaaaccgcgattttgtggagggtttgagcggcgccacttgggtagacgttgtgctggagcacgggagttgtgtcacaaccatggcgaaagataagcccactctagacattgaactcctgaaaacagaggtgaccaatcctgcagtgcttagaaagctgtgcatcgaagccaaaatatccaacacgaccacagattctaggtgtccaactcaaggagaggctaccttggtcgaagaacaggacagcaatttcgtttgccggcgcacatttgtggatcgaggctggggtaacgggtgtggactcttcggcaagggctccctgttaacttgcgccaagtttaaatgcgtaaccaagctggaggggaaaattgtgcagtacgaaaatctcaagtattcagtcatcgtgacagttcacaccggagaccagcatcaagtgggtaacgagactacggaacacggcacaattgcaaccatcactccccaggctcctaccagtgagatccagcttacagactacggggccctgaccttggattgtagcccaagaactggactagacttcaatgaaatggtcctgctcacaatgaaagagaagtcttggctggtgcataaacagtggtttcttgatctgccgttgccctggacgtccggcgcgtcaaccagccaagagacttggaacaggcaggacctcctggtaacattcaagaccgcccacgcaaagaaacaggaagttgtggtcttaggtagtcaagagggggctatgcacacagccctgactggcgctaccgaaattcagacgtctggaaccacaactatatttgccggccatctaaagtgccggctcaaaatggataagctgacccttaaagggatgtcctatgtgatgtgtacaggcagcttcaagttggagaaggaagtcgcagagactcagcacggtaccgtgctggttcaggtgaaatacgagggcacggacgccccttgcaagatcccattctcggctcaagatgaaaaaggggtaacacagaatggacgtctcattaccgcgaaccccatcgtcactgacaaggagaaacctgtgaatatagaaacagagccaccctttggcgagtcttatattgttatcggtgcaggggaaaaggccctgaaactttcctggttcaaaaagggctcaagtatcggaaaaatgtttgaggctaccgcccgcggcgcaagaaggatggccattctgggggatactgcttgggacttcggaagcatcggtggcgtgtttacctccgtcgggaagttggtgcatcaggtattcggagccgcatacggcgtgctcttttctggtgttagctggacaatgaaaattgggataggcatcctgttaacgtggctgggactaaactcacggagtacctccctcagcatgacttgtattgcggtcggcatggtgacactgtaccttggggtgatggtccaggctgattctggatgcgttatcaattggaagggccgagaattgaagtgtggttcagggatcttcgtgaccaacgaggtgcacacatggactgaacaatataaatttcaggccgacagtccgaagcgcctgagcgcagccattggaaaggcttgggaggagggcgtatgcggtataagatccgccaccaggctcgaaaacatcatgtggaagcagatttctaatgagctgaaccatatcttactggaaaatgacatgaaattcacggtcgtggttggcgatgcaaacgggattcttgctcagggaaagaaaatgatccggcctcaacccatggagcaccgctactcgtggaaaagctggggcaaggccaaaataatcggggcggacattcagaatacaacctttatcattgatggaccagacactcctgaatgtcccgatgaccagagagcctggaacatctgggaggtggaggattatggcttcggtatatttaccacaaatatttggttgaagctcagggactcctacactcagatgtgcgatcaccgtctgatgtcagctgcaatcaaagacagtaaggccgtccatgctgatatggggtattggattgaatctgagaaaaacgaaacctggaagctagcccgggccagcttcatcgaggtgaagacatgtatatggccaaaatcccacacgctgtggtcaaatggagttctcgaaagcgagatgatcattcccaagatctacggcggtcctatttctcaacataactatcgaccaggctacttcacccagactgcggggccgtggcacctgggaaaacttgagttggactttgatctgtgcgaaggcacaaccgtggtagtcgacgagcactgcgggaatagaggaccctccttaaggactacaaccgtgacgggcaagatcatacatgaatggtgttgccgcagttgtactctccctccactgcggttcagaggtgaggacgggtgctggtacggaatggagattaggcccgtgaaagaaaaggaggaaaaccttgtccgcagcatggtttctgccggctccggtgaggtggattcatttagtctgggcatcttgtgtgtaagcatcatgattgaagaggtgatgcgatcgcggtggtcccgtaagatgctcatgaccgggacactggctgtcttcctactgctcatcatgggacagctgacctggaatgaccttattagattgtgcataatggtgggcgccaacgcatctgataggatggggatgggaactacatatctggctttaatggccacctttaaaatgcgccctatgttcgcagttggcctcctgtttcggagacttacaagcagggaggtgctgctactcactatcggtctgtcattggtcgccagtgtggaactgccaaattccttagaggaactcggggacggactggctatgggcattatgatgcttaagctgttgaccgagttccaaccccaccagctctggacgacactgctatctctgacctttatcaaaactacccttagcctcgattacgcgtggcgaacaatggccatggttctgtccattgtgtcattgttcccgctgtgtttaagcactaccagtcagaagacgacatggctccctgtcctgcttggctcttttgggtgcaaaccactgaccatgttcttgatcactgaaaacaagatatggggacgcaagtcctggcccctcaacgagggtatcatggcaattggcatcgtaagcattctgctatcgtcactgcttaaaaatgacgtgcctctcgctgggcccctgatcgccggaggcatgttgatagcctgttatgttatttctggtagttccgctgatttaagcctggagaaggcagccgaagtgtcttgggaggaagaggcggaacatagcgggacatcccacaacatcctcgtcgaggtgcaggacgatggaaccatgaaaatcaaggacgaggaacgggatgacactctgacaattcttctgaaagctaccttgctagccgtatcaggcgtgtacccaatgagtatacctgcaacgctgtttgtctggtatttctggcaaaagaaaaagcagagaagcggcgttctctgggatactccctctccaccggaggtggaaagggccgtgctggacgacgggatctaccgtattcttcagcgcggattactgggtcggtcccaggtcggcgtgggggttttccaagatggagtatttcataccatgtggcacgtgacaagaggcgctgtcctcatgtatcagggtaagaggttggagccttcatgggcaagtgtgaaaaaggacctgatcagctacgggggaggctggcgattccagggctcctggaataccggggaggaagttcaggtgattgccgtcgagcccggcaaaaatccaaagaatgtgcaaacaactcccggtacctttaaaacgcctgaaggcgaggtaggggcgatcgctctcgatttcaagccaggaacatctggctcgcccatagtcaaccgggaagagaagatcgtgggtctgtacgggaatggagttgtgactaccagcggcacatatgtctcagccattgcacaggccaaaacctcccaggagggccctcttccggaaatcgaggacgaagtgtttaagaaacgcaacctgactattatggatttgcacccagggagtggaaagaccagaaggtacctacccgctatcgttcgggaggccataaaacgaaagctgagaacactcattttagcacctacgcgcgtggtcgcttctgaaatggccgaggcgctgaagggtatgccaatcaggtatcaaactaccgccgtgaaaagcgagcatacaggccgtgaaatcgtagaccttatgtgccacgcaaccttcactatgcggctgctctcccccgtgagagttcctaattacaacatgattatcatggatgaggctcattttacagacccggcctcaatagctgcaagggggtatatttctacccgcgtcggaatgggcgaagccgccgctatcttcatgacggcgactcccccaggtagcgtggaggcatttcctcagagtaatgccgtgattcaggatgaagaacgagacatccccgagagatcctggaacagcgggtacgattggataacagacttcccaggaaagaccgtctggtttgtaccttctattaaatcaggcaatgacatcgctaactgtttgcggaagaatggcaaaagggtgatccagctgtcccgcaagaccttcgatactgaatatcaaaagaccaaaaacaacgactgggattacgttgtgaccacagacattagtgagatgggggccaatttccgtgcagatagagtcatcgacccccggaggtgcctcaagccagtgattctgaaagatggaccggaacgcgttatacttgccggtcctatgcccgtgactgtcgctagcgcggcccagcgaagaggccggatcgggaggaaccagaataaggagggagaccagtacgtgtatatgggccaaccactaaacaatgatgaggaccacgcacattggacggaagctaaaatgctgttggataacattaatacccccgagggtatcatccctgccttatttgaaccagagcgcgaaaagtcggcagccattgacggggagtacagactgaggggcgaggctcggaagacattcgtagaactcatgcgtcgcggagatctgcccgtgtggctttcttataaagttgcctccgagggctttcagtacagcgaccgaagatggtgcttcgacggggaaaggaacaatcaggtcctggaggaaaacatggatgtggagatatggactaaggagggagaacggaaaaagctccgccctagatggttggacgcgaggacctattcagatccgctggcactacgggagtttaaagagttcgccgctggtcgaagaagtgtgtctggcgacctgatcctcgagattgggaaacttccacagcacctgacattacgcgcccaaaatgctttggataacctggtcatgctccacaattccgaacagggaggcaaagcatacaggcatgccatggaggagctgcccgacaccatcgaaactcttatgctgctcgctttgattgccgttctgacgggtggggtgaccttatttttcctaagcggcaagggactgggcaagacatcaatcgggctcctttgtgtaatggcaagtagcgcgctgttgtggatggccaacgtggagcctcactggatagctgcctccatcattctggaatttttcctcatggtcctgcttatccccgagccagatcggcagcgtactcctcaggacaatcaactcgcatatgtggttattggactgttgtttatgatcctgaccgtggctgccaacgagatgggtttactagaaacaaccaaaaaggatctgggcatagggcatgtcgcagccgagaaccagcaccacgctactatgctcgacgtagatcttagacccgcgtctgcctggacactgtacgcagtggctacgaccgttattactccaatgatgaggcatacaatcgaaaataccaccgccaacattagcttgacagccatcgcaaatcaggctgccatactgatgggactcgacaaaggctggcctatctccaagatggatattggtgtgccgctgcttgcgttagggtgctactcacaagtcaaccccctgactctcacggctgccgtgttgatgctggtcgcacactatgccatcattggcccaggactacaggctaaagcaacccgcgaggcccagaagcggacagcggctggcatcatgaagaatcctactgtggacgggatagttgccattgacctggatcccgtggtatacgacgcaaaattcgaaaagcagctcggacaaatcatgcttctgatcttgtgtacctctcagattctgctcatgcgaacaacctgggccctgtgcgagagtatcactttagctacgggcccacttacaaccctgtgggagggttcgcctgggaaattttggaacactaccatagccgtgagcatggcaaatattttcagaggatcctatctcgctggcgccggtctagcgttctctctgatgaagtcattgggcgggggaaggcgcggcacaggggcccagggagaaactctgggcgagaaatggaagcggcagctcaaccaacttagcaagtccgaatttaatacctacaaaagaagtggtatcatggaggtcgatcgttctgaagcaaaggaggggctgaaaaggggagagacaacgaagcatgctgttagccggggcaccgccaaattgcgctggttcgtggaacgaaacctggtcaagcccgagggtaaggtgattgacctcggctgtgggagaggaggctggtcatattactgcgcagggctaaagaaggtaactgaagtgaaaggatatacaaagggcggtccggggcacgaggaaccaatccctatggctacctacggatggaatctggttaaactttactccggcaaggatgtgtttttcactcccccagagaaatgtgacacactgctatgcgatataggcgagagtagccccaaccctaccatcgaagaggggaggacgctccgggtcctgaagatggtggaaccgtggttgcgcggaaatcagttttgtattaagatcctgaacccctatatgccatctgtcgtggagaccctcgagcagatgcagagaaaacatggtggcatgcttgttaggaatcctctgtcccgaaactcaacacacgaaatgtactgggtaagctgcgggactggaaatattgtgtcggccgtcaacatgacctctcggatgttactgaaccgtttcacaatggcccacagaaagcccacttatgagcgcgacgtggatttgggcgcgggtaccaggcatgttgctgtggaacctgaggtcgcaaatctcgacatcattgggcaacggatcgaaaacataaagaatgagcacaagagtacatggcattacgatgaggacaacccatataaaacctgggcctaccacggatcctatgaagtgaagcccagcggctcagcttcctctatggtaaatggcgtggttagactgctaactaagccttgggacgtcattccaatggtgacgcagatcgccatgacagataccactccctttgggcagcaacgcgtgttcaaagagaaggtcgacaccaggacaccgcgagcaaaacggggaacggcccagatcatggaagttaccgctaagtggctttggggttttctgagcagaaacaaaaagcctaggatttgtactcgcgaggagttcacacgtaaggtgcggagtaatgcggccataggcgcagtatttgtggatgagaaccagtggaactccgctaaagaggccgtcgaagacgagagattctgggatctcgtgcacagggaacgcgagctgcataagcaggggaaatgcgcaacctgcgtttacaacatgatgggaaagcgagagaaaaagttgggcgagtttggtaaggccaaagggagccgggctatctggtacatgtggctgggagccagattcctcgagttcgaagcgcttggctttatgaatgaggaccactggttctctagggaaaactcatttagtggcgtggagggggagggactgcataagttaggttatattctgcgcgatatctccaaaattccaggcgggaatatgtacgcagacgatactgccggatgggacacaagaatcaccgaagatgacttgcaaaacgaggctaagataacagatatcatggaacccgagcacgccctcctggcaactagcattttcaaactaacctatcagaataaggtcgtgcgggtacagaggcctgctaaaaacggcacggttatggacgtgatctctcgtcgagaccagcgcggttcggggcaagtcggaacctacggccttaacacatttactaatatggaagtgcagctgattagacagatggagtcagagggcatcttcctcccaagcgaactggagacccccaacttggccgaacgggtgttagattggctggagaagcatgggacagaaaggctcaagcgcatggctatatccggagacgattgtgtcgttaaaccggtggacgatagatttgccactgcacttattgcgctgaatgacatgggtaaggtacggaaagatatccctcagtgggagcccagtaagggctggaacgactggcaacaggtgccattctgctctcaccactttcatcagctaatcatgaaagatgggagggagattgtcgtgccttgtcgaaatcaggacgaactggttggacgtgccagagtgagccaaggcgctggttggtccctccgcgagaccgcctgcttggggaagtcatatgcacagatgtggcagctgatgtacttccaccggagggatcttagactggctgccaacgcaatatgtagtgccgtccccgtggactgggtaccaacgtctcgcacaacctggagcatccatgcgcaccaccaatggatgactacagaagacatgctctccgtttggaatcgggtgtggattgaggaaaacccctggatggaggataagacccatgtctcaagctgggaggaagtgccttatttaggaaaaagggaggaccagtggtgcggctctctgatcggcttgactgctcgagccacctgggcaacaaatattcaggttgccatcaaccaggtgagacggctgatagggaatgaaaactacctcgattacatgacgtccatgaagaggtttaaaaatgagagtgacccagagggagctctttggtga

SEQ ID NO: 13489 - RNA, 9879 nt, synthetic construct
  misc_feature 1..9879: note = derived and/or modified CDS sequence (opt3) from DENV-1__FJ547087__SS-prME
  source 1..9879: mol_type = other RNA
agcgtgacaatgctgctcatgcttctgcccacagcattggctttccacttaactacgagaggcggggaacctcatatgatcgtctccaagcaggaaagaggaaaatctctgctgtttaagacctcagctggtgttaatatgtgcacactcattgccatggacctgggcgaactttgtgaagatactatgacctacaaatgcccacggataacagaggcggaaccggacgatgtggactgttggtgcaatgctaccgatacttgggtaacatatgggacctgtagtcaaacgggagagcaccgccgagacaagcgtagcgtggccctggcaccccatgtcggcttgggtctcgagactagaaccgaaacatggatgtcctctgagggggcctggaaacagatccagaaggtggaaacttgggctctgaggcaccctggattcaccgttattgcactgtttctcgcccatgctatcggcacatcgattacccagaagggcatcatattcatcttactgatgcttgtgacgccatcaatggccatgcggtgcgtcgggattggaaaccgcgattttgtggagggtttgagcggcgcgacttgggtagacgttgtgctggagcacgggagttgtgtcacaaccatggccaagaataagcccactctagatatcgaactcctgaaaacagaggtgaccaaccctgccgtgcttagaaagctgtgcattgaagctaaaatctccaatacgaccacagactctaggtgtccaactcaaggagaggccaccttggtcgaagaacaggatgcaaacttcgtttgccggcgcacatttgtggaccgaggctggggtaatgggtgtggactcttcggcaagggcagcctgttaacttgcgctaagtttaaatgcgtaaccaagctggaggggaaaatagtgcagtacgaaaacctcaagtattccgtcattgtgacagttcacaccggagatcagcatcaagtgggtaatgagactacggaacacggcacaatcgccaccattactccccaggcgcctacctcagagatccagcttacagactacggggccctgaccttggactgtagtccaagaactggactagatttcaacgaaatggtcctgctcacaatgaaagaaaagagctggctggtgcataaacagtggtttcttgacctgccgttgccctggacgtctggcgcatccacctcacaagagacttggaataggcaggatctcctggtaacattcaagaccgctcacgccaagaaacaggaagttgtggtcttaggtagccaagagggggctatgcacacagccctgactggcgcaaccgaaatccagacgagtggaaccacaactatttttgccggccatctaaagtgccggctcaaaatggacaagctgacccttaaagggatgtcttatgtgatgtgtacaggatccttcaagttggagaaggaagtcgctgagactcagcacggtaccgtgctggttcaggtgaaatacgagggcacggatgcgccttgcaagataccattcagcacacaagacgaaaaaggggtaacccagaacggacgtctcatcactgcaaatcccattgtcacagataaggagaaacctgtgaacatcgaaaccgagccaccctttggcgagtcgtatataatggttggtgccggggaaaaggctctgaaactttcttggttcaaaaagggctcctcaattggaaaaatgtttgaggccactgcacgcggcgccagaaggatggctatcctgggggacaccgcctgggatttcggaagtatcggtggcgtgtttacaagcgtcgggaagttggtgcatcaggtattcggaacggcatacggcgtgctcttttccggtgtttcttggaccatgaaaattgggatcggcattctgttaacttggctgggactaaatagccggtcagcgagtctctccatgacatgtatagctgtcggcatggtgaccctgtaccttggggtgatggtccaggccgacagcggatgcgttatcaactggaagggccgagaattgaagtgtggttctgggattttcgtgacaaacgaggtgcacacttggaccgaacaatataaatttcaggcagattcaccgaagcgcctgagtgccgctatcggaaaagcctgggaggagggcgtatgcggtatcagaagcgcaacgaggctcgaaaatattatgtggaagcagatatccaacgagctgaatcatatcttactggaaaacgacatgaaattcacagtcgtggttggcgacgctaatgggattcttgcccagggaaagaaaatgatccggcctcaacccatggagcacaagtactcttggaagtcgtggggcaaagcgaagattatcggggccgatatacagaacaccacttttatcattgacggaccagatacccctgaatgtcccgacgatcagcgcgcttggaatatctgggaggtggaggactatggcttcggtatttttacaactaacatctggttgaaactcagagatagctacacccagatgtgcgaccacaggctgatgtccgcagccataaaggattcaaaagctgtccatgccgacatggggtattggattgaaagtgagaagaatgaaacatggaagctagcacgtgcgtctttcatcgaggtgaaaacgtgtatttggccaaagagccacaccctgtggtccaacggagttctcgaatcagagatgatcatacccaaaatctacggcggtcctattagccaacataattatcggccaggctacttcactcagacagccgggccgtggcacctgggaaaacttgagttggattttgacctgtgcgaaggcaccactgtggtagtcgatgagcactgcgggaaccgaggaccctctttaagaacaaccacggtgactggcaaaatcattcatgaatggtgttgcaggtcctgtaccctccctccactgcgcttccggggtgaggacgggtgctggtacggaatggagatcagacccgtgaaggaaaaggaggaaaatcttgtcaggagtatggttagcgctggctctggtgaggtggactccttttcactgggcatattgtgtgtaagtattatgatcgaagaggtgatgcgcagccgatggtcgcggaaaatgctcatgacagggaccctggccgtcttcctactgctcatcatgggacagctgacttggaacgatcttattcgtttgtgcatcatggtgggcgcaaatgcttccgacagaatggggatgggaacaacctatctggccttaatggcaacatttaagatgaggcctatgttcgccgttggcctcctgtttcgccggcttacttctagagaggtgctgctactcaccattggtctgagcttggtcgcttcagtggaactgccaaacagtttagaggaactcggggatggactggcgatgggcataatgatgcttaaactgttgacggagttccaaccccaccagctctggacaaccctgctatccctgacttttatcaagaccacactttctctcgactacgcctggaaaactatggcaatggttctgagcattgtgtccttgttcccgctgtgtttatcaaccacgagccagaagacaacctggctccctgtcctgcttggcagttttgggtgcaagccactgactatgttcttgatcacagaaaacaaaatttggggaaggaagtcttggcccctcaatgagggtatcatggctataggcatcgtatccattctgctaagctcgctgcttaaaaacgatgtgcctctcgccgggcccctgatcgccggaggcatgttgattgcttgttatgttatctcaggttctagtgcagacttatccctggagaaggccgcggaagtgagctgggaggaagaggctgaacattctgggaccagccacaatatactcgtcgaggtgcaggatgacggaactatgaaaattaaggatgaggaacgagacgatacactgaccatccttctgaaagccacgttgctagcagtatccggcgtgtacccaatgtcaatccctgccactctgtttgtctggtatttctggcaaaagaagaaacagcgcagtggcgttctctgggacacccccagcccaccggaggtggaacgggctgtgctggatgacgggatttacagaatacttcagaggggattactgggtcgttctcaggtcggcgtgggggttttccaagacggagtatttcatacaatgtggcacgtgacccgcggcgcagtcctcatgtatcagggtaagcggttggagccttcctgggcctcagtgaaaaaggatctgatcagttacgggggaggctggagattccagggcagctggaacacaggggaggaagttcaggtgattgcggtcgagcccggcaagaatccaaagaacgtgcaaactacccccggtacgtttaagacacctgaaggcgaggtaggggctatcgccctcgacttcaaaccaggaacttccggctctcccattgtcaatagggaaggtaagatcgtggggctgtacggaaacggcgttgtgaccacatcgggcacctatgtcagcgcaatagcccaggctaaagcctcacaggatgggcctcttccggagatcgaggacgaagtgtttaagaaacgaaatctgactattatggatttgcacccaggatccggtaagacccggcgctacctacccgcaatcgttagagaggctattaagaggaaactgcggacactcatcttagcccctacgcgagtggtcgcgagtgaaatggccgaggcactgaagggcatgccaataagatatcaaactaccgctgtgaaatctgaacatacagggcgcgagattgtagaccttatgtgccacgccaccttcactatgaggctgctcagccccgtgcgtgttcctaactacaatatgatcatcatggatgaggctcattttacagacccggcatccattgccgcccggggatatatctcaaccagagtcggcatgggtgaagctgcggcaatattcatgacggccactcccccagggtctgtggaggcttttcctcagagcaacgccgtgattcaggatgaagagagggacatccccgaacgcagttggaactccggatacgattggattacagacttcccaggcaagaccgtctggtttgtacctagcatcaaatctggcaacgacatagcaaattgtttgcgaaagaacgggaagagagtgattcagctgtcacggaaaaccttcgatactgagtatcaaaagaccaagaataatgactgggattacgttgtgaccacagacatctccgagatgggagccaacttcagggctgatcgcgtcatcgacccccgtagatgcctcaagccagtgattctgaaagatggtccggaacgggttatccttgcgggccctatgcccgtgactgtcgccagtgcagctcagaggcgcgggcgaattggaagaaatcagaacaaggagggcgaccagtacgtgtatatgggtcaaccactaaataacgatgaagaccacgcccattggacggaggcaaagatgctgttggataatataaacacccccgaggggatcattcctgccttatttgaaccagagcgggagaaaagcgctgccatcgacggcgagtacaggctgcgcggagaagcgagaaagacattcgtagagctcatgaggcggggcgatctgcccgtgtggctttcgtataaagttgcatctgaggggtttcagtactccgaccgtcgctggtgcttcgacggagaacgaaataaccaggtcctggaggaaaatatggatgtggagatctggactaaggaaggtgagaggaaaaagctcaggcctcggtggttggacgcccgcacctatagcgatccgctggctctaagagagtttaaagagttcgccgctggcaggcggtcagtgagtggggacctgattctcgagataggaaaacttccacagcacctgacaatccgagcacaaaacgccttagataatttggtcatgctgcacaactctgaacagggcggtaaggcttacagacatgccatggaggaactccccgacaccattgagactctgatgcttctggcactcatcgcggttttgaccgggggagtgacgctgtttttcttatccggaaaaggcctagggaagacaagcattggactgctctgtgtaatggcctcaagtgcacttctgtggatggccagcgtggagcctcactggatcgcagcttccataatcttggaatttttcctgatggtcctcctgattcccgagccagatcgccagaggactcctcaggacaatcaacttgcctatgtggttatcggtctcctgtttatgattttgaccgtggcagccaacgaaatgggcctgttagagacaaccaaaaaggatctagggatcggacatgtcgctgcggagaaccaccaccatgccactatgctggacgtagatctccggcccgcatctgcttggacactttacgccgtggccacgaccgttataactccaatgatgcgtcacacaattgaaaataccaccgcaaacatcagcctgacagctattgccaatcaggcggctatcttgatgggcctggacaaaggttggcctatatccaagatggatatcggggtgccgctcctggcccttggctgctactcacaggtcaaccccttaactctgacggcagccgtgctcatgttggtcgctcattatgcaattatcggaccaggcctgcaagccaaggcgaccagagaggctcagaaaaggacagccgcagggattatgaagaatcctactgtggacggaatcgttgccatagacctagatcccgtggtatacgacgctaaattcgaaaagcagctgggccagattatgctccttatcctgtgtacctctcaaatcttgctgatgcgcacaacctgggccctctgcgagagtattactctggcaacgggtccattaacaaccctttgggaagggtcgcctggaaaattttggaacactaccatcgctgtgagcatggccaatatattccggggctcctatctggcgggtgccggcctcgcattctctctaatgaagtcactagggggaggccgaagagggacaggagctcagggcgagactttgggtgagaagtggaaaaggcagctgaaccagctcagcaagtccgaatttaatacctacaaacgcagtgggattatggaggtcgatcggtctgaagccaaggagggacttaaaagaggcgaaacaacgaagcacgcagttagccgtggtaccgctaagctgaggtggttcgtggagcggaacttggtcaaacccgagggcaaggtgatcgacctggggtgtggacgcggcgggtggtcatattactgcgccggactcaaaaaggtaactgaagtgaaaggctatacaaagggtgggccgggacatgaggaaccaattcctatggccacctacggctggaatttagttaaactgcactccggcaaggatgtgtttttcactcccccagagaagtgtgacacacttctgtgcgatatcggggaaagtagccccaaccctaccatagaggagggacgaacgctaagagtcctcaaaatggtggaaccgtggctgaggggtaatcaattttgtatcaagattttgaacccctacatgccatctgtcgtggagaccctggaacagatgcagcggaaacacggcgggatgctcgttcgcaatcctctttccagaaactcaacacatgagatgtattgggtaagctgcggaactggcaatatcgtgtcggcggtcaacatgacctctaggatgctgttaaaccgattcacaatggctcaccggaagcccacttacgagcgtgacgtggatctgggtgcagggaccagacatgttgccgtggaacctgaggtcgctaatttggacattatcggacagcgcattgaaaacatcaaaaatgagcacaagagtacatggcactatgatgaagacaacccatacaagacctgggcctatcatggctcctacgaggtgaaacccagcggctcagcatcctctatggtaaatggggtggttaggctcctgactaagccttgggacgtcataccaatggtgacgcaaattgccatgacagataccactccctttggacagcagcgggtgttcaaagagaaggtcgacaccagaacaccgcgcgctaaaaggggtacggcgcaaatcatggaagttaccgccaagtggctatggggctttcttagccgaaacaagaaacctcggatctgtactagagaggagttcacaaggaaggtgcgcagtaatgcagctattggggccgtatttgtggatgagaaccagtggaactccgcaaaagaagccgtcgaggacgagcgtttctgggatctggtgcaccgggaaagagagctccataagcagggaaaatgcgctacctgcgtttataacatgatgggcaagagggaaaagaaactgggtgagtttgggaaggccaaaggaagccgcgcgatatggtacatgtggttgggcgcacgattcctggagttcgaggccctcggctttatgaatgaggaccactggttctctcgggaaaactcacttagtggggtggagggagaaggtctgcataagttaggctacatcctgagagatatttccaaaatcccagggggaaatatgtatgctgacgatactgccggctgggacacaaggattaccgaggatgacttgcagaacgaggcaaagatcacagatataatggaacccgagcacgctctcctggccactagcatctttaaactaacctaccaaaataaggtcgtgcgcgtacagagacctgctaagaacggtacggttatggacgtgatttctcggagggaccagcgtgggtcgggacaggtcggcacctatggccttaacacattcactaatatggaagtgcaactgatccgacagatggagtcagaagggatttttctcccatgtgagctggagacccccaacttggccgaacgcgtgttagattggctggagaaacacggagcagaaagactcaagcggatggcgatcagcggtgacgattgcgtcgttaaaccgatagacgataggttcgccacagctcttattgccctgaatgacatgggcaaggtgcgcaaagatatccctcagtgggagccctccaaggggtggaacgactggcagcaagtaccattttgtagtcatcacttccatcagctaatcatgaaggatggaagagaaattgtggtcccttgccggaatcaggacgagctggtgggcagggcacgagtttctcagggtgctgggtggagcctccgtgagactgcctgtttgggaaaatcctacgcacaaatgtggcagctgatgtattttcacagacgcgatcttcggctggccgcgaacgctatatgctcagccgtgcccgtcgactgggtgccaaccagtaggacgacatggtctatccacgcacatcaccagtggatgaccactgaagacatgctcagcgtatggaatagagtttggattgaggaaaacccctggatggaggataagacacatgtgtcctcatgggaagaggtcccttacttaggcaaacgcgaggaccaatggtgtggcagcctgatcgggttgaccgcccgggctacttgggccaccaatattcaggtggcaatcaaccaggttaggcgactgataggaaatgaaaactatctcgattacatgacatctatgaagagattcaaaaatgagtccgacccagaaggtgctctttggtga

SEQ ID NO: 13490 - RNA, 9879 nt, synthetic construct
  misc_feature 1..9879: note = derived and/or modified CDS sequence (opt3) from DENV-1__FJ410186__SS-prME
  source 1..9879: mol_type = other RNA
agcgtgaccatgctgctcatgcttctgcccacagccttggctttccacttaactacgagaggcggggagcctcatatgatcgtctccaagcaggaaaggggaaaatctctgctatttaagacctcagcaggtgttaacatgtgcacactcattgccatggacctgggcgagctttgtgaagatactatgacctacaaatgcccacggataacagaggtggaaccggacgatgtagactgttggtgcaatgcgaccgatacttgggtgacatatgggacctgtagtcaaacgggagagcaccgccgagacaagcgtagcgtcgctctggccccccatgtgggcttgggtctcgagactagaaccgaaacatggatgtcctctgagggggcatggaaacagatccagaaggttgaaacttgggccctgaggcaccctggattcaccgtgattgcttttttcctggcacatgccatcggcacatcgattacccagaagggcatcatatttatcctcttaatgctggtcacgccatcaatggctatgcggtgcgtggggattggaaaccgcgatttcgtagagggtcttagcggcgccacttgggttgacgtggtcttggagcacgggagttgtgtgacaaccatggcgaaaaataagcccactctggatatcgaactactcaaaacagaggtgaccaaccctgcagtcctgagaaagctttgcattgaagccaaaatctccaatacgaccacagactctaggtgtccaactcaaggagaggctaccctggttgaagagcaggatgccaactttgtgtgccggcgcacattcgtagaccgaggctggggtaatgggtgtggattgtttggcaagggcagcctcctgacttgcgcaaagttcaaatgcgtgaccaagttagaggggaaaatagtccagtacgaaaacctgaagtattccgtgattgttacagtgcacaccggagatcagcatcaagtcggtaatgagactacggaacacggcacaatcgctaccattactccccaggcccctacctcagagatccagctcacagactacggggcgcttaccctggactgtagtccaagaactggattggattttaacgaaatggtgctactgacaatgaaagagaagagctggctcgtacataaacagtggttcctggaccttccgctgccctggacgtctggcgcctccacctcacaagagacttggaataggcaggatttgctcgttacatttaagaccgcacacgctaagaaacaggaagtggtcgtgctgggtagccaagagggggccatgcacacagctttaactggcgccaccgaaatccagacgagtggaaccacaactattttcgcaggccatctgaagtgccggctaaaaatggacaagctcaccctgaaagggatgtcttatgtcatgtgtacaggatccttcaagcttgagaaggaagtggccgagactcagcacggtaccgttttggtgcaggtaaaatacgagggcacggatgctccttgcaagataccatttagcacacaagacgaaaaaggggtcacccagaacggacgtctgatcactgcgaatcccattgtgacagataaggagaaacctgttaacatcgaaaccgagccacccttcggcgagtcgtatataattgtgggtgcaggggaaaaggccctcaagctgtcttggtttaaaaagggctcctcaatcggaaaaatgttcgaggctactgcccgcggcgcaagaaggatggccatccttggggacaccgcttgggattttggaagtattggtggcgtcttcacaagcgtggggaagctggtacatcaggtgtttggaacggcctacggcgttttgttctccggtgtctcttggaccatgaaaatcgggattggcatactcctgacttggttaggactgaatagccggtcagcaagtctatccatgacatgtatcgcggtgggcatggtgaccctctacctgggggtcatggttcaggctgacagcggatgcgtgattaactggaagggccgagaacttaagtgtggttctgggatctttgtgacaaacgaggtacacacttggaccgaacaatataaattccaggccgattcaccgaagcgcttgagtgcagccatcggaaaagcttgggaggagggcgtctgcggtattagaagcgccacgaggctggaaaatataatgtggaagcagatctccaacgagctcaatcatattctgttagaaaacgacatgaaatttacagtggttgtgggcgacgcaaatgggatcctggctcagggaaagaaaatgattcggcctcaacccatggagcacaagtactcttggaagtcgtggggcaaagccaagatcataggggcggatatccagaacaccactttcattatcgacggaccagatacccctgaatgtcccgacgatcagcgcgcctggaatatttgggaggtcgaggactatggctttggtatcttcacaactaacatatggcttaaattgagagatagctacacccagatgtgcgaccacaggctcatgtccgctgcaattaaggattcaaaagccgtgcatgctgacatggggtattggatcgaaagtgagaagaatgaaacatggaagctggcccgtgcatctttcattgaggttaaaacgtgtatctggccaaagagccacaccctatggtccaacggagtgctggaatcagagatgataatccccaaaatttacggcggtcctactagccaacataattatcggccaggctactttacacagaccgcggggccgtggcacctcggaaagctggagcttgatttcgacttgtgcgaaggcactacagtagtcgtggatgagcactgcgggaaccgaggaccctctctgagaaccacgactgtgaccggcaaaatcattcatgaatggtgttgcaggtcctgtacattacctccactccgctttcggggtgaggacgggtgctggtacggaatggagatcagacccgtcaaggaaaaggaggaaaatctggttaggagtatggtgagcgccggctctggtgaggtagactccttctcacttggcatactgtgtgtgagtattatgatcgaagaggtcatgcgcagccgatggtcgcggaaaatgttgatgaccgggactctcgctgtgtttctgctactgatcatgggacagctcacatggaacgatctgattcgtctttgcatcatggttggcgccaatgcatccgacagaatggggatgggaaccacatatttggctctgatggccactttcaagatgaggcctatgtttgcagtgggcttactcttccgccggctgacctctagagaggtccttctgctaacgattggtctcagcctggtggcctcagttgaattgccaaacagtctggaggaattaggggatggactcgctatgggcataatgatgctgaaacttctgacagagtttcaaccccaccagttgtggaccactctcctgtccctaaccttcatcaagacaactctgtctcttgactacgcgtggaaaaccatggccatggtgctcagcattgtctccctgtttccgttgtgtctgtcaacgacaagccagaagaccacttggttacctgtactcctgggcagtttcgggtgcaagccacttacaatgtttctgatcaccgaaaacaaaatttggggaaggaagtcttggcccttgaatgagggtatcatggcaataggcatcgtgtccattctcctgagctcgctactgaaaaacgatgttcctcttgctgggcccctcatcgccggaggcatgctgattgcctgttatgtgatctcaggttctagtgctgacttgtccttagagaaggcagccgaagtcagctgggaggaagaggcggaacattctgggactagccacaatatactggtggaggtacaggatgacggaacaatgaaaattaaggatgaggaacgagacgataccctcacgatcctgcttaaagctactctgttggccgtgtccggcgtctacccaatgtcaatccctgcaaccctattcgtttggtatttctggcaaaagaagaaacagcgcagtggcgtgctgtgggacacacccagcccaccggaggtggaacgggccgtcctcgatgacgggatttacagaatactgcagaggggacttttaggtcgttctcaggtgggcgttggggtatttcaagacggagtgttccataccatgtggcacgtcacacgcggcgctgtgctgatgtatcagggtaagcggctcgagccttcctgggcatcagttaaaaaggatttgatcagttacgggggaggctggagatttcagggcctgtggaacactggggaggaagtgcaggtcattgccgtggagcccggaaaaaatccaaagaacgtacaaaccacgcccggtacattcaagactcctgaaggcgaggtcggggcgatcgctctcgactttaaaccaggaaccagcggctcccccattgtgaatagggaaggtaagatcgttgggctgtacggaaacggcgtggtcacaacctctggcacttatgtgtcggccatagcacaggccaaagctagccaggaggggcctcttccggagatcgaagatgaggttttcaagaaacgaaatctgaccattatggacttgcacccaggatcaggtaagacacggcgctacctacccgccatcgtgagagaagcaattaagaggaaactgcggacgctcatcttagctcctactcgagtcgtggcctccgagatggcggaagccctgaagggcatgccaataagatatcaaaccacagcagtaaaaagtgagcataccgggcgcgagattgtggatcttatgtgccacgctacttttacaatgaggctgctctctcccgttcgtgtccctaactacaatatgatcatcatggacgaagcccatttcaccgatccggctagcattgcagcccggggatatatctccacgagagtgggcatgggtgaggccgctgcgatatttatgactgcaacacccccagggtcagtggaagccttccctcagtctaacgctgtcattcaggacgaggaaagggatatccccgagcgcagctggaatagtggatacgactggattaccgattttccaggcaagaccgtatggttcgtgccttccatcaaaagcggcaacgacatagccaattgtttgcgaaagaacgggaagagagttattcagctgtctcggaaaactttcgacacagagtatcaaaagaccaaaaacaatgattgggactacgtggtcacaactgatatctcagaaatgggagcaaactttagggccgaccgcgtgatcgatccccgtagatgcctcaagccagttattctgaaagacggtccggagcgggtgatccttgctggccctatgcccgtcacggtggcgtccgccgcacagaggcgcgggcgaattggaagaaatcagaacaaggaaggcgatcagtacgtatatatgggtcaaccactaaataacgacgaggatcacgctcattggaccgaggccaagatgctgttggacaatataaacacacccgaagggatcattcctgcattattcgagccagaacgggagaaaagtgccgctatcgatggcgaatacaggctgcgcggagaggccagaaagacttttgtggagctcatgaggcggggcgacctgcccgtttggcttagctataaagtcgcgtcggaagggttccagtactctgatcgtcgctggtgctttgacggagagcgaaataaccaggtgctggaagagaatatggacgtggaaatctggaccaaggagggtgagagaaaaaagctcaggcctcggtggttggatgcacgcacatattccgacccgctggccctaagagaattcaaagagtttgctgccggcaggcggagcgtctcaggggatctgattctcgaaataggaaagcttccacagcacctgaccttacgagctcaaaacgcattggacaatctggttatgctccacaacagtgagcagggcggtaaggcctacagacatgctatggaagagctgcccgatactatcgagacgcttatgctgctcgccttgattgcagtgctgaccgggggcgtaacattattctttctatctggaaaaggcctggggaagacttccatcggactcctttgtgtgatggcgagctcagccctgttgtggatggctagtgtcgaacctcactggattgccgcaagcatcatactggagttctttctcatggtgctgcttatccccgaaccagaccgccagaggacccctcaggataatcaactcgcttatgttgtgattggtctgttgttcatgatcctgacagtcgccgcaaacgagatgggcttactagagaccactaaaaaggacctggggattggacatgtagccgctgaaaaccaccaccatgcgacaatgctcgatgtggaccttcggcccgcctccgcatggacgctgtacgctgttgccaccactgtgatcacaccaatgatgcgtcacaccatagagaataccacagccaacatttctttgactgcaatcgctaatcaggccgcgattctgatgggcctcgataaaggttggcctatcagcaagatggacataggggtcccgctgcttgctttaggctgctactcccaggtgaaccccctgacgctcaccgccgcagtcttgatgctggtggcccattatgctatcattggaccaggcctacaagcaagagccacaagggaagcgcagaagcgcactgctgccgggatcatgaaaaatcctaccgttgatggaattgtggcaatcgacctggaccccgtagtgtacgatgccaagtttgagaaacagctcggccagataatgcttctgattttgtgtacatcacaaatcctgctcatgcggaccacttgggctctgtgcgaatctatcacgttagccacaggtccacttaccactctgtgggaggggagtcctggaaagttctggaacaccacaattgcagtctcgatggctaatatcttccgaggcagctatctcgccggtgcgggcctagccttttccctgatgaaatctttggggggaggcagaagggggactggagcacagggcgagaccctgggtgaaaagtggaagcgccagctcaaccagctttcaaaaagcgagttcaatacatacaagcggtccgggataatggaagttgacagaagtgaggctaaagaaggactgaagcgtggcgagacgaccaaacacgccgtgtctaggggtactgcaaagttgcggtggtttgtcgagcgcaacctggtgaagcccgaaggcaaagtaattgatctcgggtgtggacgaggcgggtggagctattactgcgctggattaaagaaagtgacagaggttaagggctataccaaaggtgggccgggacatgaagagccaatccctatggccacttacggctggaatctggtgaagcttcactcaggcaaagacgtcttctttacacccccagaaaagtgtgataccctgctatgcgacattggggagtccagtcccaaccctacgatcgaggaaggaagaaccctcagggtgctgaagatggtcgagccgtggttgcggggtaatcaattctgtataaaaatcctgaacccctacatgccaagcgtggttgaaacactcgagcagatgcagcgcaagcacggcgggatgcttgtaagaaatcctctgtctaggaactccactcatgagatgtattgggtgtcatgcggaaccggcaatattgtcagcgccgtgaacatgacatcgcgaatgttactgaaccggtttactatggcgcaccgtaaacccacctacgaaagagatgttgacttgggtgctgggacacgccatgtggcagtcgagcctgaagtggccaatctcgatatcattggacagaggatcgagaacattaagaatgaacacaaatctacctggcactatgacgaggataacccatacaagacttgggcttatcatggcagttacgaggtaaagccctccggcagcgcctcatccatggtgaatggggttgtccggctgctaacgaaaccttgggacgtgatcccaatggtgacacaaatagcaatgaccgacactacccccttcggacagcagagagtctttaaggaaaaagttgatacacgcacgccgagggccaagcgaggtaccgctcaaattatggaggtgactgcgaaatggctttggggcttcctgtctcggaacaagaagcctagaatctgtacaagggaagagtttacccgcaaagtacgtagcaatgccgcaatcggggctgtgttcgtcgacgaaaaccagtggaatagtgccaaggaggcagtggaggatgaacggttttgggacctcgttagaagggagcgcgaactgcacaaacagggaaagtgcgccacttgcgtgtataacatgatgggcaaacgagagaagaagttgggtgaattcgggaaagctaagggatcccgggccatttggtacatgtggctgggcgcgagattcctcgagtttgaggcacttggcttcatgaatgaagatcattggtttagcagggagaactctctgtcaggggtcgaaggagagggtttacacaaactgggctacatattgcgcgacatcagtaagattccagggggaaatatgtatgccgatgacacagctggctgggataccagaatcacagaggacgatctccagaacgaagccaaaattactgacatcatggagcccgaacatgcactgctagctacctccatattcaagcttacgtaccaaaataaagtggtacgggttcagaggcctgccaagaacggtaccgtgatggatgtcatcagccgtcgagaccagcgcgggtctggacaggtgggcacatatggcctgaacacttttaccaatatggaggtgcaactcattagacagatggaatcggaggggatcttcctgccatcagagttggaaacacccaacttagctgagcgggtcctggactggctcgaaaagcacggagccgagaggcttaaacgcatggcaattagcggtgatgactgtgttgtgaagccggtagatgacagatttgcgactgccctgatcgctctaaatgatatgggcaaagtgcggaaggacatacctcagtgggaaccctccaaagggtggaacgattggcagcaagtcccattctgcagtcaccattttcaccagctgattatgaaggacggaagggagatcgtggttccttgtcgaaatcaggatgagctcgtgggccgtgccagagtctctcagggtgcagggtggagcttgcgcgaaaccgcttgcctgggaaagtcctacgcccaaatgtggcagcttatgtatttccatcggagggacctgagactcgcagccaacgcgatctgttcagctgatcccgtggactgggtaccaacgagtcgcacaacctggtctattcacgcccaccatcagtggatgactacagaggacatgttaagcgtttggaatcgggtgtggatagaagagaacccctggatggaagataaaacccacgtctcctcatgggaggaggtgccttacctgggcaagagggaagaccaatggtgcggcagcttgatcgggctgactgcacgagccacctgggctacaaatattcaggttgccatcaaccaggtgagacggctcattggaaatgagaactatcttgattacatgatctctatgaaaaggtttaagaatgaatccgacccagagggtgcactgtggtga

SEQ ID NO: 13491 - RNA, 9879 nt, synthetic construct
  misc_feature 1..9879: note = derived and/or modified CDS sequence (opt3) from DENV-1__FJ410187__SS-prME
  source 1..9879: mol_type = other RNA
agcgtgaccatgctgctcatgcttctgcccaccgccttggctttccacttaactacgagaggaggggagcctcatatgatcgtctccaagcaggaaaggggaaaatctctgttgtttaagacctcagcaggtattaacatgtgcacactcatagccatggacctgggcgagctttgtgaagatactatgacctacaaatgcccacggatcacagaggcggaaccggacgatgttgactgttggtgcaatgctaccgatacttgggtgacatatgggacctgtagtcagacgggagagcaccgccgagacaagcgtagcgtagccctggcaccccatgtgggcttgggtctcgagactagaaccgaaacatggatgtcctctgagggggcctggaaacagattcagaaggtcgaaacttgggctctgaggcaccctggattcaccgtgacagcactgtttctcgcccatgctatcggcacctcgattacgcagaagggcatcatattcatcttactgatgcttgttactccatcaatggccatgcggtgcgtggggattggaaaccgcgattttgtcgagggtttgagcggcgcgacatgggtggacgtagttctggagcacgggagttgtgtgaccactatggcaaaagataagcccacactagacatcgaactcctgaaaaccgaggtcacgaatcctgccgtgcttagaaagctgtgcattgaagctaaaatctccaacaccacaactgattctaggtgtccaacccaaggagaggccacattggtggaagaacaggacagcaatttcgtctgccggcgcacttttgttgatcgaggctggggtaacgggtgtggactcttcggcaagggctccctgttaacctgcgcaaagtttaaatgcgtgacaaagctggaggggaaaatagtacagtacgaaaatctcaagtattcagtgattgtcaccgtgcacactggagaccagcatcaagttggtaacgagacgacagaacacggcaccatcgctactattacaccccaggcccctacaagtgagatccagcttaccgactacggggcgctgactttggattgtagcccaagaacaggactagacttcaatgaaatggtgctgctcacgatgaaagagaagtcttggctggtccataaacagtggtttcttgatctgccgttgccctggacctccggcgcctcaactagccaagagacatggaacaggcaggacctcctggtgaccttcaagacagcacacgctaagaaacaggaagtagttgtgttaggtagtcaagagggggccatgcacactgctctgaccggcgccacggaaatccagacctctggaacaactaccatttttgcaggccatctaaagtgccggctcaaaatggataagctgacacttaaagggatgtcctatgtcatgtgtactggcagcttcaagttggagaaggaagtggccgagacccagcacggtacggtcctggtgcaggttaaatacgagggcacagacgctccttgcaagataccattctcggcgcaagatgaaaaaggggtgacccagaatggacgtctcatcactgcaaaccccattgtaacagacaaggagaaacctgtcaatatcgaaaccgagccaccctttggcgagtcttatatagtggttggtgccggggaaaaggctctgaaactttcctggttcaaaaagggctcaagtattggaaaaatgtttgaggccactgcacgcggcgccagaaggatggctatcctgggggataccgcctgggacttcggaagcatcggtggcgtgtttacatccgtcgggaagttggtgcatcaggtattcggagcagcgtacggcgtgctcttttctggtgttagctggacgatgaaaattgggatcggcattctgttaacctggctgggactaaactcacggagtacttccctcagcatgacatgtatagctgtcggcatggtgaccctgtaccttggggtgatggtccaggccgattctggatgcgttatcaattggaagggccgagaattgaagtgtggttcagggattttcgtgacaaacgaggtgcacacttggaccgaacaatataaatttcaggcagacagtccgaagcgcctgagcgccgctatcggaaaagcctgggaggagggcgtatgcggtatcagatccgcaacgaggctcgaaaacattatgtggaagcagatatctaatgagctgaaccatatcttactggaaaatgacatgaaattcacagtcgtggttggcgatgctaacgggattcttgcccagggaaagaaaatgatccggcctcaacccatggagcaccgctactcgtggaaaagctggggcaaggcgaagattatcggggccgacatacaaaattccacctttatcattgatggaccagacactcctgaatgtcccgatgaccagagagcttggaacatctgggaggtggaggattatggcttcggtatttttaccacaaatatctggttgaagctcagggactcatacactcagatgtgcgatcaccgtctgatgagtgcagccataaaagactctaaggctgtccatgccgatatggggtattggattgaaagcgagaaaaacgaaacctggaagctagcacgggcgtccttcatcgaggtgaagacatgtatttggccaaaatcacacacgctgtggagcaatggagttctcgaatctgagatgatcatacccaagatctacggcggtcctatttcccaacataactatcgaccaggctacttcacccagactgccgggccgtggcacctgggaaaacttgagttggactttgatctgtgcgaaggcacaaccgtggtagtcgacgagcactgcgggaatagaggacccagtttaaggactacaaccgtgacgggcaagatcattcatgaatggtgttgccgcagctgtactctccctccactgcggttcagaggtgaggacgggtgctggtacggaatggagatcaggcccgtgaaagaaaaggaggaaaaccttgtccgctctatggtttccgctggctcaggtgaggtggatagttttagcctgggcatattgtgtgtatcgattatgatcgaagaggtgatgcgatcccggtggtctcgtaagatgctcatgaccgggacactggccgtcttcctactgctcatcatgggacagctgacctggaatgaccttattagattgtgcatcatggtgggcgcaaacgctagcgataggatggggatgggaactacatatctggccttaatggcaacctttaaaatgcgccctatgttcgccgttggcctcctgtttcggagacttacatcaagggaggtgctgctactcactattggtctgagtttggtcgcttccgtggaactgccaaattctttagaggaactcggggacggactggcgatgggcataatgatgcttaagctgttgaccgagttccaaccccaccagctctggacgacactgctaagcctgacctttatcaaaactaccctttccctcgattacgcctggcgaacaatggcaatggttctgtcaattgtgagcttgttcccgctgtgtttaagtactacctctcagaagacgacatggctccctgtcctgcttggctcctttgggtgcaaaccactgaccatgttcttgatcactgaaaacaagatttggggacgcaagagctggcccctcaacgagggtatcatggctataggcatcgtatcgattctgctatcatctctgcttaaaaatgacgtgcctctcgccgggcccctgatcgccggaggcatgttgattgcttgttatgttatcagtggttccagcgcagatttatctctggagaaggccgcggaagtgagctgggaggaagaggctgaacattccgggacatcacacaacatactcgtcgaggtgcaggacgatggaaccatgaaaattaaggacgaggaacgggatgacactctgacaatccttctgaaagccaccttgctagcagtaagtggcgtgtacccaatgagcatccctgccacgctgtttgtctggtatttctggcaaaagaaaaagcagagatctggcgttctctgggatactccctccccaccggaggtggaaagggctgtgctggacgacgggatttaccgtatacttcagcgcggattactgggtcggtcacaggtcggcgtgggggttttccaagatggagtatttcataccatgtggcacgtgacaagaggcgcagtcctcatgtatcagggtaagaggttggagcctagttgggccagcgtgaaaaaggacctgatctcctacgggggaggctggcgattccagggctcttggaataccggggaggaagttcaggtgattgcggtcgagcccggcaagaacccaaagaatgtgcaaacaactcccggtacctttaaaacgcctgaaggcgaggtaggggctatcgccctcgatttcaagccaggaacatcgggcagccccattgtcaaccgggaaggtaagatcgtggggctgtacggaaatggcgttgtgactacctcaggcacatatgtctccgcaatagcccaggctaaaaccagtcaggaggggcctcttccggagatcgaagaggaagtgtttaagaaacgcaacctgactattatggacttgcacccaggatctggtaagaccagaaggtacctacccgccatcgttcgggaggcaattaaacgaaagctgagaacactcatcttagctcctacgcgcgtggtcgccagcgaaatggcggaggccctgaagggcatgccaataaggtatcaaactaccgcagtgaaatccgagcatacagggcgtgaaattgtagatcttatgtgccacgctaccttcactatgcggctgctctcacccgtgagagttcctaattacaacatgatcatcatggacgaggcccattttacagatccggcttctattgcagccaggggatatatcagcacccgcgtcggcatgggtgaagccgctgcgatattcatgacggcaactcccccagggagtgtggaggcctttcctcagtccaatgctgtgattcaggacgaagaacgagatatccccgagagaagctggaactctggatacgactggattacagatttcccaggcaagaccgtctggtttgtaccttcaatcaaatccggcaatgacatagccaactgtttgcggaagaatgggaaaagggtgattcagctgagtcgcaagaccttcgacactgaatatcaaaagacacgtaacaacgattgggactacgttgtgaccacagatatcagcgagatgggagcaaatttcagagccgaccgggtcatcgatcccaggcgctgcctcaaaccagtgattctgaaggacggtccggaacgagttatccttgctggccctatgcccgtgactgtcgcgtcggccgcacagagacgggggaggattggacgcaaccagaataaagagggcgatcagtacgtgtatatgggtcaaccactaaacaatgacgaggatcacgctcattggacggaagccaagatgctgttggacaacataaatacccccgaggggatcattcctgcattatttgaaccagagagagaaaaatctgccgctatcgatggcgagtacaggctgcggggagaggcccgtaagacattcgtagaactcatgcgccgaggcgacctgcccgtgtggctttcctataaggttgcgagcgaggggtttcagtactcagatagaaggtggtgcttcgacggagaacggaacaatcaggtcctggaggaaaacatggacgtggagatctggactaaagagggtgaacgcaagaaactcagacctaggtggttggatgcacggacctatagtgacccgctggccctacgagagtttaaggagttcgctgccggcagacgctctgtgtccggggatctgattctcgagataggaaaacttccacagcacctgacattaagggctcaaaatgcattggacaacctggtcatgctccacaatagcgaacagggcggtaaggcctaccggcatgctatggaggagctgcccgataccatcgaaactcttatgctgctcgccttgattgcagttctgaccgggggagtgacgttatttttcctatcaggaaaaggcctggggaagacaagtatcggactcctttgtgtaatggcgagctccgccctgttgtggatggctaacgtggagcctcactggattgccgcatctatcatactggaatttttcctcatggtcctgcttatccccgagccagaccgtcagagaactcctcaggataatcaactcgcttatgtggttattggtctgttgtttatgatcctgaccgtggccgcaaacgagatgggcttactagaaacaaccaagaaagacctggggattggacatgtcgccgctgagaaccagcaccacgcgactatgctcgatgtagaccttaggcccgccagcgcatggacactgtacgctgtggccacgaccgttatcactccaatgatgcgccatacaatagaaaataccaccgccaacatttccttgacagcaatcgctaatcaggccgcgattctgatgggcctcgataagggttggcctatctcaaaaatggacataggggtgccgctgcttgctttaggctgctactctcaagtcaaccccctgactctcacggccgcagtgttgatgctggtcgcccactatgctatcattggaccaggcctacaggcaaaggccacccgggaggcgcagaaacgaacagctgccgggatcatgaagaatcctactgtggatggaattgttgcaatcgacctggaccccgtggtatacgatgccaagttcgaaaaacagctcggccaaataatgcttctgattttgtgtaccagtcagatcctgctcatgagaacaacctgggctctgtgcgagtcgatcactttagccacgggtccacttacaaccctgtgggaggggagccctggaaagttttggaacactaccattgcagtgtccatggctaatatcttcaggggctcttatctcgccggtgcgggcctagccttctcactgatgaaaagcctagggggaggccgccgggggacaggagcacagggcgaaactctgggtgagaagtggaagagacagctcaaccaactttccaagagtgaatttaatacctacaagcgttctgggataatggaggtcgacaggagcgaagctaaagagggactgaagcggggcgagacaacgaaacatgccgtttcacgcggtaccgcaaagttgcgatggttcgtggaaagaaacctggtcaaacccgagggcaaggtgattgatctcgggtgtggaaggggcgggtggtcctattactgcgctggattaaagaaagtaactgaagtgaagggctatacaaaaggtgggccgggacacgaggaaccaatccctatggccacctacggctggaatctggttaaactttacagtggcaaagacgtgtttttcactcccccagagaagtgtgatacactgctatgcgacattggggagagctctcccaaccctaccatcgaagagggacggacgctccgcgtcctgaaaatggtggaaccgtggttgagaggtaatcagttttgtataaagatcctgaacccctatatgccatccgtcgtggagaccctcgagcagatgcagaggaagcatggcgggatgcttgttcgaaatcctctgtcacggaacagcacacacgaaatgtactgggtatcgtgcggaactggcaatattgtgtctgccgtcaacatgaccagtcgtatgttactgaacagattcacaatgactcaccgcaaacccacctatgagagggatgtggacttgggtgcggggacacggcatgttgctgtggaacctgaggtcgcaaatctcgatatcattggacaaagaatcgaaaacattaagaatgagcacaaatccacctggcattacgacgaggataacccatataagacttgggcctaccacggcagctatgaagtgaaaccctcaggctccgcttctagcatggtaaatggggtggttcgcctgctaacgaagccttgggacgtcatcccaatggtgacacagatagccatgaccgacactaccccctttggacagcaaagggtgttcaaggagaaagtcgatacacgaacgccgcgggcaaagagaggtaccgcccagattatggaagttactgctaaatggctttggggctttctgagtaggaacaagaaacctcgcatctgtacacgtgaggagttcacccggaaggtgagatccaatgcggccatcggggcagtatttgtggacgagaaccagtggaatagcgctaaggaggccgtcgaagatgagaggttctgggacctcgtgcaccgcgaacgagagctgcataaacagggaaagtgcgcaacttgcgtttacaacatgatgggcaaacgggaaaagaaattgggtgagtttgggaaggccaagggatctagagctatttggtacatgtggctgggcgccaggttcctcgagttcgaagcgcttggctttatgaatgaggatcactggttctcacgcgaaaacagtttttccggggtggagggagagggtctgcataaattaggctatatactgagagacatcagcaagattccagggggaaatatgtacgcagatgacacagccggctgggatacccggatcacagaagacgatttgcaaaacgaggctaaaattactgacatcatggaacccgagcacgccctcctggcaacctctatattcaagctaacgtatcagaataaagtcgtgagggtacagcgtcctgctaagaacggtaccgttatggatgtgatctcgcgacgcgaccagagagggtcaggacaagtcggcacatacggccttaacacttttaccaatatggaagtgcagctgattcggcagatggagagcgaggggatcttcctcccatccgaactggagacacccaacttggccgaaagggtgttagactggctggagaaacatggaactgaacgcctcaagagaatggctattagtggtgatgactgtgtcgttaagccggtggatgaccggtttgccaccgcacttatcgcgctgaatgatatgggcaaagtaaggaaggacatacctcagtgggagccctctaaagggtggaacgattggcaacaggtgccattctgcagccaccactttcatcagctaattatgaaggacggacgagagatcgtcgtgccttgtcgtaatcaggatgaactggttggcagagcccgcgtgtcccaaggtgctgggtggtcactccgggagacggcctgcttgggaaaaagttatgcacagatgtggcagctgatgtacttccacaggagagaccttcgcctggctgccaacgcaatctgttctgccgtccccgtggattgggtaccaacaagccggaccacttggtccattcatgcgcaccaccaatggatgacaaccgaagacatgctctcagtttggaatagggtgtggatagaggaaaacccctggatggaggacaagactcatgtcagctcttgggaggaagtgccttatttaggcaagcgagaggatcagtggtgcggctccctgatcgggttgaccgctagagccacatgggcaacgaatattcaggttgccatcaaccaggtgcggaggctgattggaaatgaaaactacctcgactacatgaccagtatgaaacgctttaagaatgagagcgatccagagggtgctctttggtga

SEQ ID NO: 13492 - RNA, 9879 nt, synthetic construct
  misc_feature 1..9879: note = derived and/or modified CDS sequence (opt3) from DENV-1__FJ478457__SS-prME
  source 1..9879: mol_type = other RNA
agcgtgaccatgctgctcatgcttctgcccactgcattggctttccacttaactacgaggggaggggagcctcatatgatcgtctccaagcaggaaaggggaaaatctctgctctttaagacctcagccggtgttaacatgtgcacactcattgcaatggacctgggcgagctttgtgaagatactatgacctacaaatgcccacggataacagaggcggaaccggacgatgtggactgttggtgcaatgctaccgatacttgggtaacatatgggacctgtagtcaaacgggagagcaccgccgagacaagcgtagcgtggccctggcaccccatgtcggcttgggtctcgagactagaaccgaaacatggatgtcctctgagggggcctggaaacagatccagaaggtggaaacttgggctctgaggcaccctggattcaccgttattgcactgtttctcgcccatgctatcggcacatcgattacccagaagggcatcatattcatcttactgatgcttgtgacgccatcaatggccatgcggtgcgtcgggattggaaaccgcgattttgtggagggtttgagcggcgcgacttgggtagacgttgtgctggagcacgggagttgtgtcacaaccatggccaagaataagcccactttggatatcgaactcctgaaaacagaggtgaccaaccctgccgtgcttagaaagctgtgcattgaagctaaaatctccaatacgaccacagactctaggtgtccaactcaaggagaggccaccttggtcgaggaacaagatgcaaacttcgtttgccggcgcacatttgtggaccgaggctggggtaatgggtgtggactcttcggcaagggcagcctgttaacttgcgctaagtttaaatgcgtaaccaagctggaggggaaaatagtgcagcacgaaaacctcaagtactccgtcattgtgacagttcataccggagatcagcaccaagtgggtaatgagactacggaacatggcacaatcgccaccattactccccaggcgcctacctcagagatccagcttacagactatggggccctgaccttggactgtagtccaagaactggactagatttcaacgaaatggtcctgctcacaatgaaagaaaagagctggctggtgcacaaacagtggtttcttgacctgccgttgccctggacgtctggcgcatccacctcacaagagacttggaataggcaggatctcctggtaacattcaagaccgctcacgccaagaaacaggaagttgtggtcttaggtagccaagagggggctatgcatacagccctgactggcgcaaccgaaatccagacgagtggaaccacaactatttttgccggccacctaaagtgccggctcaaaatggacaagctgacccttaaagggatgtcttacgtgatgtgtacaggatccttcaagttggagaaggaagtcgctgagactcagcatggtaccgtgctggttcaggtgaaatatgagggcacggatgcgccttgcaagataccattcagcacacaagacgaaaaaggggtaacccagaacggacgtctcatcactgcaaatcccattgtcacagataaggagaaacctgtgaacatcgaaaccgagccaccctttggcgagtcgtacatagttgtgggtgccggggaaaaggctctgaaactttcttggttcaaaaagggctcctcaattggaaaaatgtttgaggccactgcacgcggcgccagaaggatggctatcctgggggacaccgcctgggatttcggaagtatcggtggcatgtttacaagcgtcgggaagttggtgcaccaggtattcggaacggcatatggcgtgctcttttccggtgtttcttggaccatgaaaattgggatcggcattctgttaacttggctgggactaaatagccggtcaacaagtctctccatgacctgtatagcggtcggcatggtgacactgtaccttggggtgatggtccaggctgacagcggatgcgttatcaactggaagggccgagaattgaagtgtggttctgggattttcgtgactaacgaggtgcatacctggacggaacaatacaaatttcaggccgattcaccgaagcgcctgagtgcagccatcggaaaggcttgggaggagggcgtatgcggtatcagaagcgccacaaggctcgaaaatattatgtggaagcagatatccaacgagctgaatcacatcttactggaaaacgacatgaaattcaccgtcgtggttggcgacgcatctgggattcttgctcagggaaagaaaatgatccggcctcaacccatggagcacaagtattcgtggaaaagctggggcaaagccaagattatcggggcggatatacagaatactacctttatcattgacggaccagatacacctgaatgttccgacgatcagcgcgcctggaacatctgggaggtggaggactacggcttcggtatttttactaccaatatctggttgaaactcagagattcatatacacagatgtgcgaccataggctgatgagtgctgcaataaaggattctaaagccgtccacgctgacatggggtactggattgaaagcgagaagaacgaaacgtggaagctagcccgtgcatccttcatcgaggtgaaaacctgtatttggcccaagtcacatactctgtggagcaatggagttctcgaatctgagatgatcataccaaaaatctatggcggtcccatttcccaacacaactaccggcctggctatttcacacagaccgcggggccatggcacctgggaaaacttgagttggattttgacctgtgcgaaggcactacagtgatcgtagatgagcattgcgggaatcgaggaccgagtttaagaaccacgactgtcaccggcaaaattatccacgaatggtgttgcaggagctgtacactaccccctctgcgcttccggggtgaggacgggtgctggtacggaatggagataagaccagtgaaggaaaaggaggaaaaccttgtgaggtctatggtctccgccggctcaggtgaggttgacagttttagcctgggcattttgtgtgtgtcgatcatgatcgaagaggtaatgcgctcccgatggtctcggaaaatgctcatgaccgggactctggctgtgttcctactgctcattatgggacagctgacatggaatgatcttatccgtttgtgcattatggtcggcgccaacgcaagcgacagaatggggatgggaaccacatacctggctttaatggccacttttaagatgaggcccatgttcgcagtgggcctcctgtttcgccggcttacctcaagagaggttctgctactcacgataggtctgagtttggtggcctccgtcgaactgcctaattctttagaggaactcggggatggactggctatgggcatcatgatgcttaaactgttgacagagttccaaccacatcagctctggaccactctgctaagcctgacctttattaagacaactctttccctcgactatgcgtggaaaaccatggccatggcactgtcaatcgtgagcttgttccccctgtgtttaagtacgacatctcagaagaccacttggctcccggttctgcttggctcctttgggtgcaagcctctgacaatgttcttgattaccgaaaacaaaatctggggaagaaagtcctggccactcaacgagggtataatggctatcggcattgtgtcgatcctgctatcatctctgcttaaaaatgatgtccccctcgccgggcctctgattgccggaggcatgttgatcgcttgttacgtaataagtggttccagcgcagacttatctctggagaaggccgcggaagtgagctgggaggaagaggctgaacactccgggacttcacataacatgctcgttgaggtgcaggatgacggaacaatgaaaattaaggatgaggaacgagacgataccctgacgatccttctgaaagccactttgctagcagtcagtggcgtgtatcccatgagcatcccagccaccctgtttgtatggtacttctggcaaaagaagaaacagcgctctggcgtgctctgggacacaccttcacccccagaggtcgaacgggctgttctggatgacgggatttatagaatacttcagaggggattactgggtcgtagccaggtgggcgtgggggtcttccaagacggagtgtttcacaccatgtggcacgttacacgcggcgcagtactcatgtaccagggtaagcggttggagccgagttgggccagcgtgaaaaaggatctgatctcctatgggggaggctggagattccagggctcttggaatactggggaggaagtccaggtgattgcggttgagcctggcaagaaccccaagaatgtgcaaaccacgccaggtacatttaagactcccgaaggcgaggtcggggctatcgccctcgacttcaaacctggaacctcgggcagcccaattgtgaacagggaaggtaagatcgtagggctgtacggaaatggcgtcgtgacaacctcaggcacttacgtttccgcaatagcccaggctaaagccagtcaggaggggccccttcctgagatcgaagatgaggtgtttcgaaagcggaacctgaccattatggacttgcatccgggatctggtaaaacacgcagatatctaccagcaatcgtcagggaagctattaagcggaagctgcgaacgctcatcttagcccccactagagtggttgcgagcgagatggccgaagcactgaaaggcatgcctatacgctaccaaaccacagctgtgaagtccgagcacaccgggagggagattgtcgatcttatgtgccatgccactttcacaatgcgtctgctctcaccagtgcgggtacccaattataacatgatcatcatggacgaagctcactttaccgatcctgcatctattgccgccagaggatacatcagcacgagggtgggcatgggtgaggctgcggcaatattcatgactgccacaccgcccgggagtgttgaggcttttccacagtccaatgccgtcattcaggacgaagaacgcgatatccctgagcgaagctggaactctggatatgactggattaccgatttccccggcaaaaccgtgtggtttgtgccatcaatcaagtccggcaatgacatagcaaactgtttgaggaagaatgggaagcgggtcattcagctgagtaggaagactttcgacacagagtaccagaaaaccaagaacaacgattgggactatgtagtgacaactgatatcagcgaaatgggagccaatttccgcgctgaccgtgttatcgatcctagacggtgcctcaaacccgtgattctgaaggacggtccagagagggtcatccttgcgggcccgatgcctgtgacggttgcctcggcagctcagcgccgagggagaattggacggaaccagaataaagaaggcgatcagtacgtgtacatgggtcaacccctaaacaatgacgaggatcatgcccactggaccgaggcaaagatgctgttggacaacataaatacaccagaagggatcattcccgccttatttgagcctgaaagggagaagtctgctgccatcgatggcgaatatcgcctgagaggagaggcgaggaaaactttcgtcgagctcatgcggcgtggcgacctgccagtgtggctttcctacaaggtagcaagcgaagggtttcagtattcagatcgccgatggtgcttcgacggagagagaaacaatcaggtgctggaagagaacatggacgttgaaatctggaccaaagagggtgagaggaagaaactccggccccgctggttggatgccagaacatacagtgaccctctggctctaagggaatttaaggagttcgccgctggccggcgatctgtctccggggatctgattctcgaaataggaaaacttccgcagcacctgaccttaagagcacaaaatgccttggacaacctggtgatgctccataatagcgagcagggcggtaaggcttatcgccacgccatggaggagctgccagatactatcgagacgcttatgctgctcgcattgattgcggtgctgaccgggggcgtcacattatttttcctatcaggaaagggcctggggaaaacaagtatcggactcctttgtgttatggccagctccgctctgttgtggatggcctctgtggaaccccattggattgcagctagcatcatactggagtttttcctcatggtactgcttatccctgaacccgacaggcagcggaccccacaggataaccaactcgcctacgtggtcattggtctgttgtttatgatcctgacagtggcagccaatgagatgggcttactagagaccactaagaaagacctggggattggacacgttgctgcggaaaaccaccatcacgccacaatgctcgatgtggaccttcgtcctgcatccgcttggacgctgtatgccgtcgccaccactgtaatcacacccatgatgagacataccatagagaacaccacagcaaatatttcattgactgctatcgccaaccaggcggctattctgatgggcctcgataagggttggccaatctctaaaatggacataggggtgcctctgcttgccttaggctgctacagtcaggttaatccgctgacgctcaccgcagccgtgttgatgctggtcgctcactacgcaatcattggacccggcctacaagccaaggcgacaagggaagctcagaagcgcactgccgcagggatcatgaaaaacccaaccgtggatggaattgtcgccatcgacctggaccctgtggtttatgatgctaagttcgagaaacagctcggccagataatgcttctgattttgtgtacatcgcaaatcctgctcatgcggaccacttgggccctgtgcgaaagcatcacgttagcaacaggtccccttaccactctgtgggaggggtccccaggaaagttttggaataccacaattgctgtgtctatggccaacatcttccgaggctcatacctcgcgggtgccggcctagcattcagcctgatgaaatccctagggggaggcagaagggggactggagctcagggcgagaccctgggtgaaaagtggaagcgccagctcaatcagcttagtaaatctgagtttaacacatataagcggagcgggataatggaagtagacagatcagaggccaaagaaggactgaagcgtggcgagacgaccaaacatgcagtgtccaggggtactgctaagttgcggtggttcgtcgagcgcaatctggttaagcctgaaggcaaagtgattgatctcgggtgtggacgaggcgggtggagttactattgcgccggattaaagaaagtcacagaggtgaagggctacaccaaaggtgggcccggacacgaggagccgatcccaatggccacttatggctggaacctggtaaaacttcacagcggcaaagacgtgtttttcacacctcccgaaaagtgtgataccctgctatgcgacattggggagtcttccccaaatcccacgatcgaggaaggaagaaccctcagggttctgaagatggtggagccttggttgcggggtaaccaattttgtataaaaatcctgaatccgtacatgccctcagtcgtggaaacactcgagcagatgcagcgcaagcatggcgggatgcttgtcagaaacccactgagcagaaattcgactcacgagatgtactgggtgtcttgcggaaccggcaacattgttagtgcggtaaatatgacatcccgaatgttactgaaccggttcactatggctcatcgtaaacctacctatgaaagagatgtggacttgggtgcagggacacgccacgtcgccgtggagcccgaagttgctaacctcgatatcattggacagaggatcgagaatattaagaacgaacacaaaagcacctggcattacgacgaggataatccttataagacttgggcctaccacggctcatatgaggtgaagccatccggctctgcaagcagtatggtcaacggggtggtacggctgctaacgaaaccctgggacgtgatccctatggttacacaaatagccatgaccgacactaccccatttggacagcagagagtcttcaaggaaaaagtggatacacgcacgcccagggctaagcgaggtaccgcgcaagtgatggaggtcactgccaaatggctttggggctttctgtcccggaataagaagccgagaatttgtacaagggaagagttcacccgcaaagttcgtagcaacgcagctatcggggccgtgtttgtagacgaaaatcagtggaactctgcaaaggaggccgtggaggatgaaaaattctgggacctcgtccatcgggagagagaactgcacaagcagggaaaatgcgctacttgcgtgtacaatatgatgggcaagagggagaagaaattgggtgaatttgggaaggccaaaggatcacgcgcgatctggtatatgtggctgggcgcacgattcctcgagttcgaggcccttggctttatgaacgaagatcattggttcagtcgggaaaattccctgagcggggttgaaggagagggtttacacaagctgggctacattttgagagacatatctaaaatccctgggggaaacatgtacgctgatgacacagccggctgggataccaggattacagaggacgatctccagaatgaagcaaagatcactgacattatggagccagaacacgctctgctagccacctcgatctttaaacttacgtatcaaaacaaggtggtccgcgtgcagagacccgctaagaatggtaccgtaatggatgttatatcacggagggaccagcgtgggagcggacaggtgggcacatacggcctgaacactttcaccaacatggaggtccaactcatccgacagatggaatccgaggggatttttctgcctagtgagttggaaacaccaaatttagccgagcgcgtgctggactggctcgaaaaacatggaactgagagacttaagcggatggcaatctctggtgatgactgtgtggtcaaacccattgatgacaggttcgcgaccgccctgatcgctctaaacgatatgggcaaggttcgcaaagacataccgcagtgggaacctagcaaggggtggaatgagtggcagcaagtgcccttttgctcccaccatttccaccagctgattatgaaggatggaagagagatcgtagtgccatgtcggaaccaggacgaactcgtcggcagggcccgagtgtcacagggtgcagggtggagtttgcgtgagacggcttgcctgggaaaatcttatgcccaaatgtggcagcttatgtactttcacagacgcgatctgcggctcgcagccaatgcgatctgtagcgctgttcctgtggactgggtccccacatccaggaccacttggtcaattcatgcccaccatcagtggatgacaaccgaagatatgttaagcgtgtggaacagagtatggatagaggaaaatccatggatggaggacaagactcacgtttcttcctgggaggaagtgccctatctgggcaaacgcgaggaccaatggtgcggcagtttgatcgggctgaccgcacgggccacatgggctacgaacattcaggtcgccatcaatcaggtgaggcgactcattggaaacgaaaattaccttgattatatgaccagcatgaagagattcaaaaacgagtcggaccctgagggtgcactgtggtga

SEQ ID NO: 13493 - RNA, 9879 nt, synthetic construct
  misc_feature 1..9879: note = derived and/or modified CDS sequence (opt3) from DENV-1__FJ410188__SS-prME
  source 1..9879: mol_type = other RNA
agcgtgaccatgctgctcatgcttctgcccactgtcttggccttccacttaactacgaggggaggggagcctcatatgatcgtttccaagcaggaaaggggaaaatctctgctctttaagacctcagctggtgtgaacatgtgcacactcattgccatggacctgggcgagctttgtgaagatactatgacctacaaatgcccacggataacagaggccgaaccggacgatgtagactgttggtgcaatgcgaccgatacttgggtgacatatgggacctgtagtcaaacgggagagcaccgccgagacaagcgtagcgtcgctctggcaccccatgtgggcttgggtctcgagactagaaccgaaacatggatgtcctctgagggggcatggaaacagatccagaaggttgaaacttgggccctgaggcaccctggattcaccgtgattgctctgtttctcgcacatgccatcggcacatcgattacccagaagggcatcatattcatcttactgatgcttgtcacgccatcaatggctatgcggtgcgtggggattggaaaccgcgattttgttgagggtttgagcggcgccacttgggttgacgtggtcctggagcacgggagttgtgtgacaaccatggcgaaaaataagcccactttggatatcgaactcctgaaaacagaggtgaccaaccctgcagtccttagaaagctgtgcattgaagccaaaatctccaatacgaccacagactctaggtgtccaactcaaggagaggctaccttggttgaggaacaagatgccaacttcgtgtgccggcgcacatttgtagaccgaggctggggtaatgggtgtggactcttcggcaagggcagcctgttaacttgcgcaaagtttaaatgcgtgaccaagctggaggggaaaatagtccagcacgaaaacctcaagtactccgtgattgttacagtgcataccggagatcagcaccaagtcggtaatgagactacggaacatggcacaatcgctaccattactccccaggcccctacctcagagatccagcttacagactatggggcgctgaccttggactgtagtccaagaactggactagatttcaacgaaatggtgctgctcacaatgaaagaaaagagctggctggtacacaaacagtggtttcttgacctgccgttgccctggacgtctggcgcctccacctcacaagagacttggaataggcaggatctcctggttacattcaagaccgcacacgctaagaaacaggaagtggtcgtgttaggtagccaagagggggccatgcatacagctctgactggcgccaccgaaatccagacgagtggaaccacaactatttttgcaggccacctaaagtgccggctcaaaatggacaagctgacccttaaagggatgtcttacgtcatgtgtacaggatccttcaagttggagaaggaagtggccgagactcagcatggtaccgttctggtgcaggtaaaatatgagggcacggatgctccttgcaagataccattcagcacacaagacgaaaaaggggtcacccagaacggacgtctcatcactgcgaatcccattgtgacagataaggagaaacctgttaacatcgaaaccgagccaccctttggcgagtcgtacatagtggtcggtgcaggggaaaaggccctgaaactttcttggttcaaaaagggctcctcaattggaaaaatgtttgaggctactgcccgcggcgcaagaaggatggccatcctgggggacaccgcttgggatttcggaagtatcggtggcatgtttacaagcgtggggaagttggtacaccaggtgttcggaacggcctatggcgttctcttttccggtgtctcttggaccatgaaaattgggatcggcattctgttaacttggctgggactaaatagccggtcaacaagtctctccatgacctgtatagcagtgggcatggtgacactgtaccttggggtcatggttcaggcggacagcggatgcgtgatcaactggaagggccgagaattgaagtgtggttctgggattttcgtgactaacgaggtacatacctggacggaacaatacaaatttcaggctgattcaccgaagcgcctgagtgccgcaatcggaaaagcctgggaggagggcgtctgcggtatcagaagcgctacaaggctcgaaaatattatgtggaagcagatatccaacgagctgaatcacatcttactggaaaacgacatgaaattcaccgtggttgtgggcgacgcctctgggattcttgcacagggaaagaaaatgatccggcctcaacccatggagcacaagtattcgtggaaaagctggggcaaggctaagattatcggggccgatatacagaatactacctttatcattgacggaccagatacacctgaatgttccgacgatcagcgcgcgtggaacatctgggaggtcgaggactacggcttcggtatttttactaccaatatctggttgaaactcagagattcatatacacagatgtgcgaccataggctgatgagtgccgctataaaggattctaaagcagtgcacgccgacatggggtactggattgaaagcgagaagaacgaaacgtggaagctagctcgtgcctccttcatcgaggttaaaacctgtatttggcccaagtcacatactctgtggagcaatggagtgctcgaatctgagatgatcataccaaaaatctatggcggtcccatttcccaacacaactaccggcctggctatttcacacagaccgcagggccatggcacctgggaaaacttgagttggattttgacctgtgcgaaggcactacagtaatcgtcgatgagcattgcgggaatcgaggaccgagtttaagaaccacgactgtgaccggcaaaattatccacgaatggtgttgcaggagctgtacactaccccctctgcgcttccggggtgaggacgggtgctggtacggaatggagataagaccagtgaaggaaaaggaggaaaaccttgtcaggtctatggtttccgcgggctcaggtgaggtggacagttttagcctgggcattttgtgtgtatcgatcatgatcgaagaggtgatgcgctcccgatggtctcggaaaatgctcatgaccgggactctggccgtcttcctactgctcattatgggacagctgacatggaatgatcttatccgtttgtgcattatggtgggcgctaacgccagcgacagaatggggatgggaaccacatacctggcattaatggctacttttaagatgaggcccatgttcgccgttggcctcctgtttcgccggcttacctcaagagaggtgctgctactcacgataggtctgagtttggtcgcatccgtggaactgcctaattctttagaggaactcggggatggactggccatgggcatcatgatgcttaaactgttgacagagttccaaccacatcagctctggaccactctgctaagcctgacctttattaagacaactctttccctcgactatgcttggaaaaccatggcgatggccctgtcaatcgttagcttgttccccctgtgtttaagtacgacatctcagaagaccacttggctcccggtgctgcttggctcctttgggtgcaagcctctgacaatgttcttgattaccgaaaacaaaatctggggaagaaagtcctggccactcaacgagggtataatggcaatcggcattgtctcgatcctgctatcatctctgcttaaaaatgatgtacccctcgctgggcctctgattgccggaggcatgttgatcgcctgttacgtgataagtggttccagcgctgacttatctctggagaaggcagccgaagttagctgggaggaagaggcggaacactccgggacttcacataacatgctcgtggaggtccaggatgacggaacaatgaaaattaaggatgaggaacgagacgataccctgacgatccttctgaaagctactttgctagccgtgagtggcgtatatcccatgagcatcccagcaaccctgtttgtgtggtacttctggcaaaagaagaaacagcgctctggcgtcctctgggacacaccttcacccccagaggttgaacgggccgtgctggatgacgggatttatagaatacttcagaggggattactgggtcgtagccaggtgggcgtcggggtgttccaagacggagtttttcacaccatgtggcacgtaacacgcggcgctgtgctcatgtaccagggtaagcggttggagccgagttgggcaagcgtcaaaaaggatctgatctcctatgggggaggctggagattccagggctcttggaatactggggaggaagtgcaggttattgccgtggagcctggcaagaaccccaagaatgtccaaaccacgccaggtacatttaagactcccgaaggcgaggtgggggcgatcgctctcgacttcaaacctggaacctcgggcagcccaattgtaaacagggaaggtaagatcgtcgggctgtacggaaatggcgtggttacaacctcaggcacttacgtgtccgccatagcacaggccaaagctagtcaggaggggccccttcctgagatcgaagatgaggtctttcgaaagcggaacctgaccattatggacttgcatccgggatctggtaaaacacgcagatatctaccagccatcgtgagggaagcaattaagcggaagctgcgaacgctcatcttagctcccactagagttgtggccagcgagatggcggaagccctgaaaggcatgcctatacgctaccaaaccacagcagtcaagtccgagcacaccgggagggagattgtggatcttatgtgccatgctactttcacaatgcgtctgctctcaccagtacgggtgcccaattataacatgatcatcatggacgaagcccactttaccgatcctgcttctattgcagccagaggatacatcagcacgagggttggcatgggtgaggccgctgcgatattcatgactgcaacaccgcccgggagtgtcgaagcctttccacagtccaatgctgtgattcaggacgaggaacgcgatatccctgagcgaagctggaactctggatatgactggattaccgatttccccggcaaaaccgtgtggtttgtcccatcaatcaagtccggcaatgacatagccaactgtttgaggaagaatgggaagcgggtaattcagctgagtaggaagactttcgacacagagtaccagaagaccaagaacaacgattgggactatgtggttacaactgatatcagcgaaatgggagcaaatttccgcgccgaccgtgtgatcgatcctagacggtgcctcaaacccgtcattctgaaggacggtccagagagggtgatccttgctggcccgatgcctgttacggtggcgtcggccgcacagcgccgagggagaattggacggaaccagaataaagaaggcgatcagtacgtctacatgggtcaacccctaaacaatgacgaggatcatgctcactggaccgaggccaagatgctgttggacaacataaatacaccagaagggatcattcccgcattatttgagcctgaaagggagaagtctgccgctatcgatggcgaatatcgcctgagaggagaggccaggaaaactttcgtggagctcatgcggcgtggcgacctgccagtatggctttcctacaaggtggcgagcgaagggtttcagtattcagatcgccgatggtgcttcgacggagagagaaacaatcaggttctggaagagaacatggacgtcgaaatctggaccaaagagggtgagaggaagaaactccggccccgctggttggatgcaagaacatacagtgaccctctggccctaagggaatttaaggagttcgctgccggccggcgatctgtgtccggggatctgattctcgaaataggaaaacttccgcagcacctgaccttaagagctcaaaatgcattggacaacctggtgatgctccataatagcgagcagggcggtaaggcctatcgccacgctatggaggagctgccagatactatcgagacgcttatgctgctcgccttgattgcagtcctgaccgggggcgttacattatttttcctatcaggaaagggcctggggaaaacaagtatcggactcctttgtgtgatggcgagctccgccctgttgtggatggcttctgtagaaccccattggattgccgcaagcatcatactggagtttttcctcatggtgctgcttatccctgaacccgacaggcagcggaccccacaggataaccaactcgcttacgtcgtgattggtctgttgtttatgatcctgacagttgccgcaaatgagatgggcttactagagaccactaagaaagacctggggattggacacgtggccgctgaaaaccaccatcacgcgacaatgctcgatgtcgaccttcgtcctgcctccgcatggacgctgtatgctgtagccaccactgtgatcacacccatgatgagacataccatagagaacaccacagccaatatttcattgactgcaatcgctaaccaggccgcgattctgatgggcctcgataagggttggccaatctctaaaatggacataggggttcctctgcttgctttaggctgctacagtcaggtgaatccgctgacgctcaccgccgcagtcttgatgctggtggcccactacgctatcattggacccggcctacaagcaaaggccacaagggaagcgcagaagcgcactgctgccgggatcatgaaaaacccaaccgtcgatggaattgtggcaatcgacctggaccctgttgtgtatgatgccaagttcgagaaacagctcggccagataatgcttctgattttgtgtacatcgcaaatcctgctcatgcggaccacttgggctctgtgcgaaagcatcacgttagccacaggtccccttaccactctgtgggaggggtccccaggaaagttttggaataccacaattgcagtatctatggctaacatcttccgaggctcatacctcgccggtgcgggcctagccttcagcctgatgaaatccctagggggaggcagaagggggactggagcacagggcgagaccctgggtgaaaagtggaagcgccagctcaatcagcttagtaaatctgagtttaacacatataagcggagcgggataatggaagtggacagatcagaggctaaagaaggactgaagcgtggcgagacgaccaaacatgccgtctccaggggtactgcaaagttgcggtggttcgttgagcgcaatctggtgaagcctgaaggcaaagtcattgatctcgggtgtggacgaggcgggtggagttactattgcgctggattaaagaaagtgacagaggtaaagggctacaccaaaggtgggcccggacacgaggagccgatcccaatggccacttatggctggaacctggtgaaacttcacagcggcaaagacgtatttttcacacctcccgaaaagtgtgataccctgctatgcgacattggggagtcttccccaaatcccacgatcgaggaaggaagaaccctcagggtgctgaagatggtcgagccttggttgcggggtaaccaattttgtataaaaatcctgaatccgtacatgccctcagtggtcgaaacactcgagcagatgcagcgcaagcatggcgggatgcttgtgagaaacccactgagcagaaattcgactcacgagatgtactgggtttcttgcggaaccggcaacattgtaagtgccgtgaatatgacatcccgaatgttactgaaccggttcactatggcgcatcgtaaacctacctatgaaagagatgtcgacttgggtgctgggacacgccacgtggcagttgagcccgaagtggccaacctcgatatcattggacagaggatcgagaatattaagaacgaacacaaaagcacctggcattacgacgaggataatccttataagacttgggcttaccacggctcatatgaggtcaagccatccggctctgccagcagtatggtgaacggggtagtgcggctgctaacgaaaccctgggacgttatccctatggtcacacaaatagcaatgaccgacactaccccatttggacagcagagagtgttcaaggaaaaagtggatacacgcacgcccagggccaagcgaggtaccgctcaagtcatggaggttactgcgaaatggctttggggctttctgtcccggaataagaagccgagaatttgtacaagggaagagttcacccgcaaagtgcgtagcaacgccgcaatcggggctgtatttgtggacgaaaatcagtggaactctgccaaggaggcagtcgaggatgaaaaattctgggacctcgtgcatcgggagagagaactgcacaagcagggaaaatgcgccacttgcgtttacaatatgatgggcaagagggagaagaaattgggtgaatttgggaaggctaaaggatcacgcgccatctggtatatgtggctgggcgcgcgattcctcgagttcgaggcacttggctttatgaacgaagatcattggttcagtcgggaaaattccctgagcggggtggaaggagagggtttacacaagctgggctacattttgagagacatatctaaaatccctgggggaaacatgtacgccgatgacacagctggctgggataccaggattacagaggacgatctccagaatgaagccaagatcactgacattatggagccagaacacgcactgctagctacctcgatctttaaacttacgtatcaaaacaaggtcgtgcgcgtacagagacccgccaagaatggtaccgttatggatgtgatatcacggagggaccagcgtgggagcggacaggtcggcacatacggcctgaacactttcaccaacatggaggtgcaactcatccgacagatggaatccgaggggatttttctgcctagtgagttggaaacaccaaatttagctgagcgcgtgctggactggctcgaaaaacatggaactgagagacttaagcggatggccatctctggtgatgactgtgtcgttaaacccattgatgacaggttcgcaaccgcgctgatcgccctaaacgatatgggcaaggtgcgcaaagacataccgcagtgggaacctagcaaggggtggaatgagtggcagcaagtacccttttgctcccaccatttccaccagctgattatgaaggatggaagagagatcgtggtcccatgtcggaaccaggacgaactcgtgggcagggctcgagtttcacagggtgccgggtggagtttgcgtgagacggcatgcctgggaaaatcttatgctcaaatgtggcagcttatgtactttcacagacgcgatctgcggctcgccgcaaatgccatctgtagcgcggtgcctgtcgactgggtgcccacatccaggaccacttggtcaattcatgctcaccatcagtggatgacaaccgaagatatgttaagcgtatggaacagagtttggatagaggaaaatccatggatggaggacaagactcacgtgtcttcctgggaggaagtcccctatctgggcaaacgcgaggaccaatggtgcggcagtttgatcgggctgaccgcccgggcaacatgggccacgaacattcaggtggctatcaatcaggttaggcgactcattggaaacgaaaattaccttgattatatgaccagcatgaagagattcaaaaacgagtcggaccctgagggtgccctgtggtga

SEQ ID NO: 13494 - RNA, 9879 nt, synthetic construct
  misc_feature 1..9879: note = derived and/or modified CDS sequence (opt3) from DENV-1__FJ478458__SS-prME
  source 1..9879: mol_type = other RNA
agcgtgaccatgctgctcatgcttctgcccaccgccttggctttccacttaactacgagaggaggggaacctcatatgatcgtctccaagcaggaaaggggaaaatctctgttatttaagacctcagcaggtattaacatgtgcacactcatagccatggacctgggagagctttgtgaagatactatgacctacaaatgcccacggatcacagaggcggaaccggacgatgttgactgttggtgcaatgctaccgatacttgggtgacatatgggacctgtagtcaaacgggagagcaccgccgagacaagcgtagcgtagccctggcaccccatgtgggcttgggtctcgagactagaaccgaaacatggatgtcctctgagggggcctggaaacagattcagaaggtcgaaacttgggctctgaggcaccctggattcaccgtgacagcactgtttctcgcccatgctatcggcacctcgattacgcagaagggcatcatattcatcttactgatgcttgttactccatcaatggccatgcggtgcgtggggattggaaaccgcgattttgtcgagggtttgagcggcgcgacatgggtggacgtagttctggagcacgggagttgtgtgaccactatggcaaaagataagcccacattggacatcgaactcctgaaaaccgaggtcacgaatcctgccattcttagaaagctgtgcatcgaagctaaaatatccaacaccacaactgattctaggtgtccaacccaaggagaggccacattggtggaagaacaggacagcaatttcgtgtgccggcgcacttttgtcgatcgaggctggggtaacgggtgtggactcttcggcaagggctccctgttaacctgcgcaaagtttaaatgcgttacaaagctggaggggaaaattgtgcagtacgaaaatctcaagtattcagtaatcgtgaccgtccacactggagaccagcatcaagtgggtaacgagacgacagaacacggcaccattgctactatcacaccccaggcccctacaagtgagatccagcttaccgactacggggcgctgactttggattgtagcccaagaacaggactagacttcaatgaaatggttctgctcacgatgaaagagaagtcttggctggtgcataaacagtggtttcttgatctgccgttgccctggacctccggcgcctcaactagccaagagacatggaacaggcaggacctcctggtcaccttcaagacagcacacgctaagaaacaggaagtggtagttttaggtagtcaagagggggccatgcacactgctctgaccggcgccacggaaattcagacctctggaacaactaccatatttgcaggccatctaaagtgccggctcaaaatggataagctgacacttaaagggatgtcctatgtgatgtgtactggcagcttcaagttggagaaggaagtcgccgagacccagcacggtacggtgctggtccaggtgaaatacgagggcacagacgctccttgcaagatcccattctcggcgcaagatgaaaaaggggttacccagaatggacgtctcattactgcaaaccccatcgtgacagacaaggagaaacctgtaaatatagaaaccgagccaccctttggcgagtcttatattgtcgtgggtgccggggaaaaggctctgaaactttcctggttcaaaaagggctcaagtatcggaaaaatgtttgaggccactgcacgcggcgccagaaggatggctatcctgggggataccgcctgggacttcggaagcattggtggcgtttttacatccgtggggaagttggtccatcaggtgttcggagcagcgtacggcgtactcttttctggtgtgagctggacgatgaaaatcgggattggcatactgttaacctggctgggactaaactcacggagtacttccctcagcatgacatgtatcgctgttggcatggtcaccctgtaccttggggtgatggtgcaggccgattctggatgcgtcattaattggaagggccgagaattgaagtgtggttcagggatcttcgttacaaacgaggtgcacacttggaccgaacaatataaatttcaggcagacagtccgaagcgcctgagcgccgctatcggaaaagcctgggaggagggcgtgtgcggtattagatccgcaacgaggctcgaaaacataatgtggaagcagatctctaatgagctgaaccatattttactggaaaatgacatgaaattcacagtagtcgtgggcgatgctaacgggatccttgcccagggaaagaaaatgattcggcctcaacccatggagcaccgctactcgtggaaaagctggggcaaggcgaaaatcataggggccgacatccagaataccacttttattatcgatggaccagacacccctgaatgtcccgatgaccagagagcttggaacatttgggaggttgaggattatggcttcggtatctttacaactaatatatggttgaagctcagggactcctacacccagatgtgcgatcaccgtctgatgtcagcagccattaaagacagtaaggctgtgcatgccgatatggggtattggatcgaatctgagaaaaacgaaacatggaagctagcacgggcgagcttcattgaggtcaagacgtgtatctggccaaaatcccacaccctgtggtcaaatggagtgctcgaaagcgagatgataatccccaagatttacggcggtcctatctctcaacataactatcgaccaggctacttcactcagacagccgggccgtggcacctgggaaaacttgagttggactttgatctgtgcgaaggcaccactgttgtggtagacgagcactgcgggaatagaggaccctccttaaggacaaccacggtcactggcaagattatccatgaatggtgttgccgcagttgtaccctccctccactgcggttcagaggtgaggacgggtgctggtacggaatggagataaggcccgtgaaagaaaaggaggaaaaccttgtgcgcagcatggtctctgctggctccggtgaggttgattcatttagtctgggcattttgtgtgtgagcatcatgatcgaagaggtaatgcgatcgcggtggtcccgtaagatgctcatgacagggaccctggccgtgttcctactgctcattatgggacagctgacttggaatgaccttatcagattgtgcattatggtcggcgcaaacgcttctgataggatggggatgggaacaacctatctggccttaatggcaacatttaaaatgcgccctatgttcgccgtgggcctcctgtttcggagacttactagcagggaggttctgctactcaccataggtctgtcattggtggctagtgtcgaactgccaaattccttagaggaactcggggacggactggcgatgggcatcatgatgcttaagctgttgacggagttccaaccccaccagctctggacaaccctgctatctctgacttttattaaaaccacacttagcctcgattacgcctggcgaactatggcaatggtgctgtccatcgcttcattgttcccgctgtgtttaagcaccacgagtcagaagacaacctggctccctgttctgcttggctcttttgggtgcaaaccactgactatgttcttgattacagaaaacaagatctggggacgcaagtcctggcccctcaacgagggtataatggccatcggcattgtgagcatcctgctatcgtcactgcttaaaaatgacgtccctctcgccgggcccctgattgctggaggcatgttgatcgcatgttatgtaatatctggtagttccgccgatttaagcctggagaaggcggctgaagtgtcttgggaggaagaggccgaacatagcgggacctcccacaacattctcgttgaggtgcaggacgatggaactatgaaaatcaaggacgaggaacgggatgacacactgaccatccttctgaaagcaacgttgctagccgtctcaggcgtgtacccaatgagtattcctgctactctgtttgtatggtatttctggcaaaagaaaaagcagagaagcggcgtgctctgggataccccctctccaccggaggtcgaaagggcagttctggacgacgggatataccgtatccttcagcgcggattactgggtcggtcccaggtgggcgtgggggtcttccaagatggagtgtttcatacaatgtggcacgttaccagaggcgccgtactcatgtatcagggtaagaggttggagccttcatgggcgagtgtgaaaaaggacctgattagctacgggggaggctggcgattccagggctcctggaatacaggggaggaagtccaggtgatcgctgttgagcccggcaagaatccaaagaatgtgcaaactacccccggtacgtttaaaacacctgaaggcgaggtcggggccattgcactcgatttcaagccaggaacttctggctcgcccatcgtgaaccgggaaggtaagatagtagggctgtacggaaatggcgtcgtgaccacaagcggcacctatgtttcagccatcgctcaggccaaaacttcccaggaggggcctcttccggagattgaagaggaagtgtttaagaaacgcaacctgaccatcatggacttgcacccaggaagtggtaagacaagaaggtacctacccgcaattgtccgggaggctatcaaacgaaagctgagaacgctcatattagcccctactcgcgtggttgcgtctgaaatggccgaggcactgaagggcatgccaattaggtatcaaaccacagctgtgaaaagcgagcataccgggcgtgaaatcgtcgatcttatgtgccacgccactttcacaatgcggctgctctcccccgtgagagtacctaattacaacatgatcattatggacgaggctcattttaccgatccggcatcaatcgccgccaggggatatatatctacgcgcgtgggcatgggtgaagctgcggcaattttcatgactgccacacccccagggagcgttgaggcttttcctcagagtaatgccgtcatccaggacgaagaacgagatattcccgagagatcctggaacagcggatacgactggatcaccgatttcccaggcaagaccgtgtggtttgtgccttctataaaatcaggcaatgacattgcaaactgtttgcggaagaatgggaaaagggtcatccagctgtcccgcaagactttcgacacagaatatcaaaagaccaaaaacaacgattgggactacgtagtgacaactgatatcagtgagatgggagccaatttccgtgctgacagagttattgatccccggaggtgcctcaagccagtgatcctgaaagacggtccggaacgcgtcattcttgcgggccctatgcccgtgacggttgccagcgcagctcagcgaagagggcggataggaaggaaccagaataaggagggcgatcagtacgtgtatatgggtcaaccactaaacaatgacgaggatcacgcccattggaccgaagcaaaaatgctgttggacaacatcaatacacccgaggggattatccctgccttatttgaaccagagcgcgaaaagtcggctgccatcgatggcgagtacagactgaggggagaggcgcggaagactttcgtcgaactcatgcgtcgcggcgacctgcccgtgtggctttcttataaagtagcatccgaggggtttcagtacagcgatcgaagatggtgcttcgacggagaaaggaacaatcaggtgctggaggaaaacatggacgttgagatttggaccaaggagggtgaacggaaaaagctccgccctagatggttggatgccaggacatattcagacccgctggctctacgggagtttaaagagttcgccgctggccgaagaagtgtctctggggatctgatactcgagatcggaaaacttccacagcacctgaccttacgcgcacaaaatgccttggacaacctggtgatgctccacaattccgaacagggcggtaaggcttacaggcatgccatggaggagctgcccgatactattgaaacgcttatgctgctcgcattgatcgcggtgctgaccgggggcgtcacattatttttcctaagcggaaagggcctggggaagacttcaattggactcctttgtgttatggccagtagcgctctgttgtggatggccaacgtggagcctcactggatcgcagcttccataatcctggaatttttcctcatggtactgcttattcccgagccagaccggcagcgtacccctcaggataatcaactcgcctatgtggtcatcggtctgttgtttatgattctgacagtggcagccaacgagatgggcttactagaaaccactaaaaaggacctggggatcggacatgttgctgcggagaaccagcaccacgccacaatgctcgatgtggaccttagacccgcatctgcttggacgctgtacgccgtcgccaccactgtaataacaccaatgatgaggcataccattgaaaataccacagcaaacatcagcttgactgctattgccaatcaggcggctatcctgatgggcctcgataaaggttggcctatatccaagatggacatcggggtgccgctgcttgccttaggctgctactcacaagttaaccccctgacgctcaccgcagccgtgttgatgctggtcgctcactatgcaattatcggaccaggcctacaggccaaagcgacacgcgaggctcagaagcggactgccgcagggattatgaagaatcctaccgtggatggaatcgtcgccatagacctggaccccgtggtttacgatgctaaattcgaaaagcagctcggccaaattatgcttctgatcttgtgtacatctcagatcctgctcatgcgaaccacttgggccctgtgcgagagtattacgttagcaacaggtccacttaccactctgtgggaggggtcgcctggaaaattttggaacaccacaatcgctgtgagcatggccaatatattcagaggctcctatctcgcgggtgccggcctagcattctctctgatgaagtcactagggggaggcaggcgcgggactggagctcagggcgaaaccctgggtgagaaatggaagcggcagctcaaccaacttagcaagtccgaatttaatacatacaaaagaagtgggattatggaggtagaccgttctgaagccaaggagggactgaaaaggggcgagacgaccaagcatgcagtgagccggggtactgctaaattgcgctggttcgtcgaacgaaacctggttaagcccgagggcaaggtgatcgatctcgggtgtggaagaggcgggtggtcatattactgcgccggactaaagaaggtcacagaagtgaaaggctataccaagggtgggccgggacacgaggaaccaattcctatggccacttacggctggaatctggtaaaactttactccggcaaggacgtgtttttcacacccccagagaaatgtgataccctgctatgcgacatcggggagagtagccccaaccctacgatagaagagggaaggaccctccgggttctgaagatggtggaaccgtggttgcgcggtaatcagttttgtatcaagattctgaacccctatatgccatctgtcgtggagacactcgagcagatgcagagaaaacatggcgggatgcttgtcaggaatcctctgtcccgaaactcaactcacgaaatgtactgggtgagctgcggaaccggcaatatcgtttcggcggtaaacatgacatctcggatgttactgaaccgtttcactatgacccacagaaagcccacatatgagcgcgatgtggacttgggtgctgggaccaggcatgtcgcagtggaacctgaggttgccaatctcgatattatcggacaacggattgaaaacatcaaaaatgagcacaagagtacttggcattacgacgaggataacccatataaaacgtgggcttaccacggctcctatgaagtgaagcccagcggctcagcctcctctatggtcaatggggtggtaagactgctaacaaagccttgggacgtgataccaatggttacccagattgcaatgactgacaccacaccctttggacagcaacgcgtcttcaaagagaaggtggatacgaggaccccgcgagccaaacggggtactgctcagatcatggaagtgacagcgaagtggctttggggctttctgagcagaaacaaaaagcctaggatctgtacccgcgaggagttcactcgtaaggtccggagtaatgccgcaattggggctgtttttgtggacgagaaccagtggaactccgccaaagaggcagtagaagatgagagattctgggacctcgtgcacagggaacgcgagctgcataagcagggaaaatgcgccacatgcgtctacaacatgatgggcaagcgagagaaaaagttgggtgagtttgggaaggctaaaggaagccgggccatatggtacatgtggctgggcgcgagattcctcgagttcgaagcacttggctttatgaatgaggatcactggttctctagggaaaactcatttagtggggtggagggagagggtctgcataagttaggctatatcctgcgcgacatttccaaaatcccagggggaaatatgtacgccgatgacaccgctggctgggatacaagaattactgaagacgatttgcaaaacgaggccaagatcaccgacataatggaacccgagcacgcactcctggctacgagcatcttcaaactaacctatcagaataaggttgtgcgggtccagaggcctgccaaaaacggtacagtgatggatgtaatttctcgtcgagaccagcgcgggtcgggacaagttggcacttacggccttaacacctttacaaatatggaagtgcagctgatcagacagatggagtcagaggggattttcctcccaagcgaactggagactcccaacttggctgaacgggtcttagactggctggagaagcatggaaccgaaaggctcaagcgcatggccatctccggtgatgactgtgtggtgaaaccggtcgatgacagatttgcaacggcgcttatagccctgaatgatatgggcaaggttcggaaagacattcctcagtgggagcccagtaaggggtggaacgattggcaacaggtgccattctgctctcaccactttcatcagctaatcatgaaagacggaagggagatcgtagtgccttgtcgaaatcaggatgaactggtcggccgtgctagagtgagccaaggtgccgggtggtccctccgcgagacagcatgcttgggaaagtcatatgctcagatgtggcagctgatgtacttccaccggagggaccttagactggccgcaaacgccatttgtagtgcggttcccgtggattgggtcccaacctctcgcactacatggagcatacatgctcaccaccaatggatgaccactgaagacatgctctccgtgtggaatcgggtatggatcgaggaaaacccctggatggaggacaagacccatgtttcaagctgggaggaagtgccttatttaggcaaaagggaggatcagtggtgcggctctctgattgggttgacagcccgagcaacgtgggccaccaatatccaggtcgctattaaccaggtgagacggctgatcggaaatgaaaactacctcgactacatgacttccatgaagaggtttaaaaatgagagtgatccagagggtgccctttggtga

SEQ ID NO: 13495 - RNA, 9879 nt, synthetic construct
  misc_feature 1..9879: note = derived and/or modified CDS sequence (opt3) from DENV-1__FJ410190__SS-prME
  source 1..9879: mol_type = other RNA
agcgtgacaatgctgctcatgcttctgcccacagccttggctttccacttaactacgagaggaggggaacctcatatgatcgtctccaagcaggaaaggggaaaatctctgttatttaagacctcagttggtattaacatgtgcacactcatagcaatggacctgggagagctttgtgaagatactatgacctacaaatgcccacggatcacagaggccgaaccggacgatgtggactgttggtgcaatgcgaccgatacttgggtaacatatgggacctgtagtcagacgggagagcaccgccgagacaagcgtagcgtggctctggcaccccatgtcggcttgggtctcgagactagaaccgaaacatggatgtcctctgagggggcatggaaacagattcagaaggtggaaacttgggccctgaggcaccctggattcaccgttatcgctctgtttctcgcacatgccattggcacatcgatcacccagaagggcataatcttcattttactgatgcttgtgacgccatcaatggctatgcggtgcgtcgggatcggaaaccgcgattttgtggagggtttgagcggcgccacttgggtagacgttgtgctggagcacgggagttgtgtcacaaccatggcgaaagataagcccactctagacattgaactcctgaaaacagaggtgaccaatcctgcagtgcttagaaagctgtgcatcgaagccaaaatatccaacacgaccacagattctaggtgtccaactcaaggagaggctaccttggtcgaagaacaggacagcaatttcgtttgccggcgcacatttgtggatcgaggctggggtaacgggtgtggactcttcggcaagggctccctgttaacttgcgccaagtttaaatgcgtaaccaagctggaggggaaaattgtgcagtacgaaaatctcaagtattcagtcatcgtgacagttcacaccggagaccagcatcaagtgggtaacgagactacggaacacggcacaattgcaaccatcactccccaggctcctaccagtgagatccagcttacagactacggggccctgaccttggattgtagcccaagaactggactagacttcaatgaaatggtcctgctcacaatgaaagagaagtcttggctggtgcataaacagtggtttcttgatctgccgttgccctggacgtccggcgcgtcaaccagccaagagacttggaacaggcaggacctcctggtaacattcaagaccgcccacgcaaagaaacaggaagttgtggtcttaggtagtcaagagggggctatgcacacagccctgactggcgctaccgaaattcagacgtctggaaccacaactatatttgccggccatctaaagtgccggctcaaaatggataagctgacccttaaagggatgtcctatgtgatgtgtacaggcagcttcaagttggagaaggaagtcgcagagactcagcacggtaccgtgctggttcaggtgaaatacgagggcacggacgccccttgcaagatcccattctcggctcaagatgaaaaaggggtaacacagaatggacgtctcattaccgcgaaccccatcgtcactgacaaggagaaacctgtgaatatagaaacagagccaccctttggcgagtcttatattgttatcggtgcaggggaaaaggccctgaaactttcctggttcaaaaagggctcaagtatcggaaaaatgtttgaggctaccgcccgcggcgcaagaaggatggccattctgggggatactgcttgggacttcggaagcatcggtggcgtgtttacctccgtcgggaagttggtgcatcaggtattcggagccgcatacggcgtgctcttttctggtgttagctggacaatgaaaattgggataggcatcctgttaacgtggctgggactaaactcacggagtacctccctcagcatgacttgtattgcggtcggcatggtgacactgtaccttggggtgatggtccaggctgattctggatgcgttatcaattggaagggccgagaattgaagtgtggttcagggatcttcgtgaccaacgaggtgcacacatggactgaacaatataaatttcaggccgacagtccgaagcgcctgagcgcagccattggaaaggcttgggaggagggcgtatgcggtataagatccgccaccaggctcgaaaacatcatgtggaagcagatttctaatgagctgaaccatatcttactggaaaatgacatgaaattcacggtcgtggttggcgatgcaaacgggattcttgctcagggaaagaaaatgatccggcctcaacccatggagcaccgctactcgtggaaaagctggggcaaggccaaaataatcggggcggacattcagaatacaacctttatcattgatggaccagacactcctgaatgtcccgatgaccagagagcctggaacatctgggaggtggaggattatggcttcggtatatttaccacaaatatttggttgaagctcagggactcctacactcagatgtgcgatcaccgtctgatgtcagctgcaatcaaagacagtaaggccgtccatgctgatatggggtattggattgaatctgagaaaaacgaaacctggaagctagcccgggccagcttcatcgaggtgaagacatgtatatggccaaaatcccacacgctgtggtcaaatggagttctcgaaagcgagatgatcattcccaagatctacggcggtcctatttctcaacataactatcgaccaggctacttcacccagactgcggggccgtggcacctgggaaaacttgagttggactttgatctgtgcgaaggcacaaccgtggtagtcgacgagcactgcgggaatagaggaccctccttaaggactacaaccgtgacgggcaagatcatacatgaatggtgttgccgcagttgtactctccctccactgcggttcagaggtgaggacgggtgctggtacggaatggagattaggcccgtgaaagaaaaggaggaaaaccttgtccgcagcatggtttctgccggctccggtgaggtggattcatttagtctgggcatcttgtgtgtaagcatcatgattgaagaggtgatgcgatcgcggtggtcccgtaagatgctcatgaccgggacactggctgtcttcctactgctcatcatgggacagctgacctggaatgaccttattagattgtgcataatggtgggcgccaacgcatctgataggatggggatgggaactacatatctggctttaatggccacctttaaaatgcgccctatgttcgcagttggcctcctgtttcggagacttacaagcagggaggtgctgctactcactatcggtctgtcattggtcgccagtgtggaactgccaaattccttagaggaactcggggacggactggctatgggcattatgatgcttaagctgttgaccgagttccaaccccaccagctctggacgacactgctatctctgacctttatcaaaactacccttagcctcgattacgcgtggcgaacaatggccatggttctgtccattgtgtcattgttcccgctgtgtttaagcactaccagtcagaagacgacatggctccctgtcctgcttggctcttttgggtgcaaaccactgaccatgttcttgatcactgaaaacaagatatggggacgcaagtcctggcccctcaacgagggtatcatggcaattggcatcgtaagcattctgctatcgtcactgcttaaaaatgacgtgcctctcgctgggcccctgatcgccggaggcatgttgatagcctgttatgttatttctggtagttccgctgatttaagcctggagaaggcagccgaagtgtcttgggaggaagaggcggaacatagcgggacatcccacaacatcctcgtcgaggtgcaggacgatggaaccatgaaaatcaaggacgaggaacgggatgacactctgacaattcttctgaaagctaccttgctagccgtatcaggcgtgtacccaatgagtatacctgcaacgctgtttgtctggtatttctggcaaaagaaaaagcagagaagcggcgttctctgggatactccctctccaccggaggtggaaagggccgtgctggacgacgggatctaccgtattcttcagcgcggattactgggtcggtcccaggtcggcgtgggggttttccaagatggagtatttcataccatgtggcacgtgacaagaggcgctgtcctcatgtatcagggtaagaggttggagccttcatgggcaagtgtgaaaaaggacctgatcagctacgggggaggctggcgattccagggctcctggaataccggggaggaagttcaggtgattgccgtcgagcccggcaaaaatccaaagaatgtgcaaacaactcccggtacctttaaaacgcctgaaggcgaggtaggggcgatcgctctcgatttcaagccaggaacatctggctcgcccatagtcaaccgggaagagaagatcgtgggtctgtacgggaatggagttgtgactaccagcggcacatatgtctcagccattgcacaggccaaaacctcccaggagggccctcttccggaaatcgaggacgaagtgtttaagaaacgcaacctgactattatggatttgcacccagggagtggaaagaccagaaggtacctacccgctatcgttcgggaggccataaaacgaaagctgagaacactcattttagcacctacgcgcgtggtcgcttctgaaatggccgaggcgctgaagggtatgccaatcaggtatcaaactaccgccgtgaaaagcgagcatacaggccgtgaaatcgtagaccttatgtgccacgcaaccttcactatgcggctgctctcccccgtgagagttcctaattacaacatgattatcatggatgaggctcattttacagacccggcctcaatagctgcaagggggtatatttctacccgcgtcggaatgggcgaagccgccgctatcttcatgacggcgactcccccaggtagcgtggaggcatttcctcagagtaatgccgtgattcaggatgaagaacgagacatccccgagagatcctggaacagcgggtacgattggataacagacttcccaggaaagaccgtctggtttgtaccttctattaaatcaggcaatgacatcgctaactgtttgcggaagaatggcaaaagggtgatccagctgtcccgcaagaccttcgatactgaatatcaaaagaccaaaaacaacgactgggattacgttgtgaccacagacattagtgagatgggggccaatttccgtgcagatagagtcatcgacccccggaggtgcctcaagccagtgattctgaaagatggaccggaacgcgttatacttgccggtcctatgcccgtgactgtcgctagcgcggcccagcgaagaggccggatcgggaggaaccagaataaggagggagaccagtacgtgtatatgggccaaccactaaacaatgatgaggaccacgcacattggacggaagctaaaatgctgttggataacattaatacccccgagggtatcatccctgccttatttgaaccagagcgcgaaaagtcggcagccattgacggggagtacagactgaggggcgaggctcggaagacattcgtagaactcatgcgtcgcggagatctgcccgtgtggctttcttataaagttgcctccgagggctttcagtacagcgaccgaagatggtgcttcgacggggaaaggaacaatcaggtcctggaggaaaacatggatgtggagatatggactaaggagggagaacggaaaaagctccgccctagatggttggacgcgaggacctattcagatccgctggcactacgggagtttaaagagttcgccgctggtcgaagaagtgtgtctggcgacctgatcctcgagattgggaaacttccacagcacctgacattacgcgcccaaaatgctttggataacctggtcatgctccacaattccgaacagggaggcaaagcatacaggcatgccatggaggagctgcccgacaccatcgaaactcttatgctgctcgctttgattgccgttctgacgggtggggtgaccttatttttcctaagcggcaagggactgggcaagacatcaatcgggctcctttgtgtaatggcaagtagcgcgctgttgtggatggccaacgtggagcctcactggatagctgcctccatcattctggaatttttcctcatggtcctgcttatccccgagccagatcggcagcgtactcctcaggacaatcaactcgcatatgtggttattggactgttgtttatgatcctgaccgtggctgccaacgagatgggtttactagaaacaaccaaaaaggatctgggcatagggcatgtcgcagccgagaaccagcagcacgctactatgctcgacgtagatcttagacccgcgtctgcctggacactgtacgcagtggctacgaccgttattactccaatgatgaggcacacaatcgaaaataccaccgccaacattagcttgacagccatcgcaaatcaagctgccatactgatgggactcgacaaaggctggcctatctccaagatggatattggtgtgccgctgcttgcgttagggtgctactcacaggtcaaccccctgactctcacggctgccgtgttgatgctggtcgcacattatgccatcattggcccaggactacaggctaaagcaacccgcgaggcccagaagcggacagcggctggcatcatgaagaatcctactgtggacgggatagttgccattgacctggatcccgtggtatacgacgcaaaattcgaaaagcaactcggacagatcatgcttctgatcttgtgtacctctcagattctgctcatgcgaacaacctgggccctgtgcgagagtatcactttagctacgggcccacttacaaccctgtgggagggttcgcctgggaaattttggaacactaccatagccgtgagcatggcaaatattttcagaggatcctatctcgctggcgccggtctagcgttctctctgatgaagtcattgggcgggggaaggcgcggcacaggggcccagggagaaactctgggcgagaaatggaagcggcaactcaaccagcttagcaagtccgaatttaatacctacaaaagaagtggtatcatggaggtcgatcgttctgaagcaaaggaggggctgaaaaggggagagacaacgaagcacgctgttagccggggcaccgccaaattgcgctggttcgtggaacgaaacctggtcaagcccgagggtaaggtgattgacctcggctgtgggagaggaggctggtcatattactgcgcagggctaaagaaggtaactgaagtgaaaggatatacaaagggcggtccggggcatgaggaaccaatccctatggctacctacggatggaatctggttaaactttactccggcaaggatgtgtttttcactcccccagagaaatgtgacacactgctatgcgatataggcgagagtagccccaaccctaccatcgaagaggggaggacgctccgggtcctgaagatggtggaaccgtggttgcgcggaaatcagttttgtattaagatcctgaacccctatatgccatctgtcgtggagaccctcgagcagatgcaaagaaaacacggtggcatgcttgttaggaatcctctgtcccgaaactcaacacatgaaatgtactgggtaagctgcgggactggaaatattgtgtcggccgtcaacatgacctctcggatgttactgaaccgtttcacaatggcccacagaaagcccacttatgagcgcgacgtggatttgggcgcgggtaccaggcacgttgctgtggaacctgaggtcgcaaatctcgacatcattgggcagcggatcgaaaacataaagaatgagcataagagtacatggcactacgatgaggacaacccatataaaacctgggcctaccatggatcctatgaagtgaagcccagcggctcagcttcctctatggtaaatggcgtggttagactgctaactaagccttgggacgtcattccaatggtgacgcagatcgccatgacagataccactccctttgggcaacagcgcgtgttcaaagagaaggtcgacaccaggacaccgcgagcaaaacggggaacggcccagatcatggaagttaccgctaagtggctttggggttttctgagcagaaacaaaaagcctaggatttgtactcgcgaggagttcacacgtaaggtgcggagtaatgcggccataggcgcagtatttgtggatgagaaccagtggaactccgctaaagaggccgtcgaagacgagagattctgggatctcgtgcacagggaacgcgagctgcacaagcaagggaaatgcgcaacctgcgtttacaacatgatgggaaagcgagagaaaaagttgggcgagtttggtaaggccaaagggagccgggctatctggtacatgtggctgggagccagattcctcgagttcgaagcgcttggctttatgaatgaggaccattggttctctagggaaaactcatttagtggcgtggagggggagggactgcacaagttaggttatattctgcgcgatatctccaaaattccaggcgggaatatgtacgcagacgatactgccggatgggacacaagaatcaccgaagatgacttgcagaacgaggctaagataacagatatcatggaacccgagcatgccctcctggcaactagcattttcaaactaacctatcagaataaggtcgtgcgggtacagaggcctgctaaaaacggcacggttatggacgtgatctctcgtcgagaccaacgcggttcggggcaggtcggaacctacggccttaacacatttactaatatggaagtgcagctgattagacagatggagtcagagggcatcttcctcccaagcgaactggagacccccaacttggccgaacgggtgttagattggctggagaagcacgggacagaaaggctcaagcgcatggctatatccggagacgattgtgtcgttaaaccggtggacgatagatttgccactgcacttattgcgctgaatgacatgggtaaggtacggaaagatatccctcaatgggagcccagtaagggctggaacgactggcaacaggtgccattctgctctcatcactttcaccagctaatcatgaaagatgggagggagattgtcgtgccttgtcgaaatcaagacgaactggttggacgtgccagagtgagccagggcgctggttggtccctccgcgagaccgcctgcttggggaagtcatatgcacagatgtggcaactgatgtacttccatcggagggatcttagactggctgccaacgcaatatgtagtgccgtccccgtggactgggtaccaacgtctcgcacaacctggagcatccacgcgcatcaccagtggatgactacagaagacatgctctccgtttggaatcgggtgtggattgaggaaaacccctggatggaggataagacccacgtctcaagctgggaggaagtgccttatttaggaaaaagggaggaccagtggtgcggctctctgatcggcttgactgctcgagccacctgggcaacaaatattcaggttgccatcaaccaagtgagacggctgatagggaatgaaaactacctcgattacatgacgtccatgaagaggtttaaaaatgagagtgacccagagggagctctttggtga

SEQ ID NO: 13496 - RNA, 9879 nt, synthetic construct
  misc_feature 1..9879: note = derived and/or modified CDS sequence (opt3) from DENV-1__EU482591__SS-prME
  source 1..9879: mol_type = other RNA
agcgtgaccatgctgctcatgcttctgcccacagccttggctttccacttaactacgagaggcggggagcctcatatgatcgtctccaagcaggaaaggggaaaatctctgctatttaagacctcagcaggtgttaacatgtgcacactcattgccatggacctgggcgagctttgtgaagatactatgacctacaaatgcccacggataacagaggcggaaccggacgatgtggactgttggtgcaatgctaccgatacttgggtaacatatgggacctgtagtcaaacgggagagcaccgccgagagaagcgtagcgtggccctggcaccccatgtcggcttgggtctcgaaactagaaccgagacatggatgtcctctgaaggggcctggaaacagatccagagggtggagacttgggctctgcggcaccctggattcaccgttattgcatttttcctggcccatgctatcggcacatcgattacccagaagggcatcatatttatcctcttaatgctggtgacgccatcaatggccatgcgctgcgtcgggattggaaacagagacttcgtggagggtcttagcggcgcgacttgggtagatgttgtgttggaacacgggagttgtgtcacaaccatggcaaagaataaacccactctggacatcgagctactcaagacagaagtgaccaaccctgccgtgctgaggaaactttgcattgaggctaagatctccaatacgaccacagattctcggtgtccaactcaaggagaagccaccctggtcgaggagcaggacgcaaactttgtttgccgccgaacattcgtggatagaggctggggtaatgggtgtggattgtttggcaaaggcagcctcctgacttgcgctaagttcaagtgcgtaaccaaattagaagggaagatagtgcagtacgagaacctgaaatattccgtcattgtgacagttcacaccggagaccagcatcaagtgggtaatgaaactacggagcacggcacaatcgccaccattactccccaggcgcctacctcagaaatccagctcacagattacggggcccttaccctggactgtagtccaaggactggattggactttaacgagatggtcctactgacaatgaaggagaaaagctggctcgtgcataagcagtggttcctggatcttccgctgccctggacgtctggcgcatccacctcacaagaaacttggaatcggcaggacttgctcgtaacatttaaaaccgctcacgccaagaagcaggaggttgtggtcctgggtagccaagaaggggctatgcacacagccttaactggcgcaaccgagatccagacgagtggaaccacaactattttcgccggccatctgaaatgccgtctaaagatggataaactcaccctgaaggggatgtcttatgtgatgtgtacaggatccttcaaacttgaaaaggaggtcgctgagactcagcacggtaccgtgttggttcaggtgaagtacgaaggcacggacgcgccttgcaaaataccatttagcacacaagatgagaagggggtaacccagaacggacgcctgatcactgcaaatcccattgtcacagacaaagaaaagcctgtgaacatcgagaccgagccacccttcggcgaatcgtatatagttgtgggtgccggggagaaagctctcaagctgtcttggtttaagagaggctcctcaattggaaaaatgttcgaagccactgcaaggggcgcccggcgaatggctatccttggggataccgcctgggactttggaagtatcggtggcgtcttcacaagcgtggggaagctggtacatcaggtgtttggaacggcatacggcgttttgttctccggtgtctcttggaccatgaaaattgggatcggcattctcctgacttggttaggactgaatagccgctcaacaagtctatccatgacctgtatagcggtgggcatggtgacactctacctgggggtcatggttcaggctgatagcggatgcgtgatcaactggaagggcagagagcttaaatgtggttctgggatttttgtgactaacgaagtacacacctggacggagcaatataagttccaggccgactcaccgaagaggttgagtgcagccatcggaaaagcttgggaggaaggcgtctgcggtatccggagcgccacacgcctggagaatattatgtggaagcagatatccaacgaactcaatcatatcctgttagagaacgatatgaaatttaccgtggttgtgggcgacgcaaatgggattctggctcagggaaagaaaatgatcagacctcaacccatggaacacaagtactcttggaaatcgtggggcaaggccaagattatcggggcggacatacagaacactaccttcatcattgatggaccagacacacctgagtgtcccgatggccagagggcctggaatatctgggaggtcgaagactatggttttggggtgttcactaccaacatttggcttaaattgcgtgatagctacacacagatgtgcgaccaccggctcatgtccgctgcaatcaaggattcaaaagccgttcatgctgacatgggatattggatagagagtgaaaagaatgagacgtggaaactggcccgagcatctttcattgaagtgaagacctgtacttggccaaagagccacacactatggtccaacggcgtactggagtcagagatgatcattcccaaaatctacggtggccctataagccaacataattatagaccagggtactttacccagactgcgggaccgtggcacctcggcaagctggaacttgatttcgacttgtgcgaggggacaaccgtcgtggtggatgaacactgcggaaacaggggcccctctctgcgcacgactaccgtcacaggtaaaatcattcatgagtggtgttgccggtcctgtaccttacctccactcagatttaggggggaggacggatgctggtacggcatggaaatccgccccgttaaggagaaagaagagaatctggtgcgaagtatggtaagcgccggttctggcgaagtggattccttctcacttgggattctgtgtgtcagtatcatgatagaggaggtgatgcggagccgttggtcgagaaagatgttgatgactggaacactcgctgtttttctgctactgattatgggccagctcacctggaacgacctgatcaggctttgcatcatggtgggggccaatgcatccgaccgcatgggaatgggcacaacttatttggctctgatggccaccttcaagatgcggcctatgtttgcagtcggtttactcttcagaaggctgacgtctcgagaagtgcttctgctaacaattgggctcagcctggttgcctcagtggagttgccaaacagtctggaagagttaggagatggcctcgctatgggcatcatgatgctgaaacttctgaccgaatttcaaccccaccagttgtggactaccctcctgtccctaacattcgtcaagactaccctgtctcttgactacgcgtggaaaacgacagccatggcactcagcattgtatccctgtttccgttgtgtctgtcaaccactagccagaagacaacctggttacctgtgctcctggggagtttcggatgcaaaccacttactatgtttctgataacagagaacaagatctggggtcgcaagtcttggcccttgaatgagggcattatggctatcgggattgtttccatcctcctgagctcgctactgaaaaacgatgtgcctcttgccggacccctcatagccggcggtatgctgatcgcttgttatgtcatttcagggtctagtgcagacttgtccttagaaaaggccgcggaggtgagctgggaacaggaggctgaacattctggagccagccactccatcctggtagaggtgcaagatgacggcaccatgaaaattaaggatgaggaacgggacgatacgctcactatcctgcttaaagcaaccctgttggccgtctcaggcgtttacccaatgagtatacctgctacactattcgtgtggtatttctggcagaagaaaaagcagagaagcggggtgctgtgggacaccccctctccaccggaggtcgaaagggcagtgctcgataatggaatttaccgtatcctgcagcgcggtcttttaggccggtcccaagttggggtaggagtgtttcaggacggcgtcttccatacaatgtggcacgtgactagaggtgccgttctgatgtatcaggggaagaggctcgagccttcatgggcgagtgtgaaaaaggatttgatcagctacggaggcggctggcgatttcaggggtcctggaacaccggagaggaagtccaagtgattgctgtagagcccggtaaaaatccaaagaacgtccagacgacacccggcactttcaaaacccctgaaggggaggtgggagccatagcactggactttaagccaggcacatctggttcgcccatcgttaatcgggaagggaagattgtgggactctacggcaacggcgtcgtgaccactagcgggacctatgtttcagccatcgctcaggccaaagcatcccaagagggacctctgccggagattgaagacgaggtgttcaagaaacgcaatcttacaatcatggatctgcacccaggtagtggcaagacgagaaggtacttgcccgctatagtccgggaagccatcaaacgaaagctaagaactctgattctcgcgcctacccgcgtggtagcctctgagatggcagaagctttaaaggggatgccaatcaggtatcagacaaccgccgtgaaaagcgagcatactggacgtgagattgttgacctgatgtgccacgctacatttaccatgcggcttctgtcccccgtcagagtgcctaactacaatatgatcataatggatgaagcacatttcacggacccggcctcaattgccgctaggggctatatctctactcgcgtgggtatgggggaggcggcagccatctttatgacagctacccccccaggaagcgtcgaagccttccctcagagtaacgcagtaattcaggatgaggaacgagacatccccgagagatcctggaatagcggctacgattggataaccgactttccaggcaagactgtgtggttcgttccttctattaaatcagggaacgatatcgccaattgtctccggaagaacggaaaaagggtgattcaattgtcccgcaagacattcgacaccgagtatcagaagacaaaaaacaatgattgggactacgtcgtgactacggacatcagtgaaatgggtgctaactttcgtgcggatagagttatagacccccggaggtgcctgaagccagtgattctcaaagatggcccggagcgcgtcatcctggccgggcctatgcccgtgaccgtagcaagcgctgcccagcgaagaggacggatcggcaggaatcagaacaaggaaggtgaccaatacgtgtatatggggcagccacttaataacgatgaggaccacgcacattggacagaggccaaaatgctactggataatattaacactcccgaaggcatcattcctgctttgttcgagccagaacgcgagaagtcggccgcgatagacggagaatacagattaaggggcgaggcacggaagacctttgttgagctgatgcgtcgcggggatctccccgtctggctgtcttataaagtggcctccgaaggattccagtacagcgaccgaagatggtgctttgatggtgagaggaataaccaggtgcttgaagagaatatggacgtcgaaatctggacaaaggagggcgagcggaaaaagctgcgccctagatggctcgatgctaggacctattcagacccgttggccctgcgggaattcaaagagtttgctgcagggcgaagaagtgtttctggagacctaattctggaaatcggcaagctcccacaacaccttactctgcgcgcccagaacgctttagataatttggtgatgctgcacaactccgagcagggtgggaaagcctacaggcatgcaatggaagagctccccgacacgatcgagaccctgatgcttctggcgctcattgccgtattgacaggcggagtgactctgttctttttaagcggcaaggggctaggaaagacctcaataggtctgctctgtgtcacagctagtagcgcccttctgtggatggcatccgtggaacctcactggatcgctgcctctattatcttggagttctttctgatggttctcctgattcccgaaccagatcggcagcgtacccctcaagacaatcagcttgcatatgtggtcatcggcctcctgttcatgatattgactgtagccgctaacgagatggggctgttagagacaacgaaaaaggatctaggaatcggctacgtggcggccgaaaaccatcagcacgcaaccatgctggacgttgatctccaccccgctagcgcctggactctttacgccgtggcaacaaccgtcattaccccaatgatgagacatacaatcgagaatactacggctaacatttccctgaccgccatcgcgaatcaagctgccatattgatgggtctggacaaagggtggcctatttcaaagatggatatcggcgtgccgctcctggcacttggatgctattctcaggtcaaccccttaacactgactgccgctgtgctcatgttggttgcacactacgccattatcggcccagggctgcaggcgaaagctaccagggaagcccagaagcgcacagcagccggaataatgaagaatcctaccgtggacggcatcgtagctattgatctagaccccgtggtctatgatgccaaatttgagaagcaactgggtcagatcatgctccttattctgtgtactagtcagatcttgctgatgcggacgacatgggcactctgcgaatcgataaccctggctactgggccattaaccacactttgggagggaagccctggcaaattctggaacactaccattgccgtttccatggcgaatatcttccgaggttcttacctggccggcgcagggctcgctttttcactaatgaagagcctgggaggcgggagaaggggaacaggcgcccagggtgagacgttgggggaaaaatggaagcgccaactgaaccagctctccaagagtgagttcaatacctataaacggtctggaatcatggaagtggacagaagcgaggcaaaggaaggccttaaacgtggtgagactacaaagcatgctgtctcaaggggcaccgccaaactgcggtggtttgtggagcgcaacttggtaaagcccgaagggaaggtgattgacctgggatgtggccgagggggatggtcctactattgcgccggcctcaaaaaggttactgaggtgaaaggttacacaaaggggggaccgggccacgaagagccaatccctatggcgacctacggctggaatttagtcaaactgcatagtgggaaggatgtgttctttatgcccccagaaaaatgtgacacgcttctgtgcgatataggagagagctctcccaaccctaccattgaggaaggtagaacactaagggtcctcaagatggtggagccgtggctgcggggcaatcagttctgtatcaagattttgaacccctatatgccatccgttgtagaaactctggagcgcatgcagagaaaacacgggggaatgctcgtgaggaatcctctttcacgaaacagcacccacgagatgtactgggtctcgtgcggcacaggtaatatcgtgtctgctgttaacatgactagtcggatgctgttaaaccgttttaccatggcacatagaaagcccacatatgaacgcgacgtggatctgggggccggaaccaggcacgtcgctgtggagcctgaagtagccaatttggacataatcggccaacggattgagaacatcaaaaatgaacataagtccacttggcactacgatgaggacaacccatataaaacgtgggcataccacggcagctatgaggtgaagccctcagggtccgcctctagcatggttaatggagtcgtgagactcctgacaaagccttgggatgtgattccaatggtcacccagatcgctatgactgacaccacacccttcggtcagcaacgcgtttttaaagaaaaggtggatacgaggaccccgcgagcgaaacggggcactacacagattatggaggtaaccgccaagtggctatgggggttccttagtagaaacaaaaagcctaggatctgtactcgcgaagagtttacacgtaaggtgcggtccaatgcagctataggagccgtcttcgtggacgaaaaccagtggaatagcgcaaaagaggccgttgaggacgaaagattttgggatctggtgcatagggagcgcgaactccacaagcagggcaaatgcgctacctgcgtctacaacatgatgggtaagcgagagaaaaagctgggggaattcggaaaggccaaaggctctcgggcgatttggtacatgtggttgggcgcaagattcctggagtttgaggccctcgggttcatgaatgaagaccattggttttcaagggagaacagtctttccggagtggaaggtgagggcctgcacaagttagggtatatcctgcgcgatatcagcaaaattccaggaggcaatatgtacgctgacgatacagccggttgggacactagaataaccgaggatgacttgcaaaacgaagcaaagatcacggatattatggagcccgaacatgctctcctggccacctctatcttcaaactaacatatcagaataaggtagttcgggtgcagaggcctgctaaaaacgggactgtcatggacgtgatttcgcgtcgagatcagcgcggatcaggccaagtgggcacctacgggcttaacacatttactaatatggaggtccagctgatcagacagatggaaagcgagggaatattcctcccatccgagctggaaacccccaacttggccgagcgggcattagactggctggaaaagcacggtgcggagaggctcaagcgcatggccatcagtggcgatgactgtgttgtgaaaccgattgacgatagatttgctacggcccttacagcactgaatgacatggggaaggtacggaaagatatccctcagtgggaaccctctaagggatggaacgactggcaacaggtgccattctgcagccaccattttcaccagctaattatgaaagatggcagggagatcgtcgtgccttgtcgaaatcaggacgagctggttggtcgtgctagagtgtcccaaggggccggatggtcactccgcgaaaccgcatgcttgggcaagagttatgcccagatgtggcagctgatgtacttccatcggagggatcttagactggcggctaacgccatatgttctgcagtccccgtggactgggtaccaactagccgcacaacctggtccattcacgcccaccatcaatggatgactaccgaggatatgctctcagtttggaatcgggtgtggatcgaagagaacccctggatggaagacaagacacacgtcagctcttgggaggaggtgccttatttaggcaaaagggaagatcagtggtgcgggtccctgatcggattgacggctcgagccacctgggcaactaatattcaggttgctataaaccaggtgagacggctgatcggtaatgagaactacctcgactacatgacaagtatgaagaggtttaaaaatgaaagcgactcggagggcgccctttggtga

SEQ ID NO: 13497 - RNA, 9879 nt, synthetic construct
  misc_feature 1..9879: note = derived and/or modified CDS sequence (opt3) from DENV-1__EU482592__SS-prME
  source 1..9879: mol_type = other RNA
agcgtgaccatgctgctcatgcttctgcccaccgccttggctttccacttaactacgagaggaggggagcctcatatgatcgtctccaagcaggaaaggggaaaatctctgttgtttaagacctcagcaggtattaacatgtgcacactcatagccatggacctgggcgagctttgtgaagatactatgacctacaaatgcccacggatcacagaggcggaaccggacgatgttgactgttggtgcaatgctaccgatacttgggtgacatatgggacctgtagtcagacgggagagcaccgccgagacaagcgtagcgtagccctggcaccccatgtgggcttgggtctcgagactagaaccgaaacatggatgtcctctgagggggcctggaaacagattcagaaggtcgaaacttgggctctgaggcaccctggattcaccgtgacagcactgtttctcgcccatgctatcggcacctcgattacgcagaagggcatcatattcatcttactgatgcttgttactccatcaatggccatgcggtgcgtggggattggaaaccgcgattttgtcgagggtttgagcggcgcgacatgggtggacgtagttctggagcacgggagttgtgtgaccactatggcaaaagataagcccacactagacatcgaactcctgaaaaccgaggtcacgaatcctgccgtgcttagaaagctgtgcattgaagctaaaatctccaacaccacaactgattctaggtgtccaacccaaggagaggccacattggtggaagaacaggacagcaatttcgtctgccggcgcacttttgttgatcgaggctggggtaacgggtgtggactcttcggcaagggctccctgttaacctgcgcaaagtttaaatgcgtgacaaagctggaggggaaaatagtacagtacgaaaatctcaagtattcagtgattgtcaccgtgcacactggagaccagcatcaagttggtaacgagacgacagaacacggcaccatcgctactattacaccccaggcccctacaagtgagatccagcttaccgactacggggcgctgactttggattgtagcccaagaacaggactagacttcaatgaaatggtgctgctcacgatgaaagagaagtcttggctggtccataaacagtggtttcttgatctgccgttgccctggacctccggcgcctcaactagccaagagacatggaacaggcaggacctcctggtgaccttcaagacagcacacgctaagaaacaggaagtagttgtgttaggtagtcaagagggggccatgcacactgctctgaccggcgccacggaaatccagacctctggaacaactaccatttttgcaggccatctaaagtgccggctcaaaatggataagctgacacttaaagggatgtcctatgtcatgtgtactggcagcttcaagttggagaaggaagtggccgagacccagcacggtacggtcctggtgcaggttaaatacgagggcacagacgctccttgcaagataccattctcggcgcaagatgaaaaaggggtgacccagaatggacgtctcatcactgcaaaccccattgtaacagacaaggagaaacctgtcaatatcgaaaccgagccaccctttggcgagtcttatatagtggttggtgccggggaaaaggctctgaaactttcctggttcaaaaagggctcaagtattggaaaaatgtttgaggccactgcacgcggcgccagaaggatggctatcctgggggataccgcctgggacttcggaagcatcggtggcgtgtttacatccgtcgggaagttggtgcatcaggtattcggagcagcgtacggcgtgctcttttctggtgttagctggacgatgaaaattgggatcggcattctgttaacctggctgggactaaactcacggagtacttccctcagcatgacatgtatagctgtcggcatggtgaccctgtaccttggggtgatggtccaggccgattctggatgcgttatcaattggaagggccgagaattgaagtgtggttcagggattttcgtgacaaacgaggtgcacacttggaccgaacaatataaatttcaggcagacagtccgaagcgcctgagcgccgctatcggaaaagcctgggaggagggcgtatgcggtatcagatccgcaacgaggctcgaaaacattatgtggaagcagatatctaatgagctgaaccatatcttactggaaaatgacatgaaattcacagtcgtggttggcgatgctaacgggattcttgcccagggaaagaaaatgatccggcctcaacccatggagcaccgctactcgtggaaaagctggggcaaggcgaagattatcggggccgacatacaaaattccacctttatcattgatggaccagacactcctgaatgtcccgatgaccagagagcttggaacatctgggaggtggaggattatggcttcggtatttttaccacaaatatctggttgaagctcagggactcatacactcagatgtgcgatcaccgtctgatgagtgcagccataaaagactctaaggctgtccatgccgatatggggtattggattgaaagcgagaaaaacgaaacctggaagctagcacgggcgtccttcatcgaggtgaagacatgtatttggccaaaatcacacacgctgtggagcaatggagttctcgaatctgagatgatcatacccaagatctacggcggtcctatttcccaacataactatcgaccaggctacttcacccagactgccgggccgtggcacctgggaaaacttgagttggactttgatctgtgcgaaggcacaaccgtggtagtcgacgagcactgcgggaatagaggacccagtttaaggactacaaccgtgacgggcaagatcattcatgaatggtgttgccgcagctgtactctccctccactgcggttcagaggtgaggacgggtgctggtacggaatggagatcaggcccgtgaaagaaaaggaggaaaaccttgtccgctctatggtttccgctggctcaggtgaggtggatagttttagcctgggcatattgtgtgtatcgattatgatcgaagaggtgatgcgatcccggtggtctcgtaagatgctcatgaccgggacactggccgtcttcctactgctcatcatgggacagctgacctggaatgaccttattagattgtgcatcatggtgggcgcaaacgctagcgataggatggggatgggaactacatatctggccttaatggcaacctttaaaatgcgccctatgttcgccgttggcctcctgtttcggagacttacatcaagggaggtgctgctactcactattggtctgagtttggtcgcttccgtggaactgccaaattctttagaggaactcggggacggactggcgatgggcataatgatgcttaagctgttgaccgagttccaaccccaccagctctggacgacactgctaagcctgacctttatcaaaactaccctttccctcgattacgcctggcgaacaatggcaatggttctgtcaattgtgagcttgttcccgctgtgtttaagtactacctctcagaagacgacatggctccctgtcctgcttggctcctttgggtgcaaaccactgaccatgttcttgatcactgaaaacaagatttggggacgcaagagctggcccctcaacgagggtatcatggctataggcatcgtatcgattctgctatcatctctgcttaaaaatgacgtgcctctcgccgggcccctgatcgccggaggcatgttgattgcttgttatgttatcagtggttccagcgcagatttatctctggagaaggccgcggaagtgagctgggaggaagaggctgaacattccgggacatcacacaacatactcgtcgaggtgcaggacgatggaaccatgaaaattaaggacgaggaacgggatgacactctgacaatccttctgaaagccaccttgctagcagtaagtggcgtgtacccaatgagcatccctgccacgctgtttgtctggtatttctggcaaaagaaaaagcagagatctggcgttctctgggatactccctccccaccggaggtggaaagggctgtgctggacgacgggatttaccgtatacttcagcgcggattactgggtcggtcacaggtcggcgtgggggttttccaagatggagtatttcataccatgtggcacgtgacaagaggcgcagtcctcatgtatcagggtaagaggttggagcctagttgggccagcgtgaaaaaggacctgatctcctacgggggaggctggcgattccagggctcttggaataccggggaggaagttcaggtgattgcggtcgagcccggcaagaacccaaagaatgtgcaaacaactcccggtacctttaaaacgcctgaaggcgaggtaggggctatcgccctcgatttcaagccaggaacatcgggcagccccattgtcaaccgggaaggtaagatcgtggggctgtacggaaatggcgttgtgactacctcaggcacatatgtctccgcaatagcccaggctaaaaccagtcaggaggggcctcttccggagatcgaagaggaagtgtttaagaaacgcaacctgactattatggacttgcacccaggatctggtaagaccagaaggtacctacccgccatcgttcgggaggcaattaaacgaaagctgagaacactcatcttagctcctacgcgcgtggtcgccagcgaaatggcggaggccctgaagggcatgccaataaggtatcaaactaccgcagtgaaatccgagcatacagggcgtgaaattgtagatcttatgtgccacgctaccttcactatgcggctgctctcacccgtgagagttcctaattacaacatgatcatcatggacgaggcccattttacagatccggcttctattgcagccaggggatatatcagcacccgcgtcggcatgggtgaagccgctgcgatattcatgacggcaactcccccagggagtgtggaggcctttcctcagtccaatgctgtgattcaggacgaagaacgagatatccccgagagaagctggaactctggatacgactggattacagatttcccaggcaagaccgtctggtttgtaccttcaatcaaatccggcaatgacatagccaactgtttgcggaagaatgggaaaagggtgattcagctgagtcgcaagaccttcgacactgaatatcaaaagacacgtaacaacgattgggactacgttgtgaccacagatatcagcgagatgggagcaaatttcagagccgaccgggtcatcgatcccaggcgctgcctcaaaccagtgattctgaaggacggtccggaacgagttatccttgctggccctatgcccgtgactgtcgcgtcggccgcacagagacgggggaggattggacgcaaccagaataaagagggcgatcagtacgtgtatatgggtcaaccactaaacaatgacgaggatcacgctcattggacggaagccaagatgctgttggacaacataaatacccccgaggggatcattcctgcattatttgaaccagagagagaaaaatctgccgctatcgatggcgagtacaggctgcggggagaggcccgtaagacattcgtagaactcatgcgccgaggcgacctgcccgtgtggctttcctataaggttgcgagcgaggggtttcagtactcagatagaaggtggtgcttcgacggagaacggaacaatcaggtcctggaggaaaacatggacgtggagatctggactaaagagggtgaacgcaagaaactcagacctaggtggttggatgcacggacctatagtgacccgctggccctacgagagtttaaggagttcgctgccggcagacgctctgtgtccggggatctgattctcgagataggaaaacttccacagcacctgacattaagggctcaaaatgcattggacaacctggtcatgctccacaatagcgaacagggcggtaaggcctaccggcatgctatggaggagctgcccgataccatcgaaactcttatgctgctcgccttgattgcagttctgaccgggggagtgacgttatttttcctatcaggaaaaggcctggggaagacaagtatcggactcctttgtgtaatggcgagctccgccctgttgtggatggctaacgtggagcctcactggattgccgcatctatcatactggaatttttcctcatggtcctgcttatccccgagccagaccgtcagagaactcctcaggataatcaactcgcttatgtggttattggtctgttgtttatgatcctgaccgtggccgcaaacgagatgggcttactagaaacaaccaagaaagacctggggattggatacgtcgccgctgagaaccagcatcacgcgactatgctcgatgtagaccttaggcccgccagcgcatggacactgtacgctgtggccacgaccgttatcactccaatgatgcgccacacaatagaaaataccaccgccaacatttccttgacagcaatcgctaatcaggccgcgattctgatgggcctcgataagggttggcctatctcaaaaatggacataggggtgccgctgcttgctttaggctgctattctcaagtcaaccccctgactctcacggccgcagtgttgatgctggtcgcccattacgctatcattggaccaggcctacaggcaaaggccacccgggaggcgcagaaacgaacagctgccgggatcatgaagaatcctactgtggatggaattgttgcaatcgacctggaccccgtggtatatgatgccaagttcgaaaaacagctcggccaaataatgcttctgattttgtgtaccagtcagatcctgctcatgagaacaacctgggctctgtgcgagtcgatcactttagccacgggtccacttacaaccctgtgggaggggagccctggaaagttttggaacactaccattgcagtgtccatggctaatatcttcaggggctcttacctcgccggtgcgggcctagccttctcactgatgaaaagcctagggggaggccgccgggggacaggagcacagggcgaaactctgggtgagaagtggaagagacagctcaaccaactttccaagagtgaatttaatacctataagcgttctgggataatggaggtcgacaggagcgaagctaaagagggactgaagcggggcgagacaacgaaacacgccgtttcacgcggtaccgcaaagttgcgatggttcgtggaaagaaacctggtcaaacccgagggcaaggtgattgatctcgggtgtggaaggggcgggtggtcctactattgcgctggattaaagaaagtaactgaagtgaagggctacacaaaaggtgggccgggacatgaggaaccaatccctatggccacctacggctggaatctggttaaactttatagtggcaaagacgtgtttttcactcccccagagaagtgtgatacactgctatgcgacattggggagagctctcccaaccctaccatcgaagagggacggacgctccgcgtcctgaaaatggtggaaccgtggttgagaggtaatcagttttgtataaagatcctgaacccctacatgccatccgtcgtggagaccctcgagcagatgcagaggaagcacggcgggatgcttgttcgaaatcctctgtcacggaacagcacacatgaaatgtattgggtatcgtgcggaactggcaatattgtgtctgccgtcaacatgaccagtcgtatgttactgaacagattcacaatgactcaccgcaaacccacctacgagagggatgtggacttgggtgcggggacacggcacgttgctgtggaacctgaggtcgcaaatctcgatatcattggacaaagaatcgaaaacattaagaatgagcataaatccacctggtattacgacgaggataacccatataagacttgggcctaccacggcagctacgaagtgaaaccctcaggctccgcttctagcatggtaaatggggtggttcgcctgctaacgaagccttgggacgtcatcccaatggtgacacagatagccatgaccgacactaccccctttggacagcaaagggtgttcaaggagaaagtcgatacacgaacgccgcgggcaaagagaggtaccgcccagattatggaagttactgctaaatggctttggggctttctgagtaggaacaagaaacctcgcatctgtacacgtgaggagttcacccggaaggtgagatccaatgcggccatcggggcagtatttgtggacgagaaccagtggaatagcgctaaggaggccgtcgaagatgagaggttctgggacctcgtgcatcgcgaacgagagctgcacaaacagggaaagtgcgcaacttgcgtttataacatgatgggcaaacgggaaaagaaattgggtgagtttgggaaggccaagggatctagagctatttggtacatgtggctgggcgccaggttcctcgagttcgaagcgcttggctttatgaatgaggatcactggttctcacgcgaaaacagtttttccggggtggagggagagggtctgcataaattaggctatatactgagagacatcagcaagattccagggggaaatatgtacgcagatgacacagccggctgggatacccggatcacagaagacgatttgcaaaacgaggctaaaattactgacatcatggaacccgagcacgccctcctggcaacctctatattcaagctaacgtatcagaataaagtcgtgagggtacagcgtcctgctaagaacggtaccgttatggatgtgatctcgcgacgcgaccagagagggtcaggacaagtcggcacatacggccttaacacttttaccaatatggaagtgcagctgattcggcagatggagagcgaggggatcttcctcccatccgaactggagacacccaacttggccgaaagggtgttaaattggctggagaaacatggaactgaacgcctcaagagaatggctattagtggtgacgattgtgtcgttaagccggtggacgatcggtttgccaccgcacttatcgcgctgaacgacatgggcaaagtaaggaaggatatacctcagtgggagccctctaaagggtggaatgactggcaacaggtgccattctgcagccaccattttcaccagctaattatgaaggatggacgagagatcgtcgtgccttgtcgtaaccaggacgaactggttggcagagcccgcgtgtcccaaggtgctgggtggtcactccgggagacggcctgcttgggaaaaagttatgcacagatgtggcagctgatgtacttccacaggagagatcttcgcctggctgccaatgcaatctgttctgccgtccccgtggactgggtaccaacaagccggaccacttggtccattcatgcgcaccatcaatggatgacaaccgaagatatgctctcagtttggaacagggtgtggatagaggaaaatccctggatggaggacaagactcacgtcagctcttgggaggaagtgccttacttaggcaagcgagaggaccagtggtgcggctccctgatcgggttgaccgctagagccacatgggcaacgaacattcaggttgccatcaatcaggtgcggaggctgattggaaacgaaaattatctcgattacatgaccagtatgaaacgctttaagaacgagagcgacccagagggtgctctttggtga

SEQ ID NO: 13498 - RNA, 9879 nt, synthetic construct
  misc_feature 1..9879: note = derived and/or modified CDS sequence (opt3) from DENV-1__EU482609__SS-prME
  source 1..9879: mol_type = other RNA
agcgtgaccatgctgctcatgcttctgccaaccgccttggctttccacttaactacgagaggaggggaacctcatatgatcgtctccaagcaggaaaggggaaaatctctgttatttaagacctcagccggtgttaacatgtgcacactcattgccatggacctgggcgaactttgtgaagatactatgacctacaaatgcccacggataacagaggcggaaccggacgatgtggactgttggtgcaatgctaccgatacttgggtaacatatgggacctgtagtcaaacgggagagcaccgccgagacaagcgtagcgtggccctggcaccccatgtcggcttgggtctcgagactagaaccgaaacatggatgtcctctgagggggcctggaaacagatccagagggtggaaacttgggctctgcggcaccctggattcaccgttattgcactgtttctcgcccatgctatcggcacatcgattacccagaagggcatcatattcatcttactgatgcttgtgacgccatcaatggccatgcgctgcgtcgggattggaaacagagattttgtggagggtttgagcggcgcgacttgggtagacgttgtgctggagcacgggagttgtgtcacaaccatggcaaagaataaacccactctagatatcgaactcctgaagacagaggtgaccaaccctgccgtgcttaggaaactgtgcattgaagctaagatctccaatacgaccacagactctcggtgtccaactcaaggagaggccaccttggtcgaagaacaggatgcaaacttcgtttgccgccgaacatttgtggacagaggctggggtaatgggtgtggactcttcggcaaaggcagcctgttaacttgcgctaagtttaagtgcgtaaccaaactggaggggaagatagtgcagtacgaaaacctcaaatattccgtcattgtgacagttcacaccggagatcagcatcaagtgggtaatgagactacggaacacggcacaatcgccaccattactccccaggcgcctacctcagagatccagcttacagactacggggccctgaccttggactgtagtccaaggactggactagatttcaacgaaatggtcctgctcacaatgaaggagaaaagctggctggtgcataagcagtggtttcttgacctgccgttgccctggacgtctggcgcatccacctcacaagagacttggaatcggcaggatctcctggtaacattcaaaaccgctcacgccaagaagcaggaagttgtggtcttaggtagccaagagggggctatgcacacagccctgactggcgcaaccgaaatccagacgagtggaaccacaactatttttgccggccatctaaaatgccgtctcaagatggacaaactgacccttaaggggatgtcttatgtgatgtgtacaggatccttcaaattggagaaggaagtcgctgagactcagcacggtaccgtgctggttcaggtgaagtacgagggcacggatgcgccttgcaaaataccattcagcacacaagacgaaaagggggtaacccagaacggacgcctcatcactgcaaatcccattgtcacagataaagagaagcctgtgaacatcgaaaccgagccaccctttggcgagtcgtatatagttgtgggtgccggggaaaaagctctgaaactttcttggttcaagaaaggctcctcaattggaaagatgtttgaggccactgcaagaggcgccaggcggatggctatcctgggggacaccgcctgggatttcggaagtatcggtggcgtctttacaagcgtggggaaattggtacatcaggtgttcggaacggcatacggcgttctcttttccggtgtctcttggaccatgaagattgggatcggcattctgttaacttggctgggactaaatagccgatcaacaagtctctccatgacctgtatagcggtgggcatggtgacactgtaccttggggtcatggttcaggctgacagcggatgcgtgatcaactggaaaggccgcgaattgaagtgtggttctgggattttcgtgactaacgaggtacacacctggacggaacaatataagtttcaggccgattcaccgaaaagactgagtgcagccatcggaaaggcttgggaggagggcgtctgcggtatcaggagcgccacacggctcgaaaatattatgtggaaacagatatccaacgagctgaatcatatcttactggaaaacgacatgaagttcaccgtggttgtgggcgacgcaaatgggattcttgctcagggcaagaaaatgatccgccctcaacccatggagcacaaatactcttggaagtcgtggggcaaggccaaaattatcggggcggatatacagaacactacctttatcattgacggaccagatacacctgaatgtcccgacggccagagagcctggaatatctgggaggtcgaggattatggtttcgggatttttactaccaacatctggttgaagctcagggacagctacacacagatgtgcgatcaccgtctgatgtccgctgcaataaaagactcaaaggccgtgcatgctgatatgggatattggattgaaagtgagaaaaatgaaacgtggaagctagcccgggcatctttcatcgaggttaagacctgtacttggccaaaaagccacacactgtggtccaacggcgtgctcgaatcagagatgattatccccaagatatacggtggccctatcagccaacataattatcgaccagggtacttcacccagactgcgggaccgtggcacctgggcaaacttgagttggactttgatctgtgcgaagggacaaccgtagtcgtggacgagcactgcggaaacagaggcccctctttaaggacgactaccgtgacaggtaagattatccatgaatggtgttgccgctcctgtaccctccctccactgcggttcagaggggaggatggatgctggtacggcatggagattaggcccgtcaaagaaaaggaggaaaatcttgttcgcagtatggtgagcgccggttctggcgaggtagactccttttcactggggatcttgtgtgtgagtataatgattgaagaggtcatgcgaagccggtggtcgcgtaagatgctcatgactggaacactggctgtgttcctactgctcatcatgggccagctgacctggaacgaccttatcagattgtgcattatggttggggccaatgcatccgataggatgggaatgggcacaacttatctggctttaatggccacctttaaaatgcgccctatgttcgcagtgggtctcctgtttcggagacttacgtctagggaggtcctgctactcacaatcgggctgagcttggtggcctcagttgaactgccaaacagtttagaggaactcggagacggcctggctatgggcattatgatgcttaagctgttgaccgagttccaaccccaccagctctggactaccctgctatccctgacatttgtgaaaactaccctttctctcgattacgcgtggaagacgacagccatggtcctgagcatagtatccttgttcccgctgtgtttatcaaccactagccagaaaacaacctggctccctgtgctgcttgggagttttggatgcaagccactgactatgttcttgatcacagaaaacaagatttggggtcgaaaatcttggcccctcaatgagggcatcatggcaattgggatcgtttccatactgctaagctcgctgcttaagaacgacgtgcctctcgctggacccctgatcgccggcggtatgttgattgcctgttatgtcatctcagggtctagtgctgatttatccctggagaaagcagccgaagtgagctgggagcaggaagcggagcattctggagctagccacaatattctcgtagaagtgcaagacgatggcaccatgaagatcaaagacgaggagcgcgatgacacgctgactatacttctgaaggccaccttgctagcagtctccggcgtttacccaatgtcaattcctgccacactgtttgtgtggtatttctggcagaaaaagaagcagcggagtggggtgctctgggatacccccagcccaccggaagtcgagagagctgtgctggacgatggaatctacaggatccttcagcgtggtttactgggccgctctcaagttggggtaggagtgttccaggacggcgtctttcatacaatgtggcacgtgactcggggtgcagttctcatgtatcaggggaaaagattggaaccttcctgggcctcagtgaagaaagacctgattagttacggaggcggctggaggttccaggggagctggaacaccggagaggaggtccaagtgatagcggtagaacccggtaagaatcccaagaatgtccagacgacacccggcacttttaagacccctgagggggaagtgggagctatcgccctcgatttcaagccaggcacatccggttctcccattgttaatcgagaggggaaaatcgtgggactgtacggcaacggcgtcgtgaccacttcggggacctatgttagcgcaattgcccaggctcgggcctcacaagaaggacctcttccggagatcgaggacgaagtgtttaagaaacgcaatctgacaataatggatttgcacccaggttccggcaagacgagaaggtacctacccgcaatcgtccgggaggctattaaacgaaagctgagaactctcatcttagcccctacccgcgtggtagcgagtgaaatggccgaggcactgaaggggatgccaattaggtatcagacaaccgctgtgaaatctgaacatactggacgtgagatcgttgaccttatgtgccacgccacattcaccatgcggctgctcagccccgtcagagtgcctaactacaatatgataattatggatgaggctcattttacggacccggcatccatcgccgccaggggctatatctcaactcgcgtgggtatgggggaagctgcggcaattttcatgacagccacacccccaggatctgtcgaggcttttcctcagagcaacgccgtaatccaggatgaagaacgagacatacccgaaagaagttggaactccggctacgattggattaccgacttcccaggcaagactgtgtggtttgttcctagcatcaaatctgggaacgatattgcaaattgtttgcggaagaacggaaaaagggtgatccaactgtcacgcaagacattcgacaccgagtatcagaagaccaagaataatgactgggattacgtcgtgactacggacatatccgagatgggtgccaacttccgtgctgatagagttattgacccccggaggtgcctcaagccagtgatcctgaaagatggcccggaacgcgtcatccttgcggggcctatgcccgtgaccgtagccagtgcagctcagcgaagaggacggattggcaggaatcagaacaaggagggtgaccaatacgtgtatatggggcagccactaaataacgatgaagaccacgcccattggacagaggcaaaaatgctgttggataatatcaacactcccgagggcattatacctgccttatttgaaccagagcgcgaaaagagcgctgccatcgacggagagtacagactgaggggcgaagcgcggaagaccttcgttgagctcatgcgtcgcggggatctgcccgtctggctttcgtataaagtggcatctgagggatttcagtactccgaccgaagatggtgcttcgatggtgaaaggaataaccaggtgctggaggaaaatatggacgtcgagatttggacaaaggaaggcgagcggaaaaagctccgccctagatggttggacgccaggacctatagcgatccgctggctctacgggagtttaaagagttcgccgctgggcgaagatcagttagtggagacctgatcctcgagatcggcaaacttccacaacacctgactttacgcgcacagaacgccttggataatctggtgatgctccacaactctgaacagggtgggaaggcttacaggcatgccatggaggaactgcccgacacgattgagacccttatgctgctcgcattgatagcggtactgacaggcggagtgactttatttttcctatccggcaaggggctgggaaagaccagcatcggtctcctttgtgtcacagcctcaagtgctctgttgtggatggccagcgtggagcctcactggattgcagcttccatcattctggaatttttcctcatggttctgcttatccccgagccagatcggcagcgtacccctcaagacaatcagctcgcctatgtggtcataggcctgttgtttatgatcctgactgtagcagccaacgaaatggggttactagagacaacgaaaaaggatctgggaattggctacgtggctgcggagaaccatcagcacgccaccatgctcgacgttgatcttagacccgcatctgcttggactctgtacgccgtggccacaaccgtcatcaccccaatgatgaggcacacaattgaaaatactacggcaaacatcagcttgaccgctatagccaatcaagcggctattctgatgggtctcgacaaagggtggcctatctccaagatggatattggcgtgccgctgcttgccttaggatgctattcacaggtcaaccccctgacactcactgcagccgtgttgatgctggttgctcattacgcaatcataggcccagggctacaggccaaagcgacccgcgaggctcagaagcggacagccgcaggaatcatgaagaatcctaccgtggacggcattgtagccatcgatctggaccccgtggtctatgacgctaaattcgaaaagcaactcggtcagattatgcttctgatcttgtgtacttctcagatactgctcatgcgaacgacatgggccctgtgcgagagtattaccttagcaactgggccacttaccacactgtgggaaggatcgcctggcaaattttggaacactaccatcgctgttagcatggccaatatcttcagaggttcctacctcgcgggcgccgggctagcattctctctgatgaagtcattgggaggcgggaggcgcggaacaggcgctcagggtgagacgctgggggagaaatggaagcggcaactcaaccagcttagcaagtccgaatttaatacctataaaagaagtggaattatggaggtggatcgttctgaagccaaggagggcctgaaaaggggtgaaactacaaagcacgcagtcagccggggcaccgctaaattgcgctggttcgtggagcgaaacctggtaaagcccgaggggaaggtgatcgacctcggatgtggcagagggggatggtcatactattgcgccggcctgaaaaaggttactgaagtgaaaggttacacaaaagggggaccgggccatgaggaaccaatacctatggccacctacggctggaatctagtcaaacttcactccgggaaggatgtgtttttcatgcccccagagaaatgtgacacgctgctatgcgatattggagaaagtagccccaaccctaccatcgaggagggtaggacactccgggtcctgaagatggtggaaccgtggttgaagggcaatcagttttgtattaaaatcctgaacccctatatgccatctgttgtagagactctcgaacagatgcaacgcaagcatgggggaatgcttgtgagaaatcctctgtccaggaactcaacccacgagatgtactgggtcagctgcggcacaggtaatatagtgtcggcggttaacatgacttctcgaatgttactgaaccggttcaccatggctcaccgtaaacccacatatgagagagacgtggatttgggggcaggaacccgccatgtcgccgtggaacctgaggtagctaatctcgacatcattggccagaggatcgaaaacattaagaatgagcacaaaagtacttggcattacgatgaagacaacccatataagacgtgggcctaccacggctcctatgaggtgaagcccagcgggtcagcatcctctatggttaatggagtcgtgcggctgctaacaaaaccttgggatgtgatcccaatggtcacccagattgccatgactgacaccacaccctttggtcaacagagagttttcaaggagaaagtggacacgcgcaccccgagggctaagcgaggcactacacagatcatggaagtaaccgcgcggtggctttgggggtttctgagcagaaacaaaaagcctaggatatgtactcgcgaggagttcacacgtaaggtgcggagtaatgccgcaattggagctgtctttgtggatgagaaccagtggaactccgccaaagaagcagttgaggacgagagattctgggatctcgtgcacagggaacgcgagctgcataagcaaggcaaatgcgcaacctgcgtctacaacatgatgggtaagcgagagaaaaagttgggggagtttggaaaggctaaaggcagccgggccatctggtacatgtggctgggcgcgagattcctcgagttcgaggcacttgggtttatgaatgaggaccactggttctctagggaaaactcactgagtggagtggagggtgaaggcttacataagctggggtatatcttgcgcgatatttccaaaataccaggaggcaatatgtacgccgacgatacagctggttgggacactagaatcaccgaggatgacctccagaacgaggccaagattacggatatcatggaacccgagcacgcactgctagctaccagcatttttaaacttacatatcagaataaggtagttcgggtgcagaggcctgccaaaaacgggactgtcatggacgtgatctctcgtcgagatcaacgcggatcgggccaggtgggcacctacgggctgaacacattcactaatatggaagtccagctcataagacagatggagtcagaaggaatctttagcccatccgagctggagacccccaacttggctgaacgggttttagactggctggagaagcatggtgccgaaaggctcaagcgcatggcaattagtggcgacgattgtgtggtaaaaccgatcgacgatagattcgcgacggcccttacagctctgaatgacatggggaaggtgcggaaagatattcctcaatgggagccctctaagggatggaacgactggcagcaggtcccattttgcagccaccacttccatcagctaatcatgaaagatggcagggaaatagtggttccttgtcgaaatcaagacgagctggtgggtcgtgccagagtctcccagggggcaggatggtcactccgcgagaccgcttgcttgggcaagagttatgcccagatgtggcaactgatgtactttcaccggagggatcttagactggcagccaacgcgatttgttctgctgtgcccgtagactgggttccaactagccgcacaacctggtccatccatgcccaccaccagtggatgactaccgaagatatgctctcagtgtggaatcgggtctggatcgaggaaaacccctggatggaggacaagacacatgtgagctcttgggaagaggttccttatttaggcaaaagggaggaccagtggtgcgggtccctgattggattgacggcacgagccacctgggctactaatatacaggtggccatcaaccaagtcagacggctgattggtaatgaaaactacctcgattacatgacaagtatgaagaggttcaaaaatgagagcgacccagaaggcgcactttggtga

SEQ ID NO: 13499 - RNA, 9879 nt, synthetic construct
  misc_feature 1..9879: note = derived and/or modified CDS sequence (opt3) from DENV-1__EU482610__SS-prME
  source 1..9879: mol_type = other RNA
agcgtgaccatgctgctcatgcttctgcccacagccttggctttccacttaactacgagaggcggggagcctcatatgatcgtctccaagcaggaaaggggaaaatctctgctatttaagacctcagcaggtgttaacatgtgcacactcattgccatggacctgggcgagctttgtgaagatactatgacctacaaatgcccacggataacagaggcggaaccggacgatgtggactgttggtgcaatgctaccgatacttgggtaacatatgggacctgtagtcaaacgggagagcaccgccgagagaagcgtagcgtggccctggcaccccatgtcggcttgggtctcgaaactagaaccgagacatggatgtcctctgaaggggcctggaaacagatccagagggtggagacttgggttctgcggcaccctggattcaccgtgattgcttttttcctggcacatgccatcggcacatcgattacccagaagggcatcatatttatcctcttaatgctggtcacgccatcaatggctatgcgctgcgtggggattggaaacagagacttcgtagagggtcttagcggcgccacttgggttgatgtggtcttggaacacgggagttgtgtgacaaccatggcgaagaataaacccactctggacatcgagctactcaagacagaagtgaccaaccctgcagtcctgaggaaactttgcattgaggccaagatctccaatacgaccacagattctcggtgtccaactcaaggagaagctaccctggttgaggagcaggacgccaactttgtgtgccgccgaacattcgtagatagaggctggggtaatgggtgtggattgtttggcaaaggcagcctcctgacttgcgcaaagttcaagtgcgtgaccaaattagaagggaagatagtccagtacgagaacctgaaatattccgtgattgttacagtgcacaccggagaccagcatcaagtcggtaatgaaactacggagcacggcacaatcgctaccattactccccaggcccctacctcagaaatccagctcacagattacggggcgcttaccctggactgtagtccaaggactggattggactttaacgagatggtgctactgacaatgaaggagaaaagctggctcgtacataagcagtggttcctggatcttccgctgccctggacgtctggcgcctccacctcacaagaaacttggaatcggcaggacttgctcgttacatttaaaaccgcacacgctaagaagcaggaggtggtcgtgctgggtagccaagaaggggccatgcacacagctttaactggcgccaccgagatccagacgagtggaaccacaactattttcgcaggccatctgaaatgccgtctaaagatggataaactcaccctgaaggggatgtcttatgtcatgtgtacaggatccttcaaacttgaaaaggaggtggccgagactcagcacggtaccgttttggtgcaggtaaagtacgaaggcacggacgctccttgcaaaataccatttagcacacaagatgagaagggggtcacccagaacggacgcctgatcactgcgaatcccattgtgacagacaaagaaaagcctgttaacatcgagaccgagccacccttcggcgaatcgtatatagtggtcggtgcaggggagaaagccctcaagctgtcttggtttaagagaggctcctcaattggaaaaatgttcgaagctactgccaggggcgcacggcgaatggccatccttggggataccgcttgggactttggaagtatcggtggcgtgttcacaagcgtagggaagctggtgcatcaggtttttggaacggcctacggcgtcttgttctccggtgtgtcttggaccatgaaaattgggatcggcattctcctgacttggttaggactgaatagccgctcaacaagtctatccatgacctgtatagcagtgggcatggtcacactctacctgggggttatggtgcaggcggatagcggatgcgtgatcaactggaagggcagagagcttaaatgtggttctgggatttttgtaactaacgaagtccacacctggacggagcaatataagttccaggctgactcaccgaagaggttgagtgccgcaatcggaaaagcctgggaggaaggcgtgtgcggtatccggagcgctacacgcctggagaatattatgtggaagcagatatccaacgaactcaatcatatcctgttagagaacgatatgaaactgaccgttgtggtcggcgacgccaatgggattcttgcacagggaaagaaaatgatcagacctcaacccatggaacacaagtactcttggaaatcgtggggcaaggctaagattatcggggccgacatacagaacactacctttatcattgatggaccagacacacctgagtgtcccgatggccagagggcgtggaatatctgggaggtggaagactatggtttcggggtttttactaccaacatttggttgaaactccgtgatagctacacacagatgtgcgaccaccggctgatgtccgccgctatcaaggattcaaaagcagtgcatgccgacatgggatattggatagagagtgaaaagaatgagacgtggaaactagctcgagcctctttcattgaagtaaagacctgtacttggccaaagagccacacactgtggtccaacggcgtcctcgagtcagagatgatcattcccaaaatctacggtggccctataagccaacataattatagaccagggtacttcacccagactgcaggaccgtggcacctgggcaagcttgaattggattttgacctgtgcgaggggacaaccgtggtggtcgatgaacactgcggaaacaggggcccctctttacgcacgactaccgttacaggtaaaatcattcatgagtggtgttgccggtcctgtaccctccctccactgagattcaggggggaggacggatgctggtacggcatggaaatccgccccgtgaaggagaaagaagagaatcttgtacgaagtatggtgagcgcgggttctggcgaagtcgattccttttcactggggattttgtgtgtgagtatcatgatagaggaggttatgcggagccgttggtcgagaaagatgctcatgactggaacactggccgtgttcctactgctcattatgggccagctgacctggaacgaccttatcaggttgtgcatcatggtcggggctaatgcctccgaccgcatgggaatgggcacaacttatctggcattaatggctacctttaagatgcggcctatgttcgccgtgggtctcctgtttagaaggcttacgtctcgagaagttctgctactcacaattgggctgagcttggtggcatcagtcgagctgccaaacagtttagaagagctcggagatggcctggccatgggcatcatgatgcttaaactgttgaccgaattccaaccccaccagctctggactaccctgctatccctgacatttgtaaagactaccctttctctcgactacgcttggaaaacgacagcgatggtgctgagcattgtttccttgttcccgctgtgtttatcaaccactagccagaagacaacctggctccctgtgctgcttgggagttttggatgcaaaccactgactatgttcttgataacagagaacaagatctggggtcgcaagtcttggcccctcaatgagggcattatggccatcgggattgtctccatcctgctaagctcgctgcttaaaaacgatgtgcctctcgcaggacccctgatagctggcggtatgttgatcgcctgttatgtaatttcagggtctagtgccgacttatccctggaaaaggctgcagaggtgagctgggaacaggaggccgaacattctggagcgagccacaatatcctcgtcgaggttcaagatgacggcaccatgaaaattaaggatgaggaacgggacgatacgctgactatccttctgaaagctaccttgctagccgtgtccggcgtgtacccaatgtcaatacctgcaacactgtttgtctggtatttctggcagaagaaaaagcagagaagtggggtgctctgggacacccccagcccaccggaggttgaaagggccgtactggatgacggaatttaccgtatccttcagcgcggtttactgggccggtctcaagtgggggtcggagtgttccaggatggcgtttttcatacaatgtggcacgtgactagaggtgctgtcctcatgtatcaggggaagaggttggagccttcctgggcatcagtgaaaaaggacctgatcagttacggaggcggctggcgattccaggggagctggaacaccggagaggaagtacaagtcattgccgtggagcccggtaaaaatccaaagaacgttcagacgacacccggcacttttaaaacccctgaaggggaggtgggagcgatagctctcgacttcaagccaggcacatccggttctcccatcgtcaatcgggaagggaagattgtgggactgtacggcaacggcgttgtgaccacttcggggacctatgtcagcgccatcgcacaggccaaagcttcacaagagggacctcttccggagattgaagatgaggtgtttaagaaacgcaatctgacaatcatggacttgcacccaggttccggcaagacgagaaggtacctacccgccatagtacgggaagcaatcaaacgaaagctgagaactctcattttagctcctacccgcgtggttgccagtgagatggcggaagccctgaaggggatgccaatcaggtatcagacaaccgcagtcaaatctgagcatactggacgtgagattgtggatcttatgtgccacgctacattcaccatgcggctgctcagccccgtgagagtccctaactacaatatgatcataatggacgaagcccattttacggatccggcttccattgcagccaggggctatatctcaactcgcgtaggtatgggggaggccgctgcgatcttcatgacagcaacccccccaggatctgtggaagcctttcctcagagcaacgctgttattcaggacgaggaacgagatatccccgagagaagttggaattccggctacgactggataaccgatttcccaggcaagactgtgtggtttgtccctagcattaaatctgggaacgacatcgccaattgtttgcggaagaacggaaaaagggtgattcaactgtcacgcaagacattcgataccgagtatcagaagacaaaaaacaatgactgggactacgttgtgactacggatatctccgaaatgggtgcaaacttccgtgccgacagagtcatagatccccggaggtgcctcaagccagtgattctgaaagacggcccggagcgcgtaatccttgctgggcctatgcccgtgaccgttgcgagtgccgcacagcgaagaggacggatcggcaggaatcagaacaaggaaggtgatcaatacgtctatatggggcagccactaaataacgacgaggatcacgctcattggacagaggccaaaatgctgttggacaatattaacactcccgaaggcatcattcctgcattatttgagccagaacgcgagaagagcgccgctatagatggagaatacagactgaggggcgaggcccggaagaccttcgtggagctcatgcgtcgcggggacctgcccgtgtggctttcgtataaagtcgcgtctgaaggatttcagtactccgatcgaagatggtgcttcgacggtgagaggaataaccaggttctggaagagaatatggatgtggaaatctggacaaaggagggcgagcggaaaaagctccgccctagatggttggacgcaaggacctatagcgacccgctggccctacgggaatttaaagagttcgctgccgggcgaagatcagtaagtggagatctgattctcgaaatcggcaagcttccacaacacctgactttacgcgctcagaacgcattggacaatctggtgatgctccacaactctgagcagggtgggaaagcctacaggcatgctatggaagagctgcccgatacgatcgagacccttatgctgctcgccttgattgcagtcctgacaggcggagtgactttatttttcctatccggcaaggggctgggaaagaccagcataggtctcctttgtgttacagcgtcaagtgccctgttgtggatggctagcgtggaacctcactggatcgccgcatccattatcctggagtttttcctcatggtcctgcttattcccgaaccagaccggcagcgtacccctcaagataatcagctcgcttatgtagtgatcggcctgttgtttatgatactgactgttgccgcaaacgagatggggttactagagacaacgaaaaaggacctgggaatcggctacgtggccgctgaaaaccatcagcacgcgaccatgctcgatgtcgaccttcaccccgcctctgcatggactctgtacgctgtggccacaaccgtcattaccccaatgatgagacatacaatcgagaatactacggccaacattagcttgaccgcaatcgctaatcaagccgcgatactgatgggtctcgataaagggtggcctatttccaagatggacatcggcgtgccgctgcttgctttaggatgctattcacaggttaaccccctgacactcactgccgcagtgttgatgctggtagcccactacgctattatcggcccagggctacaggcaaaagccaccagggaagcgcagaagcgcacagctgccggaataatgaagaatcctaccgtggatggcatcgtcgcaattgacctggatcccgttgtgtatgacgccaaattcgagaagcaactcggtcagatcatgcttctgattttgtgtacttctcagatcctgctcatgcggacgacatgggctctgtgcgaaagtataaccttagccactgggccacttaccacactgtgggagggatcgcctggcaaattttggaacactaccattgcagtcagcatggctaatatcttccgaggttcctacctcgccggcgcggggctagccttctctctgatgaagtcattgggaggcgggagaaggggaacaggcgcacagggtgagacgctgggggaaaaatggaagcgccaactcaaccagcttagcaagtccgagtttaatacctataaacggagtggaatcatggaagtggacagatctgaggctaaggaaggcctgaaacgtggtgagactacaaagcatgccgtaagcaggggcaccgcaaaattgcggtggttcgtggagcgcaacctggttaagcccgaagggaaggtgattgatctcggatgtggccgagggggatggtcatactattgcgctggcttaaaaaaggtcactgaggtgaaaggttacacaaaggggggaccgggccacgaagagccaatccctatggccacctacggctggaatctggtcaaacttcattccgggaaggacgtgtttttcatgcccccagaaaaatgtgatacgctgctatgcgacataggagagagtagccccaaccctaccattgaggaaggtagaacactcagggttctgaagatggtagagccgtggttgcggggcaatcagttttgtatcaagattctgaacccctatatgccatctgtggtcgaaactctcgagcagatgcaacgcaaacacgggggaatgcttgtgagaaatcctctgtccaggaactcaacccacgagatgtactgggttagctgcggcacaggtaatatcgtgtcggccgtcaacatgacttctcgaatgttactgaaccggttcaccatggcgcatcgtaagcccacatatgaaagagatgtggacttgggggctggaacccgccacgtagcagtggagcctgaagttgccaatctcgatataatcggccagaggattgagaacatcaaaaatgaacataagagtacttggcactacgacgaggataacccatataaaacgtgggcttaccacggctcctatgaggtcaagcccagcgggtcagcctcctctatggtgaatggagtggtccggctgctaacaaagccttgggacgttattccaatggtgacccagatcgcaatgactgataccacaccctttggtcaacagagagtattcaaagaaaaggtggacacgcgcaccccgagggccaaacgaggcactacacagattatggaggtcaccgctaagtggctttgggggtttctgagccggaacaaaaagcctagaatctgtactagggaagagttcacacgcaaggtgcgtagtaatgcggccataggagcagtttttgtggacgaaaaccagtggaattccgctaaagaggccgtcgaggatgaacggttctgggacctcgtgcatagagagagggaactgcacaagcaaggcaaatgcgcaacctgcgtatacaacatgatgggtaagcgcgagaaaaagttgggggaatttggaaaggccaaaggcagccgagctatttggtacatgtggctgggcgcccggttcctcgagttcgaggcgcttgggtttatgaatgaagatcattggttctctagagagaactcactgagtggagttgaaggtgagggcttacacaagctggggtatatcttgagggacatctccaaaattccaggaggcaatatgtacgcagatgacacagccggttgggatactcgcataaccgaggacgatctccagaacgaagctaagatcacggacattatggagcccgaacatgccctgctagcaaccagcatctttaaacttacatatcagaataaggtggtcagagtgcagcggcctgctaaaaacgggactgtgatggatgtcatttctaggcgtgaccaacgaggatcgggccaggttggcacctacgggctgaacacattcactaatatggaggtgcagctcatccgccagatggaatcagagggaatatttctgccaagcgagttggaaacccccaacttagccgagagagctctggattggctcgaaaagcacggtgccgagcggcttaagaggatggcaatctccggcgacgactgtgtagtgaaaccgattgatgaccgcttcgcgacggccctgacagctctaaatgatatggggaaggtcagaaaagacatccctcaatgggaacccagtaagggatggaacgattggcagcaggtgccattttgctctcaccatttccaccagctgattatgaaagacggccgggagatcgttgtgccttgtaggaatcaagatgagctcgtcggtcgagcccgtgtgagccagggggcaggatggtccttgagagaaaccgcttgcctgggcaagtcatatgcccagatgtggcaacttatgtactttcatcgccgggacctgaggctcgcagccaacgcgatatgtagtgctgtacccgttgattgggtgccaacttctagaacaacctggagcattcacgcccaccatcagtggatgactaccgaggacatgttatccgtctggaatcgcgtgtggatcgaagagaacccctggatggaagataagacacacgtttcaagctgggaggaggtgccttatctgggcaaacgggaagaccagtggtgcgggtctttgatcggactgacggcaagggccacctgggctactaatattcaggtcgccataaaccaagtgcgaagactcatcggtaatgagaactaccttgactacatgacatccatgaagcggttcaaaaatgaaagtgatccagagggcgcactgtggtga

SEQ ID NO: 13500 - RNA, 9879 nt, synthetic construct
  misc_feature 1..9879: note = derived and/or modified CDS sequence (opt3) from DENV-1__EU482611__SS-prME
  source 1..9879: mol_type = other RNA
agcgtgaccatgctgctcatgcttctgcccaccgcattggctttccacttaactacgaggggcggggagcctcatatgatcgtctccaagcaggaaaggggaaaatctctgttatttaagacctcagccggtgttaatatgtgcacactcattgccatggacctgggcgagctttgtgaagatactatgacctacaaatgcccacggataacagaggcggaaccggacgatgtggactgttggtgcaatgctaccgatacttgggtaacatatgggacctgtagtcaaacgggagagcaccgccgagagaagcgtagcgtggccctggcaccccatgtcggcttgggtctcgaaactagaaccgagacatggatgtcctctgaaggggcctggaaacagatccagagggtggagacttgggctctgcggcaccctggattcaccgttattgcatttttcctggcccatgctatcggcacatcgattacccagaagggcatcatatttatcctcttaatgctggtgacgccatcaatggccatgcgctgcgtcgggattggaaacagagacttcgtggagggtcttagcggcgcgacttgggtagatgttgtgttggaacacgggagttgtgtcacaaccatggcaaagaataaacccactctggacatcgagctactcaagacagaagtgaccaaccctgccgtgctgaggaaactttgcattgaggctaagatctccaatacgaccacagattctcggtgtccaactcaaggagaagccaccctggtcgaggagcaggacgcaaactttgtttgccgccgaacattcgtggatagaggctggggtaatgggtgtggattgtttggcaaaggcagcctcctgacttgcgctaagttcaagtgcgtaaccaaattagaagggaagatagtgcagtacgagaacctgaaatattccgtcattgtgacagttcacaccggagaccagcatcaagtgggtaatgaaactacggagcacggcacaatcgccaccattactccccaggcgcctacctcagaaatccagctcacagattacggggcccttaccctggactgtagtccaaggactggattggactttaacgagatggtcctactgacaatgaaggagaaaagctggctcgtgcataagcagtggttcctggatcttccgctgccctggacgtctggcgcatccacctcacaagaaacttggaatcggcaggacttgctcgtaacatttaaaaccgctcacgccaagaagcaggaggttgtggtcctgggtagccaagaaggggctatgcacacagccttaactggcgcaaccgagatccagacgagtggaaccacaactattttcgccggccatctgaaatgccgtctaaagatggataaactcaccctgaaggggatgtcttatgtgatgtgtacaggatccttcaaacttgaaaaggaggtcgctgagactcagcacggtaccgtgttggttcaggtgaagtacgaaggcacggacgcgccttgcaaaataccatttagcacacaagatgagaagggggtaacccagaacggacgcctgatcactgcaaatcccattgtcacagacaaagaaaagcctgtgaacatcgagaccgagccacccttcggcgaatcgtatatagttgtgggtgccggggagaaagctctcaagctgtcttggtttaagagaggctcctcaattggaaaaatgttcgaagccactgcaaggggcgcccggcgaatggctatccttggggataccgcctgggactttggaagtatcggtggcgtcttcacaagcgtggggaagctggtacatcaggtgtttggaacggcatacggcgttttgttctccggtgtctcttggaccatgaaaattgggatcggcattctcctgacttggttaggactgaatagccgctcaacaagtctatccatgacctgtatagcggtgggcatggtgacactctacctgggggtcatggttcaggctgatagcggatgcgtgatcaactggaagggcagagagcttaaatgtggttctgggatttttgtgactaacgaagtacacacctggacggagcaatataagttccaggccgactcaccgaagaggttgagtgcagccatcggaaaggcttgggaggaaggcgtctgcggtatccggagcgccacacgcctggagaatattatgtggaagcagatatccaacgaactcaatcatatcctgttagagaacgatatgaaactgaccgtggttgtgggcgacgcaaatgggattcttgctcagggaaagaaaatgatcagacctcaacccatggaacacaagtactcttggaaatcgtggggcaaggccaagattatcggggcggacatacagaacactacctttatcattgatggaccagacacacctgagtgtcccgatggccagagggcctggaatatctgggaggtcgaagactatggtttcggggtgtttactaccaacatttggttgaaactccgtgatagctacacacagatgtgcgaccaccggctgatgtccgctgcaatcaaggattcaaaagccgttcatgctgacatgggatattggatagagagtgaaaagaatgagacgtggaaactagcccgagcatctttcattgaagtgaagacctgtacttggccaaagagccacacactgtggtccaacggcgtactcgagtcagagatgatcattcccaaaatctacggtggccctataagccaacataattatagaccagggtacttcacccagactgcgggaccgtggcacctgggcaaacttgaattggattttgacctgtgcgaggggacaaccgtcgtggtggatgaacactgcggaaacaggggcccctctttacgcacgactaccgtcacaggtaaaatcattcatgagtggtgttgccggtcctgtaccctccctccactgagattcagaggggaagacggatgctggtacggcatggaaatccgccccgttaaggagaaagaagagaatcttgtgcgaagtatggtaagcgccggttctggcgaagtggattccttttcactggggattttgtgtgtcagtatcatgatagaggaggtgatgcggagccgttggtcgagaaagatgctcatgactggaacactggctgttttcctactgctcattatgggccagctgacctggaacgaccttatcaggttgtgcatcatggtgggggccaatgcatccgaccgcatgggaatgggcacaacttatctggctttaatggccacctttaagatgcggcctatgttcgcagtcggtctcctgtttagaaggcttacgtctcgagaagtgctgctactcacaattgggctgagcttggttgcctcagtggagctgccaaacagtttagaggaactcggagatggcctggctatgggcatcatgatgcttaaactgttgaccgagttccaaccccaccagctctggactaccctgctatccctgacatttgtcaagactaccctttctctcgactacgcgtggaaaacgacagccatggtactgagcattgtgtccttgttcccgctgtgtttatcaaccactagccagaagacaacctggctccctgttctgcttgggagttttggatgcaaaccactgactatgttcttgataacagagaacaagatctggggtcgcaagtcttggcccctcaatgagggcattatggcaatcgggattgtgtccatcctgctaagctcgctgcttaaaaacgatgtccctctcgctggacccctgatagccggcggtatgttgatcgcctgttatgtgatttcagggtctagtgctgacttatccctggaaaaggcagccgaggtaagctgggaacaggaggcggaacattctggagctagccacaatatcctcgtggaggtccaagatgacggcaccatgaaaattaaggatgaggaacgggacgatacgctgactatccttctgaaagccaccttgctagcagtttccggcgtgtacccaatgtcaatacctgccacactgtttgtgtggtatttctggcagaagaaaaagcagagaagtggggtcctctgggacacccccagcccaccggaggtggaaagggctgttctggatgacggaatttaccgtatccttcagcgcggtttactgggccggtctcaagtaggggtgggagtcttccaggatggcgtgtttcatacaatgtggcacgttactagaggtgcagtgctcatgtatcaggggaagaggttggagccttcctgggcctcagtcaaaaaggacctgatcagttacggaggcggctggcgattccaggggagctggaacaccggagaggaagtgcaagtaattgcggtcgagcccggtaaaaatccaaagaacgtgcagacgacacccggcacttttaaaacccctgaaggggaggttggagctatagccctcgacttcaagccaggcacatccggttctcccatcgtgaatcgggaagggaagattgtcggactgtacggcaacggcgtggttaccacttcggggacctatgtgagcgcaatcgcccaggctaaagcctcacaagagggacctcttccggagattgaagatgaggtctttaagaaacgcaatctgacaatcatggacttgcacccaggttccggcaagacgagaaggtacctacccgcaatagtgcgggaagctatcaaacgaaagctgagaactctcattttagcccctacccgcgtagtggcgagtgagatggccgaagcactgaaggggatgccaatcaggtatcagacaaccgctgttaaatctgagcatactggacgtgagattgtcgatcttatgtgccacgccacattcaccatgcggctgctcagccccgtgagagtgcctaactacaatatgatcataatggacgaagctcattttacggatccggcatccattgccgccaggggctatatctcaactcgcgtcggtatgggggaggctgcggcaatcttcatgacagccacacccccaggatctgtagaggcttttcctcagagcaacgccgtgattcaggacgaggaacgagatatccccgagagaagttggaactccggctacgactggataaccgatttcccaggcaagactgtttggtttgtgcctagcattaaatctgggaacgacatcgcaaattgtttgcggaagaacggaaaaagggtcattcaactgtcacgcaagacattcgataccgagtatcagaagaccaagaataatgactgggactacgtggttactacggatatctccgaaatgggtgccaacttccgtgctgacagagtgatagatccccggaggtgcctcaagccagtcattctgaaagacggcccggagcgcgtgatccttgcggggcctatgcccgtaaccgtggccagtgcagctcagcgaagaggacggatcggcaggaatcagaacaaggaaggtgatcaatacgtttatatggggcagccactaaataacgacgaggatcacgcccattggacagaggcaaaaatgctgttggacaatattaacactcccgaaggcatcattcctgccttatttgagccagaacgcgaaaagagcgctgccatagatggagaatacagactgaggggcgaggcgcggaagaccttcgtcgagctcatgcgtcgcggggacctgcccgtgtggctttcgtataaagtggcatctgaaggatttcagtactccgatcgaagatggtgcttcgacggtgagaggaataaccaggtcctggaagagaatatggatgttgaaatctggacaaaggagggcgagcggaaaaagctccgccctagatggttggacgccaggacctatagcgacccgctggctctacgggaatttaaagagttcgccgctgggcgaagatcagtgagtggagatctgattctcgaaatcggcaaacttccacaacacctgactttacgcgcacagaacgccttggacaatctggtaatgctccacaactctgagcagggtgggaaggcttacaggcatgccatggaggaactgcccgatacgatcgagacccttatgctgctcgcattgattgcggtgctgacaggcggagtcactttatttttcctatccggcaaggggctgggaaagaccagcataggtctcctttgtgtgacagcctcaagtgctctgttgtggatggccagcgttgaacctcactggatcgcagcttccattatcctggagtttttcctcatggtgctgcttattcccgaaccagaccggcagcgtacccctcaagataatcagctcgcctatgtcgtaatcggcctgttgtttatgatactgactgtggcagccaacgagatggggttactagagacaacgaaaaaggacctgggaatcggctacgttgctgcggaaaaccatcagcacgccaccatgctcgatgtggaccttcaccccgcatctgcttggactctgtacgccgtcgccacaaccgtgattaccccaatgatgagacatacaatcgagaatactacggcaaacattagcttgaccgctatcgccaatcaagcggctatactgatgggtctcgataaagggtggcctatttccaagatggacatcggcgtcccgctgcttgccttaggatgctattcacaggtgaaccccctgacactcactgcagccgttttgatgctggtggctcactacgcaattatcggcccagggctacaggccaaagcgaccagggaagctcagaagcgcacagccgcaggaataatgaagaatcctaccgtagatggcatcgtggccattgacctggatcccgtcgtttatgacgctaaattcgagaagcaactcggtcagatcatgcttctgattttgtgtacttctcagatcctgctcatgcggacgacatgggccctgtgcgaaagtataaccttagcaactgggccacttaccacactgtgggagggatcgcctggcaaattttggaacactaccattgctgtgagcatggccaatatcttccgaggttcctacctcgcgggcgccgggctagcattctctctgatgaagtcattgggaggcgggagaaggggaacaggcgctcagggtgagacgctgggggaaaaatggaagcgccaactcaaccagcttagcaagtccgagtttaatacctataaacggagtggaatcatggaagtcgacagatctgaggccaaggaaggcctgaaacgtggtgagactacaaagcatgcagtgagcaggggcaccgctaaattgcggtggttcgtagagcgcaacctggtgaagcccgaagggaaggttattgatctcggatgtggccgagggggatggtcatactattgcgccggcctgaaaaaggtgactgaggtcaaaggttacacaaaagggggaccgggccacgaggaaccaatccctatggccacctacggctggaatctagtgaaacttcattccgggaaggacgtctttttcatgcccccagaaaaatgtgatacgctgctatgcgacataggagagagtagccccaaccctaccattgaggaaggtagaacactcagggtgctgaagatggttgagccgtggttgcggggcaatcagttttgtatcaagattctgaacccctatatgccatctgtagtggaaactctcgagcagatgcaacgcaaacacgggggaatgcttgtcagaaatcctctgtccaggaactcaacccacgagatgtactgggtgagctgcggcacaggtaatatcgtttcggcggtgaacatgacttctcgaatgttactgaaccggttcaccatggctcatcgtaagcccacatatgaaagagatgtcgacttgggggcaggaacccgccacgtggccgtagagcctgaagtggctaatctcgatataatcggccagaggattgagaacatcaaaaatgaacataagagtacttggcactacgacgaggataacccatataaaacgtgggcctaccacggctcctatgaggttaagcccagcgggtcagcatcctctatggtcaatggagtggtgcggctgctaacaaagccttgggacgtcattccaatggttacccagatcgccatgactgataccacaccctttggtcaacagagagtgttcaaagaaaaggtagacacgcgcaccccgagggctaaacgaggcactacacagattatggaggtgaccgcgaagtggctttgggggtttctgagccggaacaaaaagcctagaatctgtactagggaagagttcacacgcaaggtccgtagtaatgccgcaataggagctgtgtttgttgacgaaaaccagtggaactccgccaaagaggcagtggaggatgaacggttctgggacctcgtccatagagagagggaactgcacaagcaaggcaaatgcgctacctgcgtgtacaacatgatgggtaagcgcgagaaaaagttgggggaatttggaaaggccaaaggcagccgagccatttggtacatgtggctgggcgcgcggttcctcgagttcgaggcacttgggtttatgaatgaagatcattggttctctagagagaactcactgagtggagtagaaggtgagggcttacacaagctggggtatatcttgagggacatctccaaaattccaggaggcaatatgtacgccgatgacacagctggttgggatactcgcataaccgaggacgatctccagaacgaagccaagatcacggacattatggagcccgaacatgcactgctagctaccagcatctttaaacttacatatcagaataaggttgtgagagtccagcggcctgccaaaaacgggactgtgatggatgtgatttctaggcgtgaccaacgaggatcgggccaggtcggcacctacgggctgaacacattcactaatatggaggttcagctcatccgccagatggaatcagagggaatatttctgccaagcgagttggaaacccccaacttagctgagagagccctggattggctcgaaaagcacggtgcagagcggcttaagaggatggcgatctccggcgacgactgtgtggtaaaaccgattgatgaccgcttcgccacggctctgacagccctaaatgatatggggaaggtgagaaaagacatccctcaatgggaacccagtaagggatggaacgattggcagcaggtcccattttgctctcaccatttccaccagctgattatgaaagacggccgggagatcgtggttccttgtaggaatcaagatgagctcgtgggtcgagcacgtgtcagccagggggctggatggtccttgagagaaaccgcctgcctgggcaagtcatatgcacagatgtggcaacttatgtactttcatcgccgggacctgaggctcgccgcgaacgctatatgtagtgccgtgcccgtagattgggttccaacttctagaacaacctggagcattcacgcacaccatcagtggatgactaccgaggacatgttatccgtgtggaatcgcgtctggatcgaagagaacccctggatggaagataagacacacgtgtcaagctgggaggaggttccttatctgggcaaacgggaagaccagtggtgcgggtctttgatcggactgacggccagggctacctgggccactaatattcaggtggcaataaaccaagtccgaagactcatcggtaatgagaactaccttgactacatgacatccatgaagcggttcaaaaatgaaagtgatccagagggcgctctgtggtga

SEQ ID NO: 13501 - RNA, 9879 nt, synthetic construct
  misc_feature 1..9879: note = derived and/or modified CDS sequence (opt3) from DENV-1__FJ639735__SS-prME
  source 1..9879: mol_type = other RNA
agcgtgaccatgctgctcatgcttctgcccaccgccttggctttccacttaactacgagaggaggggaacctcatatgatcgtctccaagcaggaaaggggaaaatctctgttgtttaagacctcagccggtgttaacatgtgcacactcattgccatggacctgggagaactttgtgaagatactatgacctacaaatgcccacggataacagaagcggaaccggacgatgtggactgttggtgcaatgctaccgatacttgggtaacatatgggacctgtagtcagacgggagagcaccgccgagacaagcgtagcgtggccctggcaccccatgtcggcttgggtctcgagactagaaccgaaacatggatgtcctctgagggggcctggaaacagatccagagggtggaaacttgggctctgcggcaccctggattcaccgttacagcactgtttctcgcccatgctattggcacctcgatcacgcagaagggcattatcttcatattactgatgcttgtgactccatcaatggccatgcgctgcgtcgggatcggaaacagagattttgtggagggtttgagcggcgcgacatgggtagacgttgtgctggagcacgggagttgtgtcaccactatggcaaagaataaacccacactagatattgaactcctgaagaccgaggtgacgaaccctgccgtgcttaggaaactgtgcatcgaagctaagatttccaataccacaactgactctcggtgtccaacccaaggagaggccacattggtcgaagaacaggatgcaaacttcgtttgccgccgaacttttgtggacagaggctggggtaatgggtgtggactcttcggcaaaggcagcctgttaacctgcgctaagtttaagtgcgtaacaaaactggaggggaagatcgtgcagtacgaaaacctcaaatattccgtcatagtgaccgttcacactggagatcagcatcaagtgggtaatgagacgacagaacacggcaccattgccactatcacaccccaggcgcctacatcagagattcagcttaccgactacggggccctgactttggactgtagtccaaggacaggactagatttcaacgaaatggtcctgctcacgatgaaggagaaaagctggctggtgcataagcagtggtttcttgacctgccgttgccctggacctctggcgcatccacttcacaagagacatggaatcggcaggatctcctggtaaccttcaaaacagctcacgccaagaagcaggaagttgtggtcttaggtagccaagagggggctatgcacactgccctgaccggcgcaacggaaatccagaccagtggaacaactaccatctttgccggccatctaaaatgccgtctcaagatggacaaactgacacttaaggggacttcttatgtgatgtgtaccggatccttcaaattggagaaggaagtcgctgagacgcagcacggtacagtgctggttcaggtgaagtacgagggcaccgatgcgccttgcaaaattccattcagcactcaagacgaaaagggggtaacacagaacggacgcctcataaccgcaaatcccatcgtcactgataaagagaagcctgtgaacattgaaaccgagccaccctttggcgagtcgtatatcgttgtgggtgccggggaaaaagctctgaaactttcttggttcaagaaaggctcctcaataggaaagatgtttgaggccacagcaagaggcgccaggcggatggctattctgggggacacggcctgggatttcggaagtatcggtggcgtctttaccagcgtggggaaattggtacatcaggtgttcggaactgcatacggcgttctcttttccggtgtctcttggacaatgaagatcgggattggcatcctgttaacctggctgggactaaatagccgatcaacaagtctctccatgacttgtattgcggtgggcatggtgaccctgtaccttggggtcatggttcaggctgacagcggatgcgtgataaactggaaaggccgcgaattgaagtgtggttctgggatcttcgtgacgaacgaggtacacacatggaccgaacaatataagtttcaggccgattcaccgaaaagactgagtgcagccattggaaaggcttgggaggagggcgtctgcggtatcaggagcgccactcggctcgaaaatatcatgtggaaacagatttccaacgagctgaatcatatattactggaaaacgacatgaagttcaccgtggttgtgggcgacgcaaatgggatccttgctcagggcaagaagatgattcgccctcaacccatggagcacaaatactcttggaagtcgtggggcaaggccaaaatcattggggcggatatccagaacacaacttttataatcgacggaccagatacccctgaatgtcccgacgatcagagagcctggaatatttgggaggtcgaggactatggcttcggtatctttacaacgaacatttggttgaagctcagggatagctacacccagatgtgcgaccaccgtctgatgtccgctgcaatcaaagattcaaaggccgtgcatgctgacatggggtattggatagaaagtgagaaaaatgaaacttggaagctagcccgggcatctttcattgaggttaagacatgtacctggccaaaaagccacactctgtggtccaacggagtgctcgaatcagagatgatcattcccaagatctacggcggtcctataagccaacataattatcgaccaggctacttcacacagaccgcggggccgtggcacctgggaaaacttgagttggattttaacctgtgcgaaggcacgactgtagtcgtggacgagcactgcgggaatagaggaccctctttaaggaccacaaccgtgactggcaagatcattcatgaatggtgttgccgctcctgtacactccctccactgcggttcagaggtgaggatgggtgctggtacggaatggagatcaggcccgtcaaagaaaaggaggaaaaccttgttcgcagtatggtgagcgccggctctggtgaggtagactccttttcactgggcattttgtgtgtgagtatcatgatagaagaggtcatgcgaagccggtggtcgcgtaagatgctcatgaccgggacactggctgtgttcctactgctcattatgggacagctgacttggaatgaccttatcagattgtgcatcatggttggcgccaacgcatccgataggatggggatgggaaccacgtatctggctttaatggccacatttaaaatgcgccctatgttcgcagtgggcctcctgtttcggagacttacctctagggaggtcctgctactcactattggtctgagcttggtggcctcagttgaactgccaaacagtttagaggaactcggggacggactggctatgggcatcatgatgcttaagctgttgaccgagttccaaccccaccagctctggacaactctgctatccctgacctttattaaaacgacactttctctcgattacgcgtggaagaccactgccatggcactgagcatagtgtccttgttcccgctgtgtttatcaacaaccagccagaaaactacatggctccctgtcctgcttggcagttttgggtgcaagccactgaccatgttcttgatcacggaaaataagatttggggacgaaaatcttggcccctcaacgagggtatcatggctattggcatcgtatccatactgctaagctcgctgcttaagaatgacgtgcctctcgccgggcccctgatcgccggaggcatgttgattgcttgttatgttatctcaggttctagtgcagatttatccctggagaaagccgcggaagtgagctgggagcaggaagctgagcattctgggactagccacaacattctcgtcgaagtgcaagacgatggaaccatgaagatcaaagacgaggagaaggatgacacactgaccatacttctgaaagccacattgctagcagtatccggcgtgtacccaatgtcaattcctgccactctgtttgtctggtatttctggcagaagaagaaacagcgcagtggcgttctctgggatacccccagcccaccggaagtggagcgggctgtgctggacgatgggatctacagaatccttcagaggggattactgggtcgttctcaagtcggcgtgggggttttccaggacggagtatttcatacgatgtggcacgtgacacgcggcgcagtcctcatgtatcagggtaagcggttggaaccttcctgggcctcagtgaaaaaggacctgattagttacgggggaggctggagattccagggcagctggaatactggggaggaggttcaagtgatagcggtcgaacccggcaagaacccaaagaatgtgcagaccacacccggtacctttaagactcctgagggcgaagtaggggctatcgccctcgatttcaaaccaggaacctccggctctcccattgtcaacagggagggtaagatcgtggggctgtacggaaatggcgttgtgacaacgtcgggcacttatgtcagcgcaattgcccaggctaaagcctcacaagaagggcctcttccggagatcgaggacgaagtgtttaagaaacgaaacctgaccataatggatttgcacccaggatccggtaagacacggcgctacctacccgcaatcgttagagaggctattaagaggaaactgcggaccctcatcttagcccctactcgagtggtcgcgagtgaaatggccgaggcactgaagggcatgccaattagatatcagacaaccgctgtgaaatctgaacatacggggcgcgagatcgtagaccttatgtgccacgccactttcacaatgaggctgctcagccccgtgcgtgttcctaattacaacatgatagtcatggatgaggctcattttaccgacccggcatccattgccgcccggggatatatctcaaccagagtgggcatgggtgaagctgcggcaatcttcatgactgccacacccccagggtctgtggaggcttttcctcagagcaatgccgtcattcaggatgaagagagggacatccccgaacgcagttggaactccggatacgattggataaccgacttcccaggcaagacagtatggtttgtgcctagcattaaatctggcaatgatatcgcaaactgtttgcgaaagaacgggaagagagttattcaactgtcacggaaaactttcgacacggagtatcagaagaccaaaaataacgactgggattacgtggtcacaactgacatctccgagatgggagccaatttcagggctgatcgcgtgatagacccccgtagatgcctcaagccagttattctgaaagatggtccggaacgggtgatccttgcgggccctatgcccgtcaccgtggccagtgcagctcagaggcgcgggcgaatcggaagaaaccagaataaggagggcgaccaatacgtatatatgggtcagccactaaacaatgatgaagaccacgcccattggacagaggcaaagatgctgttggataacattaatacccccgaggggatcattcctgccttatttgaaccagagcgggaaaagagcgctgccatagacggcgagtacaggctgcgcggagaggcgagaaagactttcgtggagctcatgaggcggggcgatctgcccgtttggctttcgtataaagtcgcatctgaggggtttcagtactccgaccgtcgctggtgcttcgatggagaacgaaacaatcaggtgctggaggaaaacatggacgtggagatctggacgaaggaaggtgagaggaagaagctcaggcctcggtggttggacgcccgcacctatagcgatccgctggctctaagagagtttaaagagttcgccgctggcaggcggtcagtcagtggggacctgattctcgagatcggaaaacttccacaacacctgacattacgagcacagaatgccttggataacctggttatgctccacaattctgaacagggcggtaaggcttacagacatgccatggaggaactgcccgacactatcgagacccttatgctgctcgcattgattgcggtgctgacagggggcgtaaccttatttttcctatccggaaaaggcctggggaagactagcataggactcctttgtgtgacagcctcaagtgctctgttgtggatggccagcgtcgagcctcactggatcgcagcttccattatcctggaatttttcctcatggtgctgcttattcccgagccagatcgccagaggacgcctcaagacaaccagctcgcctatgttgtgatcggtctgttgtttatgatactgaccgtcgcagccaacgaaatgggcttactagagactacaaaacgggatctggggatcggacatgtagctgcggagaatcaccagcacgccaccatgctcgacgtggatcttcgtcccgcatctgcttggaccctgtacgccgttgccacaactgtgattacgccaatgatgagacataccatcgaaaacacaactgcaaatattagcttgaccgctatcgccaaccaagcggctatactgatgggcctcgacaagggttggcctatttccaaaatggatatcggggtcccgctgcttgccttaggctgctactcacaggtgaatcccctgacactcaccgcagccgtcttgatgctggtggctcactatgcaattatcggaccaggcctacaggccaaggcgactagggaggctcagaagcgcacggccgcagggataatgaaaaaccctacagttgacggaatcgtggccattgatctggaccccgtagtgtacgacgctaagttcgaaaaacaactcggccagatcatgcttctgattttgtgtacctctcagatcctgctcatgcggactacctgggccctgtgcgagagtataacattagcaactggtccacttaccacactgtgggaagggtcgcctggaaagttttggaatacgaccattgctgtcagcatggccaacatcttccgaggctcctatctcgcgggtgccggcctagcattctctctgatgaaatcactagggggaggcagaagggggactggagctcagggcgagacactgggtgagaagtggaagcgccaactcaatcagcttagcaaatccgaatttaacacctacaagcggagtgggatcatggaggttgatagatctgaagccaaagagggactgaagcgtggcgaaactacaaaacatgcagtgagcaggggtaccgctaagttgcggtggttcgtcgagcgcaatctggtgaagcccgagggcaaagtaattgacctcgggtgtggacgaggcgggtggtcatattactgcgccggattaaagaaagtgacggaagttaagggctataccaaaggtgggccgggacacgaggaaccaatccctatggccacatacggctggaacctggtgaaacttcattccggcaaagatgtctttttcatgcccccagagaagtgtgacactctgctatgcgatataggggaaagtagccccaatcctaccattgaggagggaagaacactcagggtgctgaagatggtcgaaccgtggttgcggggtaaccagttttgtatcaaaattctgaatccctacatgccatctgtggttgagactctcgaacagatgcaacgcaagcacggcgggatgcttgtaagaaaccctctgtccagaaattcaacccacgagatgtattgggtgagctgcggaacaggcaacatcgtctcggcggtgaacatgacctctcgaatgttactgaatcggttcactatggctcatcgtaaacccacgtacgagagagacgttgatttgggtgcagggacacgccacgtggccgtcgaacctgaggtggctaacctcgacataatcggacagaggattgaaaatatcaagaacgagcataaaagtacctggcactatgatgaagacaatccatacaagacttgggcctatcacggctcctacgaggtaaagcccagcggctcagcatcctctatggtgaacggggttgtccggctgctaaccaaaccttgggatgtgattccaatggtgacacagatcgccatgacggacaccactccctttggacaacagagagtcttcaaggagaaagttgacacacgcaccccgagggctaagcgaggtactacacagattatggaagtgaccgcgaaatggctttggggctttctgagccggaataagaagcctagaatctgtacaagggaggagttcactcgcaaagtacgtagtaacgccgcaataggggctgtgtttgtcgatgagaatcagtggaactccgccaaggaagcagtggaggacgagcggttctgggatctcgttcatagagaaagggagctgcacaaacaaggaaagtgcgcaacctgcgtgtataatatgatgggcaaacgcgaaaagaagttgggtgagtttgggaaagctaagggaagccgagccatttggtacatgtggctgggcgcgcggttcctcgagttcgaggcacttggctttatgaacgaggaccattggttctctagagaaaattcactgagtggggtcgagggagaaggtttacacaaactgggctacatcttgagggatatctccaagattccagggggaaacatgtatgccgacgatacggctggctgggacacccgcataacagaggatgacctccagaatgaggccaaaatcactgatattatggaacccgagcatgcactgctagctaccagcatctttaaacttacataccagaacaaagtggtaagagttcagcggcctgccaagaacggtactgtgatggacgtcatttctaggcgtgatcaacgagggtcgggacaggtgggcacctatggcctgaatacgttcacaaacatggaagtgcagctcatccgccagatggagtcagaagggatatttctgccaagcgagttggagacccccaatttagctgaaagagtcctggactggctcgagaagcacggagccgaacggcttaaaaggatggcaatctccggtgacgattgtgttgtgaagccgattgacgatcgcttcgcgactgccctgacagctctaaacgacatgggcaaagtaagaaaggatatccctcaatgggagcccagtaaagggtggaatgactggcaacaggtgccattttgctctcaccatttccaccagctgattatgaaggatggacgggaaatcgtcgtgccttgtaggaaccaagacgagctcgttggccgagcccgtgtgagccagggtgcagggtggtccttgagagagaccgcttgcctgggaaagtcatacgcccagatgtggcaacttatgtattttcatcgccgggatctgaggctcgcagccaatgcgatatgtagtgctgtccccgtggactgggtaccaacttctagaaccacatggagcattcacgcccaccatcagtggatgacgaccgaagatatgttatccgtttggaaccgcgtgtggatcgaggaaaatccctggatggaggacaaaactcacgtctcaagctgggaagaggtgccttacctgggcaagcgggaggaccagtggtgcggctctttgatcgggctgacagcaagggccacctgggctactaacattcaggttgccataaatcaagtgcgaagactcatcggaaacgaaaattatcttgattacatgacatccatgaaacggttcaagaacgagagtgacccagaaggtgcactgtggtga

SEQ ID NO: 13502 - RNA, 9879 nt, synthetic construct
  misc_feature 1..9879: note = derived and/or modified CDS sequence (opt3) from DENV-1__FJ639740__SS-prME
  source 1..9879: mol_type = other RNA
agcgtgaccatgctgctcatgcttctgcccacagccttggctttccacttaactacgagaggcggggagcctcatatgatcgtctccaagcaggaaaggggaaaatctctgctatttaagacctcagcaggtgttaacatgtgcacactcattgccatggacctgggcgagctttgtgaagatactatgacctacaaatgcccacggataacagaggcggaaccggacgatgtggactgttggtgcaatgctaccgatacttgggtaacatatgggacctgtagtcaaacgggagagcaccgccgagacaagcgtagcgtggccctggcaccccatgtcggcttgggtctcgagactagaaccgaaacatggatgtcctctgagggggcctggaaacagatccagagggtggaaacttgggctctgcggcaccctggattcaccgttattgcactgtttctcgcccatgctatcggcacatcgattacccagaagggcatcatattcatcttactgatgcttgtgacgccatcaatggccatgcgctgcgtcgggattggaaacagagattttgtggagggtttgagcggcgcgacttgggtagacgttgtgctggagcacgggagttgtgtcacaaccatggcaaagaataaacccactctagatatcgaactcctgaagacagaggtgaccaaccctgccgtgcttaggaaactgtgcattgaagctaagatctccaatacgaccacagactctcggtgtccaactcaaggagaggccaccttggtcgaagagcaggatgcaaacttcgtttgccgccgaacactcgtggacagaggctggggtaatgggtgtggactgtttggcaaaggcagcttactgacttgcgctaagttcaagtgcgtaaccaaactcgaggggaagatagtgcagtacgaaaaccttaaatattccgtcattgtgacagttcacaccggagatcagcatcaagtgggtaatgagactacggaacacggcacaatcgccaccattactccccaggcgcctacctcagagatccagctgacagactacggggccttgaccctagactgtagtccaaggactggactggattttaacgaaatggtcctcctgacaatgaaggagaaaagctggcttgtgcataagcagtggttcctggacttgccgctcccctggacgtctggcgcatccacctcacaagagacttggaatcggcaggatctgttagtaacatttaaaaccgctcacgccaagaagcaggaagttgtggtcctgggtagccaagagggggctatgcacacagccctaactggcgcaaccgaaatccagacgagtggaaccacaactattttcgccggccatctcaaatgccgtctgaagatggacaaacttaccttgaaggggatgtcttatgtgatgtgtacaggatcctttaaactggagaaggaagtcgctgagactcagcacggtaccgtgctcgttcaggtgaagtacgagggcacggatgcgccttgcaaaataccattcgcaacacaagacgaaaagggggtaacccagaacggacgcctgatcactgccaatcccattgtcacagataaagagaagcctgtgaacatcgaaaccgagccacccttcggcgagagctatatagttgtgggtgctggggaaaaagcccttaagctgtcgtggtttaagaaaggctcttccattggaaagatgttcgaggcaactgccagaggcgctaggcggatggccatcttgggggacaccgcatgggattttggatcaatcggtggcgtcttcacaagtgtggggaaactcgtacatcaggtgtttggaacggcgtacggcgttctgttcagcggtgtctcctggaccatgaagattgggatcggcattttactgacttggctaggactcaattctcgaagcacatcactgagtatgacctgtatagctgtgggcatggtgacactttacttgggggtcatggttcaggccgactccggatgcgtgatcaactggaaaggccgcgaactgaagtgtggtagcgggatttttgtgactaacgaggtacacacctggacggaacaatataagttccaggcagattctccgaaaagactctcagccgctatcggaaaggcctgggaggagggcgtctgcggtatcaggagtgcaacacggctggaaaatattatgtggaaacagataagcaacgagttaaatcatatcctgcttgaaaacgacatgaagtttaccgtggttgtgggcgacgctaatgggattttggcccagggaaaaaagatgatccgccctcaacccatggagcacaaatactcctggaagtcttggggcaaggcgaaaattatcggggccgatatacagaacactaccttcatcattgacggaccagatacacctgaatgtcccgacggccagagagcttggaatatctgggaggtcgaggattatggttttgggattttcactaccaacatctggctcaagctgagggactcgtacacacagatgtgcgatcaccgtctaatgagcgcagccataaaagactccaaggctgtgcatgccgatatgggatattggattgaatcagagaaaaatgaaacgtggaagctggcacgggcgagttttatcgaggttaagacctgtacttggccaaaatctcacacactctggagcaacggcgtgctggaatccgagatgattatccccaagatatacggtggccctatctcacaacataattatcgaccagggtacttcacccagactgccggaccgtggcaccttggcaaattggagctggacttcgatttatgcgaagggacaaccgtagtcgtggacgagcactgcggaaacagaggccccagcctcaggacgactaccgtgacaggtaagattatccatgaatggtgttgccgctcttgtaccctgcctccacttcggtttagaggggaggatggatgctggtacggcatggagattaggcccgtcaaagaaaaggaggaaaatctggttcgctccatggtgagtgctggtagcggcgaggtagactctttctccttggggatcctctgtgtgtcaataatgattgaagaggtcatgcgaagtcggtggagccgtaagatgctgatgactggaacactagccgtgtttctgctcctgatcatgggccagcttacctggaacgacttgatcagactgtgcattatggttggggcaaatgcttcggataggatgggaatgggcacaacttatttagccctcatggcaaccttcaaaatgcgccctatgtttgccgtgggtctgcttttccggagactgacgtccagggaggtcctactcctgacaatcgggttgtctctggtggctagcgttgaattaccaaactcactcgaggaactgggagacggccttgcgatgggcattatgatgctgaagttgctcaccgagtttcaaccccaccagctgtggactaccctactgagtcttacattcgtgaaaactaccctctccctggattacgcctggaagacgacagcaatggtcttgtctatagtaagcctgtttccgttatgtctctccaccacttcacagaaaacaacctggctgcctgtgcttctggggagcttcggatgcaagccattgactatgtttctcatcacagaaaacaagatttggggtcgaaaaagttggcccctgaatgagggcatcatggctattgggatcgtttctatactactgtccagccttctcaagaacgacgtgcctctggccggacccttgatcgccggcggtatgttaattgcttgttatgtcatctcggggtcatctgcagatctgagtctcgagaaagccgcggaagtgtcctgggagcaggaagctgagcatagcggagcctctcacaatattctggtagaagtgcaagacgatggcaccatgaagatcaaagacgaggagcgcgatgacacgcttactatactgttgaaggcaaccctactggccgtcagcggcgtttacccaatgtccattcctgctacactcttcgtgtggtatttttggcagaaaaagaagcagcggtcaggggtgctgtgggatacccccagtccaccggaagtcgagagagcagtgcttgacgatggaatctacaggatcttacagcgtggtctgctcggccgcagccaagttggggtaggagtgttccaggacggcgtcttccatacaatgtggcacgtgactcggggtgccgttttgatgtatcaggggaaaagactggaaccttcttgggcgtccgtgaagaaagacctcatttcatacggaggcggctggaggtttcaggggagttggaacaccggagaggaggtccaagtgatagctgtagaacccggtaagaatccaaaaaacgtccagacgacacccggcactttcaagacccctgagggggaagtgggagccatcgcactggattttaagccaggcacaagcggttcccccattgttaatcgagaggggaaaatcgtgggactttacggcaacggcgtcgtgaccacttctgggacctatgtttcggccattgctcaggccaaggcaagccaagaaggacctctgccggagatcgaggacgaagtgttcaaaaagcggaatttgacaataatggatctacacccaggttcaggcaaaacgcgcagatacctgcccgctatcgtcagggaggccattaagcggaagctccgaactttaatcctggcgcctaccagagtggtagcctccgaaatggcagaggctcttaaagggatgccaattcgctatcagacaaccgccgtgaagagtgaacatactggaagggagatcgttgacctgatgtgccacgctacatttaccatgcgtctcttgtctcccgtccgggtgcctaactacaatatgataattatggatgaggcacatttcacggacccggccagcatcgccgctagaggctatatctccactagggtgggtatgggggaagcggcagccatttttatgacagctacccccccaggatcagtcgaggccttccctcagtctaacgcagtaatccaggatgaagagcgcgacatacccgaacgaagctggaatagtggctacgattggattaccgactttccaggcaaaactgtgtggttcgttccttccatcaagagcgggaacgatattgccaattgtctgagaaaaaacggaaagcgggtgatccaactctctaggaagacatttgacaccgagtatcagaaaacaaagaacaatgactgggattacgtcgtgactacggacatatcagagatgggtgctaacttccgcgcggatcgtgttattgaccccagacggtgcctgaaaccagtgatccttaaggatggcccggaaagggtcatcctagccgggcctatgcccgtgaccgtagcatccgctgcccagcgccgaggaagaattggccggaatcagaacaaagagggtgaccaatacgtgtatatggggcagccactgaataacgatgaagaccacgcacattggacagaggccaagatgttgttagataatatcaacactcccgagggcattatacctgctctgttcgaaccagagagggaaaagagtgccgcgatcgacggagagtaccgcctcagaggcgaagcaaggaaaacctttgttgagctgatgcggcgtggggatcttcccgtctggctgagctataaggtggcctcggagggattccagtactctgaccgccgatggtgctttgatggtgaaagaaataaccaggtgctcgaggaaaatatggacgtcgagatttggacaaaagaaggcgagaggaagaaattgcggcctcgctggctggacgctagaacctattccgatccgctagccctgagggagttcaaggaatttgctgcagggcggcgaagcgtttcaggagacctcatccttgagatcggcaaactgccacaacacttaactttgagagcccagaacgctctggataatctcgtgatgctgcacaacagtgaacagggtgggaaggcctaccgccatgcaatggaggaacttcccgacacgattgagaccctgatgctcttggcgctgatagccgtattaacaggcggagtgactctattctttctgtctggcaaggggctcggaaaaacctccatcggtcttctgtgtgtcacagctagctcagccttgctgtggatggcaagtgtggagcctcactggattgctgccagcatcattctcgaattctttctgatggttcttctcatccccgagccagataggcagcggacccctcaagacaatcagctggcatatgtggtcataggcttgctgttcatgatcttaactgtagccgctaacgaaatggggctactggagacaacgaagaaagatctcggaattggctacgtggcggccgagaaccatcagcacgcaaccatgcttgacgttgatctgcgtcccgcttccgcctggactttgtacgccgtggcaacaaccgtcatcaccccaatgatgagacacacaattgaaaatactacggctaacatctctctgaccgccatagcgaatcaagctgccattctcatgggtctggacaaggggtggcctatcagcaaaatggatattggcgtgccgcttttagcactgggatgctattcccaggtcaaccccctcacattgactgccgctgtgctgatgctagttgcacattacgccatcataggcccagggctgcaggcgaaggctaccagggaggcccagaagcgcacagcagccggaatcatgaaaaatcctaccgtggacggcattgtagctatcgatctcgaccccgtggtctatgacgccaagtttgaaaaacaacttggtcagattatgctgttgatcctgtgtacttcacagatactcctgatgcggacgacatgggcattatgcgagtctattacccttgctactgggccactgaccacactctgggaaggaagtcctggcaagttctggaacactaccatcgccgtttcgatggcgaatatctttcgaggtagctacctagccggcgcagggctggctttctccttgatgaaatctctgggaggcgggagaaggggaacaggcgcccagggtgagacgctcggggagaagtggaagcgccaacttaaccagctgtcaaaaagcgaattcaatacctataagcggtccggaattatggaggtggatagaagtgaagcaaaagagggcttgaagcgtggtgaaactacaaaacacgctgtctctaggggcaccgccaagctgcggtggtttgtggagcgcaacctcgtaaagcccgaggggaaagtgatcgacttaggatgtggccgagggggatggagctactattgcgccggcctgaagaaagttactgaagtgaagggttacacaaaagggggaccgggccatgaggaaccaatacctatggcgacctacggctggaatcttgtcaagctgcactcagggaaagatgtgttctttatgcccccagagaagtgtgacacgctactctgcgatattggagaatccagtcccaaccctaccatcgaggagggtagaacactgagggtcttgaagatggtggaaccgtggctgcggggcaatcagttctgtattaaaatcctcaacccctatatgccaagcgttgtagagactcttgaacagatgcaacgcaagcatgggggaatgctggtgagaaatcctttatctaggaactccacccacgagatgtactgggtctcatgcggcacaggtaatatagtgagcgctgttaacatgacttcgcgaatgctgttgaaccggtttaccatggcacaccgtaaacccacatatgagagagacgtggatctcggggccggaacccgccatgtcgctgtggaacctgaggaagccaatctggacatcattggccagaggatcgagaacattaagaatgaacacaaatctacttggcattacgatgaggacaacccatataagacgtgggcataccacggcagttatgaggtaaagccctccgggagcgcctcatccatggtgaatggagttgtccggctacttacaaaaccttgggatgtgatcccaatggtgacccagattgctatgactgacaccacacccttcggtcaacagagagtctttaaggaaaaagttgacacgcgcaccccgagggcgaagcgaggcactacacagatcatggaggtgaccgccaaatggctgtgggggttcctctctcggaacaagaagcctagaatatgtactagggaagagtttacacgcaaagtacgtagcaatgcagctattggagccgtgttcgtcgatgaaaaccagtggaatagtgcaaaggaggccgtggaggacgaacggttttgggatctggttcacagagagagggaattgcataaacaaggcaagtgcgctacctgcgtgtacaacatgatgggtaaacgcgagaagaagctgggggaattcggaaaagccaagggctcccgagcgatctggtacatgtggctcggcgcacggtttcttgagttcgaggccctggggttcatgaatgaagaccactggtttagcagagagaactctttatcaggagtcgaaggtgagggcctgcataaattggggtatatcctcagggatattagtaagataccaggaggcaatatgtacgctgacgatacagccggttgggacactcgcatcaccgaggatgacctgcagaacgaagcaaaaattacggatatcatggagcccgaacacgctctacttgccacctccattttcaagctgacatatcagaataaagtggtaagagttcagcggcctgctaagaacgggactgtgatggacgtcatcagcaggcgtgatcaacgaggatctggccaggtgggcacctacgggctcaacacatttactaatatggaggtgcagctgatacgccagatggaatcggagggaatcttcttgccatcagagttagaaacccccaacctggccgagagagtcctcgactggcttgaaaagcatggtgcagagcggctgaaaaggatggcgattagcggcgacgattgtgttgtgaagccgatcgacgatcgctttgccacggctctaacagccctgaatgacatggggaaagtaagaaaggatattcctcaatgggaaccctccaaaggatggaacgactggcagcaggtgccattctgcagtcaccactttcatcagctcatcatgaaggatggccgggagatagtcgtgccttgtaggaatcaagacgagttggttggtcgagcacgtgtgtctcagggggctggatggagcctgagagaaaccgcctgccttggcaagtcctatgcacagatgtggcaactgatgtacttccaccgccgggatctcaggttagccgcgaacgctatttgttcagccgtccccgtggactgggtaccaactagtagaacaacctggtctatccatgcacaccaccagtggatgactaccgaggatatgctgagcgtttggaatcgcgtgtggatcgaagagaacccctggatggaagacaaaacacatgtctcctcatgggaggaggtgccttatttgggcaagcgggaagaccagtggtgcgggagcctgattggactcacggccagggctacctgggccactaatatacaggttgcaatcaaccaagtgcgaagacttattggtaatgagaactacctggattacatgacatctatgaaacggtttaagaatgaatccgacccagagggcgctctatggtga

SEQ ID NO: 13503 - RNA, 9879 nt, synthetic construct
  misc_feature 1..9879: note = derived and/or modified CDS sequence (opt3) from DENV-1__FJ639741__SS-prME
  source 1..9879: mol_type = other RNA
agcgtgaccatcctgctcatgcttctgcccacagcattggctttccacttaactacgagaggaggggaacctcatatgattgtctccaagcaggaaagaggaaaatctctgttatttaagacctcagccggtgttaatatgtgcacactcatagcaatggacctgggagaactttgtgaagatactatgacctacaaatgcccacggatcacagaagcggaaccggacgatgtggactgttggtgcaatgctaccgatacttgggtaacatatgggacctgtagtcagacgggagaacaccgccgagacaagcgtagcgtggccctggcaccccatgtcggcttgggtctcgagactagaaccgaaacatggatgtcctctgagggggcctggaaacagattcagagggtggaaacttgggctctgcggcaccctggattcaccgttatcgcactgtttctcgcccatgctattggcacatcgatcacccagaagggcattatcttcattttactgatgcttgtgacgccatcaatggccatgcgctgcgtcgggatcggaaacagagattttgtggagggtttgagcggcgcgacttgggtagacgttgtgctggagcacgggagttgtgtcacaaccatggcaaagaataaacccactttggatattgaactcctgaagacagaggtgaccaaccctgccgtgcttaggaaactgtgcatcgaagctaagatatccaatacgaccacagactctcggtgtccaactcaaggagaggccaccttggtcgaagaacaggatgcaaacttcgtttgccgccgaacatttgtggacagaggctggggtaatgggtgtggactcttcggcaaaggcagcctgttaacttgcgctaagtttaagtgcgtaaccaaactggaggggaagattgtgcagtacgaaaacctcaaatattccgtcatcgtgacagttcacaccggagatcagcatcaagtgggtaatgagactacggaacacggcacaattgccaccatcactccccaggcgcctacctcagagatccagcttacagactacggggccctgaccttggactgtagtccaaggactggactagatttcaacgaaatggtcctgctcacaatgaaggagaaaagctggctggtgcataagcagtggtttcttgacctgccgttgccctggacgtctggcacctccacttcacaagagacatggaatcggcaggatctcctggtaaccttcaaaacagcacacgctaagaagcaggaagttgtggtcttaggtagccaagagggggccatgcacactgctctgaccggcgccacggaaattcagaccagtggaacaactaccatatttgcaggccatctaaaatgccgtctcaagatggacaaactgacacttaaggggacttcttatgtgatgtgtaccggatccttcaaattggagaaggaagtcgccgagacgcagcacggtacagtgctggttcaggtgaagtacgagggcaccgatgctccttgcaaaatcccattcagcactcaagacgaaaagggggtaacacagaacggacgcctcattaccgcgaatcccatcgtcactgataaagagaagcctgtgaacatagaaaccgagccaccctttggcgagtcgtatattgttgtgggtgcaggggaaaaagccctgaaactttcttggttcaagaaaggctcctcaatcggaaagatgtttgaggctacagccagaggcgcaaggcggatggccatcctgggggacacggcttgggatttcggaagtattggtggcgtctttaccagcgtggggaaattggtacatcaggtgttcggaactgcctacggcgttctcttttccggtgtctcttggacaatgaagatcgggattggcatactgttaacctggctgggactaaatagccgatcaacaagtctctccatgacttgtatcgcagtgggcatggtgaccctgtaccttggggtcatggttcaggcggacagcggatgcgtgattaactggaaaggccgcgaattgaagtgtggttctgggatcttcgtgacgaacgaggtacacacatggaccgaacaatataagtttcaggctgattcaccgaaaagactgagtgccgcaatcggaaaggcctgggaggagggcgtctgcggtattaggagcgctactcggctcgaaaatataatgtggaaacagatctccaacgagctgaatcatattttactggaaaacgacatgaagttcaccgtggttgtgggcgacgccaatgggatccttgcacagggcaagaagatgattcgccctcaacccatggagcacaaatactcttggaagtcgtggggcaaggctaaaatcataggggccgatatccagaacacaacttttattatcgacggaccagatacccctgaatgtcccgacgatcagagagcgtggaatatttgggaggtcgaggactatggcttcggtatctttacaacgaacatatggttgaagctcagggatagctacacccagatgtgcgaccaccgtctgatgtccgccgctattaaagattcaaaggcagtgcatgccgacatggggtattggatcgaaagtgagaaaaatgaaacttggaagctagctaaggcctctttcattgaggttaaaacatgtatctggccaaagagccacaccctgtggtccaacggagtgctcgaatcagagatgataatccccaaaatttacggcggtcctatcagccaacataattatcggccaggctacttcactcagacagcagggccgtggcacctgggaaaacttgagttggattttgacctgtgcgaaggcaccacggtagtcgtggatgagcactgcgggaaccgaggaccctctttaagaactaccacagtgaccggcaaaattatccatgaatggtgttgcaggtcctgtactctccctccactgcgcttccggggtgaggacgggtgctggtacggaatggagataagacccgtcaaggaaaaggaggaaaatcttgttaggagtatggtgagcgcgggctctggtgaggtagactccttttcactgggcattttgtgtgtgagtatcatgatcgaagaggtcatgcgcagccgatggtcgcggaaaatgctcatgacagggaccctggccgtgttcctactgctcattatgggacagctgacatggaacgatcttatccgtttgtgcattatggttggcgctaatgcctccgacagaatggggatgggaactacctatctggcattaatggctacgtttaagatgaggcctatgttcgccgtgggcctcctgtttcgccggcttacatctagagaggtcctgctactcaccataggtctgagcttggtggcatcagttgaactgccaaacagtttagaggaactcggggatggactggccatgggcatcatgatgcttaaactgttgactgagttccaaccccaccagctctggaccacactgctatccctgacttttattaagaccacgctttctctcgactacgcttggaaaacaaccgcgatggtgctgagcatcgtctccttgttcccgctgtgtttatcaactacaagccagaagaccacttggctccctgtactgcttggcagttttgggtgcaagccactgacaatgttcttgattaccgaaaacaaaatctggggaaggaagtcttggcccctcaatgagggtataatggccatcggcattgtgtccatcctgctaagctcgctgcttaaaaacgatgttcctctcgcagggcccctgattgctggaggcatgttgatcgcctgttatgtgatatcaggttctagtgccgacttatccctggagaaggctgcagaagtcagctgggagcaggaagccgagcattctgggacgagccacaatattctcgtggaagtacaagatgacggaactatgaaaatcaaggatgaggagcgagacgataccctgacaatccttctgaaagcgaccttgctagctgtgtccggcgtctacccaatgtcaattcctgccacactgtttgtttggtatttctggcagaagaagaaacagcgcagtggcgtgctctgggacactcccagcccaccggaagtggagcgggcagtcctggatgacgggatatacagaatccttcagaggggattactgggtcgttctcaagtgggcgttggggtattccaggacggagtgtttcataccatgtggcacgtcacgcgcggcgccgtgctcatgtatcagggtaagcggttggaaccttcctgggcttcagttaaaaaggatctgattagttacgggggaggctggagattccagggcagctggaacacaggggaggaggtgcaagtcatcgcagtggaacccggcaagaatccaaagaacgtacagactacccccggtacatttaagacccctgagggcgaagtcggggccattgcgctcgacttcaaaccaggaacttccggctctcccatcgtgaatagggagggtaagatagttgggctgtacggaaacggcgtggtcaccacatcgggcacgtatgtgagcgctatcgcccaggcaaaagcctcacaagaagggcctcttccggagattgaggatgaagtttttaagaaacgaaatctgactatcatggacttgcacccaggatccggtaagacccggcgctacctacccgctattgtgagagaggccatcaagaggaaactgcggacactcatattagcacctacccgagtcgtggctagtgaaatggccgaggcgctgaagggcatgccaattagatatcagactacagccgtaaaatctgaacataccgggcgcgagatcgtggatcttatgtgccacgcaacgttcactatgaggctgctcagccccgttcgtgtccctaactacaatatgatcattatggacgaggctcattttacagatccggcctccatcgctgcacggggatatatatcaaccagagtgggcatgggtgaagccgccgctattttcatgaccgcgactcccccagggtctgtggaggcatttcctcagagcaacgccgtcatccaggacgaagagagggatattcccgaacgcagttggaactccggatacgactggatcacagatttcccaggcaagaccgtatggtttgtgcctagcataaaatctggcaacgacattgctaattgtttgcgaaagaacgggaagagagttatccaactgtcacggaaaacattcgacactgagtatcagaagacgaaaaacaatgattgggactacgtggtcaccacagatatctccgagatgggagccaacttcagggcagaccgcgtgattgatccccgtagatgcctcaagccagttatcctgaaagacggtccggaacgggtgattcttgccggccctatgcccgtcactgtggctagtgcggcccagaggcgcgggcgaataggaagaaatcagaacaaggagggcgatcaatacgtatatatgggtcagccactaaataacgacgaagatcacgcacattggaccgaggctaagatgctgttggacaatatcaacacacccgaggggattatccctgccttatttgaaccagagcgggagaaaagcgcagccatcgatggcgagtacaggctgcgcggagaagctagaaagaccttcgtggagctcatgaggcggggcgacctgcccgtttggctttcgtataaagtcgcctctgaggggtttcagtactccgatcgtcgctggtgcttcgacggagaacgaaataaccaggtgctggaggaaaatatggacgtggagatttggactaaggaaggtgagaggaaaaagctcaggcctcggtggttggatgcgcgcacgtatagcgacccgctggcactaagagagtttaaagagttcgccgctggcaggcggtcagtcagtggggatctgatactcgagatcggaaaacttccacaacacctgaccttacgagcccagaacgctttggacaatctggttatgctccacaactctgaacagggcggtaaggcatacagacatgccatggaggaactgcccgatacaattgagactcttatgctgctcgctttgatcgccgtgctgaccgggggcgtaacattatttttcctatccggaaaaggcctggggaagaccagcattggactcctttgtgtgactgcatcaagtgcgctgttgtggatggccagcgtcgagcctcactggatcgctgcctccataatcctggaatttttcctcatggtgctgcttattcccgagccagaccgccagaggacacctcaagataatcagctcgcatatgttgtgatcggtctgttgtttatgattctgacggtcgctgccaacgaaatgggcttactagagaccactaaaaaggacctggggatcggacatgtagcagccgagaaccaccagcacgctacaatgctcgatgtggaccttcggcccgcgtctgcctggaccctgtacgcagttgctaccacagtgataactccaatgatgcgtcatacgattgaaaataccacagccaacatcagcttgactgccattgcaaatcaagctgccatcctgatgggcctcgataaaggttggcctatatccaagatggacatcggggtcccgctgcttgcgttaggctgctactcacaggtgaaccccctgaccctcacagctgccgtcttgatgctggtggcacactatgccattatcggaccaggcctacaggctaaggcaaccagagaggcccagaaaaggactgcggctgggattatgaagaatcctacggttgatggaatcgtggccatagacctggaccccgtagtgtacgatgcaaaattcgaaaagcaactcggccagattatgcttctgatcttgtgtacatctcagatcctgctcatgcgcaccacttgggccctgtgcgagagtattaccttagctacaggtccacttactaccctgtgggaagggtcgcctggaaaattttggaacacaacgatcgccgtcagcatggcaaatatattccggggctcctatctcgctggtgccggcctagcgttctctctgatgaagtcactagggggaggccgaagagggaccggagcccagggcgagactctgggtgagaagtggaaaaggcaactcaaccagcttagcaagtccgaatttaatacatacaaacgcagtgggattatggaggttgaccggtctgaagcaaaggagggactgaaaagaggcgaaaccactaagcatgctgtgagccgtggtacagccaagttgaggtggttcgtcgagcggaacctggtgaaacccgagggcaaggtaatcgatctcgggtgtggacgcggcgggtggtcatattactgcgcaggactaaagaaggtgaccgaagttaaaggctatacgaagggtgggctgggacacgaggaaccgattccaatggctacctacggctggaatcttgtgaaactgcattccggcaaggacgtctttttcatgcctcccgagaagtgtgatacactactctgcgacatcggggaaagtagcccaaaccccactatagaggagggacgaaccctgagagtgttgaaaatggtcgaaccttggctgaggggtaatcagttttgtatcaagattctcaacccgtacatgccctctgtggttgagacacttgaacagatgcaacggaaacacggcgggatgctggtacgcaatccattatccagaaactcaactcacgagatgtattgggtgagctgcggaaccggcaatatcgtctcggccgtgaacatgacatctaggatgctgttgaaccgattcaccatggcccatcggaagcctacttacgagcgtgatgttgacctcggtgcggggacgagacacgtggctgtcgaacccgaggtggcaaatctggatattatcggacagcgcattgaaaacatcaaaaatgagcataagagtacatggcactatgacgaagataacccttacaagacctgggcctatcacggctcctacgaggtaaaaccaagcggctcagcttcctctatggtgaatggggttgtcaagctacttactaaaccctgggacgtgatacctatggtgacccagattgccatgacagacacgaccccatttggacaacagagggtcttcaaggagaaagttgatactcggacacccagagcaaagcgcggtaccactcagatcatggaagtgacagccaagtggctgtggggctttctcagcaggaacaaaaagccgcgaatctgtacccgggaggagttcacaagaaaagtaaggagtaatgctgcgattggggccgtgtttgtcgacgagaaccagtggaactccgcaaaggaagctgtggaggatgagcgcttctggaacctggttcatcgtgaacgggagttgcacaaacaaggaaagtgcgccacttgcgtgtataatatgatgggcaagagagagaaaaagctgggtgagtttgggaaagcaaagggaagcagggccatatggtacatgtggctcggcgctcgcttccttgagttcgaggccctgggctttatgaacgaggaccattggttctctcgagaaaattcattaagtggggtcgagggagaaggtctgcacaaattgggctacatcctccgggatatttccaagatccctgggggaaacatgtatgcggacgataccgcaggctgggacacgagaattaccgaggatgacctgcagaatgaggccaaaatcacagatataatggaaccagagcatgctctacttgccactagcatctttaagctgacctaccagaacaaggtggtaagggttcagcgccccgccaaaaatggtacagtgatggacgtcatttctagacgggatcaaagggggtcgggacaggtgggcacttatggcctcaataccttcacgaacatggaagtgcagctgatccgtcagatggagtcagaagggatatttttgcctagcgagttagagacaccaaatctggctgaacgagtcctcgactggcttgagaagcacggagccgaacgcctgaaaagaatggctatctccggtgacgattgtgttgtgaagcccatagacgatcggttcgccaccgcactaactgcgctgaacgacatgggcaaagtaaggaaggatattccgcaatgggagcctagtaaggggtggaatgactggcaacaggtgcccttttgctctcaccatttccaccagctcatcatgaaagatggacgcgaaatcgtcgtgccatgtagaaaccaagacgagttggttggccgggccagggtgagccagggtgctgggtggtccctgcgagagacagcctgccttggaaagtcatacgcacagatgtggcaactgatgtattttcatcgtagagatctccgcttagctgccaatgcaatttgtagtgccgtccctgtggactgggtacccacctctcggactacctggagcatacacgcgcaccatcagtggatgacaacggaagatatgctgtccgtttggaacagggtgtggatcgaggaaaatccatggatggaggacaaaacccacgtctcaagctgggaagaggtgccctacttgggcaagagagaggaccagtggtgcggctctctgattgggctcactgctcgcgccacatgggcaaccaacatccaggttgccattaatcaagtgcggaggcttatcggaaacgaaaattatctggattacatgacttccatgaaacgattcaagaacgagagtgaccctgaaggtgctctatggtga

SEQ ID NO: 13504 - RNA, 9879 nt, synthetic construct
  misc_feature 1..9879: note = derived and/or modified CDS sequence (opt3) from DENV-1__FJ639743__SS-prME
  source 1..9879: mol_type = other RNA
agcgtgaccatgctgctcatgcttctgcccactgcattggctttccacttaactacgaggggcggggagcctcatatgatcgtctccaagcaggaaaggggaaaatctctgctatttaagacctcagccggtgttaatatgtgcacactcattgccatggacctgggcgagctttgtgaagatactatgacctacaaatgcccacggataacagaggcggaaccggacgatgtggactgttggtgcaatgctaccgatacttgggtaacatatgggacctgtagtcagacgggagagcaccgccgagacaagcgtagcgtggccctggcaccccatgtcggcttgggtctcgagactagaaccgaaacatggatgtcctctgagggggcctggaaacagatccagagggtggaaacttgggctctgcggcaccctggattcaccgttatggcactgtttctcgcccatgctattggcacatcgatcacccagaagggcattatcttcatattactgatgcttgtgacgccatcaatggccatgcgctgcgtcgggatcggaaacagagattttgtggagggtttgagcggcgcgacttgggtagacgttgtgctggagcacgggagttgtgtcacaaccatggcaaagaataaacccactctagatattgaactcctgaagacagaggtgaccaaccctgccgtgcttaggaaactgtgcatcgaagctaagatttccaatacgaccacagactctcggtgtccaactcaaggagaggccaccttggtcgaagaacaggatgcaaacttcgtttgccgccgaacatttgtggacaggggctggggtaatgggtgtggactcttcggcaaaggcagcctgttaacttgcgctaagtttaagtgcgtaaccaaactggaggggaagatcgtgcagtacgaaaacctcaaatattccgtcatagtgacagttcacaccggagatcagcatcaagtgggtaatgagactacggaacacggcacaattgccaccatcactccccaggcgcctacctcagagattcagcttacagactacggggccctgaccttggactgtagtccaaggactggactagatttcaacgaaatggtcctgctcacaatgaaggagaaaagctggctggtgcataagcagtggtttcttgacctgccgttgccctggacgtctggcgcatccacctcacaagagacttggaatcggcaggatctcctggtaacattcaaaaccgctcacgccaagaagcaggaagttgtggtcttaggtagccaagagggggctatgcacacagccctgactggcgcaaccgaaatccagacgagtggaaccacaactatctttgccggccatctaaaatgccgtctcaagatggacaaactgacccttaaggggatgtcttatgtgatgtgtacaggatccttcaaattggagaaggaagtcgctgagactcagcacggtaccgtgctggttcaggtgcgctacgagggcacggatgcgccttgcaagattccattcagcacacaagacgaaaaaggggtaacccagaacggaagactcataactgcaaatcccatcgtcacagataaggagaaacctgtgaacattgaaaccgagccaccctttggcgagtcgtatatcgttgtgggtgccggggaaaaggctctgaaactttcttggttcaagaagggctcctcaataggaaaaatgtttgaggccactgcaaggggcgcccggcgaatggctattctgggggacaccgcctgggatttcggaagtatcggtggcgtctttacaagcgtggggaagttggtacatcaggtgttcggaacggcatacggcgttctcttttccggtgtctcttggaccatgaaaatcgggattggcatcctgttaacttggctgggactaaatagccgctcaacaagtctctccatgacctgtattgcggtgggcatggtgacactgtaccttggggtcatggttcaggctgacagcggatgcgtgataaactggaagggcagagaattgaaatgtggttctgggatcttcgtgactaacgaggtacacacctggacggaacaatataagtttcaggccgattcaccgaagaggctgagtgcagccattggaaaggcttgggaggagggcgtctgcggtatccggagcgccacacgcctcgaaaatatcatgtggaagcagatttccaacgagctgaatcatatattactggaaaacgacatgaaattcaccgtggttgtgggcgacgcaaatgggatccttgctcagggaaagaaaatgattagacctcaacccatggagcacaagtactcttggaaatcgtggggcaaggccaaggtcatcggggcggatattcagaacactacctttatcatagacggaccagatacacctgaatgtcccgacggccagagggcctggaatatctgggaggtggaggattatggtttcgggatttttactaccaacatctggttgaaactccgtgacagctacacacagatgtgcgatcaccggctgatgtccgctgcaattaaggactcaaaagccgttcatgctgatatgggatattggatcgaaagtgagaagaatgaaacgtggaaactagcccgagcatctttcatagaggtgaagacctgtacttggccaaagagccacacactgtggtccaacggcgtactcgaatcagagatgattatccccaaaatttacggtggccctatcagccaacataattatagaccagggtacttcacccagactgcgggaccgtggcacctgggcaaacttgagttggactttgatctgtgcgaagggacaaccgtcgtggtggacgagcactgcggaaacaggggcccctctttacgcacgactaccgtcacaggtaaaataatccatgaatggtgttgccggtcctgtaccctccctccactgagattcagaggggaagatggatgctggtacggcatggagattcgccccgttaaggaaaaagaggaaaatcttgtgcgaagtatggtaagcgccggttctggcgaggtggactccttttcactggggatcttgtgtgtcagtattatgatcgaagaggtgatgcggagccgttggtcgagaaagatgctcatgactggaacactggctgttttcctactgctcgtgatgggccagctgacctggaacgaccttataaggttgtgcattatggtcggggccaatgcatccgatcgcatgggaatgggcacaacttatctggctttaatggccacctttaagatgcggcctatgttcgcagtgggtctcctgtttagaaggcttacgtctcgagaggttctgctactcacaatcgggctgagcttggtggcctcagtcgaactgccaaacagtttagaggaactcggagacggcctggctatgggcatcatgatgcttaaactgttgaccgagttccaaccccaccagctctggactaccctgctatccctgacatttgtaaagactaccctttctctcgattacgcgtggaaaacgacagccatggtgctgagcattgtttccttgttcccgctgtgtttatcaaccactagccagaagacaacctggctccctgtgctgcttgggagttttggatgcaaaccactgactatgttcttgatcacagaaaacaagatttggggtcgcaagtcttggcccctcaatgagggcataatggcaatcgggattgtctccatcctgctaagctcgctgcttaaaaacgacgtgcctctcgctggacccctgattgccggcggtatgttgatcgcctgttatgtaatatcagggtctagtgctgatttatccctggagaaggcagccgaagtgagctgggagcaggaagcggagcattctggagctagccacaatatcctcgtcgaagttcaagacgatggcaccatgaaaattaaggacgaggagcgggatgacacgctgactatccttctgaaagccaccttgctagcagtgtccggcgtgtacccaatgtcaattcctgccacactgtttgtctggtatttctggcagaagaaaaagcagagaagtggggtgctctgggatacccccagcccaccggaagttgagagggctgtactggacgatggaatctaccgtatacttcagcgcggtttactgggccggtctcaagtgggggtcggagtgttccaggacggcgtttttcatacaatgtggcacgtgactagaggtgcagtcctcatgtatcaggggaagaggttggaaccttcctgggcctcagtgaaaaaggacctgattagttacggaggcggctggcgattccaggggagctggaacaccggagaggaggtacaagtcatcgcggtggaacccggtaaaaatccaaagaacgttcagacgacacccggcacttttaaaacctccgagggggaagtgggagctatcgccctcgatttcaagcctggcacatctggttcgccaattgtcaatcgggaggggaagatagtgggactgtacggcaacggcgttgtgaccactagcgggacctatgtctcagcaatcgcccaggctaaagcctcccaagaaggaccccttcctgagattgaggacgaagtgtttaagaaacgcaatctgacaatcatggatttgcacccgggtagtggcaagacgagaaggtacctaccagcaattgtacgggaggctatcaaacgaaagctgagaactctcatattagcccccacccgcgtggttgcgtctgaaatggccgaggcactgaaggggatgcctatcaggtatcagacaaccgctgtcaaaagcgaacatactggacgtgagattgtggaccttatgtgccacgccacattcaccatgcggctgctctccccagtgagagtccccaactacaatatgatcattatggatgaggctcattttacggaccctgcatcaatcgccgccaggggctatatatctactcgcgtaggtatgggggaagctgcggcaattttcatgacagccaccccgcccggaagcgtggaggcttttccacagagtaacgccgttatccaggatgaggagcgagacatccctgaaagatcctggaatagcggctacgattggattaccgacttccccggccggactgtgtggtttgtcccatctatcaagtcagggaacgatatagcaaattgtttgaggaaaaacggaaagcgcgtgattcaactgtcccgtaaaacattcgacaccgagtatcagaagacaaagaacaatgactgggattacgttgtgactacggacatcagtgagatgggtgccaacttcagagctgatcgggtcattgaccctaggcgctgcctcaaacccgtgatcctgaaggatggcccagaacgagtaatacttgcggggccgatgcctgtgaccgttgccagcgcagctcagagacggggaaggattggccgcaatcagaacaaagagggtgaccaatacgtctatatggggcagcccctaaataacgatgaagaccacgcccattggacagaggcaaagatgctgttggataatatcaacactccagagggcatcattcccgccttatttgaacctgagagagaaaaatcggctgccatcgacggagagtacaggctgcggggcgaagcgcgtaagaccttcgtggagctcatgcgccgaggggatctgccagtgtggctttcttataaggtcgcatccgagggatttcagtacagcgacagaaggtggtgcttcgatggtgaacggaataaccaggttctggaggaaaatatggacgtggagatttggacaaaagaaggcgagcgcaagaaactcagacccaggtggttggacgcccggacctattcagatcctctggctctacgagagtttaaggagttcgccgctgggagacgcagtgtatctggagacctgatactcgagatcggcaaacttccgcaacacctgactttaagggcacagaacgccttggataatctggtgatgctccacaactccgaacagggtgggaaggcttaccggcatgccatggaggaactgccagacacgattgagacccttatgctgctcgcattgatcgcggtcctgacaggcggagtgactttatttttcctaagcggcaaagggctgggaaagacctcaatcggtctcctttgtgttacagccagtagcgctctgttgtggatggcctccgtggagccccactggattgcagcttctataatcctggaatttttcctcatggtcctgcttattcctgagcccgatcgtcagagaaccccacaagacaatcagctcgcctatgtagtgatcggcctgttgtttatgattctgactgttgcagccaacgaaatggggttactagagacaacgaagaaagatctgggaatcggctacgtggctgcggagaaccatcagcacgccaccatgctcgacgtcgatcttaggcctgcaagcgcttggactctgtacgccgtggccacaaccgtcataacccccatgatgcgccacacaatcgaaaatactacggcaaacatttccttgaccgctatcgccaatcaagcggctattctgatgggtctcgacaaggggtggccaatctcaaaaatggatataggcgtgcctctgcttgccttaggatgctattctcaggttaacccgctgacactcactgcagccgtgttgatgctggtagctcattacgcaattatcggccccgggctacaggccaaggcgacccgggaggctcagaaacgaacagccgcaggaattatgaagaatccaaccgtggacggcatcgtcgccatagatctggaccctgttgtgtatgacgctaagttcgaaaaacaactcggtcagatcatgcttctgattttgtgtacaagtcagatcctgctcatgagaacgacatgggccctgtgcgagtcgattaccttagcaactgggccccttaccacactgtgggaaggaagcccaggcaagttttggaacactaccatcgctgtctccatggccaatatattcaggggttcttacctcgcgggcgccgggctagcattctcactgatgaagtccttgggaggcgggcgccggggaacaggcgctcagggtgagacgctgggggagaagtggaaaagacaactcaaccagcttagcaagagtgaatttaatacctataagcgttctggaattatggaggtggataggagcgaagccaaagagggcctgaagcggggtgaaactacaaaacacgcagtatcacgcggcaccgctaagttgcgatggttcgtggagagaaacctggttaaacctgaggggaaggtgatcgacctcggatgtggcagagggggatggtcctactattgcgccggcttaaagaaagtcactgaagtgaagggttacacaaaagggggacccggccatgaggaaccgatcccaatggccacctacggctggaatctggtcaaacttcacagtgggaaagatgtgtttttcatgagccctgagaagtgtgacacgctgctatgcgatattggagaatcttcccccaacccaaccatcgaggagggtcggacactccgcgttctgaaaatggtagaaccctggttgagaggcaatcagttttgtataaagattctgaacccttatatgccgtcagtggtcgagactctcgaacagatgcaaaggaagcatgggggaatgcttgtgcgaaatcccctgagccggaactcgacccacgagatgtactgggtttcttgcggcacaggtaatatcgtgagtgcggtcaacatgacttcccgtatgttactgaacagattcaccatggctcaccgcaaaccaacatatgagagggacgtggatttgggggcaggaacccggcatgtagccgtggaacctgaggaagctaatctcgacattatcggccagagaatagagaacatccgcaatgaacacaagagcacttggcattacgatgaggacaacccctataaaacgtgggcctaccacggctcatatgaggttaagccttccgggtctgcaagcagtatggtcaatggagtggtgaggctgctaacaaaaccatgggatgtcattcccatggttacccagatcgccatgactgacaccacaccttttggtcaacagcgagtgttcaaggaaaaggtagacacgcggaccccaagagctaaaaggggcactacacagattatggaggtgaccgcgaagtggctttgggggtttctgtcccgcaacaaaaagccccgtatctgtactcgggaagagttcacaagaaaagtcaggagcaatgccgcaattggagctgtgtttgttgatgaaaaccagtggaactctgccaaggaggcagtggaggacgaacgcttctgggatctcgtccaccgagagcgggaactgcataagcaaggcaaatgcgctacctgcgtgtacaacatgatgggtaagagagagaaaaagttgggggaatttggaaaagccaagggctcaagggccatctggtacatgtggctgggcgcgcgcttcctcgagttcgaggcacttgggtttatgaatgaagaccactggttcagtagagagaactccctgagcggagtagaaggtgagggcttacataagctggggtatatattgcgggatatttctaaaatcccgggaggcaatatgtacgccgacgatacagctggttgggacactaggatcaccgaggatgacctccagaacgaagccaagattacggatataatggagcctgaacacgcactgctagctacctcgatctttaaacttacatatcagaataaggttgtgcgtgtccagcgaccagccaaaaacgggactgtgatggacgtgatttcacgcagagatcaacggggaagcggccaggtcggcacctacgggctgaacacattcactaatatggaggttcagctcatcaggcagatggaatccgagggaatttttctgcccagtgagttggaaacccctaacttagctgagcgcgtgctggactggctcgaaaagcatggtgccgagagacttaaacggatggcaatctctggcgacgattgtgtagtgaagccaatagacgataggttcgcgacggccctgacagctctaaatgacatggggaaggtccgaaaagatatcccccaatgggaaccgagcaagggatggaacgactggcaacaggtgcctttttgctcccaccacttccatcagctgattatgaaagatggccgtgagatcgttgtgccctgtagaaatcaagacgagctcgtcggtcgcgcccgggtgtcacagggggcaggatggagtttgagggaaaccgcttgcctgggcaagtcttatgcccagatgtggcaacttatgtactttcacagacgcgatctgcggctcgcagccaacgcgatttgtagcgctgtaccagttgactgggtgcctacttccaggacaacctggtcaatccatgcccaccaccagtggatgactaccgaggatatgttaagcgtctggaatcgagtgtggatagaagagaacccctggatggaagacaaaacacatgtttcttcctgggaggaggtgccatatctgggcaagagagaagaccagtggtgcgggagtttgattggactgacggcacgggccacctgggctactaatatccaggtcgccatcaaccaagtgaggcgcctcattggtaatgagaactaccttgattacatgacaagcatgaagcgtttcaaaaatgaatcggaccccgagggcgcactgtggtga

SEQ ID NO: 13505 - RNA, 9879 nt, synthetic construct
  misc_feature 1..9879: note = derived and/or modified CDS sequence (opt3) from DENV-1__FJ639794__SS-prME
  source 1..9879: mol_type = other RNA
agcgtgaccatgctgctcatgcttctgcccacagccttggctttccacttaactacgagaggcggggagcctcatatgatcgtctccaagcaggaaaggggaaaatctctgctatttaagacctcagcaggtgttaacatgtgcacactcattgccatggacctgggcgagctttgtgaagatactatgacctacaaatgcccacggataacagaggcggaaccggacgatgtggactgttggtgcaatgctaccgatacttgggtaacatatgggacctgtagtcaaacgggagagcaccgccgagacaagcgtagcgtggccctggcaccccatgtcggcttgggtctcgagactagaaccgaaacatggatgtcctctgagggggcctggaaacagatccagagggtggaaacttgggctctgcggcaccctggattcaccgttattgcactgtttctcgcccatgctatcggcacatcgattacccagaagggcatcatattcatcttactgatgcttgtgacgccatcaatggccatgcgctgcgtcgggattggaaacagagattttgtggagggtttgagcggcgcgacttgggtagacgttgtgctggagcacgggagttgtgtcacaaccatggcaaagaataaacccactctagatatcgaactcctgaagacagaggtgaccaaccctgccgtgcttaggaaactgtgcattgaagctaagatctccaatacgaccacagactctcggtgtccaactcaaggagaggccaccttggtcgaagagcaggatgcaaacttcgtttgccgccgaacatttgtggacagaggctggggtaatgggtgtggactcttcggcaaaggcagcctgttaacttgcgctaagtttaagtgcgtaaccaaactggaggggaagatagtgcagtacgaaaacctcaaatattccgtcattgtgacagttcacaccggagatcagcatcaagtgggtaatgagactacggaacacggcacaatcgccaccattactccccaggcgcctacctcagagatccagcttacagactacggggccctgaccttggactgtagtccaaggactggactagatttcaacgaaatggtcctgctcacaatgaaggagaaaagctggctggtgcataagcagtggtttcttgacctgccgttgccctggacgtctggcgcatccacctcacaagagacttggaatcggcaggatctcctggtaacattcaaaaccgctcacgccaagaagcaggaagttgtggtcttaggtagccaagagggggctatgcacacagccctgactggcgcaaccgaaatccagacgagtggaaccacaactatttttgccggccatctaaaatgccgtctcaagatggacaaactgacccttaaggggatgtcttatgtgatgtgtacaggatccttcaaattggagaaggaagtcgctgagactcagcacggtaccgtgctggttcaggtgaagtacgagggcacggatgcgccttgcaaaataccattcagcacacaagacgaaaagggggtaacccagaacggacgcctcatcactgcaaatcccattgtcacagataaagagaagcctgtgaacatcgaaaccgagccaccctttggcgagtcgtatatagttgtgggtgccggggaaaaagctctgaagctttcttggttcaagaaaggctcctcaattggaaagatgtttgaggccactgcaagaggcgccaggcggatggctatcctgggggacaccgcctgggatttcggaagtatcggtggcgtctttacaagcgtggggaaattggtacatcaggtgttcggaacggcatacggcgttctcttttccggtgtctcttggaccatgaagattgggatcggcattctgttaacttggctgggactaaatagccgatcaacaagtctctccatgacctgtatagtggtgggcatggtcacactgtaccttggggttatggtgcaggcggacagcggatgcgtgatcaactggaaaggccgcgaattgaagtgtggttctgggattttcgtaactaacgaggtccacacctggacggaacaatataagtttcaggctgattcaccgaaaagactgagtgccgcaatcggaaaggcctgggaggagggcgtgtgcggtatcaggagcgctacacggctcgaaaatattatgtggaaacagatatccaacgagctgaatcatatcttactggaaaacgacatgaagttcaccgttgtggtcggcgacgccaatgggattcttgcacagggaaaaaagatgatccgccctcaacccatggagcacaaatactcttggaagtcgtggggcaaggctaaaattatcggggccgatatacagaacactacctttatcattgacggaccagatacacctgaatgtcccgacggccagagagcgtggaatatctgggaggtggaggattatggtttcgggatttttactaccaacatctggttgaagctcagggacagctacacacagatgtgcgatcaccgtctgatgtccgccgctataaaagactcaaaggcagttcatgccgatatgggatattggattgaaagtgagaaaaatgaaacgtggaagctagctcgggcctctttcatcgaggtgaagacctgtacttggccaaaaagccacacactgtggtccaacggcgtactcgaatcagagatgattatccccaagatatacggtggccctatcagccaacataattatcgaccagggtacttcacccagactgcaggaccgtggcacctgggcaaacttgagttggactttgatctgtgcgaagggacaaccgtcgtggtggacgagcactgcggaaacagaggcccctctttaaggacgactaccgtcacaggtaagattatccatgaatggtgttgccgctcctgtaccctccctccactgcggttcagaggggaggatggatgctggtacggcatggagattaggcccgttaaagaaaaggaggaaaatcttgtgcgcagtatggtaagcgcgggttctggcgaggtggactccttttcactggggatcttgtgtgtcagtataatgattgaagaggtgatgcgaagccggtggtcgcgtaagatgctcatgactggaacactggccgttttcctactgctcatcatgggccagctgacctggaacgaccttatcagattgtgcattatggtgggggctaatgcctccgataggatgggaatgggcacaacttatctggcattaatggctacctttaaaatgcgccctatgttcgccgtcggtctcctgtttcggagacttacgtctagggaggtgctgctactcacaatcgggctgagcttggttgcatcagtggaactgccaaacagtttagaggaactcggagacggcctggccatgggcattatgatgcttaagctgttgaccgagttccaaccccaccagctctggactaccctgctatccctgacatttgtcaaaactaccctttctctcgattacgcttggaagacgacagcgatggtactgagcatagtgtccttgttcccgctgtgtttatcaaccactagccagaaaacaacctggctccctgttctgcttgggagttttggatgcaagccactgactatgttcttgatcacagaaaacaagatttggggtcgaaaatcttggcccctcaatgagggcatcatggccattgggatcgtgtccatactgctaagctcgctgcttaagaacgacgtccctctcgcaggacccctgatcgctggcggtatgttgattgcctgttatgtgatctcagggtctagtgccgatttatccctggagaaagctgcagaagtaagctgggagcaggaagccgagcattctggagcgagccacaatattctcgtggaagtccaagacgatggcaccatgaagatcaaagacgaggagcgcgatgacacgctgactatacttctgaaggctaccttgctagccgtttccggcgtgtacccaatgtcaattcctgcaacactgtttgtgtggtatttctggcagaaaaagaagcagcggagtggggtcctctgggatacccccagcccaccggaagtggagagagccgttctggacgatggaatctacaggatccttcagcgtggtttactgggccgctctcaagtaggggtgggagtcttccaggacggcgtgtttcatacaatgtggcacgttactcggggtgctgtgctcatgtatcaggggaaaagattggaaccttcctgggcatcagtcaagaaagacctgattagttacggaggcggctggaggttccaggggagctggaacaccggagaggaggtgcaagtaatagccgtcgaacccggtaagaatccaaaaaacgtgcagacgacacccggcacttttaagacccctgagggggaagttggagcgatcgctctcgatttcaagccaggcacatccggttctcccattgtgaatcgagaggggaaaatcgtcggactgtacggcaacggcgtggttaccacttcggggacctatgtgagcgccattgcacaggccaaggcttcacaagaaggacctcttccggagatcgaggacgaagtctttaaaaagcggaatctgacaataatggatttgcacccaggttccggcaaaacgcgcagatacctacccgccatcgtgagggaggcaattaagcggaagctgcgaactctcatcttagctcctaccagagtagtggccagtgaaatggcggaggccctgaaagggatgccaattcgctatcagacaaccgcagttaagtctgaacatactggaagggagatcgtcgaccttatgtgccacgctacattcaccatgcgtctgctcagccccgtgcgggtgcctaactacaatatgataattatggatgaggcccattttacggacccggcttccatcgcagccagaggctatatctcaactagggtcggtatgggggaagccgctgcgattttcatgacagcaacccccccaggatctgtagaggcctttcctcagagcaacgctgtgatccaggatgaagagcgcgacatacccgaacgaagttggaatttgggctacgattggattaccgacttcccaggcaaaactgtttggtttgtgccttccatcaagagcgggaacgatattgccaattgtctgagaaaaaacggaaagcgggtcatccaactctctaggaagacattcgacaccgagtatcagaaaacaaagaacaatgactgggattacgtggttactacggacatatcagagatgggtgcaaacttccgcgccgatcgtgtgattgaccccagacggtgcctgaaaccagtcatccttaaggatggcccggaaagggtgatcctagctgggcctatgcccgtaaccgtggcgtccgccgcacagcgccgaggaagaattggccggaatcagaacaaagagggtgaccaatacgtttatatggggcagccactgaataacgatgaagaccacgctcattggacagaggccaagatgttgttagataatatcaacactcccgagggcattatacctgcactgtttgaaccagagagggaaaagagtgccgctatcgacggagagtaccgcctcagaggcgaagccaggaaaaccttcgtcgagctgatgcggcgtggggatcttcccgtgtggctgagctataaggtggcgtcggagggatttcagtactctgaccgccgatggtgcttcgatggtgaaagaaataaccaggtcctcgaggaaaatatggacgttgagatttggacaaaagaaggcgagaggaagaaattgcggcctcgctggctggacgcaagaacctattccgatccgctagccctgagggagtttaaggaattcgctgccgggcggcgaagcgtgtcaggagacctcatccttgagatcggcaaactgccacaacacttaactttgagagctcagaacgcactggataatctcgtaatgctgcacaacagtgaacagggtgggaaggcctaccgccatgctatggaggaacttcccgacacgattgagaccctgatgctcttggccctgatagcagtgttaacaggcggagtcactctatttttcctgtctggcaaggggctcggaaaaacctccatcggtcttctgtgtgtgacagcgagctcagccttgctgtggatggctagtgttgagcctcactggattgccgcaagcatcattctcgaatttttcctgatggtgcttctcatccccgagccagataggcagcggacccctcaagacaatcagctggcttatgtcgtaataggcttgctgtttatgatcttaactgtggccgcaaacgaaatggggctactggagacaacgaagaaagatctcggaattggctacgttgccgctgagaaccatcagcacgcgaccatgcttgacgtggatctgcgtcccgcctccgcatggactttgtacgctgtcgccacaaccgtgatcaccccaatgatgagacacacaattgaaaatactacggccaacatctctctgaccgcaatagctaatcaagccgcgattctcatgggtctggacaaggggtggcctatcagcaaaatggatattggcgtcccgcttttagctctgggatgctattcccaggtgaaccccctcacattgactgccgcagttctgatgctagtggcccattacgctatcataggcccagggctgcaggcaaaggccaccagggaggcgcagaagcgcacagctgccggaatcatgaaaaatcctaccgtagacggcattgtggcaatcgatctcgaccccgtcgtttatgacgccaagttcgaaaaacaacttggtcagattatgctgttgatcctgtgtacttcacagatactcctgatgcggacgacatgggctttatgcgagtctattacccttgccactgggccactgaccacactctgggaaggaagtcctggcaagttttggaacactaccatcgcagtgtcgatggctaatatcttccgaggtagctacctagccggcgcggggctggccttctccttgatgaaatctctgggaggcgggagaaggggaacaggcgcacagggtgagacgctcggggagaagtggaagcgccaacttaaccagctgtcaaaaagcgaatttaatacctataagcggtccggaattatggaggtcgatagaagtgaagctaaagagggcttgaagcgtggtgaaactacaaaacacgccgtgtctaggggcaccgcaaagctgcggtggttcgtagagcgcaacctcgtgaagcccgaggggaaagttatcgacttaggatgtggccgagggggatggagctactattgcgctggcctgaagaaagtgactgaagtcaagggttacacaaaagggggaccgggccatgaggaaccaatacctatggccacctacggctggaatcttgtgaagctgcactcagggaaagatgtctttttcatgcccccagagaagtgtgacacgctactctgcgatattggagaatccagtcccaaccctaccatcgaggagggtagaacactgagggtgttgaagatggttgaaccgtggctgaaaggcaatcagttttgtattaagatcctcaacccctatatgccaagcgtagtggagactcttgaacagatgcaacggaaacatgggggaatgctggtccgcaatcctttatctagaaactccacccacgagatgtactgggtgtcatgcggcacaggtaatatagttagcgccgtgaacatgacttcgaggatgctgttgaaccgattcaccatggtccaccggaagcccacatatgagcgtgacgtggatctcggggcgggaaccagacatgtagctgtggaacctgaggttgcaaatctggacatcattggccagcgcatcgaaaacattaaaaatgagcacaagtctacttggcattacgatgaagacaacccatataagacgtgggcctaccacggcagttatgaggtcaaaccctccgggagcgcttcatccatggtgaatggagtggtcaggctacttacaaagccttgggatgttatcccaatggtgacccagattgccatgactgacaccacaccctttggtcaacagcgggtattcaaagagaaggtggacacgagaaccccgcgcgcaaaaaggggcactacacagatcatggaagtcaccgccaagtggctgtgggggtttctctctcgaaacaagaaacctcggatatgtactagagaggaattcacaaggaaggtgcgcagcaatgctgcgattggagccgtttttgtggatgagaaccagtggaatagtgcaaaagaagctgtcgaggacgagcgtttctgggatctggtgcaccgggaaagagagttgcataagcaaggcaaatgcgccacctgcgtatacaacatgatgggtaagagggaaaagaaactgggggagtttggaaaggcaaaaggctcccgcgccatctggtacatgtggctcggcgctcgattccttgaattcgaggccctggggtttatgaatgaggaccactggttcagccgggaaaactctttatcaggagttgagggtgaaggcctgcataagttggggtatatcctcagagatattagtaaaataccaggaggcaatatgtacgcggacgatacagcaggttgggacactaggatcaccgaggatgacctgcagaacgaggccaagattacggatatcatggaacccgagcacgctctacttgccacctccatttttaaactgacatatcagaataaggtggtccgcgtgcagagacctgcaaagaacgggactgtgatggacgtcatcagccggagggatcaacgtggatctggccaggttggcacctacgggctcaacacattcactaatatggaagtgcagctgatacgacagatggagtcggaaggaatctttttgccatcagagttagagacccccaacctggctgaacgcgtactcgactggcttgagaaacatggtgccgaaagactgaagcggatggctattagcggcgacgattgtgtggtcaaaccgatcgacgataggttcgccacggcactaacagcgctgaatgacatggggaaggtgcgcaaagatattcctcaatgggagccctccaagggatggaacgactggcagcaggttccattttgcagtcaccacttccatcagctcgtgatgaaggatggcagagaaatcgtcgtgccttgtcggaatcaagacgagttggtaggtagggcccgagtttctcagggggctggatggagcctgcgtgagaccgcctgccttggcaaatcctatgcacagatgtggcaactgatgtactttcacagacgcgatctccggttagctgccaacgcaatatgttcagccgtgcccgtcgactgggtgccaactagtaggacaacctggtctattcatgcgcaccaccagtggatgactaccgaagatatgctgagcgtttggaatagagtgtggatcgaggaaaacccctggatggaggacaagacacatgtctcctcatgggaagaggtgccttatttgggcaaacgcgaggaccagtggtgcgggagcctgatcggactcacggctcgggccacctgggcaactaatattcaggtagccataaaccaagtgaggcgacttatcggtaatgaaaactacctggattacatgacatctatgaagagattcaaaaatgagtccgacccagaaggcgctctatggtga

SEQ ID NO: 13506 - RNA, 9879 nt, synthetic construct
  misc_feature 1..9879: note = derived and/or modified CDS sequence (opt3) from DENV-1__FJ639796__SS-prME
  source 1..9879: mol_type = other RNA
agcgtgaccatgctgctcatgcttctgcccacagccttggctttccacttaactacgagaggcggggagcctcatatgatcgtctccaagcaggaaaggggaaaatctctgctatttaagacctcagcaggtgttaacatgtgcacactcattgccatggacctgggcgagctttgtgaagatactatgacctacaaatgcccacggataacagaggcggaaccggacgatgtggactgttggtgcaatgctaccgatacttgggtaacatatgggacctgtagtcaaacgggagagcaccgccgagacaagcgtagcgtggccctggcaccccatgtcggcttgggtctcgagactagaaccgaaacatggatgtcctctgagggggcctggaaacagatccagagggtggaaacttgggctctgcggcaccctggattcaccgttattgcactgtttctcgcccatgctatcggcacatcgattacccagaagggcatcatattcatcttactgatgcttgtgacgccatcaatggccatgcgctgcgtcgggattggaaacagagattttgtggagggtttgagcggcgcgacttgggtagacgttgtgctggagcacgggagttgtgtcacaaccatggcaaagaataaacccactctagatatcgaactcctgaagacagaggtgaccaaccctgccgtgcttaggaaactgtgcattgaagctaagatctccaatacgaccacagactctcggtgtccaactcaaggagaggccaccttggtcgaagagcaggatgcaaacttcgtttgccgccgaacatttgtggacagaggctggggtaatgggtgtggactcttcggcaaaggcagcctgttaacttgcgctaagtttaagtgcgtaaccaaactggaggggaagatagtgcagtacgaaaacctcaaatattccgtcattgtgacagttcacaccggagatcagcatcaagtgggtaatgagactacggaacacggcacaatcgccaccattactccccaggcgcctacctcagagatccagcttacagactacggggccctgaccttggactgtagtccaaggactggactagatttcaacgaaatggtcctgctcacaatgaaggagaaaagctggctggtgcataagcagtggtttcttgacctgccgttgccctggacgtctggcgcatccacctcacaagagacttggaatcggcaggatctcctggtaacattcaaaaccgctcacgccaagaagcaggaagttgtggtcttaggtagccaagagggggctatgcacacagccctgactggcgcaaccgaaatccagacgagtggaaccacaactatttttgccggccatctaaaatgccgtctcaagatggacaaactgacccttaaggggatgtcttatgtgatgtgtacaggatccttcaaattggagaaggaagtcgctgagactcagcacggtaccgtgctggttcaggtgaagtacgagggcacggatgcgccttgcaaaataccattcagcacacaagacgaaaagggggtaacccagaacggacgcctcatcactgcaaatcccattgtcacagataaagagaagcctgtgaacatcgaaaccgagccaccctttggcgagtcgtatatagttgtgggtgccggggaaaaagctctgaagctttcttggttcaagaaaggctcctcaattggaaagatgtttgaggccactgcaagaggcgccaggcggatggctatcctgggggacaccgcctgggatttcggaagtatcggtggcgtctttacaagcgtggggaaattggtacatcaggtgttcggaacggcatacggcgttctcttttccggtgtctcttggaccatgaagattgggatcggcattctgttaacttggctgggactaaatagccgatcaacaagtctctccatgacctgtatagcggtgggcatggtgacactgtaccttggggtcatggttcaggctgacagcggatgcgtgatcaactggaaaggccgcgaattgaagtgtggttctgggattttcgtgactaacgaggtacacacctggacggaacaatataagtttcaggccgattcaccgaaaagactgagtgcagccatcggaaaggcttgggaggagggcgtctgcggtatcaggagcgccacacggctcgaaaatattatgtggaaacagatatccaacgagctgaatcatatcttactggaaaacgacatgaagttcaccgtggttgtgggcgacgcaaatgggattcttgctcagggaaaaaagatgatccgccctcaacccatggagcacaaatactcttggaagtcgtggggcaaggccaaaattatcggggcggatatacagaacactacctttatcattgacggaccagatacacctgaatgtcccgacggccagagagcctggaatatctgggaggtcgaggattatggtttcgggatttttactaccaacatctggttgaagctcagggacagctacacacagatgtgcgatcaccgtctgatgtccgctgcaataaaagactcaaaggccgtgcatgctgatatgggatattggattgaaagtgagaaaaatgaaacgtggaagctagcccgggcatctttcatcgaggttaagacctgtacttggccaaaaagccacacactgtggtccaacggcgtgctcgaatcagagatgattatccccaagatatacggtggccctatcagccaacataattatcgaccagggtacttcacccagactgcgggaccgtggcacctgggcaaacttgagttggactttgatctgtgcgaagggacaaccgtagtcgtggacgagcactgcggaaacagaggcccctctttaaggacgactaccgtgacaggtaagattatccatgaatggtgttgccgctcctgtaccctccctccactgcggttcagaggggaggatggatgctggtacggcatggagattaggcccgtcaaagaaaaggaggaaaatcttgttcgcagtatggtgagcgccggttctggcgaggtagactccttttcactggggatcttgtgtgtgagtataatgattgaagaggtcatgcgaagccggtggtcgcgtaagatgctcatgactggaacactggctgtgttcctactgctcatcatgggccagctgacctggaacgaccttatcagattgtgcattatggttggggccaatgcatccgataggatgggaatgggcacaacttatctggctttaatggccacctttaaaatgcgccctatgttcgcagtgggtctcctgtttcggagacttacgtctagggaggtcctgctactcacaatcgggctgagcttggtggcctcagttgaactgccaaacagtttagaggaactcggagacggcctggctatgggcattatgatgcttaagctgttgaccgagttccaaccccaccagctctggactaccctgctatccctgacatttgtgaaaactaccctttctctcgattacgcgtggaagacgacagccatggtcctgagcatagtatccttgttcccgctgtgtttatcaaccactagccagaaaacaacctggctccctgtgctgcttgggagttttggatgcaagccactgactatgttcttgatcacagaaaacaagatttggggtcgaaaatcttggcccctcaatgagggcatcatggcaattgggatcgtttccatactgctaagctcgctgcttaagaacgacgtgcctctcgctggacccctgatcgccggcggtatgttgattgcctgttatgtcatctcagggtctagtgctgatttatccctggagaaagcagccgaagtgagctgggagcaggaagcggagcattctggagctagccacaatattctcgtagaagtgcaagacgatggcaccatgaagatcaaagacgaggagcgcgatgacacgctgactatacttctgaaggccaccttgctagcagtctccggcgtttacccaatgtcaattcctgccacactgtttgtgtggtatttctggcagaaaaagaagcagcggagtggggtgctctgggatacccccagcccaccggaagtcgagagagctgtgctggacgatggaatctacaggatccttcagcgtggtttactgggccgctctcaagttggggtaggagtgttccaggacggcgtctttcatacaatgtggcacgtgactcggggtgcagttctcatgtatcaggggaaaagattggaaccttcctgggcctcagtgaagaaagacctgattagttacggaggcggctggaggttccaggggagctggaacaccggagaggaggtccaagtgatagcggtagaacccggtaagaatccaaaaaacgtccagacgacacccggcacttttaagacccctgagggggaagtgggagctatcgccctcgatttcaagccaggcacatccggttctcccattgttaatcgagaggggaaaatcgtgggactgtacggcaacggcgtcgtgaccacttcggggacctatgttagcgcaattgcccaggctaaggcctcacaagaaggacctcttccggagatcgaggacgaagtgtttaaaaagcggaatctgacaataatggatttgcacccaggttccggcaaaacgcgcagatacctacccgcaatcgtcagggaggctattaagcggaagctgcgaactctcatcttagcccctaccagagtggtagcgagtgaaatggccgaggcactgaaagggatgccaattcgctatcagacaaccgctgtgaagtctgaacatactggaagggagatcgttgaccttatgtgccacgccacattcaccatgcgtctgctcagccccgtccgggtgcctaactacaatatgataattatggatgaggctcattttacggacccggcatccatcgccgccagaggctatatctcaactagggtgggtatgggggaagctgcggcaattttcatgacagccacccccccaggatctgtcgaggcttttcctcagagcaacgccgtaatccaggatgaagagcgcgacatacccgaacgaagttggaattccggctacgattggattaccgacttcccaggcaaaactgtgtggtttgttcctagcatcaagtctgggaacgatattgcaaattgtttgagaaaaaacggaaagcgggtgatccaactgtcaaggaagacattcgacaccgagtatcagaaaacaaagaacaatgactgggattacgtcgtgactacggacatatccgagatgggtgccaacttccgcgctgatcgtgttattgaccccagacggtgcctcaaaccagtgatcctgaaggatggcccggaaagggtcatccttgcggggcctatgcccgtgaccgtagccagtgcagctcagcgccgaggaagaattggccggaatcagaacaaagagggtgaccaatacgtgtatatggggcagccactaaataacgatgaagaccacgcccattggacagaggcaaagatgctgttggataatatcaacactcccgagggcattatacctgccttatttgaaccagagagggaaaagagcgctgccatcgacggagagtaccgcctgagaggcgaagcgaggaaaaccttcgttgagctcatgcggcgtggggatctgcccgtctggctttcgtataaggtggcatctgagggatttcagtactccgaccgccgatggtgcttcgatggtgaaagaaataaccaggtgctggaggaaaatatggacgtcgagatttggacaaaagaaggcgagaggaagaaactccggcctcgctggttggacgccagaacctatagcgatccgctggctctaagggagtttaaggaattcgccgctgggcggcgatcagttagtggagacctgatcctcgagatcggcaaacttccacaacacctgactttaagagcacagaacgccttggataatctggtgatgctccacaactctgaacagggtgggaaggcttaccgccatgccatggaggaactgcccgacacgattgagacccttatgctgctcgcattgatagcggtactgacaggcggagtgactttatttttcctatccggcaaggggctgggaaaaaccagcatcggtctcctttgtgtcacagcctcaagtgctctgttgtggatggccagcgtggagcctcactggattgcagcttccatcattctggaatttttcctcatggttctgcttatccccgagccagataggcagcggacccctcaagacaatcagctcgcctatgtggtcataggcctgttgtttatgatcctgactgtagcagccaacgaaatggggttactagagacaacgaagaaagatctgggaattggctacgtggctgcggagaaccatcagcacgccaccatgctcgacgttgatcttcgtcccgcatctgcttggactctgtacgccgtggccacaaccgtcatcaccccaatgatgagacacacaattgaaaatactacggcaaacatcagcttgaccgctatagccaatcaagcggctattctgatgggtctcgacaaggggtggcctatctccaaaatggatattggcgtgccgctgcttgccttaggatgctattcacaggtcaaccccctgacactcactgcagccgtgttgatgctggttgctcattacgcaatcataggcccagggctacaggccaaggcgaccagggaggctcagaagcgcacagccgcaggaatcatgaaaaatcctaccgtggacggcattgtagccatcgatctggaccccgtggtctatgacgctaagttcgaaaaacaactcggtcagattatgcttctgatcttgtgtacttctcagatactgctcatgcggacgacatgggccctgtgcgagagtattaccttagcaactgggccacttaccacactgtgggaaggatcgcctggcaagttttggaacactaccatcgctgttagcatggccaatatcttccgaggttcctacctcgcgggcgccgggctagcattctctctgatgaaatcattgggaggcgggagaaggggaacaggcgctcagggtgagacgctgggggagaagtggaagcgccaactcaaccagcttagcaaatccgaatttaatacctataagcggagtggaattatggaggtggatagatctgaagccaaagagggcctgaagcgtggtgaaactacaaaacacgcagtcagcaggggcaccgctaagttgcggtggttcgtggagcgcaacctggtaaagcccgaggggaaagtgatcgacctcggatgtggccgagggggatggtcatactattgcgccggcttaaagaaagttactgaagtgaagggttacacaaaagggggaccgggccatgaggaaccaatacctatggccacctacggctggaatctggtcaagcttcactccgggaaagatgtgtttttcatgcccccagagaagtgtgacacgctgctatgcgatattggagaaagtagccccaaccctaccatcgaggagggtagaacactcagggtcctgaagatggtggaaccgtggttgaaaggcaatcagttttgtattaagatcctgaacccctatatgccatctgttgtagagactctcgaacagatgcaacggaaacatgggggaatgcttgtgcgcaatcctctgtccagaaactcaacccacgagatgtactgggtcagctgcggcacaggtaatatagtgtcggcggttaacatgacttctaggatgttactgaaccgattcaccatggctcaccggaagcccacatatgagcgtgacgtggatttgggggcaggaaccagacatgtcgccgtggaacctgaggtagctaatctcgacatcattggccagcgcatcgaaaacattaaaaatgagcacaagagtacttggcattacgatgaagacaacccatataagacgtgggcctaccacggctcctatgaggtgaaacccagcgggtcagcatcctctatggttaatggagtcgtgaggctgctaacaaagccttgggatgtgatcccaatggtcacccagattgccatgactgacaccacaccctttggtcaacagcgggttttcaaagagaaggtggacacgagaaccccgcgcgctaaaaggggcactacacagatcatggaagtaaccgcgaagtggctttgggggtttctgagccgaaacaagaaacctcggatatgtactagagaggaattcacaaggaaggtgcgcagtaatgccgcaattggagctgtctttgtggatgagaaccagtggaattccgccaaagaagcagttgaggacgagcgtttctgggatctcgtgcaccgggaaagagagctgcataagcaaggcaaatgcgccacctgcgtctacaacatgatgggtaagagggaaaagaaattgggggagtttggaaaggctaaaggcagccgcgccatctggtacatgtggctgggcgcgcgattcctcgaattcgaggcacttgggtttatgaatgaggaccactggttctctcgggaaaactcactgagtggagtggagggtgaaggcttacataagctggggtatatcttgagagatatttccaaaataccaggaggcaatatgtacgccgacgatacagctggttgggacactaggatcaccgaggatgacctccagaacgaggccaagattacggatatcatggaacccgagcacgcactgctagctaccagcatttttaaacttacatatcagaataaggtagttcgcgtgcagagacctgccaagaacgggactgtcatggacgtgatctctcggagggatcaacgtggatcgggccaggtgggcacctacgggctgaacacattcactaatatggaagtccagctcatacgacagatggagtcagaaggaatctttctgccaagcgagttggagacccccaacttagctgaacgcgttctggactggctcgagaaacatggtgccgaaagacttaagcggatggcaatttccggcgacgattgtgtggtaaaaccgatcgacgataggttcgcgacggccctgacagctctaaatgacatggggaaggtgcgcaaagatattcctcaatgggagcccagtaagggatggaacgactggcagcaggtcccattttgctctcaccacttccatcagctgatcatgaaggatggcagagaaatagtggttccttgtcggaatcaagacgagctcgtgggtagggcccgagtcagccagggggcaggatggtccttgcgtgagaccgcttgcctgggcaaatcatatgcccagatgtggcaacttatgtactttcacagacgcgatctgcggctcgcagccaacgcgatttgtagtgctgtgcccgtagactgggttccaacttctaggacaacctggagcatccatgcccaccaccagtggatgactaccgaagatatgttatccgtgtggaatagagtctggatcgaggaaaacccctggatggaggacaagacacatgtgtcaagctgggaagaggttccttatctgggcaaacgcgaggaccagtggtgcgggtctttgattggactgacggcacgggccacctgggctactaatatacaggtggccatcaaccaagtcaggcgactcattggtaatgaaaactaccttgattacatgacatccatgaagagattcaaaaatgagagtgacccagaaggcgcactgtggtga

SEQ ID NO: 13507 - RNA, 9879 nt, synthetic construct
  misc_feature 1..9879: note = derived and/or modified CDS sequence (opt3) from DENV-1__FJ639797__SS-prME
  source 1..9879: mol_type = other RNA
agcgtgaccatgctgctcatgcttctgcccacagccttggctttccacttaactacgagaggcggggagcctcatatgatcgtctccaagcaggaaaggggaaaatctctgctatttaagacctcagcaggtgttaacatgtgcacactcattgccatggacctgggcgagctttgtgaagatactatgacctacaaatgcccacggataacagaggcggaaccggacgatgtggactgttggtgcaatgctaccgatacttgggtaacatatgggacctgtagtcaaacgggagagcaccgccgagacaagcgtagcgtggccctggcaccccatgtcggcttgggtctcgagactagaaccgaaacatggatgtcctctgagggggcctggaaacagatccagagggtggaaacttgggctctgcggcaccctggattcaccgttattgcactgtttctcgcccatgctatcggcacatcgattacccagaagggcatcatattcatcttactgatgcttgtgacgccatcaatggccatgcgctgcgtcgggattggaaacagagattttgtggagggtttgagcggcgcgacttgggtagacgttgtgctggagcacgggagttgtgtcacaaccatggcaaagaataaacccactctagatatcgaactcctgaagacagaggtgaccaaccctgccgtgcttaggaaactgtgcattgaagctaagatctccaatacgaccacagactctcggtgtccaactcaaggagaggccaccttggtcgaagagcaggatgcaaacttcgtttgccgccgaacatttgtggacagaggctggggtaatgggtgtggactcttcggcaaaggcagcctgttaacttgcgctaagtttaagtgcgtaaccaaactggaggggaagatagtgcagtacgaaaacctcaaatattccgtcattgtgacagttcacaccggagatcagcatcaagtgggtaatgagactacggaacacggcacaatcgccaccattactccccaggcgcctacctcagagatccagcttacagactacggggccctgaccttggactgtagtccaaggactggactagatttcaacgaaatggtcctgctcacaatgaaggagaaaagctggctggtgcataagcagtggtttcttgacctgccgttgccctggacgtctggcgcatccacctcacaagagacttggaatcggcaggatctcctggtaacattcaaaaccgctcacgccaagaagcaggaagttgtggtcttaggtagccaagagggggctatgcacacagccctgactggcgcaaccgaaatccagacgagtggaaccacaactatttttgccggccatctaaaatgccgtctcaagatggacaaactgacccttaaggggatgtcttatgtgatgtgtacaggatccttcaaattggagaaggaagtcgctgagactcagcacggtaccgtgctggttcaggtgaagtacgagggcacggatgcgccttgcaaaataccattcagcacacaagacgaaaagggggtaacccagaacggacgcctcatcactgcaaatcccattgtcacagataaagagaagcctgtgaacatcgaaaccgagccaccctttggcgagtcgtatatagttgtgggtgccggggaaaaagctctgaagctttcttggttcaagaaaggctcctcaattggaaagatgtttgaggccactgcaagaggcgccaggcggatggctatcctgggggacaccgcctgggatttcggaagtatcggtggcgtctttacaagcgtggggaaattggtacatcaggtgttcggaacggcatacggcgttctcttttccggtgtctcttggaccatgaagattgggatcggcattctgttaacttggctgggactaaatagccgatcaacaagtctctccatgacctgtatagcggtgggcatggtgacactgtaccttggggtcatggttcaggctgacagcggatgcgtgatcaactggaaaggccgcgaattgaagtgtggttctgggattttcgtgactaacgaggtacacacctggacggaacaatataagtttcaggccgattcaccgaaaagactgagtgcagccatcggaagggcttgggaggagggcgtctgcggtatccggagcgccacacgcctcgaaaatattatgtggaagcagatatccaacgagctgaatcatatcttactggaaaacgacatgaaattcaccgtggttgtgggcgacgcaaatgggattcttgctcagggaaagaaaatgatcagacctcaacccatggagcacaagtactcttggaaatcgtggggcaaggccaagattatcggggcggatatacagaacactacctttatcattgacggaccagatacacctgaatgtcccgacggccagagggcctggaatatctgggaggtcgaggattatggtttcgggatttttactaccaacatctggttgaaactccgtgacagctacacacagatgtgcgatcaccggctgatgtccgctgcaataaaggactcaaaagccgtgcatgctgatatgggatattggattgaaagtgagaagaatgaaacgtggaaactagcccgagcatctttcatcgaggttaagacctgtatttggccaaagagccacactctgtggtccaacggcgtgctcgaatcagagatgatcatacccaaaatctacggtggccctattagccaacataattatagaccagggtacttcacacagaccgcgggaccgtggcacctgggcaagcttgagttggactttgatctgtgcgaagggactacagtagtcgtggacgagcactgcggaaacaggggcccctctttacgcaccacgactgtgaccggtaaaatcattcatgaatggtgttgccggtcctgtacactccctccactgagattcaggggggaggatggatgctggtacggcatggagatccgccccgtcaaggaaaaagaggaaaatcttgttcgaagtatggtgagcgccggttctggcgaggtagactccttttcactggggatattgtgtgtgagtattatgatcgaagaggtcatgcggagccgttggtcgagaaagatgctcatgaccggaactctggctgtgttcctactgctcatcatgggccagctgacatggaacgaccttattaggttgtgcatcatggttggggccaatgcatccgatcgcatgggaatgggcaccacatatctggctttaatggccacttttaagatgcggcctatgttcgcagtgggtctcctgtttagaaggcttacctctcgagaggtcctgctactcacgattgggctgagcttggtggcctcagttgaactgccaaacagtttagaggaactcggagacggcctggctatgggcataatgatgcttaaactgttgacagagttccaaccccaccagctctggaccactctgctatccctgacctttgtgaagacaactctttctctcgattacgcgtggaaaaccacggccatggtcctgagcatcgtatccttgttcccgctgtgtttatcaacaaccagccagaagactacatggctccctgtgctgcttgggagttttggatgcaaaccactgaccatgttcttgattactgaaaacaagatctggggtcgcaagtcttggcccctcaatgagggcattatggcaatcgggatagtttccatcctgctaagctcgctgcttaaaaacgacgtgcctctcgctggacccctgattgccggcggtatgttgatcgcctgttatgtcatttcagggtctagtgctgatttatccctggagaaggcagccgaagtgagctgggagcaggaagcggagcattctggagctagccacaatatcctcgtagaagtgcaagacgatggcacaatgaaaataaaggacgaggagcgggatgacaccctgacgattcttctgaaagccactttgctagcagtctccggcgtttacccaatgtcaatccctgccaccctgtttgtgtggtatttctggcagaagaaaaagcagagaagtggggtgctctgggatacacccagcccaccggaagtcgagagggctgtgctggacgatggaatctaccgtattcttcagcgcggtttactgggccggtctcaagttggggtaggagtgttccaggacggcgtctttcataccatgtggcacgtgacaagaggtgcagttctcatgtatcaggggaagaggttggaaccttcctgggcctcagtgaaaaaggacctgataagttacggaggcggctggcgattccaggggagctggaacactggagaggaggtccaagtgatcgcggtagaacccggtaaaaatccaaagaacgtccagaccacgcccggcacatttaaaactcctgagggggaagtgggagctattgccctcgatttcaagccaggcacctccggttctcccatcgttaatcgggaggggaagattgtgggactgtacggcaacggcgtcgtgacaacctcggggacttatgttagcgcaatcgcccaggctaaagcctcacaagaaggacctcttccggagatagaggacgaagtgtttaagaaacgcaatctgaccatcatggatttgcacccaggttccggcaagacaagaaggtacctacccgcaattgtccgggaggctatcaaacgaaagctgagaacgctcattttagcccctactcgcgtggtagcgagtgaaatggccgaggcactgaaggggatgccaatcaggtatcagaccacagctgtgaaatctgaacataccggacgtgagatagttgaccttatgtgccacgccactttcacaatgcggctgctcagccccgtcagagtgcctaactacaatatgattatcatggatgaggctcattttaccgacccggcatccatcgccgccaggggctatatttcaacgcgcgtgggtatgggggaagctgcggcaatcttcatgactgccacacccccaggatctgtcgaggcttttcctcagagcaacgccgtaatacaggatgaagagcgagacattcccgaaagaagttggaattccggctacgattggatcaccgacttcccaggcaagaccgtgtggtttgttcctagcattaaatctgggaacgatatcgcaaattgtttgcggaagaacggaaaaagggtgatacaactgtcacgcaagactttcgacacagagtatcagaagaccaaaaacaatgactgggattacgtcgtgacaactgacatttccgagatgggtgccaacttccgtgctgatagagttatcgacccccggaggtgcctcaagccagtgatcctgaaagatggcccggaacgcgtcattcttgcggggcctatgcccgtgacggtagccagtgcagctcagcgaagaggacggatcggcaggaatcagaacaaggagggtgaccaatacgtgtatatggggcagccactaaataacgatgaagaccacgcccattggaccgaggcaaaaatgctgttggataatattaacacacccgagggcataatccctgccttatttgaaccagagcgcgaaaagagcgctgccattgacggagagtacagactgaggggcgaagcgcggaagactttcgttgagctcatgcgtcgcggggatctgcccgtctggctttcgtataaagtggcatctgagggatttcagtactccgaccgaagatggtgcttcgatggtgaaaggaataaccaggtgctggaggaaaatatggacgtcgagatctggaccaaggaaggcgagcggaaaaagctccgccctagatggttggacgccaggacatatagcgatccgctggctctacgggagtttaaagaattcgccgctgggcgaagatcagttagtggagacctgatcctcgagattggcaagcttccacaacacctgaccttacgcgcacagaacgccttggataatctggtgatgctccacaactctgaacagggtgggaaagcttacaggcatgccatggaggaactgcccgacactatagagacgcttatgctgctcgcattgatcgcggtactgaccggcggagtgacattatttttcctatccggcaaggggctgggaaagactagcattggtctcctttgtgtcaccgcctcaagtgctctgttgtggatggccagcgtggagcctcactggatcgcagcttccattatcctggaatttttcctcatggttctgcttatacccgagccagatcggcagcgtacacctcaagacaatcagctcgcctatgtggtcatcggcctgttgtttatgattctgaccgtagcagccaacgaaatggggttactagagactacaaaaaaggatctgggaatcggctacgtggctgcggagaaccatcagcacgccacgatgctcgacgttgatcttagacccgcatctgcttggaccctgtacgccgtggccactacagtcattaccccaatgatgaggcacaccatcgaaaatacaactgcaaacataagcttgacggctattgccaatcaagcggctatcctgatgggtctcgacaaagggtggcctatttccaagatggatatcggcgtgccgctgcttgccttaggatgctattcacaggtcaaccccctgaccctcacagcagccgtgttgatgctggttgctcattacgcaataatcggcccagggctacaggccaaagcgactcgcgaggctcagaagcggaccgccgcaggaattatgaagaatcctacagtggacggcatcgtagccattgatctggaccccgtggtctatgacgctaaattcgaaaagcaactcggtcagatcatgcttctgatattgtgtacctctcagattctgctcatgcgaactacgtgggccctgtgcgagagtatcacattagcaaccgggccacttactaccctgtgggaaggatcgcctggcaaattttggaacacaactatcgctgttagcatggccaatattttcagaggttcctacctcgcgggcgccgggctagcattctctctgatgaagtcattgggaggcgggaggcgcggaaccggcgctcagggtgagacactgggggagaaatggaagcggcaactcaaccagcttagcaagtccgaatttaatacgtataaaagaagtggaatcatggaggtggatcgttctgaagccaaggagggcctgaaaaggggtgaaaccactaagcacgcagtcagccggggcacagctaaattgcgctggttcgtggagcgaaacctggtaaagcccgaggggaaggtgatagacctcggatgtggcagagggggatggtcatactattgcgccggcttaaaaaaggttaccgaagtgaaaggttacactaaggggggaccgggccatgaggaaccaattcctatggccacatacggctggaatctggtcaaacttcactccgggaaggatgtgtttttcatgcccccagagaaatgtgacaccctgctatgcgatatcggagaaagtagccccaaccctacgattgaggagggtaggaccctccgggtcctgaagatggtggaaccgtggttgaagggcaatcagttttgtatcaaaatactgaacccctatatgccatctgttgtagagacactcgaacagatgcaacgcaagcatgggggaatgcttgtgagaaatcctctgtccaggaactcaactcacgagatgtactgggtcagctgcggcaccggtaatatcgtgtcggcggttaacatgacatctcgaatgttactgaaccggttcactatggctcaccgtaaacccacctatgagagagacgtggatttgggggcaggaacacgccatgtcgccgtggaacctgaggtagctaatctcgacattatcggccagaggattgaaaacatcaagaatgagcacaaaagtacctggcattacgatgaagacaacccatataagacttgggcctaccacggctcctatgaggtgaagcccagcgggtcagcatcctctatggttaatggagtcgtgcggctgctaacgaaaccttgggatgtgattccaatggtcacacagatcgccatgaccgacactaccccctttggtcaacagagagttttcaaggagaaagtggacacacgcacgccgagggctaagcgaggcaccactcagataatggaagtaacagcgaaatggctttgggggtttctgagccggaacaagaagcctagaatttgtaccagggaggaattcactcgcaaagtgcgtagtaatgccgcaatcggagctgtctttgtggatgagaaccagtggaattccgccaaggaagcagttgaggacgagcggttctgggatctcgtgcacagagaaagggagctgcataaacaaggcaagtgcgccacatgcgtctacaacatgatgggtaaacgcgaaaagaagttgggggagtttggaaaagctaagggcagccgagccatctggtacatgtggctgggcgcgcggttcctcgaattcgaggcacttgggtttatgaatgaggaccactggttctctagagaaaactcactgagtggagtggagggtgaaggcttacataaactggggtatattttgagggatatatccaagatcccaggaggcaatatgtacgccgacgataccgctggttgggacacacgcattactgaggatgacctccagaacgaggccaaaatcaccgatattatggaacccgagcacgcactgctagctacgagcatctttaagcttacctatcagaataaagtagttagagtgcagcggcctgccaagaacgggacagtcatggacgtgatatctaggcgtgatcaacgaggatcgggccaggtgggcacttacgggctgaacaccttcacaaatatggaagtccagctcatccgccagatggagtcagaaggaatttttctgccaagcgagttggagactcccaacttagctgaaagagttctggactggctcgagaagcatggtgccgaacggcttaaaaggatggcaatctccggcgacgattgtgtggtaaagccgattgacgatcgcttcgcgaccgccctgacggctctaaatgacatggggaaagtgagaaaggatatccctcaatgggagcccagtaaaggatggaacgactggcagcaggtcccattttgctctcaccacttccatcagctgataatgaaggatggccgggaaattgtggttccttgtaggaatcaagacgagctcgtgggtcgagcccgtgtcagccagggggcaggatggtccttgagagagacagcttgcctgggcaagtcatatgcccagatgtggcaacttatgtactttcaccgccgggatctgaggctcgcagccaacgcgatctgtagtgctgtgcccgtagactgggttccaacctctagaactacatggagcatccatgcccaccaccagtggatgaccactgaagatatgttatccgtgtggaatcgcgtctggattgaggaaaacccctggatggaggacaaaacccatgtgtcaagctgggaagaggttccttatctgggcaagcgggaggaccagtggtgcgggtctttgataggactgacagcaagggccacgtgggctaccaatatccaggtggccattaaccaagtccgaagactcatcggtaatgaaaactaccttgattacatgacttccatgaaacggttcaagaatgagagtgacccagaaggcgcactgtggtga

SEQ ID NO: 13508 - RNA, 9879 nt, synthetic construct
  misc_feature 1..9879: note = derived and/or modified CDS sequence (opt3) from DENV-1__FJ639802__SS-prME
  source 1..9879: mol_type = other RNA
agcgtgaccatgctgctcatgcttctgcccacagccttggctttccacttaactacgagaggcggggagcctcatatgatcgtctccaagcaggaaaggggaaaatctctgctatttaagacctcagcaggtgttaacatgtgcacactcattgccatggacctgggcgagctttgtgaagatactatgacctacaaatgcccacggataacagaggcggaaccggacgatgtggactgttggtgcaatgctaccgatacttgggtaacatatgggacctgtagtcaaacgggagagcaccgccgagacaagcgtagcgtggccctggcaccccatgtcggcttgggtctcgagactagaaccgaaacatggatgtcctctgagggggcctggaaacagatccagagggtggaaacttgggctctgcggcaccctggattcaccgttattgcactgtttctcgcccatgctatcggcacatcgattacccagaagggcatcatattcatcttactgatgcttgtgacgccatcaatggccatgcgctgcgtcgggattggaaacagagattttgtggagggtttgagcggcgcgacttgggtagacgttgtgctggagcacgggagttgtgtcacaaccatggcaaagaataaacccactctagatatcgaactcctgaagacagaggtgaccaaccctgccgtgcttaggaaactgtgcattgaagctaagatctccaatacgaccacagactctcggtgtccaactcaaggagaggccaccttggtcgaagagcaggatgcaaacttcgtttgccgccgaacatttgtggacagaggctggggtaatgggtgtggactcttcggcaaaggcagcctgttaacttgcgctaagtttaagtgcgtaaccaaactggaggggaagatagtgcagtacgaaaacctcaaatattccgtcattgtgacagttcacaccggagatcagcatcaagtgggtaatgagactacggaacacggcacaatcgccaccattactccccaggcgcctacctcagagatccagcttacagactacggggccctgaccttggactgtagtccaaggactggactagatttcaacgaaatggtcctgctcacaatgaaggagaaaagctggctggtgcataagcagtggtttcttgacctgccgttgccctggacgtctggcgcatccacctcacaagagacttggaatcggcaggatctcctggtaacattcaaaaccgctcacgccaagaagcaggaagttgtggtcttaggtagccaagagggggctatgcacacagccctgactggcgcaaccgaaatccagacgagtggaaccacaactatttttgccggccatctaaaatgccgtctcaagatggacaaactgacccttaaggggatgtcttatgtgatgtgtacaggatccttcaaattggagaaggaagtcgctgagactcagcacggtaccgtgctggttcaggtgaagtacgagggcacggatgcgccttgcaaaataccattcagcacacaagacgaaaagggggtaacccagaacggacgcctcatcactgcaaatcccattgtcacagataaagagaagcctgtgaacatcgaaaccgagccaccctttggcgagtcgtatatagttgtgggtgccggggaaaaagctctgaagctttcttggttcaagaaaggctcctcaattggaaagatgtttgaggccactgcaagaggcgccaggcggatggctatcctgggggacaccgcctgggatttcggaagtatcggtggcgtctttacaagcgtggggaaattggtacatcaggtgttcggaacggcatacggcgttctcttttccggtgtctcttggaccatgaagattgggatcggcattctgttaacttggctgggactaaatagccgatcaacaagtctctccatgacctgtatagcggtgggcatggtgacactgtaccttggggtcatggttcaggctgacagcggatgcgtgatcaactggaaaggccgcgaattgaagtgtggttctgggattttcgtgactaacgaggtacacacctggacggaacaatatagatttcaggccgattcaccgaagaggctgagtgcagccatcggaaaagcttgggaggagggcgtctgcggtatccggagcgccacacgcctcgaaaatattatgtggaagcagatatccaacgagctgaatcatatcttactggaaaacgacatgaaattcaccgtggttgtgggcgacgcaaatgggattcttgctcagggaaagaaaatgatcagacctcaacccatggagcacaagtactcttggaaatcgtggggcaaggccaagattatcggggcggatatacagaacactacctttatcattgacggaccagatacacctgaatgtcccgacggccagagggcctggaatatctgggaggtcgaggattatggtttcgggatttttactaccaacatctggttgaaactccgtgacagctacacacagatgtgcgatcaccggctgatgtccgctgcaataaaggactcaaaagccgtgcatgctgatatgggatattggattgaaagtgagaagaatgaaacgtggaaactagcccgagcatctttcatcgaggttaagacctgtatttggccaaagagccacactctgtggtccaacggcgtgctcgaatcagagatgatcatacccaaaatctacggtggccctattagccaacataattatagaccagggtacttcacacagaccgcgggaccgtggcacctgggcaagcttgagttggactttgatctgtgcgaagggactacagtagtcgtggacgagcactgcggaaacaggggcccctctttacgcaccacgactgtgaccggtaaaatcattcatgaatggtgttgccggtcctgtacactccctccactgagattcaggggggaggatggatgctggtacggcatggagatccgccccgtcaaggaaaaagaggaaaatcttgttcgaagtatggtgagcgccggttctggcgaggtagactccttttcactggggatattgtgtgtgagtattatgatcgaagaggtcatgcggagccgttggtcgagaaagatgctcatgaccggaactctggctgtgttcctactgctcatcatgggccagctgacatggaacgaccttattaggttgtgcatcatggttggggccaatgcatccgatcgcatgggaatgggcaccacatatctggctttaatggccacttttaagatgcggcctatgttcgcagtgggtctcctgtttagaaggcttacctctcgagaggtcctgctactcacgattgggctgagcttggtggcctcagttgaactgccaaacagtttagaggaactcggagacggcctggctatgggcataatgatgcttaaactgttgacagagttccaaccccaccagctctggaccactctgctatccctgacctttgtgaagacaactctttctctcgattacgcgtggaaaaccacggccatggtcctgagcatcgtatccttgttcccgctgtgtttatcaacaaccagccagaagactacatggctccctgtgctgcttgggagttttggatgcaaaccactgaccatgttcttgattactgaaaacaagatctggggtcgcaagtcttggcccctcaatgagggcattatggcaatcgggatagtttccatcctgctaagctcgctgcttaaaaacgacgtgcctctcgctggacccctgattgccggcggtatgttgatcgcctgttatgtcatttcagggtctagtgctgatttatccctggagaaggcagccgaagtgagctgggagcaggaagcggagcattctggagctagccacaatatcctcgtagaagtgcaagacgatggcacaatgaaaataaaggacgaggagcgggatgacaccctgacgattcttctgaaagccactttgctagcagtctccggcgtttacccaatgtcaatccctgccaccctgtttgtgtggtatttctggcagaagaaaaagcagagaagtggggtgctctgggatacacccagcccaccggaagtcgagagggctgtgctggacgatggaatctaccgtattcttcagcgcggtttactgggccggtctcaagttggggtaggagtgttccaggacggcgtctttcataccatgtggcacgtgacaagaggtgcagttctcatgtatcaggggaagaggttggaaccttcctgggcctcagtgaaaaaggacctgataagttacggaggcggctggcgattccaggggagctggaacactggagaggaggtccaagtgatcgcggtagaacccggtaaaaatccaaagaacgtccagaccacgcccggcacatttaaaactcctgagggggaagtgggagctattgccctcgatttcaagccaggcacctccggttctcccatcgttaatcgggaggggaagattgtgggactgtacggcaacggcgtcgtgacaacctcggggacttatgttagcgcaatcgcccaggctaaagcctcacaagaaggacctcttccggagatagaggacgaagtgtttaagaaacgcaatctgaccatcatggatttgcacccaggttccggcaagacaagaaggtacctacccgcaattgtccgggaggctatcaaacgaaagctgagaacgctcattttagcccctactcgcgtggtagcgagtgaaatggccgaggcactgaaggggatgccaatcaggtatcagaccacagctgtgaaatctgaacataccggacgtgagatagttgaccttatgtgccacgccactttcacaatgcggctgctcagccccgtcagagtgcctaactacaatatgattatcatggatgaggctcattttaccgacccggcatccatcgccgccaggggctatatttcaacgcgcgtgggtatgggggaagctgcggcaatcttcatgactgccacacccccaggatctgtcgaggcttttcctcagagcaacgccgtaatacaggatgaagagcgagacattcccgaaagaagttggaattccggctacgattggatcaccgacttcccaggcaagaccgtgtggtttgttcctagcattaaatctgggaacgatatcgcaaattgtttgcggaagaacggaaaaagggtgatacaactgtcacgcaagactttcgacacagagtatcagaagaccaaaaacaatgactgggattacgtcgtgacaactgacatttccgagatgggtgccaacttccgtgctgatagagttatcgacccccggaggtgcctcaagccagtgatcctgaaagatggcccggaacgcgtcattcttgcggggcctatgcccgtgacggtagccagtgcagctcagcgaagaggacggatcggcaggaatcagaacaaggagggtgaccaatacgtgtatatggggcagccactaaataacgatgaagaccacgcccattggaccgaggcaaaaatgctgttggataatattaacacacccgagggcataatccctgccttatttgaaccagagcgcgaaaagagcgctgccattgacggagagtacagactgaggggcgaagcgcggaagactttcgttgagctcatgcgtcgcggggatctgcccgtctggctttcgtataaagtggcatctgagggatttcagtactccgaccgaagatggtgcttcgatggtgaaaggaataaccaggtgctggaggaaaatatggacgtcgagatctggaccaaggaaggcgagcggaaaaagctccgccctagatggttggacgccaggacatatagcgatccgctggctctacgggagtttaaagaattcgccgctgggcgaagatcagttagtggagacctgatcctcgagattggcaagcttccacaacacctgaccttacgcgcacagaacgccttggataatctggtgatgctccacaactctgaacagggtgggaaagcttacaggcatgccatggaggaactgcccgacactatagagacgcttatgctgctcgcattgatcgcggtactgaccggcggagtgacattatttttcctatccggcaaggggctgggaaagactagcattggtctcctttgtgtcaccgcctcaagtgctctgttgtggatggccagcgtggagcctcactggatcgcagcttccattatcctggaatttttcctcatggttctgcttatacccgagccagatcggcagcgtacacctcaagacaatcagctcgcctatgtggtcatcggcctgttgtttatgattctgaccgtagcagccaacgaaatggggttactagagactacaaaaaaggatctgggaatcggctacgtggctgcggagaaccatcagcacgccacgatgctcgacgttgatcttagacccgcatctgcttggaccctgtacgccgtggccactacagtcattaccccaatgatgaggcacaccatcgaaaatacaactgcaaacataagcttgacggctattgccaatcaagcggctatcctgatgggtctcgacaaagggtggcctatttccaagatggatatcggcgtgccgctgcttgccttaggatgctattcacaggtcaaccccctgaccctcacagcagccgtgttgatgctggttgctcattacgcaataatcggcccagggctacaggccaaagcgactcgcgaggctcagaagcggaccgccgcaggaattatgaagaatcctacagtggacggcatcgtagccattgatctggaccccgtggtctatgacgctaaattcgaaaagcaactcggtcagatcatgcttctgatattgtgtacctctcagattctgctcatgcgaactacgtgggccctgtgcgagagtatcacattagcaaccgggccacttactaccctgtgggaaggatcgcctggcaaattttggaacacaactatcgctgttagcatggccaatattttcagaggttcctacctcgcgggcgccgggctagcattctctctgatgaagtcattgggaggcgggaggcgcggaaccggcgctcagggtgagacactgggggagaaatggaagcggcaactcaaccagcttagcaagtccgaatttaatacgtataaaagaagtggaatcatggaggtggatcgttctgaagccaaggagggcctgaaaaggggtgaaaccactaagcacgcagtcagccggggcacagctaaattgcgctggttcgtggagcgaaacctggtaaagcccgaggggaaggtgatagacctcggatgtggcagagggggatggtcatactattgcgccggcttaaaaaaggttaccgaagtgaaaggttacactaaggggggaccgggccatgaggaaccaattcctatggccacatacggctggaatctggtcaaacttcactccgggaaggatgtgtttttcatgcccccagagaaatgtgacaccctgctatgcgatatcggagaaagtagccccaaccctacgattgaggagggtaggaccctccgggtcctgaagatggtggaaccgtggttgaagggcaatcagttttgtatcaaaatactgaacccctatatgccatctgttgtagagacactcgaacagatgcaacgcaagcatgggggaatgcttgtgagaaatcctctgtccaggaactcaactcacgagatgtactgggtcagctgcggcaccggtaatatcgtgtcggcggttaacatgacatctcgaatgttactgaaccggttcactatggctcaccgtaaacccacctatgagagagacgtggatttgggggcaggaacacgccatgtcgccgtggaacctgaggtagctaatctcgacattatcggccagaggattgaaaacatcaagaatgagcacaaaagtacctggcattacgatgaagacaacccatataagacttgggcctaccacggctcctatgaggtgaagcccagcgggtcagcatcctctatggttaatggagtcgtgcggctgctaacgaaaccttgggatgtgattccaatggtcacacagatcgccatgaccgacactaccccctttggtcaacagagagttttcaaggagaaagtggacacacgcacgccgagggctaagcgaggcaccactcagataatggaagtaacagcgaaatggctttgggggtttctgagccggaacaagaagcctagaatttgtaccagggaggaattcactcgcaaagtgcgtagtaatgccgcaatcggagctgtctttgtggatgagaaccagtggaattccgccaaggaagcagttgaggacgagcggttctgggatctcgtgcacagagaaagggagctgcataaacaaggcaagtgcgccacatgcgtctacaacatgatgggtaaacgcgaaaagaagttgggggagtttggaaaagctaagggcagccgagccatctggtacatgtggctgggcgcgcggttcctcgaattcgaggcacttgggtttatgaatgaggaccactggttctctagagaaaactcactgagtggagtggagggtgaaggcttacataaactggggtatattttgagggatatatccaagatcccaggaggcaatatgtacgccgacgataccgctggttgggacacacgcattactgaggatgacctccagaacgaggccaaaatcaccgatattatggaacccgagcacgcactgctagctacgagcatctttaagcttacctatcagaataaagtagttagagtgcagcggcctgccaagaacgggacagtcatggacgtgatatctaggcgtgatcaacgaggatcgggccaggtgggcacttacgggctgaacaccttcacaaatatggaagtccagctcatccgccagatggagtcagaaggaatttttctgccaagcgagttggagactcccaacttagctgaaagagttctggactggctcgagaagcatggtgccgaacggcttaaaaggatggcaatctccggcgacgattgtgtggtaaagccgattgacgatcgcttcgcgaccgccctgacggctctaaatgacatggggaaagtgagaaaggatatccctcaatgggagcccagtaaaggatggaacgactggcagcaggtcccattttgctctcaccacttccatcagctgataatgaaggatggccgggaaattgtggttccttgtaggaatcaagacgagctcgtgggtcgagcccgtgtcagccagggggcaggatggtccttgagagagacagcttgcctgggcaagtcatatgcccagatgtggcaacttatgtactttcaccgccgggatctgaggctcgcagccaacgcgatctgtagtgctgtgcccgtagactgggttccaacctctagaactacatggagcatccatgcccaccaccagtggatgaccactgaagatatgttatccgtgtggaatcgcgtctggattgaggaaaacccctggatggaggacaaaacccatgtgtcaagctgggaagaggttccttatctgggcaagcgggaggaccagtggtgcgggtctttgataggactgacagcaagggccacgtgggctaccaatatccaggtggccattaaccaagtccgaagactcatcggtaatgaaaactaccttgattacatgacttccatgaaacggttcaagaatgagagtgacccagaaggcgcactgtggtga

SEQ ID NO: 13509 - RNA, 9879 nt, synthetic construct
  misc_feature 1..9879: note = derived and/or modified CDS sequence (opt3) from DENV-1__JN819410__SS-prME
  source 1..9879: mol_type = other RNA
agcgtgaccatgctgctcatgcttctgcccacagcattggctttccacttaactacgaggggcggggagcctcatatgatcgtatccaagcaggaaaggggaaaatctctgttatttaagacctcagccggtgttaacatgtgcaccctcattgccatggacctgggcgagctttgtgaagatactatgacctacaaatgcccacggataacagaggcggaaccggacgatgtggactgttggtgcaatgctaccgatacttgggtaacatatgggacctgtagtcagacgggagagcaccgccgagagaagcgtagcgtggccctggcaccccatgtcggcttgggtctcgaaactagaaccgagacatggatgtcctctgaaggggcctggaaacagatccagagggtggagacttgggctctgcggcaccctggattcaccgttattgcatttttcctggcccatgctatcggcacatcgattacccagaagggcatcatatttatcctcttaatgctggtgacgccatcaatggccatgcgctgcgtcgggattggaaacagggacttcgtggagggtcttagcggcgcgacttgggtagatgttgtgttggaacacgggagttgtgtcacaaccatggcaaagaataaacccactctggacatcgagctactcaagacagaagtgaccaaccctgccgtgctgaggaaactttgcattgaggctaagatctccaatacgaccacagattctcggtgtccaactcaaggagaagccaccctggtcgaggagcaggacgcaaactttgtttgccgccgaacattggtggatagaggctggggtaatgggtgtggactcttcggcaaaggcaacctgttaacttgcgctaagtttaagtgcgtaaccaaactggaagggaagatagtgcagtacgagaatctcaaatatagcgtcattgtgacagttcacaccggagaccagcatcaagtgggtaacgaaactacggagcacggcacaatcgccaccattactccccaggcgcctacctccgaaatccagcttacagattacggggccctgaccttggactgttcaccaaggactggactagacttcaatgagatggtcctgctcacaatgaaggagaaaagttggctggtgcataagcagtggtttcttgatctgccgttgccctggacgagcggcgcatctacctcccaagaaacttggaaccggcaggacctcctggtaacattcaaaaccgctcacgccaagaagcaggaggttgtggtcttaggttcacaagaaggggctatgcacacagccctgactggcgcaaccgagatccagacgagcggaaccacaactatttttgccggccatctaaaatgccgtctcaagatggataaactgacccttaaggggatgagttatgtgatgtgtacaggatctttcaaattggaaaaggaggtcgctgagactcagcacggtaccgtgctggttcaggtgaagtacgaaggcacggacgcgccttgcaaaataccattctccacacaagatgagaagggggtaacccagaatggacgcctcatcactgcaaaccccattgtcacagacaaagaaaagcctgtgaatatcgagaccgagccaccctttggcgaaagctatatagttgtgggtgccggggagaaagctctgaaactttcgtggttcaagagaggatcttccattggaaaaatgtttgaagccactgcaaggggcgcccggcgaatggctatcctgggggataccgcctgggacttcggatcaatcggtggcgtctttacaagtgtggggaagttggtacatcaggtgttcggaacggcatacggcgttctctttagcggtgtctcctggaccatgaaaattgggatcggcattctgttaacttggctgggactaaactctcgcagcacatcactcagtatgacctgtatagcggtgggcatggtgacactgtaccttggggtcatggttcaggctgattccggatgcgtgatcaactggaagggcagagagttgaaatgtggtagcgggattttcgtgactaatgaagtacacacctggacggagcaatataagtttcaggccgactctccgaagaggctgtcagcagccatcggaaaggcttgggaggaaggcgtctgcggtatccggagtgccacacgcctcgagaacattatgtggaagcagataagcaatgaactgaaccatatcttactggagaatgatatgaaattcaccgtggttgtgggcgacgcaaacgggattcttgctcagggaaagaaaatgatcagacctcaacccatggaacacaagtactcctggaaatcttggggcaaggccaagattatcggggcggacatacagaatactacctttatcattgatggaccagacacacctgagtgtcccgatggccagagggcctggaacatctgggaggtcgaagactatggtttcggggtgtttactaccaatatttggttgaaactccgtgattcgtacacacagatgtgcgaccaccggctgatgagcgctgcaatcaaggattccaaagccgttcatgctgacatgggatattggatagagtcagaaaagaacgagacgtggaaactagcccgagcaagtttcattgaagtgaagacctgtacttggccaaagtctcacacactgtggagcaatggcgtactcgagtccgagatgatcattcccaaaatctacggtggccctatatcacaacataactatagaccagggtacttcacccagactgcgggaccgtggcacctgggcaaacttgaattggattttgacctgtgcgaggggacaaccgtcgtggtggatgaacactgcggaaataggggccccagcttacgcacgactaccgtcacaggtaaaatcattcatgagtggtgttgccggtcttgtaccctccctccactgagattcagaggggaagacggatgctggtacggcatggaaatccgccccgttaaggagaaagaagagaaccttgtgcgatccatggtaagtgccggtagcggcgaagtggattctttttccctggggattttgtgtgtctcaatcatgatagaggaggtgatgcggagtcgttggagcagaaagatgctcatgactggaacactggctgttttcctactgctcattatgggccagctgacctggaatgaccttatcaggttgtgcatcatggtgggggccaacgcatcggaccgcatgggaatgggcacaacttatctggctttaatggccacctttaagatgcggcctatgttcgcagtcggtctcctgtttagaaggcttacgtcccgagaagtgctgctactcacaattgggctgtctttggttgccagcgtggagctgccaaactcattagaggaactcggagatggcctggctatgggcatcatgatgcttaaactgttgaccgagttccaaccccaccagctctggactaccctgctaagtctgacatttattaagactaccctttccctcgactacgcgtggaaaacgacagccatggtcctgtctatagtcagcttgttcccgctgtgtttatccaccacttcacagaagacaacctggctccctgtgctgcttgggagctttggatgcaaaccactgactatgttcttgatcacagagaataagatttggggtcgcaagagttggcccctcaacgagggcatcatggcaattgggatcgtttctatactgctatccagcctgcttaaaaatgatgtgcctctcgctggacccctgatcgccggcggtatgttgattgcctgttatgtcatctcggggtcatctgctgacttaagtctggaaaaggcagccgaggtgtcctgggaacaggaggcggaacatagcggagcttctcacaacattctcgtagaggtgcaagatgacggcaccatgaaaatcaaggatgaggaacgggacgatacgctgactatacttctgaaagccaccttgctagcagtcagcggcgtttacccaatgtccattcctgccacactgtttgtgtggtatttctggcagaagaaaaagcagagatcaggggtgctctgggacacccccagtccaccggaggtcgaaagggctgtgctggatgacggaatctaccgtatccttcagcgcggtttactgggccggagccaagttggggtaggagtgttccaggatggcgtctttcatacaatgtggcacgtgactagaggtgcagttctcatgtatcaggggaagaggttggagccttcttgggcctccgtgaaaaaggacctgatttcatacggaggcggctggcgattccaggggagttggaataccggagaggaagtccaagtgatagcggtagagcccggtaaaaacccaaagaatgtccagacgacacccggcacttttaaaacccctgaaggggaggtgggagctatcgccctcgacttcaagccaggcacaagcggttcccccattgttaaccgggaagggaagatcgtgggactgtacggcaatggcgtcgtgaccacttctgggacctatgtttcggcaattgcccaggctaaagccagccaagagggacctcttccggagatcgaagatgaggtgtttaagaaacgcaacctgacaataatggacttgcacccaggttcaggcaagacgagaaggtacctacccgcaatcgtccgggaagctattaaacgaaagctgagaactctcatcttagcccctacccgcgtggtagcgtccgagatggccgaagcactgaaggggatgccaattaggtatcagacaaccgctgtgaaaagtgagcatactggacgtgagatcgttgatcttatgtgccacgccacattcaccatgcggctgctctctcccgtcagagtgcctaattacaacatgataattatggacgaagctcattttacggatccggcaagcatcgccgccaggggctatatctccactcgcgtgggtatgggggaggctgcggcaattttcatgacagccacacccccaggatcagtcgaagcctttcctcagtctaatgccgtaatccaggacgaggaacgagatatacccgagagaagctggaacagtggctacgactggattaccgatttcccaggcaagactgtgtggtttgttccttccatcaaaagcgggaatgacattgcaaactgtttgcggaagaacggaaaaagggtgatccaactgtctcgcaagacattcgataccgagtatcagaagactaagaataacgactgggactacgtcgtgactacggatatatcagaaatgggtgccaatttccgtgctgacagagttattgatccccggaggtgcctcaagccagtgatcctgaaagacggcccggagcgcgtcatccttgcggggcctatgcccgtgaccgtagcctccgcagctcagcgaagaggacggattggcaggaaccagaataaggaaggtgatcaatacgtgtatatggggcagccactaaacaatgacgaggatcacgcccattggacagaggcaaaaatgctgttggacaacatcaatactcccgaaggcattatacctgccttatttgagccagaacgcgagaagagtgctgccatcgatggagaatacagactgaggggcgaggcgcggaagaccttcgttgagctcatgcgtcgcggggacctgcccgtctggcttagctataaagtggcatcggaaggatttcagtactctgatcgaagatggtgcttcgacggtgagaggaacaatcaggtgctggaagagaacatggatgtcgaaatttggacaaaggagggcgagcggaaaaagctccgccctagatggttggacgccaggacctattccgacccgctggctctacgggaatttaaagagttcgccgctgggcgaagaagcgtttcaggagatctgatcctcgaaatcggcaaacttccacaacacctgactttacgcgcacagaatgccttggacaacctggtgatgctccacaatagtgagcagggtgggaaggcttacaggcatgccatggaggaactgcccgatacgattgagacccttatgctgctcgcattgatagcggtactgacaggcggagtgactttatttttcctatctggcaaggggctgggaaagacctccatcggtctcctttgtgtcacagccagctcagctctgttgtggatggccagtgtggaacctcactggattgcagctagcatcattctggagtttttcctcatggttctgcttatccccgaaccagaccggcagcgtacccctcaagataaccagctcgcctatgtggtcataggcctgttgtttatgatcctgactgtagcagccaacgagatggggttactagagacaacgaaaaaggacctgggaattggctacgtggctgcggaaaatcatcagcacgccaccatgctcgatgttgaccttcaccccgcatccgcttggactctgtacgccgtggccacaaccgtcatcaccccaatgatgagacatacaattgagaacactacggcaaatatctctttgaccgctatagccaaccaagcggctattctgatgggtctcgataaagggtggcctatcagcaagatggacattggcgtgccgctgcttgccttaggatgctattcccaggtcaatcccctgacactcactgcagccgtgttgatgctggttgctcactacgcaatcataggcccagggctacaggccaaagcgaccagggaagctcagaagcgcacagccgcaggaatcatgaagaaccctaccgtggatggcattgtagccatcgacctggatcccgtggtctatgacgctaaattcgagaagcaactcggtcagattatgcttctgatcttgtgtacttcacagatactgctcatgcggacgacatgggccctgtgcgaatctattaccttagcaactgggccacttaccacactgtgggagggaagtcctggcaaattttggaatactaccatcgctgtttcgatggccaacatcttccgaggtagctacctcgcgggcgccgggctagcattctccctgatgaagtctttgggaggcgggagaaggggaacaggcgctcagggtgagacgctgggggaaaaatggaagcgccaactcaatcagctttcaaagagcgagtttaacacctataaacggtccggaattatggaagtggacagaagtgaggccaaggaaggcctgaaacgtggtgagactacaaagcatgcagtctctaggggcaccgctaaattgcggtggttcgtggagcgcaatctggtaaagcccgaagggaaggtgatcgatctcggatgtggccgagggggatggagctactattgcgccggcctaaagaaggttactgaggtgaaaggttacacaaaagggggcccgggccacgaggagccaatacctatggccacctacggctggaacctggtcaaacttcattcagggaaggacgtgtttttcatgcccccagaaaaatgtgatacgctgctatgcgacattggagagtccagtcccaatcctaccatcgaggaaggtagaacactcagggtcctgaagatggtggagccgtggttgcggggcaaccagttttgtattaagatcctgaatccctatatgccaagcgttgtagaaactctcgagcagatgcaacgcaaacacgggggaatgcttgtgagaaaccctctgtctagaaattccacccacgagatgtactgggtctcatgcggcacaggtaacatagtgagcgcggttaacatgacttcgcgaatgttactgaatcggttcaccatggctcatcgtaagcccacatatgaaagagatgtggacttgggggcaggaacccgccacgtcgccgtggagcctgaagtagctaacctcgatatcattggccagaggatcgagaatattaaaaacgaacataagtctacttggcactacgacgaggataatccatataaaacgtgggcctaccacggcagttatgaggtgaagccctccgggagcgcatcatccatggttaacggagtcgtgcggctgctaacaaagccttgggacgtgatcccaatggtcacccagattgccatgactgataccacaccctttggtcaacagagagttttcaaagaaaaggtggacacgcgcaccccgagggctaaacgaggcactacacagatcatggaggtaaccgcgaagtggctttgggggtttctgtctcggaataaaaagcctagaatatgtactagggaagagttcacacgcaaggtgcgtagcaacgccgcaattggagctgtctttgtggacgaaaatcagtggaacagtgccaaagaggcagttgaggatgaacggttctgggacctcgtgcatagagagagggaactgcacaagcaaggcaaatgcgctacctgcgtctacaatatgatgggtaagcgcgagaaaaagttgggggaatttggaaaggctaaaggctcccgagccatctggtacatgtggctgggcgcgcggttcctcgagttcgaggcacttgggtttatgaacgaagatcattggttcagcagagaaaattctctgtcaggagtggaaggtgagggcttacacaagctggggtatatcttgagggacattagtaaaataccaggaggcaacatgtacgccgatgacacagctggttgggatactcgcatcaccgaggacgatctccagaatgaagccaagattacggacatcatggagcccgaacatgcactgctagctacctccatttttaaacttacatatcagaacaaggtagttagagtgcagcggcctgccaaaaacgggactgtcatggatgtgatcagcaggcgtgaccaacgaggatctggccaggtgggcacctacgggctgaatacattcactaacatggaggtccagctcatacgccagatggaatcggagggaatctttctgccatcagagttggaaacccccaatttagctgagagagccctggattggctcgaaaagcacggtgcagagcggcttaagaggatggcgattagcggcgacgactgtgttgtgaaaccgatcgatgaccgcttcgccacggctctgacagccctaaacgatatggggaaggtaagaaaagacattcctcaatgggaaccctccaagggatggaatgattggcaacaggtgccattttgcagtcaccatttccaccagctgatcatgaaagacggccgggagatagtcgtgccttgtaggaaccaagatgagctcgttggtcgagcacgtgtgtctcagggggctggatggagcttgagagaaaccgcctgcctgggcaagtcctatgcacagatgtggcaacttatgtactttcatcgccgggacctgaggctcgccgcgaatgctatttgttcagccgtccccgtggattgggtaccaacaagtagaacaacctggtctatccacgcacaccatcagtggatgactaccgaggacatgttaagcgtttggaaccgcgtgtggatcgaagagaatccctggatggaagataagacacacgtctcctcatgggaggaggtgccttatctgggcaaacgggaagaccagtggtgcgggagcttgattggactgacggccagggctacctgggccactaacatacaggttgcaatcaatcaagtgcgaagactcattggtaacgagaattaccttgactacatgacatctatgaagcggttcaaaaacgaatccgatccagagggcgctctgtggtga

SEQ ID NO: 13510 - RNA, 9879 nt, synthetic construct
  misc_feature 1..9879: note = derived and/or modified CDS sequence (opt3) from DENV-1__FJ639806__SS-prME
  source 1..9879: mol_type = other RNA
agcgtgaccatgctgctcatgcttctgcccacagccttggctttccacttaactacgagaggcggggagcctcatatgatcgtctccaagcaggaaaggggaaaatctctgctatttaagacctcagcaggtgttaacatgtgcacactcattgccatggacctgggcgagctttgtgaagatactatgacctacaaatgcccacggataacagaggcggaaccggacgatgtggactgttggtgcaatgctaccgatacttgggtaacatatgggacctgtagtcaaacgggagagcaccgccgagacaagcgtagcgtggccctggcaccccatgtcggcttgggtctcgagactagaaccgaaacatggatgtcctctgagggggcctggaaacagatccagagggtggaaacttgggctctgcggcaccctggattcaccgttattgcactgtttctcgcccatgctatcggcacatcgattacccagaagggcatcatattcatcttactgatgcttgtgacgccatcaatggccatgcgctgcgtcgggattggaaacagagattttgtggagggtttgagcggcgcgacttgggtagacgttgtgctggagcacgggagttgtgtcacaaccatggcaaagaataaacccactctagatatcgaactcctgaagacagaggtgaccaaccctgccgtgcttaggaaactgtgcattgaagctaagatctccaatacgaccacagactctcggtgtccaactcaaggagaggccaccttggtcgaagagcaggatgcaaacttcgtttgccgccgaacatttgtggacagaggctggggtaatgggtgtggactcttcggcaaaggcagcctgttaacttgcgctaagtttaagtgcgtaaccaaactggaggggaagatagtgcagtacgaaaacctcaaatattccgtcattgtgacagttcacaccggagatcagcatcaagtgggtaatgagactacggaacacggcacaatcgccaccattactccccaggcgcctacctcagagatccagcttacagactacggggccctgaccttggactgtagtccaaggactggactagatttcaacgaaatggtcctgctcacaatgaaggagaaaagctggctggtgcataagcagtggtttcttgacctgccgttgccctggacgtctggcgcatccacctcacaagagacttggaatcggcaggatctcctggtaacattcaaaaccgctcacgccaagaagcaggaagttgtggtcttaggtagccaagagggggctatgcacacagccctgactggcgcaaccgaaatccagacgagtggaaccacaactatttttgccggccatctaaaatgccgtctcaagatggacaaactgacccttaaggggatgtcttatgtgatgtgtacaggatccttcaaattggagaaggaagtcgctgagactcagcacggtaccgtgctggttcaggtgaagtacgagggcacggatgcgccttgcaaaataccattcagcacacaagacgaaaagggggtaacccagaacggacgcctcatcactgcaaatcccattgtcacagataaagagaagcctgtgaacatcgaaaccgagccaccctttggcgagtcgtatatagttgtgggtgccggggaaaaagctctgaagctttcttggttcaagaaaggctcctcaattggaaagatgtttgaggccactgcaagaggcgccaggcggatggctatcctgggggacaccgcctgggatttcggaagtatcggtggcgtctttacaagcgtggggaaattggtacatcaggtgttcggaacggcatacggcgttctcttttccggtgtctcttggaccatgaagattgggatcggcattctgttaacttggctgggactaaatagccgatcaacaagtctctccatgacctgtatagcggtgggcatggtgacactgtaccttggggtcatggttcaggctgacagcggatgcgtgatcaactggaaaggccgcgaattgaagtgtggttctgggattttcgtgactaacgaggtacacacctggacggaacaatataagtttcaggccgattcaccgaaaagactgagtgcagccatcggaagggcttgggaggagggcgtctgcggtatccggagcgccacacgcctcgaaaatattatgtggaagcagatatccaacgagctgaatcatatcttactggaaaacgacatgaaattcaccgtggttgtgggcgacgcaaatgggattcttgctcagggaaagaaaatgatcagacctcaacccatggagcacaagtactcttggaaatcgtggggcaaggccaagattatcggggcggatatacagaacactacctttatcattgacggaccagatacacctgaatgtcccgacggccagagggcctggaatatctgggaggtcgaggattatggtttcgggatttttactaccaacatctggttgaaactccgtgacagctacacacagatgtgcgatcaccggctgatgtccgctgcaataaaggactcaaaagccgtgcatgctgatatgggatattggattgaaagtgagaagaatgaaacgtggaaactagcccgagcatctttcatcgaggttaagacctgtatttggccaaagagccacactctgtggtccaacggcgtgctcgaatcagagatgatcatacccaaaatctacggtggccctattagccaacataattatagaccagggtacttcacacagaccgcgggaccgtggcacctgggcaagcttgagttggactttgatctgtgcgaagggactacagtagtcgtggacgagcactgcggaaacaggggcccctctttacgcaccacgactgtgaccggtaaaatcattcatgaatggtgttgccggtcctgtacactccctccactgagattcaggggggaggatggatgctggtacggcatggagatccgccccgtcaaggaaaaagaggaaaatcttgttcgaagtatggtgagcgccggttctggcgaggtagactccttttcactggggatattgtgtgtgagtattatgatcgaagaggtcatgcggagccgttggtcgagaaagatgctcatgaccggaactctggctgtgttcctactgctcatcatgggccagctgacatggaacgaccttattaggttgtgcatcatggttggggccaatgcatccgatcgcatgggaatgggcaccacatatctggctttaatggccacttttaagatgcggcctatgttcgcagtgggtctcctgtttagaaggcttacctctcgagaggtcctgctactcacgattgggctgagcttggtggcctcagttgaactgccaaacagtttagaggaactcggagacggcctggctatgggcataatgatgcttaaactgttgacagagttccaaccccaccagctctggaccactctgctatccctgacctttgtgaagacaactctttctctcgattacgcgtggaaaaccacggccatggtcctgagcatcgtatccttgttcccgctgtgtttatcaacaaccagccagaagactacatggctccctgtgctgcttgggagttttggatgcaaaccactgaccatgttcttgattactgaaaacaagatctggggtcgcaagtcttggcccctcaatgagggcattatggcaatcgggatagtttccatcctgctaagctcgctgcttaaaaacgacgtgcctctcgctggacccctgattgccggcggtatgttgatcgcctgttatgtcatttcagggtctagtgctgatttatccctggagaaggcagccgaagtgagctgggagcaggaagcggagcattctggagctagccacaatatcctcgtagaagtgcaagacgatggcacaatgaaaataaaggacgaggagcgggatgacaccctgacgattcttctgaaagccactttgctagcagtctccggcgtttacccaatgtcaatccctgccaccctgtttgtgtggtatttctggcagaagaaaaagcagagaagtggggtgctctgggatacacccagcccaccggaagtcgagagggctgtgctggacgatggaatctaccgtattcttcagcgcggtttactgggccggtctcaagttggggtaggagtgttccaggacggcgtctttcataccatgtggcacgtgacaagaggtgcagttctcatgtatcaggggaagaggttggaaccttcctgggcctcagtgaaaaaggacctgataagttacggaggcggctggcgattccaggggagctggaacactggagaggaggtccaagtgatcgcggtagaacccggtaaaaatccaaagaacgtccagaccacgcccggcacatttaaaactcctgagggggaagtgggagctattgccctcgatttcaagccaggcacctccggttctcccatcgttaatcgggaggggaagattgtgggactgtacggcaacggcgtcgtgacaacctcggggacttatgttagcgcaatcgcccaggctaaagcctcacaagaaggacctcttccggagatagaggacgaagtgtttaagaaacgcaatctgaccatcatggatttgcacccaggttccggcaagacaagaaggtacctacccgcaattgtccgggaggctatcaaacgaaagctgagaacgctcattttagcccctactcgcgtggtagcgagtgaaatggccgaggcactgaaggggatgccaatcaggtatcagaccacagctgtgaaatctgaacataccggacgtgagatagttgaccttatgtgccacgccactttcacaatgcggctgctcagccccgtcagagtgcctaactacaatatgattatcatggatgaggctcattttaccgacccggcatccatcgccgccaggggctatatttcaacgcgcgtgggtatgggggaagctgcggcaatcttcatgactgccacacccccaggatctgtcgaggcttttcctcagagcaacgccgtaatacaggatgaagagcgagacattcccgaaagaagttggaattccggctacgattggatcaccgacttcccaggcaagaccgtgtggtttgttcctagcattaaatctgggaacgatatcgcaaattgtttgcggaagaacggaaaaagggtgatacaactgtcacgcaagactttcgacacagagtatcagaagaccaaaaacaatgactgggattacgtcgtgacaactgacatttccgagatgggtgccaacttccgtgctgatagagttatcgacccccggaggtgcctcaagccagtgatcctgaaagatggcccggaacgcgtcattcttgcggggcctatgcccgtgacggtagccagtgcagctcagcgaagaggacggatcggcaggaatcagaacaaggagggtgaccaatacgtgtatatggggcagccactaaataacgatgaagaccacgcccattggaccgaggcaaaaatgctgttggataatattaacacacccgagggcataatccctgccttatttgaaccagagcgcgaaaagagcgctgccattgacggagagtacagactgaggggcgaagcgcggaagactttcgttgagctcatgcgtcgcggggatctgcccgtctggctttcgtataaagtggcatctgagggatttcagtactccgaccgaagatggtgcttcgatggtgaaaggaataaccaggtgctggaggaaaatatggacgtcgagatctggaccaaggaaggcgagcggaaaaagctccgccctagatggttggacgccaggacatatagcgatccgctggctctacgggagtttaaagaattcgccgctgggcgaagatcagttagtggagacctgatcctcgagattggcaagcttccacaacacctgaccttacgcgcacagaacgccttggataatctggtgatgctccacaactctgaacagggtgggaaagcttacaggcatgccatggaggaactgcccgacactatagagacgcttatgctgctcgcattgatcgcggtactgaccggcggagtgacattatttttcctatccggcaaggggctgggaaagactagcattggtctcctttgtgtcaccgcctcaagtgctctgttgtggatggccagcgtggagcctcactggatcgcagcttccattatcctggaatttttcctcatggttctgcttatacccgagccagatcggcagcgtacacctcaagacaatcagctcgcctatgtggtcatcggcctgttgtttatgattctgaccgtagcagccaacgaaatggggttactagagactacaaaaaaggatctgggaatcggctacgtggctgcggagaaccatcagcacgccacgatgctcgacgttgatcttagacccgcatctgcttggaccctgtacgccgtggccactacagtcattaccccaatgatgaggcacaccatcgaaaatacaactgcaaacataagcttgacggctattgccaatcaagcggctatcctgatgggtctcgacaaagggtggcctatttccaagatggatatcggcgtgccgctgcttgccttaggatgctattcacaggtcaaccccctgaccctcacagcagccgtgttgatgctggttgctcattacgcaataatcggcccagggctacaggccaaagcgactcgcgaggctcagaagcggaccgccgcaggaattatgaagaatcctacagtggacggcatcgtagccattgatctggaccccgtggtctatgacgctaaattcgaaaagcaactcggtcagatcatgcttctgatattgtgtacctctcagattctgctcatgcgaactacgtgggccctgtgcgagagtatcacattagcaaccgggccacttactaccctgtgggaaggatcgcctggcaaattttggaacacaactatcgctgttagcatggccaatattttcagaggttcctacctcgcgggcgccgggctagcattctctctgatgaagtcattgggaggcgggaggcgcggaaccggcgctcagggtgagacactgggggagaaatggaagcggcaactcaaccagcttagcaagtccgaatttaatacgtataaaagaagtggaatcatggaggtggatcgttctgaagccaaggagggcctgaaaaggggtgaaaccactaagcacgcagtcagccggggcacagctaaattgcgctggttcgtggagcgaaacctggtaaagcccgaggggaaggtgatagacctcggatgtggcagagggggatggtcatactattgcgccggcttaaaaaaggttaccgaagtgaaaggttacactaaggggggaccgggccatgaggaaccaattcctatggccacatacggctggaatctggtcaaacttcactccgggaaggatgtgtttttcatgcccccagagaaatgtgacaccctgctatgcgatatcggagaaagtagccccaaccctacgattgaggagggtaggaccctccgggtcctgaagatggtggaaccgtggttgaagggcaatcagttttgtatcaaaatactgaacccctatatgccatctgttgtagagacactcgaacagatgcaacgcaagcatgggggaatgcttgtgagaaatcctctgtccaggaactcaactcacgagatgtactgggtcagctgcggcaccggtaatatcgtgtcggcggttaacatgacatctcgaatgttactgaaccggttcactatggctcaccgtaaacccacctatgagagagacgtggatttgggggcaggaacacgccatgtcgccgtggaacctgaggtagctaatctcgacattatcggccagaggattgaaaacatcaagaatgagcacaaaagtacctggcattacgatgaagacaacccatataagacttgggcctaccacggctcctatgaggtgaagcccagcgggtcagcatcctctatggttaatggagtcgtgcggctgctaacgaaaccttgggatgtgattccaatggtcacacagatcgccatgaccgacactaccccctttggtcaacagagagttttcaaggagaaagtggacacacgcacgccgagggctaagcgaggcaccactcagataatggaagtaacagcgaaatggctttgggggtttctgagccggaacaagaagcctagaatttgtaccagggaggaattcactcgcaaagtgcgtagtaatgccgcaatcggagctgtctttgtggatgagaaccagtggaattccgccaaggaagcagttgaggacgagcggttctgggatctcgtgcacagagaaagggagctgcataaacaaggcaagtgcgccacatgcgtctacaacatgatgggtaaacgcgaaaagaagttgggggagtttggaaaagctaagggcagccgagccatctggtacatgtggctgggcgcgcggttcctcgaattcgaggcacttgggtttatgaatgaggaccactggttctctagagaaaactcactgagtggagtggagggtgaaggcttacataaactggggtatattttgagggatatatccaagatcccaggaggcaatatgtacgccgacgataccgctggttgggacacacgcattactgaggatgacctccagaacgaggccaaaatcaccgatattatggaacccgagcacgcactgctagctacgagcatctttaagcttacctatcagaataaagtagttagagtgcagcggcctgccaagaacgggacagtcatggacgtgatatctaggcgtgatcaacgaggatcgggccaggtgggcacttacgggctgaacaccttcacaaatatggaagtccagctcatccgccagatggagtcagaaggaatttttctgccaagcgagttggagactcccaacttagctgaaagagttctggactggctcaagaaacatggtgccgagcggcttaagaggatggcaatctccggcgacgattgtgtggtaaaaccgattgacgatcgcttcgcgaccgccctgacggctctaaatgacatggggaaggtgagaaaagatatccctcaatgggaacccagtaagggatggaacgactggcagcaggtcccattttgctctcaccacttccatcagctgataatgaaggatggccgggagattgtggttccttgtaggaatcaagacgaactcgtgggtcgagcccgtgtcagccagggggcaggatggtccttgagagagacagcttgcctgggcaaatcatatgcccagatgtggcaacttatgtactttcaccgccgggatctgaggctcgcagccaacgcgatctgtagtgctgtgcccgtagactgggttccaacctctagaactacatggagcatccatgcccaccaccagtggatgaccactgaggatatgttatccgtgtggaatcgcgtctggattgaagagaacccctggatggaagacaagacccatgtgtcaagctgggaggaagttccttatctgggcaaacgggaggaccagtggtgcgggtctttgataggactgacagcaagggccacgtgggctaccaatatccaggtggccattaaccaagtccgaagactcatcggtaatgagaactaccttgattacatgacttccatgaagcggttcaaaaatgaaagtgacccagagggcgcactgtggtga

SEQ ID NO: 13511 - RNA, 9879 nt, synthetic construct
  misc_feature 1..9879: note = derived and/or modified CDS sequence (opt3) from DENV-1__JN819411__SS-prME
  source 1..9879: mol_type = other RNA
agcgtgaccatgctgctcatgcttctgcccacagccttggctttccacttaactacgagaggcggggagcctcatatgatcgtctccaagcaggaaaggggaaaatctctgctatttaagacctcagcaggtgttaacatgtgcacactcattgccatggacctgggcgagctttgtgaagatactatgacctacaaatgcccacggataacagaggcggaaccggacgatgtggactgttggtgcaatgctaccgatacttgggtaacatatgggacctgtagtcaaacgggagagcaccgccgagacaagcgtagcgtggccctggcaccccatgtcggcttgggtctcgagactagaaccgaaacatggatgtcctctgagggggcctggaaacagatccagagggtggaaacttgggctctgcggcaccctggattcaccgttattgcactgtttctcgcccatgctatcggcacatcgattacccagaagggcatcatattcatcttactgatgcttgtgacgccatcaatggccatgcgctgcgtcgggattggaaacagagattttgtggagggtttgagcggcgcgacttgggtagacgttgtgctggagcacgggagttgtgtcacaaccatggcaaagaataaacccactctagatatcgaactcctgaagacagaggtgaccaaccctgccgtgcttaggaaactgtgcattgaagctaagatctccaatacgaccacagactctcggtgtccaactcaaggagaggccaccttggtcgaagagcaggatgcaaacttcgtttgccgccgaacatttgtggacagaggctggggtaatgggtgtggactcttcggcaaaggcagcctgttaacttgcgctaagtttaagtgcgtaaccaaactggaggggaagatagtgcagtacgaaaacctcaaatattccgtcattgtgacagttcacaccggagatcagcatcaagtgggtaatgagactacggaacacggcacaatcgccaccattactccccaggcgcctacctcagagatccagcttacagactacggggccctgaccttggactgtagtccaaggactggactagatttcaacgaaatggtcctgctcacaatgaaggagaaaagctggctggtgcataagcagtggtttcttgacctgccgttgccctggacgtctggcgcatccacctcacaagagacttggaatcggcaggatctcctggtaacattcaaaaccgctcacgccaagaagcaggaagttgtggtcttaggtagccaagagggggctatgcacacagccctgactggcgcaaccgaaatccagacgagtggaaccacaactatttttgccggccatctaaaatgccgtctcaagatggacaaactgacccttaaggggatgtcttatgtgatgtgtacaggatccttcaaattggagaaggaagtcgctgagactcagcacggtaccgtgctggttcaggtgaagtacgagggcacggatgcgccttgcaaaataccattcagcacacaagacgaaaagggggtaacccagaacggacgcctcatcactgcaaatcccattgtcacagataaagagaagcctgtgaacatcgaaaccgagccaccctttggcgagtcgtatatagttgtgggtgccggggaaaaagctctgaagctttcttggttcaagaaaggctcctcaattggaaagatgtttgaggccactgcaagaggcgccaggcggatggctatcctgggggacaccgcctgggatttcggaagtatcggtggcgtctttacaagcgtggggaaattggtacatcaggtgttcggaacggcatacggcgttctcttttccggtgtctcttggaccatgaagattgggatcggcattctgttaacttggctgggactaaatagccgatcaacaagtctctccatgacctgtatagcggtgggcatggtgacactgtaccttggggtcatggttcaggctgacagcggatgcgtgatcaactggaaaggccgcgaattgaagtgtggttctgggattttcgtgactaacgaggtacacacctggacggaacaatataagtttcaggccgattcaccgaaaagactgagtgcagccatcggaaaggcttgggaggagggcgtctgcggtatcaggagcgccacacggctcgaaaatattatgtggaaacagatatccaacgagctgaatcatatcttactggaaaacgacatgaagttcaccgtggttgtgggcgacgcaaatgggattcttgctcagggaaaaaagatgatccgccctcaacccatggagcacaaatactcttggaagtcgtggggcaaggccaaaattatcggggcggatatacagaacactacctttatcattgacggaccagatacacctgaatgtcccgacggccagagagcctggaatatctgggaggtcgaggattatggtttcgggatttttactaccaacatctggttgaagctcagggacagctacacacagatgtgcgatcaccgtctgatgtccgctgcaataaaagactcaaaggccgtgcatgctgatatgggatattggattgaaagtgagaaaaatgaaacgtggaagctagcccgggcatctttcatcgaggttaagacctgtacttggccaaaaagccacacactgtggtccaacggcgtgctcgaatcagagatgattatccccaagatatacggtggccctatcagccaacataattatcgaccagggtacttcacccagactgcgggaccgtggcacctgggcaaacttgagttggactttgatctgtgcgaagggacaaccgtagtcgtggacgagcactgcggaaacagaggcccctctttaaggacgactaccgtgacaggtaagattatccatgaatggtgttgccgctcctgtaccctccctccactgcggttcagaggggaggatggatgctggtacggcatggagattaggcccgtcaaagaaaaggaggaaaatcttgttcgcagtatggtgagcgccggttctggcgaggtagactccttttcactggggatcttgtgtgtgagtataatgattgaagaggtcatgcgaagccggtggtcgcgtaagatgctcatgactggaacactggctgtgttcctactgctcatcgttggccagctgacctggaacgaccttatcagattgtgcattatggtgggggccaatgcatccgataggatgggaatgggcacaacttatctggctttaatggccacctttaaaatgcgccctatgttcgcagtcggtctcctgtttcggagacttacgtctagggaggtgctgctactcacaatcgggctgagcttggttgcctcagtggaactgccaaacagtttagaggaactcggagacggcctggctatgggcattatgatgcttaagctgttgaccgagttccaaccccaccagctctggactaccctgctatccctgacatttgtcaaaactaccctttctctcgattacgcgtggaagacgacagccatggtactgagcatagtgtccttgttcccgctgtgtttatcaaccactagccagaaaacaacctggctccctgttctgcttgggagttttggatgcaagccactgactatgttcttgatcacagaaaacaagatttggggtcgaaaatcttggcccctcaatgagggcatcatggcaattgggatcgtgtccatactgctaagctcgctgcttaagaacgacgtccctctcgctggacccctgatcgccggcggtatgttgattgcctgttatgtgatctcagggtctagtgctgatttatccctggagaaagcagccgaagtaagctgggagcaggaagcggagcattctggagctagccacaatattctcgtggaagtccaagacgatggcaccatgaagatcaaagacgaggagcgcgatgacacgctgactatacttctgaaggccaccttgctagcagtttccggcgtgtacccaatgtcaattcctgccacactgtttgtgtggtatttctggcagaaaaagaagcagcggagtggggtcctctgggatacccccagcccaccggaagtggagagagctgttctggacgatggaatctacaggatccttcagcgtggtttactgggccgctctcaagtaggggtgggagtcttccaggacggcgtgtttcatacaatgtggcacgttactcggggtgcagtgctcatgtatcaggggaaaagattggaaccttcctgggcctcagtcaagaaagacctgattagttacggaggcggctggaggttccaggggagctggaacaccggagaggaggtgcaagtaatagcggtcgaacccggtaagaatccaaaaaacgtgcagacgacacccggcacttttaagacccctgagggggaagttggagctatcgccctcgatttcaagccaggcacatccggttctcccattgtgaatcgagaggggaaaatcgtcggactgtacggcaacggcgtggttaccacttcggggacctatgtgagcgcaattgcccaggctaaggcctcacaagaaggacctcttccggagatcgaggacgaagtctttaaaaagcggaatctgacaataatggatttgcacccaggttccggcaaaacgcgcagatacctacccgcaatcgtgagggaggctattaagcggaagctgcgaactctcatcttagcccctaccagagtagtggcgagtgaaatggccgaggcactgaaagggatgccaattcgctatcagacaaccgctgttaagtctgaacatactggaagggagatcgtcgaccttatgtgccacgccacattcaccatgcgtctgctcagccccgtgcgggtgcctaactacaatatgataattatggatgaggctcattttacggacccggcatccatcgccgccagaggctatatctcaactagggtcggtatgggggaagctgcggcaattttcatgacagccacccccccaggatctgtagaggcttttcctcagagcaacgccgtgatccaggatgaagagcgcgacatacccgaacgaagttggaattccggctacgattggattaccgacttcccaggcaaaactgtttggtttgtgcctagcatcaagtctgggaacgatattgcaaattgtttgagaaaaaacggaaagcgggtcatccaactgtcaaggaagacattcgacaccgagtatcagaaaacaaagaacaatgactgggattacgtggttactacggacatatccgagatgggtgccaacttccgcgctgatcgtgtgattgaccccagacggtgcctcaaaccagtcatcctgaaggatggcccggaaagggtgatccttgcggggcctatgcccgtaaccgtggccagtgcagctcagcgccgaggaagaattggccggaatcagaacaaagagggtgaccaatacgtttatatggggcagccactaaataacgatgaagaccacgcccattggacagaggcaaagatgctgttggataatatcaacactcccgagggcattatacctgccttatttgaaccagagagggaaaagagcgctgccatcgacggagagtaccgcctgagaggcgaagcgaggaaaaccttcgtcgagctcatgcggcgtggggatctgcccgtgtggctttcgtataaggtggcatctgagggatttcagtactccgaccgccgatggtgcttcgatggtgaaagaaataaccaggtcctggaggaaaatatggacgttgagatttggacaaaagaaggcgagaggaagaaactccggcctcgctggttggacgccagaacctatagcgatccgctggctctaagggagtttaaggaattcgccgctgggcggcgatcagtgagtggagacctgatcctcgagatcggcaaacttccacaacacctgactttaagagcacagaacgccttggataatctggtaatgctccacaactctgaacagggtgggaaggcttaccgccatgccatggaggaactgcccgacacgattgagacccttatgctgctcgcattgatagcggtgctgacaggcggagtcactttatttttcctatccggcaaggggctgggaaaaaccagcatcggtctcctttgtgtgacagcctcaagtgctctgttgtggatggccagcgttgagcctcactggattgcagcttccatcattctggaatttttcctcatggtgctgcttatccccgagccagataggcagcggacccctcaagacaatcagctcgcctatgtcgtaataggcctgttgtttatgatcctgactgtggcagccaacgaaatggggttactagagacaacgaagaaagatctgggaattggctacgttgctgcggagaaccatcagcacgccaccatgctcgacgtggatcttcgtcccgcatctgcttggactctgtacgccgtcgccacaaccgtgatcaccccaatgatgagacacacaattgaaaatactacggcaaacatcagcttgaccgctatagccaatcaagcggctattctgatgggtctcgacaaggggtggcctatctccaaaatggatattggcgtcccgctgcttgccttaggatgctattcacaggtgaaccccctgacactcactgcagccgttttgatgctggtggctcattacgcaatcataggcccagggctacaggccaaggcgaccagggaggctcagaagcgcacagccgcaggaatcatgaaaaatcctaccgtagacggcattgtggccatcgatctggaccccgtcgtttatgacgctaagttcgaaaaacaactcggtcagattatgcttctgatcttgtgtacttctcagatactgctcatgcggacgacatgggccctgtgcgagagtattaccttagcaactgggccacttaccacactgtgggaaggatcgcctggcaagttttggaacactaccatcgctgtgagcatggccaatatcttccgaggttcctacctcgcgggcgccgggctagcattctctctgatgaaatcattgggaggcgggagaaggggaacaggcgctcagggtgagacgctgggggagaagtggaagcgccaactcaaccagcttagcaaatccgaatttaatacctataagcggagtggaattatggaggtcgatagatctgaagccaaagagggcctgaagcgtggtgaaactacaaaacacgcagtgagcaggggcaccgctaagttgcggtggttcgtagagcgcaacctggtgaagcccgaggggaaagttatcgacctcggatgtggccgagggggatggtcatactattgcgccggcttaaagaaagtgactgaagtcaagggttacacaaaagggggaccgggccatgaggaaccagtgcctatggccacctacggctggaatctggtcaagcttcactccgggaaagatgtgtttttcatgcccccagagaagtgtgacacgctgctatgcgatataggagaaagtagccccaaccctaccattgaggagggtagaacactcagggttctgaagatggtagaaccgtggttgaaaggcaatcagttttgtatcaagattctgaacccctatatgccatctgtggtcgagactctcgaacagatgcaacggaaacatgggggaatgcttgtgcgcaatcctctgtccagaaactcaacccacgagatgtactgggttagctgcggcacaggtaatatcgtgtcggcggtcaacatgacttctaggatgttactgaaccgattcaccatggctcaccggaagcccacatatgagcgtgacgtggatttgggggcaggaaccagacatgtagccgtggaacctgaggttgctaatctcgacataatcggccagcgcattgaaaacatcaaaaatgagcacaagctgacttggcattacgatgaagacaacccatataagacgtgggcctaccacggcagttatgaggtcaaaccctccgggagcgcatcatccatggtgaatggagtggtcaggctacttacaaagccttgggatgttattccaatggtgacccagatcgccatgactgacaccacaccctttggtcaacagcgggtattcaaagagaaggtggacacgagaaccccgcgcgctaaaaggggcactacacagattatggaagtcaccgcgaagtggctgtgggggtttctctctcgaaacaagaaacctcggatctgtactagagaggaattcacaaggaaggtgcgcagcaatgccgcaataggagctgtttttgtggatgagaaccagtggaatagtgccaaagaagcagtcgaggacgagcgtttctgggatctggtgcaccgggaaagagagttgcataagcaaggcaaatgcgccacctgcgtatacaacatgatgggtaagagggaaaagaaactgggggagtttggaaaggctaaaggctcccgcgccatttggtacatgtggctcggcgcgcgattccttgaattcgaggcactggggtttatgaatgaggaccactggttcagccgggaaaactctttatcaggagttgagggtgaaggcctgcataagttggggtatatcctcagagatatcagtaaaattccaggaggcaatatgtacgccgacgatacagctggttgggacactaggataaccgaggatgacctgcagaacgaggccaagatcacggatattatggaacccgagcacgcactacttgctacctccatctttaaactgacatatcagaataaggtggtccgcgtgcagagacctgccaagaacgggactgtgatggacgtcattagccggagggatcaacgtggatctggccaggttggcacctacgggctcaacacattcactaatatggaagtgcagctgatccgacagatggagtcggaaggaatattttcaccaagcgagttggagacccccaacttagctgaacgcgtactggactggctcgagaaacatggtgccgaaagacttaagcggatggcaatctccggcgacgattgtgtggtcaaaccgattgacgataggttcgcgacggccctgacagctctaaatgacatggggaaggtgcgcaaagatatccctcaatgggagcccagtaagggatggaacgactggcagcaggttccattttgctctcaccacttccatcagctgattatgaaggatggcagagaaatcgtggtcccttgtcggaatcaagacgagctcgtgggtagggcccgagtaagccagggggcaggatggtccttgcgtgagaccgcttgcctgggcaaatcatatgcccagatgtggcaacttatgtactttcacagacgcgatctgcggctcgcagccaacgcgatatgtagtgctgttcccgtggactgggtcccaacttctaggacaacctggagcattcatgcccaccaccagtggatgactaccgaagatatgttatccgtgtggaatagagtttggatcgaggaaaacccctggatggaggacaagacacatgtgtcaagctgggaagaggtcccttatctgggcaaacgcgaggaccagtggtgcgggtctttgatcggactgacggcacgggccacctgggctactaatattcaggtggccataaaccaagtaaggcgactcatcggtaatgaaaactaccttgattacatgacatccatgaagagattcaaaaatgagagtgacccagaaggcgcactgtggtga

SEQ ID NO: 13512 - RNA, 9879 nt, synthetic construct
  misc_feature 1..9879: note = derived and/or modified CDS sequence (opt3) from DENV-1__FJ639812__SS-prME
  source 1..9879: mol_type = other RNA
agcgtgaccatgctgctcatgcttctgcccacagccttggctttccacttaactacgagaggcggggagcctcatatgatcgtctccaagcaggaaaggggaaaatctctgctatttaagacctcagcaggtgttaacatgtgcacactcattgccatggacctgggcgagctttgtgaagatactatgacctacaaatgcccacggataacagaggcggaaccggacgatgtggactgttggtgcaatgctaccgatacttgggtaacatatgggacctgtagtcaaacgggagagcaccgccgagacaagcgtagcgtggccctggcaccccatgtcggcttgggtctcgagactagaaccgaaacatggatgtcctctgagggggcctggaaacagatccagagggtggaaacttgggctctgcggcaccctggattcaccgttattgcactgtttctcgcccatgctatcggcacatcgattacccagaagggcatcatattcatcttactgatgcttgtgacgccatcaatggccatgcgctgcgtcgggattggaaacagagattttgtggagggtttgagcggcgcgacttgggtagacgttgtgctggagcacgggagttgtgtcacaaccatggcaaagaataaacccactctagatatcgaactcctgaagacagaggtgaccaaccctgccgtgcttaggaaactgtgcattgaagctaagatctccaatacgaccacagactctcggtgtccaactcaaggagaggccaccttggtcgaagagcaggatgcaaacttcgtttgccgccgaacatttgtggacagaggctggggtaatgggtgtggactcttcggcaaaggcagcctgttaacttgcgctaagtttaagtgcgtaaccaaactggaggggaagatagtgcagtacgaaaacctcaaatattccgtcattgtgacagttcacaccggagatcagcatcaagtgggtaatgagactacggaacacggcacaatcgccaccattactccccaggcgcctacctcagagatccagcttacagactacggggccctgaccttggactgtagtccaaggactggactagatttcaacgaaatgatgctgctcacaatgaaggagaaaagctggctggtccataagcagtggtttcttgacctgccgttgccctggacgtctggcgcatccacctcacaagagacttggaatcggcaggatctcctggtgacattcaaaaccgctcacgccaagaagcaggaagtagttgtgttaggtagccaagagggggctatgcacacagccctgactggcgcaaccgaaatccagacgagtggaaccacaactatttttgccggccatctaaaatgccgtctcaagatggacaaactgacccttaaggggatgtcttatgtcatgtgtacaggatccttcaaattggagaaggaagtggctgagactcagcacggtaccgtcctggtgcaggttaagtacgagggcacggatgcgccttgcaaaataccattcagcacacaagacgaaaagggggtgacccagaacggacgcctcatcactgcaaatcccattgtaacagataaagagaagcctgtcaacatcgaaaccgagccaccctttggcgagtcgtatatagtggttggtgccggggaaaaagctctgaagctttcttggttcaagaaaggctcctcaattggaaagatgtttgaggccactgcaagaggcgccaggcggatggctatcctgggggacaccgcctgggatttcggaagtatcggtggcgtgtttacaagcgtcgggaaattggtgcatcaggtattcggaacggcatacggcgtgctcttttccggtgtttcttggaccatgaagattgggatcggcattctgttaacttggctgggactaaatagccgatcaacaagtctctccatgacctgtatagcggtcggcatggtgacactgtaccttggggtgatggtccaggctgacagcggatgcgttatcaactggaaaggccgcgaattgaagtgtggttctgggattttcgtgactaacgaggtgcacacctggacggaacaatataagtttcaggccgattcaccgaaaagactgagtgcagccatcggaaaggcttgggaggagggcgtatgcggtatcaggagcgccacacggctcgaaaatattatgtggaaacagatatccaacgagctgaatcatatcttactggaaaacgacatgaagttcaccgtcgtggttggcgacgcaaatgggattcttgctcagggaaaaaagatgatccgccctcaacccatggagcacaaatactcttggaagtcgtggggcaaggccaaaattatcggggcggatatacagaacactacctttatcattgacggaccagatacacctgaatgtcccgacggccagagagcctggaatatctgggaggtggaggattatggtttcgggatttttactaccaacatctggttgaagctcagggacagctacacacagatgtgcgatcaccgtctgatgtccgctgcaataaaagactcaaaggccgtccatgctgatatgggatattggattgaaagtgagaaaaatgaaacgtggaagctagcccgggcatctttcatcgaggtgaagacctgtacttggccaaaaagccacacactgtggtccaacggcgttctcgaatcagagatgattatccccaagatatacggtggccctatcagccaacataattatcgaccagggtacttcacccagactgcgggaccgtggcacctgggcaaacttgagttggactttgatctgtgcgaagggacaaccgtggtagtcgacgagcactgcggaaacagaggcccctctttaaggacgactaccgtgacaggtaagattatccatgaatggtgttgccgctcctgtaccctccctccactgcggttcagaggggaggatggatgctggtacggcatggagattaggcccgtgaaagaaaaggaggaaaatcttgtccgcagtatggttagcgccggttctggcgaggtggactccttttcactggggatcttgtgtgtaagtataatgattgaagaggtgatgcgaagccggtggtcgcgtaagatgctcatgactggaacactggctgtcttcctactgctcatcatgggccagctgacctggaacgaccttatcagattgtgcattatggtgggggccaatgcatccgataggatgggaatgggcacaacttatctggctttaatggccacctttaaaatgcgccctatgttcgcagttggtctcctgtttcggagacttacgtctagggaggtgctgctactcacaatcgggctgagcttggtcgcctcagtggaactgccaaacagtttagaggaactcggagacggcctggctatgggcattatgatgcttaagctgttgaccgagttccaaccccaccagctctggactaccctgctatccctgacatttgttaaaactaccctttctctcgattacgcgtggaagacgacagccatggtgctgagcatagtctccttgttcccgctgtgtttatcaaccactagccagaaaacaacctggctccctgtactgcttgggagttttggatgcaagccactgactatgttcttgatcacagaaaacaagatttggggtcgaaaatcttggcccctcaatgagggcatcatggcaattgggatcgtgtccatactgctaagctcgctgcttaagaacgacgttcctctcgctggacccctgatcgccggcggtatgttgattgcctgttatgtgatctcagggtctagtgctgatttactgctcgagaaagcagccgaagtctcctgggagcaggaagcggagcatagcggagcttctcacaatattctggtggaagtacaagacgatggcaccatgaagatcaaagacgaggagcgcgatgacacgcttactatactgttgaaggccaccctactggcagtgagcggcgtctacccaatgtccattcctgccacactctttgtttggtatttctggcagaaaaagaagcagcggtcaggggtgctgtgggatacccccagtccaccggaagtggagagagctgtccttgacgatggaatctacaggatcttacagcgtggtctgctcggccgcagccaagtgggggttggagtattccaggacggcgtgtttcatacaatgtggcacgtcactcggggtgcagtgttgatgtatcaggggaaaagactggaaccttcttgggcctccgttaagaaagacctcatttcatacggaggcggctggaggttccaggggagttggaacaccggagaggaggtgcaagtcatagcggtggaacccggtaagaatccaaaaaacgtacagacgacacccggcacttttaagacccctgagggggaagtcggagctatcgccctggatttcaagccaggcacaagcggttcccccattgtgaatcgagaggggaaaatcgttggactttacggcaacggcgtggtcaccacttctgggacctatgtgtcggcaattgcccaggctaaggccagccaagaaggacctctgccggagatcgaggacgaagtttttaaaaagcggaatttgacaataatggatctacacccaggttcaggcaaaacgcgcagatacctgcccgcaatcgtgagggaggctattaagcggaagctccgaactttaatcctggcccctaccagagtcgtggcgtccgaaatggccgaggcacttaaagggatgccaattcgctatcagacaaccgctgtaaagagtgaacatactggaagggagatcgtggacctgatgtgccacgccacattcaccatgcgtctcttgtctcccgttcgggtccctaactacaatatgataattatggatgaggctcattttacggacccggcaagcatcgccgccagaggctatatctccactagggtgggtatgggggaagctgcggcaattttcatgacagccacccccccaggatcagtggaggcttttcctcagtctaacgccgtcatccaggatgaagagcgcgacatacccgaacgaagctggaatagtggctacgattggattaccgacttcccaggcaaaactgtatggtttgtgccttccatcaagagcgggaacgatattgcaaattgtctgagaaaaaacggaaagcgggttatccaactctctaggaagacattcgacaccgagtatcagaaaacaaagaacaatgactgggattacgtggtcactacggacatatcagagatgggtgccaacttccgcgctgatcgtgtgattgaccccagacggtgcctgaaaccagttatccttaaggatggcccggaaagggtgatcctagcggggcctatgcccgtcaccgtggcctccgcagctcagcgccgaggaagaattggccggaatcagaacaaagagggtgaccaatacgtatatatggggcagccactgaataacgatgaagaccacgcccattggacagaggcaaagatgttgttagataatatcaacactcccgagggcattatacctgccctgtttgaaccagagagggaaaagagtgctgccatcgacggagagtaccgcctcagaggcgaagcgaggaaaaccttcgtggagctgatgcggcgtggggatcttcccgtttggctgagctataaggtcgcatcggagggatttcagtactctgaccgccgatggtgcttcgatggtgaaagaaataaccaggtgctcgaggaaaatatggacgtggagatttggacaaaagaaggcgagaggaagaaattgcggcctcgctggctggacgccagaacctattccgatccgctagctctgagggagtttaaggaattcgccgctgggcggcgaagcgtctcaggagacctcatccttgagatcggcaaactgccacaacacttaactttgagagcacagaacgccctggataatctcgttatgctgcacaacagtgaacagggtgggaaggcttaccgccatgccatggaggaacttcccgacacgattgagaccctgatgctcttggcactgatagcggtgttaacaggcggagtaactctatttttcctgtctggcaaggggctcggaaaaacctccatcggtcttctgtgtgtgacagccagctcagctttgctgtggatggccagtgtcgagcctcactggattgcagctagcatcattctcgaatttttcctgatggtgcttctcatccccgagccagataggcagcggacccctcaagacaatcagctggcctatgttgtgataggcttgctgtttatgatcttaactgtcgcagccaacgaaatggggctactggagacaacgaagaaagatctcggaattggctacgtagctgcggagaaccatcagcacgccaccatgcttgacgtggatctgcgtcccgcatccgcttggactttgtacgccgttgccacaaccgtgatcaccccaatgatgagacacacaattgaaaatactacggcaaacatctctctgaccgctatagccaatcaagcggctattctcatgggtctggacaaggggtggcctatcagcaaaatggatattggcgtcccgcttttagccctgggatgctattcccaggtgaaccccctcacattgactgcagccgtcctgatgctagtggctcattacgcaatcataggcccagggctgcaggccaaggcgaccagggaggctcagaagcgcacagccgcaggaatcatgaaaaatcctaccgttgacggcattgtggccatcgatctcgaccccgtagtgtatgacgctaagttcgaaaaacaacttggtcagattatgctgttgatcctgtgtacttcacagatactcctgatgcggacgacatgggccttatgcgagtctattacccttgcaactgggccactgaccacactctgggaaggaagtcctggcaagttttggaacactaccatcgctgtctcgatggccaatatcttccgaggtagctacctagcgggcgccgggctggcattctccttgatgaaatctctgggaggcgggagaaggggaacaggcgctcagggtgagacgctcggggagaagtggaagcgccaacttaaccagctgtcaaaaagcgaatttaatacctataagcggtccggaattatggaggttgatagaagtgaagccaaagagggcttgaagcgtggtgaaactacaaaacacgcagtgtctaggggcaccgctaagctgcggtggttcgtcgagcgcaacctcgtgaagcccgaggggaaagtaatcgacttaggatgtggccgagggggatggagctactattgcgccggcctgaagaaagtgactgaagttaagggttacacaaaagggggaccgggccatgaggaaccaatacctatggccacctacggctggaatcttgtgaagctgcactcagggaaagatgtctttttcatgcccccagagaagtgtgacacgctactctgcgatattggagaatccagtcccaaccctaccatcgaggagggtagaacactgagggtgttgaagatggtcgaaccgtggctgaaaggcaatcagttttgtattaagatcctcaacccctatatgccaagcgtggttgagactcttgaacagatgcaacggaaacatgggggaatgctggtacgcaatcctttatctagaaactccacccacgagatgtactgggtgtcatgcggcacaggtaatatagtcagcgcggtgaacatgacttcgaggatgctgttgaaccgattcaccatggctcaccggaagcccacatatgagcgtgacgttgatctcggggcaggaaccagacatgtggccgtcgaacctgaggtggctaatctggacatcattggccagcgcatcgaaaacattaaaaatgagcacaagtctacttggcattacgatgaagacaacccatataagacgtgggcctaccacggcagttatgaggtaaaaccctccgggagcgcatcatccatggtgaatggagttgtcaggctacttacaaagccttgggatgtgatcccaatggtgacccagattgccatgactgacaccacaccctttggtcaacagcgggtcttcaaagagaaggttgacacgagaaccccgcgcgctaaaaggggcactacacagatcatggaagtgaccgcgaagtggctgtgggggtttctctctcgaaacaagaaacctcggatatgtactagagaggaattcacaaggaaggtacgcagcaatgccgcaattggagctgtgtttgtcgatgagaaccagtggaatagtgccaaagaagcagtggaggacgagcgtttctgggatctggttcaccgggaaagagagttgcataagcaaggcaaatgcgccacctgcgtgtacaacatgatgggtaagagggaaaagaaactgggggagtttggaaaggctaaaggctcccgcgccatctggtacatgtggctcggcgcgcgattccttgaattcgaggcactggggtttatgaatgaggaccactggttcagccgggaaaactctttatcaggagtcgagggtgaaggcctgcataagttggggtatatcctcagagatattagtaaaataccaggaggcaatatgtacgccgacgatacagctggttgggacactaggatcaccgaggatgacctgcagaacgaggccaagattacggatatcatggaacccgagcacgcactacttgctacctccatttttaaactgacatatcagaataaggtggtacgcgttcagagacctgccaagaacgggactgtgatggacgtcatcagccggagggatcaacgtggatctggccaggtgggcacctacgggctcaacacattcactaatatggaagtgcagctgatacgacagatggagtcggaaggaatctttttgccatcagagttagagacccccaacctggctgaacgcgtcctcgactggcttgagaaacatggtgccgaaagactgaagcggatggcaattagcggcgacgattgtgttgtgaaaccgatcgacgataggttcgcgacggccctaacagctctgaatgacatggggaaggtacgcaaagatattcctcaatgggagccctccaagggatggaacgactggcagcaggtgccattttgcagtcaccacttccatcagctcatcatgaaggatggcagagaaatagtcgtgccttgtcggaatcaagacgagttggttggtagggcccgagtgtctcagggggcaggatggagcctgcgtgagaccgcttgccttggcaaatcctatgcccagatgtggcaactgatgtactttcacagacgcgatctccggttagcagccaacgcgatttgttcagctgtccccgtggactgggtaccaactagtaggacaacctggtctatccatgcccaccaccagtggatgactaccgaagatatgctgagcgtttggaatagagtgtggatcgaggaaaacccctggatggaggacaagacacatgtctcctcatgggaagaggtgccttatttgggcaaacgcgaggaccagtggtgcgggagcctgattggactcacggcacgggccacctgggctactaatatacaggttgccatcaaccaagtgaggcgacttattggtaatgaaaactacctggattacatgacatctatgaagagattcaaaaatgagtccgacccagaaggcgcactatggtga

SEQ ID NO: 13513 - RNA, 9879 nt, synthetic construct
  misc_feature 1..9879: note = derived and/or modified CDS sequence (opt3) from DENV-1__FJ639813__SS-prME
  source 1..9879: mol_type = other RNA
agcgtgaccatgctgctcatgcttctgcccacagccttggctttccacttaactacgagaggcggggagcctcatatgatcgtctccaagcaggaaaggggaaaatctctgctatttaagacctcagcaggtgttaacatgtgcacactcattgccatggacctgggcgagctttgtgaagatactatgacctacaaatgcccacggataacagaggcggaaccggacgatgtggactgttggtgcaatgctaccgatacttgggtaacatatgggacctgtagtcaaacgggagagcaccgccgagacaagcgtagcgtggccctggcaccccatgtcggcttgggtctcgagactagaaccgaaacatggatgtcctctgagggggcctggaaacagatccagagggtggaaacttgggctctgcggcaccctggattcaccgttattgcactgtttctcgcccatgctatcggcacatcgattacccagaagggcatcatattcatcttactgatgcttgtgacgccatcaatggccatgcgctgcgtcgggattggaaacagagattttgtggagggtttgagcggcgcgacttgggtagacgttgtgctggagcacgggagttgtgtcacaaccatggcaaagaataaacccactctagatatcgaactcctgaagacagaggtgatgaaccctgccgtgcttaggaaactgtgcattgaagctaagatctccaataccacgaccgactctcggtgtccaacacaaggagaggccactttggtcgaagagcaggatgcaaacttcgtttgccgccgaacctttgtggacagaggctggggtaatgggtgtggactcttcggcaaaggcagcctgttaacatgcgctaagtttaagtgcgtaactaaactggaggggaagatagtgcagtacgaaaacctcaaatattccgtcattgtgaccgttcacacaggagatcagcatcaagtgggtaatgagaccactgaacacggcacgatcgccacaattaccccccaggcgcctacttcagagatccagcttaccgactacggggccctgacattggactgtagtccaaggaccggactagatttcaacgaaatggtcctgctcactatgaaggagaaaagctggctggtgcataagcagtggtttcttgacctgccgttgccctggacatctggcgcatccacgtcacaagagacctggaatcggcaggatctcctggtaactttcaaaacagctcacgccaagaagcaggaagttgtggtcttaggtagccaagagggggctatgcacaccgccctgacaggcgcaactgaaatccagaccagtggaacgaccacaatttttgccggccatctaaaatgccgtctcaagatggacaaactgactcttaaggggatgtcttatgtgatgtgtaccggatccttcaaattggagaaggaagtcgctgagacacagcacggtactgtgctggttcaggtgaagtacgagggcaccgatgcgccttgcaaaataccattcagcacgcaagacgaaaagggggtaacacagaacggacgcctcatcaccgcaaatcccattgtcactgataaagagaagcctgtgaacatcgaaacagagccaccctttggcgagtcgtatatagttgtgggtgccggggaaaaagctctgaagctttcttggttcaagaaaggctcctcaattggaaagatgtttgaggccaccgcaagaggcgccaggcggatggctatcctgggggacactgcctgggatttcggaagtatcggtggcgtctttaccagcgtggggaaattggtacatcaggtgttcggaacagcatacggcgttctcttttccggtgtctcttggacgatgaagattgggatcggcattctgttaacctggctgggactaaatagccgatcaactagtttctccatgacatgtatagcggtgggcatggtgaccctctacctgggggtcatggttcaggctgacagcggatgcgtgatcaactggaaaggccgcgaacttaagtgtggttctgggatttttgtgacaaacgaggtacacacttggaccgaacaatataagttccaggccgattcaccgaaaagattgagtgcagccatcggaaaggcttgggaggagggcgtctgcggtatcaggagcgccacgcggctggaaaatattatgtggaaacagatatccaacgagctcaatcatatcctgttagaaaacgacatgaagtttacagtggttgtgggcgacgcaaatgggattctggctcagggaaaaaagatgatccgccctcaacccatggagcacaaatactcttggaagtcgtggggcaaggccaaaattatcggggcggatatacagaacaccactttcatcattgacggaccagatacccctgaatgtcccgacggccagagagcctggaatatctgggaggtcgaggattatggttttgggattttcacaactaacatctggcttaagttgagggacagctacacccagatgtgcgatcaccgtctcatgtccgctgcaataaaagactcaaaggccgtgcatgctgatatgggatattggattgaaagtgagaaaaatgaaacatggaagctggcccgggcatctttcatcgaggttaagacgtgtacctggccaaaaagccacactctatggtccaacggcgtgctggaatcagagatgattatccccaagatatacggtggccctatcagccaacataattatcgaccagggtactttacacagaccgcgggaccgtggcacctcggcaaactggagcttgacttcgatttgtgcgaagggactacagtagtcgtggacgagcactgcggaaacagaggcccctctctgaggaccacgactgtgaccggtaagattatccatgaatggtgttgccgctcctgtacattacctccactccggtttagaggggaggatggatgctggtacggcatggagattaggcccgtcaaagaaaaggaggaaaatctggttcgcagtatggtgagcgccggttctggcgaggtagactccttctcacttgggatcctgtgtgtgagtataatgattgaagaggtcatgcgaagccggtggtcgcgtaagatgttgatgaccggaactctcgctgtgtttctgctactgatcatgggccagctcacatggaacgacctgatcagactttgcattatggttggggccaatgcatccgataggatgggaatgggcaccacatatttggctctgatggccactttcaaaatgcgccctatgtttgcagtgggtttactcttccggagactgacctctagggaggtccttctgctaacgatcgggctcagcctggtggcctcagttgaattgccaaacagtctggaggaattaggagacggcctcgctatgggcattatgatgctgaagcttctgacagagtttcaaccccaccagttgtggaccactctcctgtccctaaccttcgtgaaaacaactctgtctcttgattacgcgtggaagaccacggccatggtcctcagcatagtatccctgtttccgttgtgtctgtcaacaaccagccagaaaactacatggttacctgtgctcctggggagtttcggatgcaagccacttaccatgtttctgatcactgaaaacaagatttggggtcgaaaatcttggcccttgaatgagggcatcatggcaattgggatcgtttccatactcctgagctcgctactgaagaacgacgtgcctcttgctggacccctcatcgccggcggtatgctgattgcctgttatgtcatctcagggtctagtgctgatttgtccttagagaaagcagccgaagtgagctgggagcaggaagcggagcattctggagctagccacaatattctggtagaagtgcaagacgatggcacaatgaagatcaaagacgaggagcgcgatgacaccctcacgatactgcttaaggccactctgttggcagtctccggcgtttacccaatgtcaattcctgccaccctattcgtgtggtatttctggcagaaaaagaagcagcggagtggggtgctgtgggatacacccagcccaccggaagtcgagagagctgtgctcgacgatggaatctacaggatcctgcagcgtggtcttttaggccgctctcaagttggggtaggagtgtttcaggacggcgtcttccataccatgtggcacgtgacacggggtgcagttctgatgtatcaggggaaaagactcgaaccttcctgggcctcagtgaagaaagacttgattagttacggaggcggctggaggtttcaggggagctggaacactggagaggaggtccaagtgatagcggtagaacccggtaagaatccaaaaaacgtccagaccacgcccggcacattcaagactcctgagggggaagtgggagctatcgccctggattttaagccaggcacctccggttctcccattgttaatcgagaggggaaaatcgtgggactctacggcaacggcgtcgtgacaacctcggggacttatgttagcgcaattgcccaggctaaggcctcacaagaaggacctctgccggagatcgaggacgaagtgttcaaaaagcggaatcttaccataatggatctgcacccaggttccggcaaaacacgcagatacttgcccgcaatcgtcagggaggctattaagcggaagctacgaacgctgatcctcgcccctactagagtggtagcgagtgaaatggccgaggcattaaaagggatgccaattcgctatcagaccacagctgtgaagtctgaacataccggaagggagatcgttgacctgatgtgccacgccacttttacaatgcgtcttctgagccccgtccgggtgcctaactacaatatgataattatggatgaggctcatttcaccgacccggcatccatcgccgccagaggctatatctcaacgagggtgggtatgggggaagctgcggcaatttttatgactgccacacccccaggatctgtcgaggctttccctcagagcaacgccgtaatccaggatgaagagcgcgacatacccgaacgaagttggaattccggctacgattggattaccgactttccaggcaaaaccgtgtggttcgttcctagcatcaagtctgggaacgatattgcaaattgtctcagaaaaaacggaaagcgggtgatccaattgtcaaggaagactttcgacacagagtatcagaaaaccaagaacaatgactgggattacgtcgtgacaactgacatatccgagatgggtgccaactttcgcgctgatcgtgttattgaccccagacggtgcctgaaaccagtgatcctcaaggatggcccggaaagggtcatcctggcggggcctatgcccgtgacggtagccagtgcagctcagcgccgaggaagaattggccggaatcagaacaaagagggtgaccaatacgtgtatatggggcagccacttaataacgatgaagaccacgcccattggaccgaggcaaagatgctactggataatatcaacacacccgagggcattatacctgccttgttcgaaccagagagggaaaagagcgctgccatcgacggagagtaccgcttaagaggcgaagcgaggaaaacttttgttgagctgatgcggcgtggggatctccccgtctggctgtcgtataaggtggcatctgagggattccagtactccgaccgccgatggtgctttgatggtgaaagaaataaccaggtgcttgaggaaaatatggacgtcgagatttggaccaaagaaggcgagaggaagaaactgcggcctcgctggctcgacgccagaacatatagcgatccgttggctctgagggagttcaaggaatttgccgctgggcggcgatcagttagtggagacctaatcctggagatcggcaaactcccacaacaccttaccctgagagcacagaacgccttagataatttggtgatgctgcacaactctgaacagggtgggaaggcttaccgccatgccatggaggaactccccgacactattgagacgctgatgcttctggcactcatagcggtattgaccggcggagtgacactgttctttttatccggcaaggggctaggaaaaactagcatcggtctgctctgtgtcaccgcctcaagtgctcttctgtggatggccagcgtggagcctcactggattgcagcttccatcattttggaattctttctgatggttctcctgatccccgagccagataggcagcggacacctcaagacaatcagcttgcctatgtggtcataggcctcctgttcatgatcttgaccgtagcagccaacgaaatggggctgttagagactacaaagaaagatctaggaattggctacgtggctgcggagaaccatcagcacgccacgatgctggacgttgatctccgtcccgcatctgcttggaccctttacgccgtggccactacagtcatcaccccaatgatgagacacaccattgaaaatacaactgcaaacatcagcctgacggctatagccaatcaagcggctattttgatgggtctggacaaggggtggcctatctccaaaatggatattggcgtgccgctcctggcccttggatgctattcacaggtcaaccccttaaccctgacagcagccgtgctcatgttggttgctcattacgcaatcataggcccagggctgcaggccaaggcgactagggaggctcagaagcgcaccgccgcaggaatcatgaaaaatcctacagtggacggcattgtagccatcgatctagaccccgtggtctatgacgctaagtttgaaaaacaactgggtcagattatgctccttatcctgtgtacctctcagatattgctgatgcggactacgtgggccctctgcgagagtattacactggcaaccgggccattaactaccctttgggaaggatcgcctggcaagttctggaacacaactatcgctgttagcatggccaatatcttccgaggttcctacctggcgggcgccgggctcgcattttctctaatgaaatcactgggaggcgggagaaggggaaccggcgctcagggtgagacattgggggagaagtggaagcgccaactgaaccagctcagcaaatccgaattcaatacgtataagcggagtggaattatggaggtggatagatctgaagccaaagagggccttaagcgtggtgaaaccactaaacacgcagtcagcaggggcacagctaagctgcggtggtttgtggagcgcaacttggtaaagcccgaggggaaagtgatcgacctgggatgtggccgagggggatggtcatactattgcgccggcctcaagaaagttaccgaagtgaagggttacactaaagggggaccgggccatgaggaaccaatgcctatggccacatacggctggaatttagtcaagctgcactccgggaaagatgtgttctttatgcccccagagaagtgtgacacccttctgtgcgatataggagaaagtagccccaaccctacgattgaggagggtagaaccctaagggtcctcaagatggtggaaccgtggctgaaaggcaatcagttctgtatcaagattttgaacccctatatgccatctgttgtagagacactggaacagatgcaacggaaacatgggggaatgctcgtgcgcaatcctctttccagaaactcaactcacgagatgtactgggtcagctgcggcaccggtaatatcgtgtcggcggttaacatgacatctaggatgctgttaaaccgatttactatggctcaccggaagcccacctatgagcgtgacgtggatctgggggcaggaacaagacatgtcgccgtggaacctgaggtagctaatttggacataatcggccagcgcattgaaaacatcaaaaatgagcacaagagtacctggcattacgatgaagacaacccatataagacttgggcctaccacggctcctatgaggtgaaacccagcgggtcagcatcctctatggttaatggagtcgtgaggctcctgacgaagccttgggatgtgattccaatggtcacacagatcgccatgaccgacactacccccttcggtcaacagcgggtttttaaagagaaggtggacacaagaacgccgcgcgctaaaaggggcaccactcagattatggaagtaacagcgaagtggctatgggggttccttagccgaaacaagaaacctcggatctgtaccagagaggaatttactaggaaggtgcgcagtaattccgccataggagcagtcttcgtggatgagaaccagtggaatagcgctaaagaagccgttgaggacgagcgtttttgggatctggtgcaccgggaaagagagctccataagcaaggcaaatgcgcaacatgcgtctacaacatgatgggtaagagggaaaagaaactgggggagttcggaaaggccaaaggctctcgcgctatttggtacatgtggttgggcgcccgattcctggaatttgaggcgctcgggttcatgaatgaggaccactggttttcacgggaaaacagtctttccggagtggagggtgaaggcctgcataagttagggtatatcctgagagatatcagcaaaattccaggaggcaatatgtacgcagacgataccgccggttgggacacaaggataactgaggatgacttgcagaacgaggctaagatcaccgatattatggaacccgagcacgccctcctggcaacgtctatcttcaaactaacctatcagaataaggtagttcgcgtgcagagacctgctaagaacgggacagtcatggacgtgatttcgcggagggatcaacgtggatcaggccaggtgggcacttacgggcttaacacctttacaaatatggaagtccagctgatccgacagatggagagcgaaggaatattctccccaagtgagctcgagactcccaacctggccgaacgcgttttggactggttagagaaacatggtgctgaaagactgaagcggatggccatctctggcgacgattgtgtggtaaaaccgattgacgataggtttgcaaccgcgctcacggcccttaatgacatggggaaggtgcgcaaagatatccctcaatgggagcccagcaagggatggaacgactggcagcaggtcccattctgctcccaccactttcatcagctgattatgaaggatggcagagaaatcgtggttccttgtcggaatcaagacgagctagtgggtagggctcgagtctcacagggggccggatggagtctgcgtgagacagcatgcctcggcaaatcttatgctcagatgtggcaattgatgtacttccacagacgcgatctgcggcttgccgcaaacgccatatgtagcgcggtgcccgtagactgggttccaacctccaggactacatggtcaattcatgctcaccaccagtggatgaccactgaagatatgctgagcgtgtggaatagagtctggatcgaggaaaacccctggatggaggacaagacccatgtgtcttcctgggaagaggttccttatctcggcaaacgcgaggaccagtggtgcgggagtttaatcggactgacagcccgggcaacgtgggccaccaatattcaggtggctataaaccaagtcaggcgattgatcggtaatgaaaactacctggattacatgactagcatgaagagatttaaaaatgagtcggacccagaaggcgccctctggtga

SEQ ID NO: 13514 - RNA, 9879 nt, synthetic construct
  misc_feature 1..9879: note = derived and/or modified CDS sequence (opt3) from DENV-1__JN819412__SS-prME
  source 1..9879: mol_type = other RNA
agcgtgaccatgctgctcatgcttctgcccacagccttggctttccacttaactacgagaggcggggagcctcatatgatcgtctccaagcaggaaaggggaaaatctctgctatttaagacctcagcaggtgttaacatgtgcacactcattgccatggacctgggcgagctttgtgaagatactatgacctacaaatgcccacggataacagaggcggaaccggacgatgtggactgttggtgcaatgctaccgatacttgggtaacatatgggacctgtagtcaaacgggagagcaccgccgagacaagcgtagcgtggccctggcaccccatgtcggcttgggtctcgagactagaaccgaaacatggatgtcctctgagggggcctggaaacagatccagagggtggaaacttgggctctgcggcaccctggattcaccgttattgcactgtttctcgcccatgctatcggcacatcgattacccagaagggcatcatattcatcttactgatgcttgtgacgccatcaatggccatgcgctgcgtcgggattggaaacagagattttgtggagggtttgagcggcgcgacttgggtagacgttgtgctggagcacgggagttgtgtcacaaccatggcaaagaataaacccactctagatatcgaactcctgaagacagaggtgaccaaccctgccgtgcttaggaaactgtgcattgaagctaagatctccaatacgaccacagactctcggtgtccaactcaaggagaggccaccttggtcgaagagcaggatgcaaacttcgtttgccgccgaacatttgtggacagaggctggggtaatgggtgtggactcttcggcaaaggcagcctgttaacttgcgctaagtttaagtgcgtaaccaaactggaggggaagatagtgcagtacgaaaacctcaaatattccgtcattgtgacagttcacaccggagatcagcatcaagtgggtaatgagactacggaacacggcacaatcgccaccattactccccaggcgcctacctcagagatccagcttacagactacggggccctgaccttggactgtagtccaaggactggactagatttcaacgaaatggtcctgctcacaatgaaggagaaaagctggctggtgcataagcagtggtttcttgacctgccgttgccctggacgtctggcgcatccacctcacaagagacttggaatcggcaggatctcctggtaacattcaaaaccgctcacgccaagaagcaggaagttgtggtcttaggtagccaagagggggctatgcacacagccctgactggcgcaaccgaaatccagacgagtggaaccacaactatttttgccggccatctaaaatgccgtctcaagatggacaaactgacccttaaggggatgtcttatgtgatgtgtacaggatccttcaaattggagaaggaagtcgctgagactcagcacggtaccgtgctggttcaggtgaagtacgagggcacggatgcgccttgcaaaataccattcagcacacaagacgaaaagggggtaacccagaacggacgcctcatcactgcaaatcccattgtcacagataaagagaagcctgtgaacatcgaaaccgagccaccctttggcgagtcgtatatagttgtgggtgccggggaaaaagctctgaagctttcttggttcaagaaaggctcctcaattggaaagatgtttgaggccactgcaagaggcgccaggcggatggctatcctgggggacaccgcctgggatttcggaagtatcggtggcgtctttacaagcgtggggaaattggtacatcaggtgttcggaacggcatacggcgttctcttttccggtgtctcttggaccatgaagattgggatcggcattctgttaacttggctgggactaaatagccgatcaacaagtctctccatgacctgtatagcggtgggcatggtgacactgtaccttggggtcatggttcaggctgacagcggatgcgtgatcaactggaaaggccgcgaattgaagtgtggttctgggattttcgtgactaacgaggtacacacctggacggaacaatataagtttcaggccgattcaccgaaaagactgagtgcagccatcggaaaggcttgggaggagggcgtctgcggtatcaggagcgccacacggctcgaaaatattatgtggaaacagatatccaacgagctgaatcatatcttactggaaaacgacatgaagttcaccgtggttgtgggcgacgcaaatgggattcttgctcagggaaaaaagatgatccgccctcaacccatggagcacaaatactcttggaagtcgtggggcaaggccaaaattatcggggcggatatacagaacactacctttatcattgacggaccagatacacctgaatgtcccgacggccagagagcctggaatatctgggaggtcgaggattatggtttcgggatttttactaccaacatctggttgaagctcagggacagctacacacagatgtgcgatcaccgtctgatgtccgctgcaataaaagactcaaaggccgtgcatgctgatatgggatattggattgaaagtgagaaaaatgaaacgtggaagctagcccgggcatctttcatcgaggttaagacctgtacttggccaaaaagccacacactgtggtccaacggcgtgctcgaatcagagatgattatccccaagatatacggtggccctatcagccaacataattatcgaccagggtacttcacccagactgcgggaccgtggcacctgggcaaacttgagttggactttgatctgtgcgaagggacaaccgtagtcgtggacgagcactgcggaaacagaggcccctctttaaggacgactaccgtgacaggtaagattatccatgaatggtgttgccgctcctgtaccctccctccactgcggttcagaggggaggatggatgctggtacggcatggagattaggcccgtcaaagaaaaggaggaaaatcttgttcgcagtatggtgagcgccggttctggcgaggtagactccttttcactggggatcttgtgtgtgagtataatgattgaagaggtcatgcgaagccggtggtcgcgtaagatgctcatgactggaacactggctgtgttcctactgctcatcatgggccagctgacctggaacgaccttatcagattgtgcattatggttggggccaatgcatccgataggatgggaatgggcacaacttatctggctttaatggccacctttaaaatgcgccctatgttcgcagtgggtctcctgtttcggagacttacgtctagggaggtcctgctactcacaatcgggctgagcttggtggcctcagttgaactgccaaacagtttagaggaactcggagacggcctggctatgggcattatgatgcttaagctgttgaccgagttccaaccccaccagctctggactaccctgctatccctgacatttgtgaaaactaccctttctctcgattacgcgtggaagacgacagccatggtcctgagcatagtatccttgttcccgctgtgtttatcaaccactagccagaaaacaacctggctccctgtgctgcttgggagttttggatgcaagccactgactatgttcttgatcacagaaaacaagatttggggtcgaaaatcttggcccctcaatgagggcatcatggcaattgggatcgtttccatactgctaagctcgctgcttaagaacgacgtgcctctcgctggacccctgatcgccggcggtatgttgattgcctgttatgtcatctcagggtctagtgctgatttactgctcgagaaagcagccgaagtgtcctgggagcaggaagcggagcatagcggagcttctcacaatattctggtagaagtgcaagacgatggcaccatgaagatcaaagacgaggagcgcgatgacacgcttactatactgttgaaggccaccctactggcagtcagcggcgtttacccaatgtccattcctgccacactctttgtgtggtatttctggcagaaaaagaagcagcggtcaggggtgctgtgggatacccccagtccaccggaagtcgagagagctgtgcttgacgatggaatctacaggatcttacagcgtggtctgctcggccgcagccaagttggggtaggagtgttccaggacggcgtctttcatacaatgtggcacgtgactcggggtgcagttttgatgtatcaggggaaaagactggaaccttcttgggcctccgtgaagaaagacctcatttcatacggaggcggctggaggttccaggggagttggaacaccggagaggaggtccaagtgatagcggtagaacccggtaagaatccaaaaaacgtccagacgacacccggcacttttaagacccctgagggggaagtgggagctatcgccctggatttcaagccaggcacaagcggttcccccattgttaatcgagaggggaaaatcgtgggactttacggcaacggcgtcgtgaccacttctgggacctatgtttcggcaattgcccaggctaaggccagccaagaaggacctctgccggagatcgaggacgaagtgtttaaaaagcggaatttgacaataatggatctacacccaggttcaggcaaaacgcgcagatacctgcccgcaatcgtcagggaggctattaagcggaagctccgaactttaatcctggcccctaccagagtggtagcgtccgaaatggccgaggcacttaaagggatgccaattcgctatcagacaaccgctgtgaagagtgaacatactggaagggagatcgttgacctgatgtgccacgccacattcaccatgcgtctcttgtctcccgtccgggtgcctaactacaatatgataattatggatgaggctcattttacggacccggcaagcatcgccgccagaggctatatctccactagggtgggtatgggggaagctgcggcaattttcatgacagccacccccccaggatcagtcgaggcttttcctcagtctaacgccgtaatccaggatgaagagcgcgacatacccgaacgaagctggaatagtggctacgattggattaccgacttcccaggcaaaactgtgtggtttgttccttccatcaagagcgggaacgatattgcaaattgtctgagaaaaaacggaaagcgggtgatccaactctctaggaagacattcgacaccgagtatcagaaaacaaagaacaatgactgggattacgtcgtgactacggacatatcagagatgggtgccaacttccgcgctgatcgtgttattgaccccagacggtgcctgaaaccagtgatccttaaggatggcccggaaagggtcatcctagcggggcctatgcccgtgaccgtagcctccgcagctcagcgccgaggaagaattggccggaatcagaacaaagagggtgaccaatacgtgtatatggggcagccactgaataacgatgaagaccacgcccattggacagaggcaaagatgttgttagataatatcaacactcccgagggcattatacctgccctgtttgaaccagagagggaaaagagtgctgccatcgacggagagtaccgcctcagaggcgaagcgaggaaaaccttcgttgagctgatgcggcgtggggatcttcccgtctggctgagctataaggtggcatcggagggatttcagtactctgaccgccgatggtgcttcgatggtgaaagaaataaccaggtgctcgaggaaaatatggacgtcgagatttggacaaaagaaggcgagaggaagaaattgcggcctcgctggctggacgccagaacctattccgatccgctagctctgagggagtttaaggaattcgccgctgggcggcgaagcgtttcaggagacctcatccttgagatcggcaaactgccacaacacttaactttgagagcacagaacgccctggataatctcgtgatgctgcacaacagtgaacagggtgggaaggcttaccgccatgccatggaggaacttcccgacacgattgagaccctgatgctcttggcactgatagcggtattaacaggcggagtgactctatttttcctgtctggcaaggggctcggaaaaacctccatcggtcttctgtgtgtcacagccagctcagctttgctgtggatggccagtgtggagcctcactggattgcagctagcatcattctcgaatttttcctgatggttcttctcatccccgagccagataggcagcggacccctcaagacaatcagctggcctatgtggtcataggcttgctgtttatgatcttaactgtagcagccaacgaaatggggctactggagacaacgaagaaagatctcggaattggctacgtggctgcggagaaccatcagcacgccaccatgcttgacgttgatctgcgtcccgcatccgcttggactttgtacgccgtggccacaaccgtcatcaccccaatgatgagacacacaattgaaaatactacggcaaacatctctctgaccgctatagccaatcaagcggctattctcatgggtctggacaaggggtggcctatcagcaaaatggatattggcgtgccgcttttagccctgggatgctattcccaggtcaaccccctcacattgactgcagccgtgctgatgctagttgctcattacgcaatcataggcccagggctgcaggccaaggcgaccagggaggctcagaagcgcacagccgcaggaatcatgaaaaatcctaccgtggacggcattgtagccatcgatctcgaccccgtggtctatgacgctaagttcgaaaaacaacttggtcagattatgctgttgatcctgtgtacttcacagatactcctgatgcggacgacatgggccttatgcgagtctattacccttgcaactgggccactgaccacactctgggaaggaagtcctggcaagttttggaacactaccatcgctgtttcgatggccaatatcttccgaggtagctacctagcgggcgccgggctggcattctccttgatgaaatctctgggaggcgggagaaggggaacaggcgctcagggtgagacgctcggggagaagtggaagcgccaacttaaccagctgtcaaaaagcgaatttaatacctataagcggtccggaattatggaggtggatagaagtgaagccaaagagggcttgaagcgtggtgaaactacaaaacacgcagtctctaggggcaccgctaagctgcggtggttcgtggagcgcaacctcgtaaagcccgaggggaaagtgatcgacttaggatgtggccgagggggatggagctactattgcgccggcctgaagaaagttactgaagtgaagggttacacaaaagggggaccgggccatgaggaaccaatacctatggccacctacggctggaatcttgtcaagctgcactcagggaaagatgtgtttttcatgcccccagagaagtgtgacacgctactctgcgatattggagaatccagtcccaaccctaccatcgaggagggtagaacactgagggtcttgaagatggtggaaccgtggctgaaaggcaatcagttttgtattaagatcctcaacccctatatgccaagcgttgtagagactcttgaacagatgcaacggaaacatgggggaatgctggtgcgcaatcctttatctagaaactccacccacgagatgtactgggtctcatgcggcacaggtaatatagtgagcgcggttaacatgacttcgaggatgctgttgaaccgattcaccatggctcaccggaagcccacatatgagcgtgacgtggatctcggggcaggaaccagacatgtcgccgtggaacctgaggtagctaatctggacatcattggccagcgcatcgaaaacattaaaaatgagcacaagtctacttggcattacgatgaagacaacccatataagacgtgggcctaccacggcagttatgaggtgaaaccctccgggagcgcatcatccatggttaatggagtcgtgaggctacttacaaagccttgggatgtgatcccaatggtcacccagattgccatgactgacaccacaccctttggtcaacagcgggttttcaaagagaaggtggacacgagaaccccgcgcgctaaaaggggcactacacagatcatggaagtaaccgcgaagtggctgtgggggtttctctctcgaaacaagaaacctcggatatgtactagagaggaattcacaaggaaggtgcgcagcaatgccgcaattggagctgtctttgtggatgagaaccagtggaatagtgccaaagaagcagttgaggacgagcgtttctgggatctggtgcaccgggaaagagagttgcataagcaaggcaaatgcgccacctgcgtctacaacatgatgggtaagagggaaaagaaactgggggagtttggaaaggctaaaggctcccgcgccatctggtacatgtggctcggcgcgcgattccttgaattcgaggcactggggtttatgaatgaggaccactggttcagccgggaaaactctttatcaggagtggagggtgaaggcctgcataagttggggtatatcctcagagatattagtaaaataccaggaggcaatatgtacgccgacgatacagctggttgggacactaggatcaccgaggatgacctgcagaacgaggccaagattacggatatcatggaacccgagcacgcactacttgctacctccatttttaaactgacatatcagaataaggtagttcgcgtgcagagacctgccaagaacgggactgtcatggacgtgatcagccggagggatcaacgtggatctggccaggtgggcacctacgggctcaacacattcactaatatggaagtccagctgatacgacagatggagtcggaaggaatctttttgccatcagagttagagacccccaacctggctgaacgcgttctcgactggcttgagaaacatggtgccgaaagactgaagcggatggcaattagcggcgacgattgtgtggtaaaaccgatcgacgataggttcgcgacggccctaacagctctgaatgacatggggaaggtgcgcaaagatattcctcaatgggagccctccaagggatggaacgactggcagcaggtcccattttgcagtcaccacttccatcagctcatcatgaaggatggcagagaaatagtggttccttgtcggaatcaagacgagttggtgggtagggcccgagtctctcagggggcaggatggagcctgcgtgagaccgcttgccttggcaaatcctatgcccagatgtggcaactgatgtactttcacagacgcgatctccggttagcagccaacgcgatttgttcagctgtgcccgtagactgggttccaactagtaggacaacctggtctatccatgcccaccaccagtggatgactaccgaagatatgctgagcgtgtggaatagagtctggatcgaggaaaacccctggatggaggacaagacacatgtgtcctcatgggaagaggttccttatttgggcaaacgcgaggaccagtggtgcgggagcctgattggactcacggcacgggccacctgggctactaatatacaggtggccatcaaccaagtcaggcgacttattggtaatgaaaactacctggattacatgacatctatgaagagattcaaaaatgagtccgacccagaaggcgcactatggtga

SEQ ID NO: 13515 - RNA, 9879 nt, synthetic construct
  misc_feature 1..9879: note = derived and/or modified CDS sequence (opt3) from DENV-1__FJ810415__SS-prME
  source 1..9879: mol_type = other RNA
agcgtgaccatgctgctcatgcttctgcccacagccttggctttccacttaactacgaggggcggggagcctcatatgatcgtctccaaacaggaaaggggaaaatctctgctatttaagacctcagctggtgttaacatgtgcaccctcattgccatggacctgggcgagctttgtgaagatactatgacctacaaatgcccacggataacagaggcggaaccggacgatgtggactgttggtgcaatgctaccgatacttgggtaacatatgggacctgtagtcagacgggagagcaccgccgagagaagcgtagcgtggccctggctccccatgtcggcttgggtctcgaaactagaaccgagacatggatgtcctctgaaggggcctggaaacagatccagagggtggagacttgggccctgcggcaccctggattcaccgttattgcatttttcctggcccatgctatcggcacatcgattacccagaagggcgtgatctttatactcttaatgctggtcacgccatcaatggccatgcgctgcgtggggatcggaaacagggacttcgtagagggtcttagcggcgcgacttgggttgatgtggtcttggaacacgggagttgtgtgacaaccatggcaaagaataaacccactctggacattgagctactcaagacagaagtgaccaaccctgccgtcctgaggaaactttgcatcgaggctaagatttccaatacgaccacagattctcggtgtccaactcaaggagaagccaccctggttgaggagcaggacgcaaactttgtgtgccgccgaacattcgtagatagaggctggggtaatgggtgtggattgtttggcaaaggcagcctcctgacttgcgctaagttcaagtgcgtgaccaaattagaagggaagatcgtccagtacgagaacctgaaatattccgtgatagttacagtgcacaccggagaccagcatcaagtcggtaatgaaactacggagcacggcacaattgccaccatcactccccaggcgcctacctcagaaattcagctcacagattacggggcccttaccctggactgtagtccaaggactggattggactttaacgagatggtgctactgacaatgaaggagaaaagctggctcgtacataagcagtggttcctggatcttccgctgccctggacgtctggcgcatccacctcacaagaaacttggaatcggcaggacttgctcgttacatttaaaaccgctcacgccaagaagcaggaggtggtcgtgctgggtagccaagaaggggctatgcacacagccttaactggcgcaaccgagatccagacgagtggaaccacaactatcttcgccggccatctgaaatgccgtctaaagatggataaactcaccctgaaggggatgtcttatgtcatgtgtacaggatccttcaaacttgaaaaggaggtggctgagactcagcacggtaccgttttggtgcaggtaaagtacgaaggcacggacgcgccttgcaaaattccatttagcacacaagatgagaagggggtcacccagaacggacgcctgataactgcaaatcccatcgtgacagacaaagaaaagcctgttaacattgagaccgagccacccttcggcgaatcgtatatcgtggtcggtgccggggagaaagctctcaagctgaattggtttaagagaggatcttccataggaaaaatgttcgaagccactgcaaggggcgcccggcgaatggctattcttggggataccgcctgggactttggatcaatcggtggcgtgttcacaagtgtagggaagctggtgcatcaggtttttggaacggcatacggcgtcttgttcagcggtgtgtcctggaccatgaaaatcgggattggcatcctcctgacttggttaggactgaactctcgcagcacatcactaagtatgacctgtattgcggtgggcatggtcacactctacctgggggttatggtgcaggctgattccggatgcgtgataaactggaagggcagagagcttaaatgtggtagcgggatctttgtaactaatgaagtccacacctggacggagcaatataagttccaggccgactctccgaagaggttgtcagcagccattggaaaggcttgggaggaaggcgtgtgcggtatccggagtgccacacgcctggagaacatcatgtggaagcagattagcaatgaactcaaccatatactgttagagaatgatatgaaatttaccgttgtggtcggcgacgcaaacgggatcctggctcagggaaagaaaatgattagacctcaacccatggaacacaagtactcctggaaatcttggggcaaggccaagatcattggggcggacatccagaatactaccttcataatcgatggaccagacacacctgagtgtcccgatggccagagggcctggaacatttgggaggtggaagactatggttttggggttttcactaccaatatctggcttaaattgcgtgattcgtacacacagatgtgcgaccaccggctcatgagcgctgcaattaaggattccaaagccgtgcatgctgacatgggatattggatcgagtcagaaaagaacgagacgtggaaactggcccgagcaagtttcatagaagtaaagacctgtacttggccaaagtctcacacactatggagcaatggcgtcctggagtccgagatgattatccccaaaatttacggtggccctatctcacaacataactatagaccagggtactttacccagactgcgggaccgtggcacctcggcaagctggaacttgatttcgacttgtgcgaggggacaaccgtggtggtcgatgaacactgcggaaataggggccccagcctgcgcacgactaccgttacaggtaaaataatccatgagtggtgttgccggtcttgtaccttacctccactcagatttagaggggaagacggatgctggtacggcatggaaattcgccccgtgaaggagaaagaagagaacctggtacgatccatggtgagtgccggtagcggcgaagtcgattctttctcccttgggatcctgtgtgtgtcaattatgatcgaggaggttatgcggagtcgttggagcagaaagatgttgatgactggaacactcgctgtgtttctgctactgataatgggccagctcacctggaatgacctgattaggctttgcatcatggtcggggccaacgcatcggaccgcatgggaatgggcacaacttatttggctctgatggccaccttcaagatgcggcctatgtttgcagtgggtttactcttcagaaggctgacgtcccgagaagttcttctgctaacaatcgggctctctctggtggccagcgtcgagttgccaaactcactggaagagttaggagatggcctcgctatgggcattatgatgctgaaacttctgaccgaatttcaaccccaccagttgtggactaccctcctgagtctaacattcgtaaagactaccctgtcccttgactacgcgtggaaaacgacagccatggtgctctctatcgttagcctgtttccgttgtgtctgtccaccacttcacagaagacaacctggttacctgtgctcctggggagcttcggatgcaaaccacttactatgtttctgattacagagaataagatatggggtcgcaagagttggcccttgaacgagggcatcatggcaattgggatcgtctctattctcctgtccagcctactgaaaaatgatgtgcctcttgctggacccctcatcgccggcggtatgctgatagcctgttatgtaatctcggggtcatctgctgacttgagtttagaaaaggcagccgaggtgtcctgggaacaggaggcggaacatagcggagcttctcacaacattctggtcgaggttcaagatgacggcaccatgaaaatcaaggatgaggaacgggacgatacgctcactattctgcttaaagccaccctgttggcagtgagcggcgtgtacccaatgtccatccctgccacactattcgtctggtatttctggcagaagaaaaagcagagatcaggggtgctgtgggacacccccagtccaccggaggttgaaagggctgtactcgatgacggaatataccgtattctgcagcgcggtcttttaggccggagccaagtgggggtcggagtgtttcaggatggcgttttccatacaatgtggcacgtgactagaggtgcagtcctgatgtatcaggggaagaggctcgagccttcttgggcctccgtgaaaaaggacttgatctcatacggaggcggctggcgatttcaggggagttggaataccggagaggaagtacaagtcatcgcggtggagcccggtaaaaacccaaagaatgttcagacgacacccggcactttcaaaacccctgaaggggaggtgggagctattgccctggactttaagccaggcacaagcggttcccccatagtcaaccgggaagggaagatcgtgggactctacggcaatggcgttgtgaccacttctgggacctatgtctcggcaattgcccaggctaaagccagccaagagggacctctgccggagatcgaagatgaggtgttcaagaaacgcaaccttacaattatggacctgcacccaggttcaggcaagacgagaaggtacttgcccgcaatcgtacgggaagctataaaacgaaagctaagaactctgatcctcgcccctacccgcgtggttgcgtccgagatggccgaagcattaaaggggatgccaattaggtatcagacaaccgctgtcaaaagtgagcatactggacgtgagatcgtggatctgatgtgccacgccacatttaccatgcggcttctgtctcccgtgagagtccctaattacaacatgattatcatggacgaagctcatttcacggatccggcaagcatagccgccaggggctatatttccactcgcgtaggtatgggggaggctgcggcaatctttatgacagccacacccccaggatcagtggaggctttccctcagtctaatgccgttatccaggacgaggaacgagatattcccgagagaagctggaacagtggctacgactggatcaccgattttccaggcaagactgtgtggttcgtcccttccataaaaagcgggaatgacattgcaaactgtctccggaagaacggaaaaagggtgatccaattgtctcgcaagacattcgataccgagtatcagaagactaaaaataacgactgggactacgttgtgactacggatatttcagaaatgggtgccaattttcgtgctgacagagtcatcgatccccggaggtgcctgaagccagtgatactcaaagacggcccggagcgcgtaattctggcggggcctatgcccgtgaccgttgcctccgcagctcagcgaagaggacggatcggcaggaaccagaataaggaaggtgatcaatacgtctatatggggcagccacttaacaatgacgaggatcacgcccattggacagaggcaaaaatgctactggacaacatcaatactcccgaaggcattatccctgccttgttcgagccagaacgcgagaagagtgctgccattgatggagaatacagattaaggggcgaggcgcggaagacctttgtggagctgatgcgtcgcggggacctccccgtgtggctgagctataaagtcgcatcggaaggattccagtactctgatcgaagatggtgctttgacggtgagaggaacaatcaggttcttgaagagaacatggatgtggaaatatggacaaaggagggcgagcggaaaaagctgcgccctagatggctcgacgccaggacctattccgacccgttggctctgcgggagttcaaagagtttgccgctgggcgaagaagcgtatcaggagatctaatcctggaaattggcaagctcccacaacaccttactctgcgcgcacagaatgccttagacaacttggtgatgctgcacaatagtgagcagggtgggaaggcttacaggcatgccatggaggaactccccgatacgatcgagaccctgatgcttctggcactcatcgcggtcttgacaggcggagtgactctgttctttttatctggcaaggggctaggaaagacctccattggtctgctctgtgttacagccagctcagcacttctgtggatggccagtgtggaacctcactggatagcagctagcatcattttggagttctttctgatggtcctcctgatccccgaaccagaccggcagcgtacccctcaagataaccagcttgcctatgtagtgattggcctcctgttcatgatcttgactgttgcagccaacgagatggggctgttagagacaacgaaaaaggacctaggaataggctacgtggctgcggaaaatcatcagcacgccaccatgctggatgtcgacctccaccccgcatccgcttggactctttacgccgtggccacaaccgtcatcaccccaatgatgagacatacaattgagaacactacggcaaatatctctctgaccgctattgccaaccaagcggctatcttgatgggtctggataaagggtggcctataagcaagatggacattggcgtgccgctcctggcccttggatgctattcccaggttaatcccttaacactgactgcagccgtgctcatgttggtagctcactacgcaatcattggcccagggctgcaggccaaagcgaccagggaagctcagaagcgcacagccgcaggaatcatgaagaaccctaccgtggatggcatagtcgccatcgacctagatcccgttgtgtatgacgctaaatttgagaagcaactgggtcagattatgctccttatcctgtgtacttcacagattttgctgatgcggacgacatgggccctctgcgaatctatcaccctggcaactgggccattaaccacactttgggagggaagtcctggcaaattctggaatactaccatagctgtctcgatggccaacattttccgaggtagctacctggcgggcgccgggctcgcattttccctaatgaagtctctgggaggcgggagaaggggaacaggcgctcagggtgagacgttgggggaaaaatggaagcgccaactgaatcagctctcaaagagcgagttcaacacctataaacggtccggaatcatggaagtggacagaagtgaggccaaggaaggccttaaacgtggtgagactacaaagcatgcagtatctaggggcaccgctaaactgcggtggtttgtggagcgcaatttggttaagcccgaagggaaggtgatcgatctgggatgtggccgagggggatggagctactattgcgccggcctcaaaaaggtcactgaggtgaaaggttacacaaaagggggcccgggccacgaagaaccaattcctatggccacctacggctggaacttagtcaaactgcattcagggaaggacgtgttctttatgcccccagaaaaatgtgatacgcttctgtgcgacatcggagagtccagtcccaatcctaccatagaggaaggtagaacactaagggttctcaagatggtagagccgtggctgcggggcaaccagttctgtattaagatcttgaatccctatatgccaagcgtggtcgaaactctggagcagatgcaacgcaaacacgggggaatgctcgtgagaaaccctctttctagaaattccacccacgagatgtactgggtttcatgcggcacaggtaacattgtgagcgcggtcaacatgacttcgcgaatgctgttaaatcggtttaccatggctcatcgtaagcccacatatgaaagagatgtggacctgggggcaggaacccgccacgtagccgtggagcctgaagttgctaacttggatatcataggccagaggatcgagaatattaaaaacgaacataagtctacttggcactacgacgaggataatccatataaaacgtgggcctaccacggcagttatgaggtcaagccctccgggagcgcatcatccatggtgaacggagtggtccggctcctgacaaagccttgggacgttatcccaatggtgacccagattgccatgactgataccacacccttcggtcaacagagagtatttaaagaaaaggtggacacgcgcaccccgagggctaaacgaggcactacacagatcatggaggtcaccgcgaagtggctatgggggttcctttctcggaataaaaagcctagaatttgtactagggaagagtttacacgcaaggtgcgtagcaacgccgcaatcggagctgttttcgtggacgaaaatcagtggaacagtgccaaagaggcagtcgaggatgaacggttttgggacctggtgcatagagagagggaactccacaagcaaggcaaatgcgcaacctgcgtatacaatatgatgggtaagcgcgagaaaaagctgggggagttcggaaaggctaaaggctcccgagccatatggtacatgtggttgggcgcgcggttcctggagtttgaggcactcgggttcatgaacgaagatcattggtttagcagagaaaattctctttcaggagttgaaggtgagggcctgcacaagttagggtatattctgagggacatcagtaaaatcccaggaggcaacatgtacgccgatgacacagctggttgggatactcgcattaccgaggacgatttgcagaatgaagccaagataacggacatcatggagcccgaacatgcactcctggctacctccattttcaaactaacatatcagaacaaggtggtcagagtgcagcggcctgccaaaaacgggactgtgatggatgtcatcagcaggcgtgaccaacgaggatctggccaggttggcacctacgggcttaatacatttactaacatggaggtgcagctgattcgccagatggaatcggagggaatcttcctcccatcagagctggaaacccccaatttggctgagagagccttagattggctggaaaagcacggtgcagagcggctcaagaggatggcgataagcggcgacgactgtgtagtgaaaccgatcgatgaccgctttgccacggctcttacagccctgaacgatatggggaaggtcagaaaagacattcctcaatgggaaccctccaagggatggaatgattggcaacaggtgccattctgcagtcaccattttcaccagctaatcatgaaagacggccgggagattgttgtgccttgtaggaaccaagatgagctggtcggtcgagcacgtgtgtctcagggggctggatggagcctcagagaaaccgcctgcttgggcaagtcctatgcacagatgtggcaactgatgtacttccatcgccgggaccttaggctggccgcgaatgctatctgttcagccgtacccgttgattgggtgccaacaagtagaacaacctggtctatacacgcacaccatcagtggatgactaccgaggacatgctcagcgtctggaaccgcgtgtggattgaagagaatccctggatggaagataagacacacgtttcctcatgggaggaggtgccttatttaggcaaacgggaagaccagtggtgcgggagcctgatcggattgacggccagggctacctgggccactaacatccaggtcgcaattaatcaagtgcgaagactgataggtaacgagaattacctcgactacatgacatctatgaagcggtttaaaaacgaatccgatccagagggcgctctttggtga

SEQ ID NO: 13516 - RNA, 9879 nt, synthetic construct
  misc_feature 1..9879: note = derived and/or modified CDS sequence (opt3) from DENV-1__FJ639814__SS-prME
  source 1..9879: mol_type = other RNA
agcgtgaccatgctgctcatgcttctgcccaccgccttggctttccacttaactacgaggggcggggagcctcatatgatcgtctccaagcaggaaaggggaaaatctctgctatttaagacctcagctggtgttaacatgtgcacactcattgccatggacctgggcgagctttgtgaagatactatgacctacaaatgcccacggataacagaggcggaaccggacgatgtggactgttggtgcaatgctaccgatacttgggtaacatatgggacctgtagtcaaacgggagagcaccgccgagagaagcgtagcgtggccctggctccccatgtcggcttgggtctcgaaactagaaccgagacatggatgtcctctgaaggggcctggaaacagatccagagggtggagacttgggccctgcggcaccctggattcaccgttattgcatttttcctggcccatgctatcggcacatcgattacccagaagggcatcatatttatcctcttaatgctggtgacgccatcaatggccatgcgctgcgtcgggattggaaacagggacttcgtggagggtcttagcggcgcgacttgggtagatgttgtgttggaacacgggagttgtgtcacaaccatggcaaagaataaacccactctggacatcgagctactcaagacagaagtgaccaaccctgccgtgctgaggaaactttgcattgaggctaagatctccaatacgaccacagattctcggtgtccaactcaaggagaagccaccctggtcgaggagcaggacgcaaactttgtttgccgccgaacattcgtggatagaggctggggtaatgggtgtggattgtttggcaaaggcagcctcctgacttgcgctaagttcaagtgcgtaaccaaattagaagggaagatagtgcagtacgagaacctgaaatattccgtcattgtgacagttcacaccggagaccagcatcaagtgggtaatgaaactacggagcacggcacaatcgccaccattactccccaggcgcctacctcagaaatccagctcacagattacggggcccttaccctggactgtagtccaaggactggattggactttaacgagatggtcctactgacaatgaaggagaaaagctggctcgtgcataagcagtggttcctggatcttccgctgccctggacgtctggcgcatccacctcacaagaaacttggaatcggcaggacttgctcgtaacatttaaaaccgctcacgccaagaagcaggaggttgtggtcctgggtagccaagaaggggctatgcacacagccttaactggcgcaaccgagatccagacgagtggaaccacaactattttcgccggccatctgaaatgccgtctaaagatggataaactcaccctgaaggggatgtcttatgtgatgtgtacaggatccttcaaacttgaaaaggaggtcgctgagactcagcacggtaccgtgttggttcaggtgaagtacgaaggcacggacgcgccttgcaaaataccatttagcacacaagatgagaagggggtaacccagaacggacgcctgatcactgcaaatcccattgtcacagacaaagaaaagcctgtgaacatcgagaccgagccacccttcggcgaatcgtatatagttgtgggtgccggggagaaagctctcaagctgtcttggtttaagagaggctcctcaattggaaaaatgttcgaagccactgcaaggggcgcccggcgaatggctatccttggggataccgcctgggactttggaagtatcggtggcgtcttcacaagcgtggggaagctggtacatcaggtgtttggaacggcatacggcgttttgttctccggtgtctcttggaccatgaaaattgggatcggcattctcctgacttggttaggactgaatagccgctcaacaagtctatccatgacctgtatagcggtgggcatggtgacactctacctgggggtcatggttcaggctgatagcggatgcgtgatcaactggaagggcagagagcttaaatgtggttctgggatttttgtgactaacgaagtacacacctggacggagcaatataagttccaggccgactcaccgaagaggttgagtgcagccatcggaaaggcttgggaggaaggcgtctgcggtatccggagcgccacacgcctggagaatattatgtggaagcagatatccaacgaactcaatcatatcctgttagagaacgatatgaaatttaccgtggttgtgggcgacgcaaatgggattctggctcagggaaagaaaatgatcagacctcaacccatggaacacaagtactcttggaaatcgtggggcaaggccaagattatcggggcggacatacagaacactaccttcatcattgatggaccagacacacctgagtgtcccgatggccagagggcctggaatatctgggaggtcgaagactatggttttggggtgttcactaccaacatttggcttaaattgcgtgatagctacacacagatgtgcgaccaccggctcatgtccgctgcaatcaaggattcaaaagccgttcatgctgacatgggatattggatagagagtgaaaagaatgagacgtggaaactggcccgagcatctttcattgaagtgaagacctgtacttggccaaagagccacacactatggtccaacggcgtactggagtcagagatgatcattcccaaaatctacggtggccctataagccaacataattatagaccagggtactttacccagactgcgggaccgtggcacctcggcaagctggaacttgatttcaacttgtgcgaggggacaaccgtcgtggtggacgaacactgcggaaataggggcccctctctgcgcacgactaccgtcacaggtaaaatcattcatgagtggtgttgccggtcctgtaccttacctccactcagatttagaggggaagatggatgctggtacggcatggaaatccgccccgttaaggagaaagaagagaacctggtgcgaagtatggtaagcgccggttctggcgaagtggactccttctcacttgggattctgtgtgtcagtatcatgatagaggaggtgatgcggagccgttggtcgagaaagatgttgatgactggaacactcgctgtttttctgctactgattatgggccagctcacctggaatgatctgatcaggctttgcatcatggtgggggccaacgcatccgaccgcatgggaatgggcacaacttatttggctctgatggccaccttcaagatgcggcctatgtttgcagtcggtttactcttcagaaggctgacgtctcgagaagtgcttctgctaacaattgggctcagcctggttgcctcagtggagttgccaaacagtctggaagagttaggagacggcctcgctatgggcatcatgatgctgaaacttctgaccgaatttcaaccccaccagttgtggactaccctcctgtccctaacattcgtcaagactaccctgtctcttgattacgcgtggaaaacgacagccatggtactcagcattgtgtccctgtttccgttgtgtctgtcaaccactagccagaagacaacctggttacctgttctcctggggagtttcggatgcaaaccacttactatgtttctgataacagagaataagatctggggtcgcaagtcttggcccttgaacgagggcattatggcaatcgggattgtgtccatcctcctgagctcgctactgaaaaatgacgtccctcttgctggacccctcatagccggcggtatgctgatcgcctgttatgtgatttcagggtctagtgctgatttgtccttagaaaaggcagccgaggtaagctgggaacaggaggcggaacattctggagctagccacaacatcctggtggaggtccaagacgatggcaccatgaaaattaaggacgaggaacgggatgacacgctcactatcctgcttaaagccaccctgttggcagtttccggcgtgtacccaatgtcaatacctgccacactattcgtgtggtatttctggcagaagaaaaagcagagaagtggggtcctgtgggatacccccagcccaccggaggtggaaagggctgttctcgacgatggaatttaccgtatcctgcagcgcggtcttttaggccggtctcaagtaggggtgggagtctttcaggacggcgtgttccatacaatgtggcacgttactagaggtgcagtgctgatgtatcaggggaagaggctcgagccttcctgggcctcagtcaaaaaggatttgatcagttacggaggcggctggcgatttcaggggagctggaataccggagaggaagtgcaagtaattgcggtcgagcccggtaaaaacccaaagaatgtgcagacgacacccggcactttcaaaacccctgaaggggaggttggagctatagccctggactttaagccaggcacatccggttctcccatcgtgaaccgggaagggaagattgtcggactctacggcaatggcgtggttaccacttcggggacctatgtgagcgcaatcgcccaggctaaagcctcacaagagggacctctgccggagattgaagacgaggtcttcaagaaacgcaaccttacaatcatggatctgcacccaggttccggcaagacgagaaggtacttgcccgcaatagtgcgggaagctatcaaacgaaagctaagaactctgattctcgcccctacccgcgtagtggcgagtgagatggccgaagcattaaaggggatgccaatcaggtatcagacaaccgctgttaaatctgagcatactggacgtgagattgtcgacctgatgtgccacgccacatttaccatgcggcttctgagccccgtgagagtgcctaattacaacatgatcataatggatgaagctcatttcacggacccggcatccattgccgccaggggctatatctcaactcgcgtcggtatgggggaggctgcggcaatctttatgacagccacacccccaggatctgtagaggctttccctcagagcaatgccgtgattcaggatgaggaacgagacatccccgagagaagttggaactccggctacgattggataaccgactttccaggcaagactgtttggttcgtgcctagcattaaatctgggaatgatatcgcaaactgtctccggaagaacggaaaaagggtcattcaattgtcacgcaagacattcgacaccgagtatcagaagaccaaaaataacgattgggactacgtggttactacggacatctccgaaatgggtgccaattttcgtgctgatagagtgatagacccccggaggtgcctgaagccagtcattctcaaagatggcccggagcgcgtgatcctggcggggcctatgcccgtaaccgtggccagtgcagctcagcgaagaggacggatcggcaggaaccagaataaggaaggtgaccaatacgtttatatggggcagccacttaacaatgatgaggaccacgcccattggacagaggcaaaaatgctactggataacattaatactcccgaaggcatcattcctgccttgttcgagccagaacgcgagaaaagcgctgccatagacggagaatacagattaaggggcgaagcgcggaagacctttgtcgagctgatgcgtcgcggggatctccccgtgtggctgtcgtataaagtggcatctgaaggattccagtactccgaccgaagatggtgctttgatggtgagaggaacaatcaggtccttgaagagaacatggacgttgaaatctggacaaaggagggcgagcggaaaaagctgcgccctagatggctcgatgccaggacctatagcgacccgttggctctgcgggagttcaaagagtttgccgctgggcgaagatcagtgagtggagacctaattctggaaatcggcaagctcccacaacaccttactctgcgcgcacagaatgccttagataacttggtaatgctgcacaattctgagcagggtgggaaggcttacaggcatgccatggaggaactccccgacacgatcgagaccctgatgcttctggcactcattgcggtgttgacaggcggagtcactctgttctttttatccggcaaggggctaggaaagaccagcataggtctgctctgtgtgacagcctcaagtgcacttctgtggatggccagcgttgaacctcactggatcgcagcttccattatcttggagttctttctgatggtgctcctgattcccgaaccagatcggcagcgtacccctcaagacaaccagcttgcctatgtcgtaatcggcctcctgttcatgatattgactgtggcagccaacgagatggggctgttagagacaacgaaaaaggatctaggaatcggctacgttgctgcggaaaatcatcagcacgccaccatgctggacgtggatctccaccccgcatctgcttggactctttacgccgtcgccacaaccgtgattaccccaatgatgagacatacaatcgagaacactacggcaaatattagcctgaccgctatcgccaaccaagcggctatattgatgggtctggacaaagggtggcctatttccaagatggatatcggcgtcccgctcctggcccttggatgctattcacaggtgaatcccttaacactgactgcagccgttctcatgttggtggctcactacgcaattatcggcccagggctgcaggccaaagcgaccagggaagctcagaagcgcacagccgcaggaataatgaagaaccctaccgtagacggcatcgtggccattgatctagaccccgtcgtttatgatgctaaatttgagaagcaactgggtcagatcatgctccttattctgtgtacttctcagatcttgctgatgcggacgacatgggccctctgcgaaagtataaccctggcaactgggccattaaccacactttgggagggatcgcctggcaaattctggaatactaccattgctgtgagcatggccaacatcttccgaggttcctacctggcgggcgccgggctcgcattttctctaatgaagtcactgggaggcgggagaaggggaacaggcgctcagggtgagacgttgggggaaaaatggaagcgccaactgaatcagctcagcaagtccgagttcaacacctataaacggagtggaatcatggaagtcgacagatctgaggccaaggaaggccttaaacgtggtgagactacaaagcatgcagtgagcaggggcaccgctaaactgcggtggtttgtagagcgcaatttggtgaagcccgaagggaaggttattgacctgggatgtggccgagggggatggtcatactattgcgccggcctcaaaaaggtgactgaggtcaaaggttacacaaaagggggaccgggccacgaggaaccaatccctatggccacctacggctggaacttagtgaaactgcattccgggaaggatgtcttctttatgcccccagaaaaatgtgacacgcttctgtgcgatataggagagagtagccccaatcctaccattgaggaaggtagaacactaagggtgctcaagatggttgagccgtggctgcggggcaaccagttctgtatcaagattttgaatccctatatgccatctgtagtggaaactctggagcagatgcaacgcaaacacgggggaatgctcgtcagaaaccctctttccagaaattcaacccacgagatgtactgggtgagctgcggcacaggtaacatcgtttcggcggtgaacatgacttctcgaatgctgttaaatcggtttaccatggctcatcgtaagcccacatatgaaagagacgtcgatctgggggcaggaacccgccacgtggccgtagagcctgaagtggctaacttggacataatcggccagaggattgagaatatcaaaaacgaacataagagtacttggcactacgatgaggacaatccatataaaacgtgggcctaccacggctcctatgaggttaagcccagcgggtcagcatcctctatggtcaacggagtggtgcggctcctgacaaagccttgggatgtcattccaatggttacccagatcgccatgactgacaccacacccttcggtcaacagagagtgtttaaagaaaaggtagatacgcgcaccccgagggctaaacgaggcactacacagattatggaggtgaccgcgaagtggctatgggggttccttagccggaataaaaagcctagaatctgtactagggaagagtttacacgcaaggtccgtagtaacgccgcaataggagctgtgttcgttgacgaaaatcagtggaactccgccaaagaggcagtggaggacgaacggttttgggatctggtccatagagagagggaactccacaagcaaggcaaatgcgcaacctgcgtgtacaatatgatgggtaagcgcgagaaaaagctgggggagttcggaaaggctaaaggcagccgagccatttggtacatgtggttgggcgcgcggttcctggagtttgaggcactcgggttcatgaacgaagaccattggttttctagagaaaattcacttagtggagtagaaggtgagggcctgcacaagttagggtatatcctgagggatatctccaaaattccaggaggcaacatgtacgccgacgatacagctggttgggacactcgcataaccgaggatgacttgcagaatgaagccaagatcacggatattatggagcccgaacatgcactcctggctaccagcatcttcaaactaacatatcagaacaaggttgtgagagtccagcggcctgccaaaaacgggactgtgatggacgtgatttctaggcgtgatcaacgaggatcgggccaggtcggcacctacgggcttaatacatttactaacatggaggttcagctgatccgccagatggaatcagagggaatattcctcccaagcgagctggaaacccccaatttggctgagagagccttagactggctggaaaagcacggtgcagagcggctcaagaggatggcgatctccggcgatgactgtgtggtaaaaccgattgacgatcgctttgccacggctcttacagccctgaacgacatggggaaggtgagaaaagatatccctcaatgggaacccagtaagggatggaatgactggcagcaggtcccattctgctctcaccattttcaccagctaattatgaaagatggccgggagatcgtggttccttgtaggaaccaagacgagctggtgggtcgagcacgtgtcagccagggggctggatggtccctcagagaaaccgcctgcttgggcaagtcatatgcacagatgtggcaactgatgtacttccatcgccgggatcttaggctggccgcgaatgctatatgtagtgccgtgcccgtagactgggttccaacttctagaacaacctggagcattcacgcacaccatcagtggatgactaccgaggatatgctctccgtgtggaaccgcgtctggatcgaagagaatccctggatggaagacaagacacacgtgtcaagctgggaggaggttccttatttaggcaaacgggaagatcagtggtgcgggtctctgatcggattgacggccagggctacctgggccactaacattcaggtggcaataaatcaagtccgaagactgatcggtaacgagaattacctcgactacatgacatccatgaagcggtttaaaaacgaaagtgacccagagggcgctctttggtga

SEQ ID NO: 13517 - RNA, 9879 nt, synthetic construct
  misc_feature 1..9879: note = derived and/or modified CDS sequence (opt3) from DENV-1__FJ639815__SS-prME
  source 1..9879: mol_type = other RNA
agcgtgaccatgctgctcatgcttctgcccaccgccttggctttccacttaactacgaggggcggggagcctcatatgatcgtctccaagcaggaaaggggaaaatctctgttatttaagacctcagccggtgttaatatgtgcacactcattgccatggacctgggcgagctttgtgaagatactatgacctacaaatgcccacggataacagaggcggaaccggacgatgtggactgttggtgcaatgctaccgatacttgggtaacatatgggacctgtagtcagacgggagagcaccgccgagagaagcgtagcgtggccctggcaccccatgtcggcttgggtctcgaaactagaaccgagacatggatgtcctctgaaggggcctggaaacagatccagagggtggagacttgggctctgcggcaccctggattcaccgttattgcatttttcctggcccatgctatcggcacatcgattacccagaagggcatcatatttatcctcttaatgctggtgacgccatcaatggccatgcgctgcgtcgggattggaaacagagacttcgtggagggtcttagcggcgcgacttgggtagatgttgtgttggaacacgggagttgtgtcacaaccatggcaaagaataaacccactctggacatcgagctactcaagacagaagtgaccaaccctgccgtgctgaggaaactttgcattgaggctaagatctccaatacgaccacagattctcggtgtccaactcaaggagaagccaccctggtcgaggagcaggacgcaaactttgtttgccgccgaacattcgtggatagaggctggggtaatgggtgtggattgtttggcaaaggcagcctcctgacttgcgctaagttcaagtgcgtaaccaaattagaagggaagatagtgcagtacgagaacctgaaatattccgtcattgtgacagttcacaccggagaccagcatcaagtgggtaatgaaactacggagcacggcacaatcgccaccattactccccaggcgcctacctcagaaatccagctcacagattacggggcccttaccctggactgtagtccaaggactggattggactttaacgagatggtcctactgacaatgaaggagaaaagctggctcgtgcataagcagtggttcctggatcttccgctgccctggacgtctggcgcatccacctcacaagaaacttggaatcggcaggacttgctcgtaacatttaaaaccgctcacgccaagaagcaggaggttgtggtcctgggtagccaagaaggggctatgcacacagccttaactggcgcaaccgagatccagacgagtggaaccacaactattttcgccggccatctgaaatgccgtctaaagatggataaactcaccctgaaggggatgtcttatgtgatgtgtacaggatccttcaaacttgaaaaggaggtcgctgagactcagcacggtaccgtgttggttcaggtgaagtacgaaggcacggacgcgccttgcaaaataccatttagcacacaagatgagaagggggtaacccagaacggacgcctgatcactgcaaatcccattgtcacagacaaagaaaagcctgtgaacatcgagaccgagccacccttcggcgaatcgtatatagttgtgggtgccggggagaaagctctcaagctgtcttggtttaagagaggctcctcaattggaaaaatgttcgaagccactgcaaggggcgcccggcgaatggctatccttggggataccgcctgggactttggaagtatcggtggcgtcttcacaagcgtggggaagctggtacatcaggtgtttggaacggcatacggcgttttgttctccggtgtctcttggaccatgaaaattgggatcggcattctcctgacttggttaggactgaatagccgctcaacaagtctatccatgacctgtatagcggtgggcatggtgacactctacctgggggtcatggttcaggctgatagcggatgcgtgatcaactggaagggcagagagcttaaatgtggttctgggatttttgtgactaacgaagtacacacctggacggagcaatataagttccaggccgactcaccgaagaggttgagtgcagccatcggaaaggcttgggaggaaggcgtctgcggtatccggagcgccacacgcctggagaatattatgtggaagcagatatccaacgaactcaatcatatcctgttagagaacgatatgaaatttaccgtggttgtgggcgacgcaaatgggattctggctcagggaaagaaaatgatcagacctcaacccatggaacacaagtactcttggaaatcgtggggcaaggccaagattatcggggcggacatacagaacactaccttcatcattgatggaccagacacacctgagtgtcccgatggccagagggcctggaatatctgggaggtcgaagactatggttttggggtgttcactaccaacatttggcttaaattgcgtgatagctacacacagatgtgcgaccaccggctcatgtccgctgcaatcaaggattcaaaagccgttcatgctgacatgggatattggatagagagtgaaaagaatgagacgtggaaactggcccgagcatctttcattgaagtgaagacctgtacttggccaaagagccacacactatggtccaacggcgtactggagtcagagatgatcattcccaaaatctacggtggccctataagccaacataattatagaccagggtactttacccagactgcgggaccgtggcacctcggcaagctggaacttgatttcgacttgtgcgaggggacaaccgtcgtggtggatgaacactgcggaaacaggggcccctctctgcgcacgactaccgtcacaggtaaaatcattcatgagtggtgttgccggtcctgtaccttacctccactcagatttagaggggaagacggatgctggtacggcatggaaatccgccccgttaaggagaaagaagagaatctggtgcgaagtatggtaagcgccggttctggcgaagtggattccttctcacttgggattctgtgtgtcagtatcatgatagaggaggtgatgcggagccgttggtcgagaaagatgttgatgactggaacactcgctgtttttctgctactgattatgggccagctcacctggaacgacctgatcaggctttgcatcatggtgggggccaatgcatccgaccgcatgggaatgggcacaacttatttggctctgatggccaccttcaagatgcggcctatgtttgcagtcggtttactcttcagaaggctgacgtctcgagaagtgcttctgctaacaattgggctcagcctggttgcctcagtggagttgccaaacagtctggaagagttaggagatggcctcgctatgggcatcatgatgctgaaacttctgaccgaatttcaaccccaccagttgtggactaccctcctgtccctaacattcgtcaagactaccctgtctcttgactacgcgtggaaaacgacagccatgctcctgagcattgtatccttgtttccgctgtgtttatcaaccactagccagaagacaacctggctccctgtgctgcttgggagtttcggatgcaaaccactgactatgtttttgataacagagaacaagatctggggtcgcaagtcttggcccctcaatgagggcattatggcaatcgggattgtttccatcctgctaagctcgctgcttaaaaacgatgtgcctctcgctggacccctgatagccggcggtatgttgatcgcctgttatgtcatttcagggtctagtgctgacttatccctggaaaaggcagccgaggtgagctgggaacaggaggcggaacattctggagctagccacaatatcctcgtagaggtgcaagatgacggcaccatgaaaattaaggatgaggaacgggacgatacgctgactatccttctgaaagccaccttgctagcagtctccggcgtttacccaatgtcaatacctgccacactgttcgtgtggtatttctggcagaagaaaaagcagagaagtggggtgctctgggacacccccagcccaccggaggtcgaaagggctgtgctggatgacggaatttaccgtatccttcagcgcggtttactgggccggtctcaagttggggtaggagtgtttcaggatggcgtcttccatacaatgtggcacgtgactagaggtgcagttctcatgtatcaggggaagaggttggagccttcctgggcctcagtgaaaaaggacctgatcagttacggaggcggctggcgatttcaggggagctggaacaccggagaggaagtccaagtgattgcggtagagcccggtaaaaatccaaagaacgtccagacgacacccggcactttcaaaacccctgaaggggaggtgggagctatagccctcgactttaagccaggcacatccggttctcccatcgttaatcgggaagggaagattgtgggactgtacggcaacggcgtcgtgaccacttcggggacctatgttagcgcaatcgcccaggctaaagcctcacaagagggacctcttccggagattgaagatgaggtgttcaagaaacgcaatctgacaatcatggacttgcacccaggttccggcaagacgagaaggtacctacccgcaatagtccgggaagctatcaaacgaaagctgagaactctcattttagcccctacccgcgtggtagcgagtgagatggccgaagcactgaaggggatgccaatcaggtatcagacaaccgctgtgaaatctgagcatactggacgtgagattgttgatcttatgtgccacgccacatttaccatgcggctgctcagccccgtcagagtgcctaactacaatatgatcataatggacgaagctcatttcacggatccggcatccattgccgccaggggctatatctcaactcgcgtgggtatgggggaggctgcggcaatctttatgacagccacacccccaggatctgtcgaggctttccctcagagcaacgccgtaattcaggacgaggaacgagatatccccgagagaagttggaactccggctacgactggataaccgattttccaggcaagactgtgtggttcgttcctagcattaaatctgggaacgacatcgcaaattgtttgcggaagaacggaaaaagggtgattcaactgtcacgcaagacattcgataccgagtatcagaagaccaagaataatgactgggactacgtcgtgactacggatatctccgaaatgggtgccaactttcgtgctgacagagttatagatccccggaggtgcctcaagccagtgattctgaaagacggcccggagcgcgtcatccttgcggggcctatgcccgtgaccgtagccagtgcagctcagcgaagaggacggatcggcaggaatcagaacaaggaaggtgatcaatacgtgtatatggggcagccactaaataacgacgaggatcacgcccattggacagaggcaaaaatgctgttggacaatattaacactcccgaaggcatcattcctgccttattcgagccagaacgcgagaaaagcgctgccatagatggagaatacagactgaggggcgaagcgcggaagacctttgttgagctcatgcgtcgcggggacctgcccgtctggctttcgtataaagtggcatctgaaggattccagtactccgatcgaagatggtgctttgacggtgagaggaataaccaggtgctggaagagaatatggatgtcgaaatctggacaaaggagggcgagcggaaaaagctccgccctagatggttggacgccaggacctatagcgacccgctggctctacgggagttcaaagagtttgccgctgggcgaagatcagttagtggagatctgattctcgaaatcggcaaacttccacaacacctgactttacgcgcacagaacgccttggacaatctggtgatgctccacaactctgagcagggtgggaaggcttacaggcatgccatggaagaactgcccgatacgatcgagacccttatgctgctcgcattgattgcggtactgacaggcggagtgactttattctttctatccggcaaggggctgggaaagaccagcataggtctcctttgtgtcacagcctcaagtgctctgttgtggatggccagcgtggaacctcactggatcgcagcttccattatcctggagttctttctcatggttctgcttattcccgaaccagaccggcagcgtacccctcaagataatcagctcgcctatgtggtcatcggcctgttgttcatgatactgactgtagcagccaacgagatggggttactagagacaacgaaaaaggacctgggaatcggctacgtggctgcggaaaaccatcagcacgccaccatgctcgatgttgaccttcaccccgcatctgcttggactctgtacgccgtggccacaaccgtcattaccccaatgatgagacatacaatcgagaatactacggcaaacattagcttgaccgctatcgccaatcaagcggctatactgatgggtctcgataaagggtggcctatttccaagatggacatcggcgtgccgctgcttgccttaggatgctattcacaggtcaaccccctgacactcactgcagccgtgttgatgctggttgctcactacgcaattatcggcccagggctacaggccaaagcgaccagggaagctcagaagcgcacagccgcaggaataatgaagaatcctaccgtggatggcatcgtagccattgacctggatcccgtggtctatgacgctaaatttgagaagcaactcggtcagatcatgcttctgattttgtgtacttctcagatcctgctcatgcggacgacatgggccctgtgcgaaagtataaccttagcaactgggccacttaccacactgtgggagggatcgcctggcaaattctggaacactaccattgctgttagcatggccaatatcttccgaggttcctacctcgcgggcgccgggctagcattttctctgatgaagtcattgggaggcgggagaaggggaacaggcgctcagggtgagacgctgggggaaaaatggaagcgccaactcaaccagcttagcaagtccgagttcaatacctataaacggagtggaatcatggaagtggacagatctgaggccaaggaaggcctgaaacgtggtgagactacaaagcatgcagtcagcaggggcaccgctaaattgcggtggtttgtggagcgcaacctggtaaagcccgaagggaaggtgattgatctcggatgtggccgagggggatggtcatactattgcgccggcctgaaaaaggttactgaggtgaaaggttacacaaaagggggaccgggccacgaggaaccaatccctatggccacctacggctggaatctagtcaaacttcattccgggaaggacgtgttctttatgcccccagaaaaatgtgatacgctgctatgcgacataggagagagtagccccaaccctaccattgaggaaggtagaacactcagggtcctgaagatggtggagccgtggttgcggggcaatcagttctgtatcaagattctgaacccctatatgccatctgttgtagaaactctcgagcagatgcaacgcaaacacgggggaatgcttgtgagaaatcctctgtccaggaactcaacccacgagatgtactgggtcagctgcggcacaggtaatatcgtgtcggcggttaacatgacttctcgaatgttactgaaccggtttaccatggctcatcgtaagcccacatatgaaagagatgtggacttgggggcaggaacccgccacgtcgccgtggagcctgaagtagctaatctcgatataatcggccagaggattgagaacatcaaaaatgaacataagagtacttggcactacgacgaggataacccatataaaacgtgggcctaccacggctcctatgaggtgaagcccagcgggtcagcatcctctatggttaatggagtcgtgcggctgctaacaaagccttgggacgtgattccaatggtcacccagatcgccatgactgataccacacccttcggtcaacagagagtttttaaagaaaaggtggacacgcgcaccccgagggctaaacgaggcactacacagattatggaggtaaccgcgaagtggctttgggggttcctgagccggaacaaaaagcctagaatctgtactagggaagagtttacacgcaaggtgcgtagtaatgccgcaataggagctgtcttcgtggacgaaaaccagtggaactccgccaaagaggcagttgaggatgaacggttttgggacctcgtgcatagagagagggaactgcacaagcaaggcaaatgcgcaacctgcgtctacaacatgatgggtaagcgcgagaaaaagttgggggagttcggaaaggctaaaggcagccgagccatttggtacatgtggctgggcgcgcggttcctcgagtttgaggcacttgggttcatgaatgaagatcattggttttctagagagaactcactgagtggagtggaaggtgagggcttacacaagctggggtatatcttgagggacatctccaaaattccaggaggcaatatgtacgccgatgacacagctggttgggatactcgcataaccgaggacgatctccagaacgaagccaagatcacggacattatggagcccgaacatgcactgctagctaccagcatcttcaaacttacatatcagaataaggtagttagagtgcagcggcctgccaaaaacgggactgtcatggatgtgatttctaggcgtgaccaacgaggatcgggccaggtgggcacctacgggctgaacacatttactaatatggaggtccagctcatccgccagatggaatcagagggaatattcctgccaagcgagttggaaacccccaacttagctgagagagccctggattggctcgaaaagcacggtgcagagcggcttaagaggatggcgatctccggcgacgactgtgttgtgaaaccgattgatgaccgctttgccacggctctgacagccctaaatgatatggggaaggtaagaaaagacatccctcaatgggaacccagtaagggatggaacgattggcaacaggtgccattctgctctcaccattttcaccagctgattatgaaagacggccgggagatcgtcgtgccttgtaggaatcaagatgagctcgttggtcgagcacgtgtgagccagggggctggatggtccttgagagaaaccgcctgcctgggcaagtcatatgcacagatgtggcaacttatgtacttccatcgccgggacctgaggctcgccgcgaacgctatatgtagtgccgtccccgtggattgggtaccaacttctagaacaacctggagcattcacgcacaccatcagtggatgactaccgaggacatgttatccgtttggaatcgcgtgtggatcgaagagaacccctggatggaagataagacacacgtctcaagctgggaggaggtgccttatctgggcaaacgggaagaccagtggtgcgggtctttgatcggactgacggccagggctacctgggccactaatattcaggttgcaataaaccaagtgcgaagactcatcggtaatgagaactaccttgactacatgacatccatgaagcggtttaaaaatgaaagtgatccagagggcgctctgtggtga

SEQ ID NO: 13518 - RNA, 9879 nt, synthetic construct
  misc_feature 1..9879: note = derived and/or modified CDS sequence (opt3) from DENV-1__FJ639818__SS-prME
  source 1..9879: mol_type = other RNA
agcgtgaccatgctgctcatgcttctgcccacagccttggctttccacttaactacgagaggcggggagcctcatatgatcgtctccaagcaggaaaggggaaaatctctgctatttaagacctcagcaggtgttaacatgtgcacactcattgccatggacctgggcgagctttgtgaagatactatgacctacaaatgcccacggataacagaggcggaaccggacgatgtggactgttggtgcaataccactgatacatgggtaacctatgggacgtgtagtcaaactggagagcaccgccgagacaagcgtagcgtggctctggccccccatgtcggcttgggtctcgagaccagaacagaaacttggatgtcctctgagggggcatggaaacagatccagagggtggaaacctgggccctgcggcaccctggattcacagttattgctctgtttctcgcacatgccatcggcacctcgattacgcagaagggcatcatattcatcttactgatgcttgtgactccatcaatggctatgcgctgcgtcgggattggaaacagagattttgtggagggtttgagcggcgccacatgggtagacgttgtgctggagcacgggagttgtgtcaccactatggcgaagaataaacccacactagatatcgaactcctgaagaccgaggtgacgaaccctgcagtgcttaggaaactgtgcattgaagccaagatctccaataccacaactgactctcggtgtccaacccaaggagaggctacattggtcgaagagcaggatgccaacttcgtttgccgccgaacttttgtggacagaggctggggtaatgggtgtggactcttcggcaaaggcagcctgttaacctgcgcaaagtttaagtgcgtaacaaaactggaggggaagatagtgcagtacgaaaacctcaaatattccgtcattgtgaccgttcacactggagatcagcatcaagtgggtaatgagacgacagaacacggcaccatcgctactattaccccccaggcccctacatcagagatccagcttaccgactacggggcgctgactttggactgtagtccaaggacaggactagatttcaacgaaatggtcctgctcacgatgaaggagaaaagctggctggtgcataagcagtggtttcttgacctgccgttgccctggacctctggcgcctccacttcacaagagacatggaatcggcaggatctcctggtaaccttcaaaacagcacacgctaagaagcaggaagttgtggtcttaggtagccaagagggggccatgcacactgctctgaccggcgccacggaaatccagaccagtggaacaactaccatttttgcaggccatctaaaatgccgtctcaagatggagaaactgacacttaaggggatgtcttatgtgatgtgtactggatccttcaaattggaaaaggaggtcgccgagacccagcacggtacggtgctggttcaggtgaagtacgaaggcacagacgctccttgcaaaataccattcagcacccaagatgagaagggggtaactcagaacggacgcctcatcacagcgaatcccattgtcaccgacaaagaaaagcctgtgaacatcgagactgagccaccctttggcgaatcgtatatagttgtgggtgcaggggagaaagccctgaagctttcttggttcaagaaaggctcctcaattggaaagatgtttgaagctaccgccagaggcgcaaggcggatggccatcctgggggatacagcttgggacttcggaagtatcggtggcgtctttacgagcgtggggaaattggtacatcaggtgttcggaaccgcctacggcgttctcttttccggtgtctcttggactatgaagattgggatcggcattctgttaacatggctgggactaaatagccgatcaaccagtctctccatgacatgtatagcagtgggcatggtgactctgtaccttggggtcatggttcaggcggatagcggatgcgtgatcaactggaaaggccgcgagttgaagtgtggttctgggattttcgtgaccaacgaagtacacacgtggacagagcaatataagtttcaggctgactcaccgaaaagactgagtgccgcaatcggaaaggcctgggaggaaggcgtctgcggtatcaggagcgctacccggctcgagaatattatgtggaaacagatatccaacgaactgaatcatatcttactggagaacgatatgaagttcactgtggttgtgggcgacgccaatgggattcttgcacagggaaaaaagatgatccgccctcaacccatggaacacaaatactcttggaagtcgtggggcaaggctaaaattatcggggccgacatacagaacaccacatttatcattgatggaccagacactcctgagtgtcccgatggccagagagcgtggaatatctgggaggtcgaagactatggtttcgggatttttaccacaaacatctggttgaagctcagggatagctacacgcagatgtgcgaccaccgtctgatgtccgccgctataaaagattcaaaggcagtgcatgccgacatgggatattggattgagagtgaaaaaaatgagacctggaagctagctcgggcctctttcatcgaagttaagacttgtacatggccaaaaagccacaccctgtggtccaacggcgtgctcgagtcagagatgattatccccaagatatacggtggccctatcagccaacataattatcgaccagggtacttcactcagacagcaggaccgtggcacctgggcaaacttgaattggattttgacctgtgcgaggggaccacggtagtcgtggatgaacactgcggaaacagaggcccctctttaaggactaccacagtgaccggtaagattatccatgagtggtgttgccgctcctgtactctccctccactgcggttcagaggggaggacggatgctggtacggcatggaaattaggcccgtcaaagagaaggaagagaatcttgttcgcagtatggtgagcgcgggttctggcgaagtagattccttttcactggggatcttgtgtgtgagtataatgattgaggaggtcatgcgaagccggtggtcgcgtaagatgctcatgacaggaaccctggccgtgttcctactgctcatcatgggccagctgacatggaacgaccttatcagattgtgcattatggttggggctaatgcctccgacaggatgggaatgggcactacccacctggcattaatggctacgtttaaaatgcgccctatgttcgccgtgggtctcctgtttcggagacttacatctagggaagtcctgctactcaccatcgggctgagcttggtggcatcagttgagctgccaaacagtttagaagagctcggagatggcctggccatgggcattatgatgcttaagctgttgactgaattccaaccccatcagctctggaccacactgctatccctgacttttgtgaaaaccacgctttctctcgactatgcttggaagacaaccgcgatggtcctgagcatagtatccttgttcccgctgtgtttatcaactacaagccagaaaaccacttggctccctgtgctgcttgggagttttggatgcaagccactgacaatgttcttgatcaccgagaacaagatttggggtcgaaaatcttggcccctcaatgagggcatcatggccattgggatcgtttccatactgctaagctcgctgcttaagaacgatgtgcctctcgcaggacccctgatcgctggcggtatgttgattgcctgttacgtcatctcagggtctagtgccgacttatccctggaaaaagctgcagaggtgagctgggaacaggaggccgaacactctggagcgagccataatattctcgtagaggtgcaagatgacggcacgatgaagatcaaagatgaggaacgcgacgatactctgaccatacttctgaaggctacattgctagccgtctccggcgtttatccaatgtcaattcctgcaaccctgtttgtgtggtacttctggcagaaaaagaagcagcggagtggggtgctctgggacacacccagcccaccggaggtcgaaagagccgtgctggatgacggaatctataggatccttcagcgtggtttactgggccgctctcaagttggggtaggagtgttccaggatggcgtctttcacactatgtggcacgtgacccggggtgctgttctcatgtaccaggggaaaagattggagccttcctgggcatcagtgaagaaagacctgattagttatggaggcggctggaggttccaggggagctggaacacgggagaggaagtccaagtgatagccgtagagcccggtaagaatccaaaaaacgtccagacaactcccggcacctttaagacacctgaaggggaggtgggagcgatcgctctcgacttcaagccaggcacctccggttctcccattgttaatcgagaagggaaaatcgtgggactgtacggcaacggcgtcgtgactacctcggggacatacgttagcgccattgcacaggccaaggcttcacaagagggacctcttccggagatcgaagatgaggtgtttaaaaagcggaatctgacgataatggacttgcatccaggttccggcaaaactcgcagatatctacccgccatcgtcagggaagcaattaagcggaagctgcgaaccctcatcttagctcctacaagagtggtagccagtgagatggcggaagccctgaaagggatgccaattcgctaccagaccactgcagtgaagtctgagcacacaggaagggagatcgttgatcttatgtgccatgctaccttcacgatgcgtctgctcagccccgtccgggtgcctaactataatatgataattatggacgaagcccactttactgatccggcttccatcgcagccagaggctacatctcaacaagggtgggtatgggggaggccgctgcgattttcatgaccgcaacccccccaggatctgtcgaagcctttcctcagagcaacgctgtaatccaggacgaggaacgcgatatacccgagcgaagttggaattccggctatgactggattactgatttcccaggcaaaacagtgtggtttgttcctagcatcaagtctgggaacgacattgccaattgtttgagaaaaaacggaaagcgggtgatccaactgtcaaggaagaccttcgatacagagtaccagaaaactaagaacaatgactgggactatgtcgtgacgaccgatatatccgaaatgggtgcaaacttccgcgccgaccgtgttattgatcccagacggtgcctcaaaccagtgatcctgaaggacggcccggagagggtcatccttgctgggcctatgcccgtgacagtagcgagtgccgcacagcgccgaggaagaattggccggaatcagaacaaagaaggtgatcaatacgtgtacatggggcagccactaaataacgacgaggatcatgctcactggactgaggccaagatgctgttggacaatatcaacacccccgaaggcattatacctgcattatttgagccagaaagggagaagagcgccgctatcgatggagaatatcgcctgagaggcgaggccaggaaaacattcgttgagctcatgcggcgtggggacctgcccgtctggctttcgtacaaggtggcgtctgaaggatttcagtattccgatcgccgatggtgcttcgacggtgagagaaataaccaggtgctggaagagaatatggatgtcgaaatttggaccaaagagggcgagaggaagaaactccggcctcgctggttggacgcaagaacttacagcgacccgctggccctaagggaatttaaggagttcgctgccgggcggcgatcagttagtggagatctgatcctcgaaatcggcaaacttccacaacacctgacgttaagagctcagaacgcattggacaatctggtgatgctccataactctgagcagggtgggaaggcctatcgccacgctatggaagagctgcccgataccattgagacacttatgctgctcgccttgatagcagtactgactggcggagtgaccttatttttcctatccggcaaggggctgggaaaaacaagcatcggtctcctttgtgtcaccgcgtcaagtgccctgttgtggatggctagcgtggaacctcattggattgccgcatccatcattctggagtttttcctcatggttctgcttatccccgaaccagacaggcagcggactcctcaagataatcagctcgcttacgtggtcataggcctgttgtttatgatcctgacagtagccgcaaacgagatggggttactagagacgaccaagaaagacctgggaattggctatgtggccgctgaaaaccaccagcacgcgactatgctcgatgttgaccttcgtcccgcctctgcatggacactgtacgctgtggccaccaccgtcatcacaccaatgatgagacatactattgagaatacgaccgccaacatcagcttgacagcaatagctaatcaagccgcgattctgatgggtctcgataaggggtggcctatctccaaaatggacattggcgtgccgctgcttgctttaggatgctactcacaggtcaaccccctgactctcaccgccgcagtgttgatgctggttgcccactatgctatcataggcccagggctacaggcaaaggccacaagggaagcgcagaagcgcaccgctgccggaatcatgaaaaatcctactgtggatggcattgtagcaatcgacctggatcccgtggtctacgacgccaagttcgagaaacaactcggtcagattatgcttctgatcttgtgtacgtctcagatactgctcatgcggacaacctgggctctgtgcgaaagtattactttagccaccgggccacttacaactctgtgggagggatcgcctggcaagttttggaacaccacaatcgcagttagcatggctaatatcttccgaggttcctatctcgccggcgcggggctagccttctctctgatgaaatcattgggaggcgggagaaggggaacgggcgcacagggtgagaccctgggggaaaagtggaagcgccaactcaaccagcttagcaaatccgagtttaatacttacaagcggagtggaattatggaagtggacagatctgaggctaaagaaggcctgaagcgtggtgagacaaccaaacatgccgtcagcaggggcactgcaaagttgcggtggttcgtggagcgcaacctggtaaagcccgaagggaaagtgatcgatctcggatgtggccgagggggatggtcatattactgcgctggcttaaagaaagttacagaggtgaagggttataccaaagggggaccgggccacgaagagccaatacctatggccacgtacggctggaatctggtcaagcttcattccgggaaagacgtgtttttcatgcccccagaaaagtgtgataccctgctatgcgacattggagagagtagccccaaccctacaatcgaggaaggtagaactctcagggtcctgaagatggtggagccgtggttgaaaggcaatcagttttgtattaagatcctgaacccctacatgccatctgttgtagaaaccctcgagcagatgcaacggaaacacgggggaatgcttgtgcgcaatcctctgtccagaaactcaacacacgagatgtattgggtcagctgcggcactggtaatatagtgtcggccgttaacatgacctctaggatgttactgaaccgattcacaatggcgcatcggaagcccacctacgaacgtgatgtggacttgggggctggaactagacacgtcgcagtggagcctgaagtagccaatctcgatatcattggccagcgcatcgagaacattaaaaatgaacataagagtacgtggcactatgacgaggataacccatacaagacatgggcttatcacggctcctacgaggtgaaacccagcgggtcagcctcctctatggttaatggagtcgtgaggctgctaaccaagccttgggacgtgatcccaatggtcactcagattgcaatgaccgatacaacgccctttggtcaacagcgggttttcaaagaaaaggtggacaccagaactccgcgcgccaaaaggggcacaacccagatcatggaggtaactgctaagtggctttgggggtttctgagccgaaacaagaaacctcggatatgtacaagagaagagttcaccaggaaggtgcgcagtaatgcggccattggagcagtctttgtggacgaaaaccagtggaattccgctaaagaggccgttgaggatgaacgtttctgggacctcgtgcatcgggagagagaactgcacaagcaaggcaaatgcgcaacatgcgtctataacatgatgggtaagagggagaagaaattgggggaatttggaaaggccaaaggcagccgcgctatctggtacatgtggctgggcgcccgattcctcgagttcgaggcgcttgggtttatgaatgaagatcattggttctctcgggagaactcactgagtggagtggaaggtgagggcttacacaagctggggtacatcttgagagacatttccaaaataccaggaggcaatatgtatgcagatgacactgccggttgggataccaggatcacggaggacgatctccagaacgaagctaagattaccgacatcatggagcccgaacatgccctgctagcaacaagcatttttaaacttacttaccagaataaggtagttcgcgtgcagagacctgctaagaacgggaccgtcatggatgtgatctctcggagggaccaacgtggatcgggccaggtgggcacatatgggctgaacactttcaccaatatggaggtccagctcatacgacagatggaatcagagggaatctttctgccaagcgagttggaaacgcccaacttagccgagcgcgttctggattggctcgaaaaacacggtgctgagagacttaagcggatggccatttccggcgacgactgtgtggtaaaaccgatcgatgacaggttcgcaacagcgctgaccgccctaaatgatatggggaaggtgcgcaaagacattcctcaatgggaacccagtaagggatggaacgattggcagcaggtcccattttgctctcaccatttccaccagctgatcatgaaggacggcagagagatagtggttccttgtcggaatcaagatgagctcgtgggtagggctcgagtcagccagggggccggatggtccttgcgtgaaactgcatgcctgggcaaatcatacgctcagatgtggcaacttatgtattttcatagacgcgacctgcggctcgccgcaaacgccatttgtagtgcggtgcccgtagattgggttccaacatctaggaccacttggagcatccacgctcaccatcagtggatgaccacagaggacatgttatccgtgtggaatagagtctggatcgaagagaacccctggatggaagataagacgcacgtgtcaagctgggaggaggttccttacctgggcaaacgcgaagaccagtggtgcgggtctttgattggactgaccgcccgggcaacttgggccacaaatatacaggtggctatcaaccaagtcaggcgactcattggtaatgagaactatcttgactacatgacctccatgaagagattcaaaaatgaaagtgatccagagggcgccctgtggtga

SEQ ID NO: 13519 - RNA, 9879 nt, synthetic construct
  misc_feature 1..9879: note = derived and/or modified CDS sequence (opt3) from DENV-1__FJ639819__SS-prME
  source 1..9879: mol_type = other RNA
agcgtgaccatgctgctcatgcttctgcccaccgcattggctttccacttaactacgaggggcggggagcctcatatgatcgtctccaagcaggaaaggggaaaatctctgttatttaagacctcagccggtgttaacatgtgcacactcattgccatggacctgggcgagctttgtgaagatactatgacctacaaatgcccacggataacagaggcggaaccggacgatgtggactgttggtgcaatgctaccgatacttgggtaacatatgggacctgtagtcaaacgggagagcaccgccgagagaagcgtagcgtggccctggcaccccatgtcggcttgggtctcgaaactagaaccgagacatggatgtcctctgaaggggcctggaaacagatccagagggtggagacttgggctctgcggcaccctggattcaccgttattgcatttttcctggcccatgctatcggcacatcgattacccagaagggcatcatatttatcctcttaatgctggtgacgccatcaatggccatgcgctgcgtcgggattggaaacagagacttcgtggagggtcttagcggcgcgacttgggtagatgttgtgttggaacacgggagttgtgtcacaaccatggcaaagaataaacccactctggacatcgagctactcaagacagaagtgaccaaccctgccgtgctgaggaaactttgcattgaggctaagatctccaatacgaccacagattctcggtgtccaactcaaggagaagccaccctggtcgaggagcaggacgcaaactttgtttgccgccgaacattcgtggatagaggctggggtaatgggtgtggattgtttggcaaaggcagcctcctgacttgcgctaagttcaagtgcgtaaccaaattagaagggaagatagtgcagtacgagaacctgaaatattccgtcattgtgacagttcacaccggagaccagcatcaagtgggtaatgaaactacggagcacggcacaatcgccaccattactccccaggcgcctacctcagaaatccagctcacagattacggggcccttaccctggactgtagtccaaggactggattggactttaacgagatggtcctactgacaatgaaggagaaaagctggctcgtgcataagcagtggttcctggatcttccgctgccctggacgtctggcgcatccacctcacaagaaacttggaatcggcaggacttgctcgtaacatttaaaaccgctcacgccaagaagcaggaggttgtggtcctgggtagccaagaaggggctatgcacacagccttaactggcgcaaccgagatccagacgagtggaaccacaactattttcgccggccatctgaaatgccgtctaaagatggataaactcaccctgaaggggatgtcttatgtgatgtgtacaggatccttcaaacttgaaaaggaggtcgctgagactcagcacggtaccgtgttggttcaggtgaagtacgaaggcacggacgcgccttgcaaaataccatttagcacacaagatgagaagggggtaacccagaacggacgcctgatcactgcaaatcccattgtcacagacaaagaaaagcctgtgaacatcgagaccgagccacccttcggcgaatcgtatatagttgtgggtgccggggagaaagctctcaagctgtcttggtttaagagaggctcctcaattggaaaaatgttcgaagccactgcaaggggcgcccggcgaatggctatccttggggataccgcctgggactttggaagtatcggtggcgtcttcacaagcgtggggaagctggtacatcaggtgtttggaacggcatacggcgttttgttctccggtgtctcttggaccatgaaaattgggatcggcattctcctgacttggttaggactgaatagccgctcaacaagtctatccatgacctgtatagcggtgggcatggtgacactctacctgggggtcatggttcaggctgatagcggatgcgtgatcaactggaagggcagagagcttaaatgtggttctgggatttttgtgactaacgaagtacacacctggacggagcaatataagttccaggccgactcaccgaagaggttgagtgcagccatcggaaaggcttgggaggaaggcgtctgcggtatccggagcgccacacgcctggagaatattatgtggaagcagatatccaacgaactcaatcatatcctgttagagaacgatatgaaatttaccgtggttgtgggcgacgcaaatgggattctggctcagggaaagaaaatgatcagacctcaacccatggaacacaagtactcttggaaatcgtggggcaaggccaagattatcggggcggacatacagaacactaccttcatcattgatggaccagacacacctgagtgtcccgatggccagagggcctggaatatctgggaggtcgaagactatggttttgggattttcactaccaacatctggcttaaattgcgtgatagctacacacagatgtgcgaccaccggctcatgtccgctgcaataaaggattcaaaagccgtgcatgctgacatgggatattggattgagagtgaaaagaatgagacgtggaaactggcccgagcatctttcatcgaagttaagacctgtacttggccaaagagccacacactatggtccaacggcgtgctggagtcagagatgattatccccaaaatatacggtggccctatcagccaacataattatagaccagggtactttacccagactgcgggaccgtggcacctcggcaagctggaacttgatttcgacttgtgcgaggggacaaccgtagtcgtggatgaacactgcggaaacaggggcccctctctgcgcacgactaccgtgacaggtaaaattatccatgagtggtgttgccggtcctgtaccttacctccactcagatttagaggggaagacggatgctggtacggcatggaaattcgccccgtcaaggagaaagaagagaatctggttcgaagtatggtgagcgccggttctggcgaagtagataacttctcccttgggatcctgtgtgtgtcaataatgattgaggaggtcatgcggagtcgttggagcagaaagatgttgatgactggaacactcgctgtgtttctgctactgatcatgggccagctcacctggaatgacctgatcaggctttgcattatggttggggccaacgcatcggaccgcatgggaatgggcacaacttatttggctctgatggccaccttcaagatgcggcctatgtttgcagtgggtttactcttcagaaggctgacgtcccgagaagtccttctgctaacaatcgggctctctctggtggccagcgttgagttgccaaactcactggaagagttaggagatggcctcgctatgggcattatgatgctgaaacttctgaccgaatttcaaccccaccagttgtggactaccctcctgagtctaacattcgtgaagactaccctgtcccttgactacgcgtggaaaacgacagccatggtcctctctatagtaagcctgtttccgttgtgtctgtccaccacttcacagaagacaacctggttacctgtgctcctggggagcttcggatgcaaaccacttactatgtttctgatcacagagaataagatttggggtcgcaagagttggcccttgaacgagggcatcatggcaattgggatcgtttctatactcctgtccagcctactgaaaaatgatgtgcctcttgctggacccctcatcgccggcggtatgctgattgcctgttatgtcatctcggggtcatctgctgacttgagtttagaaaaggcagccgaggtgtcctgggaacaggaggcggaacatagcggagcttctcacaacattctggtagaggtgcaagatgacggcaccatgaaaatcaaggatgaggaacgggacgatacgctcactatactgcttaaagccaccctgttggcagtcagcggcgtttacccaatgtccattcctgccacactattcgtgtggtatttctggcagaagaaaaagcagagatcaggggtgctgtgggacacccccagtccaccggaggtcgaaagggctgtgctcgatgacggaatctaccgtatcctgcagcgcggtcttttaggccggagccaagttggggtaggagtgtttcaggatggcgtcttccatacaatgtggcacgtgactagaggtgcagttctgatgtatcaggggaagaggctcgagccttcttgggcctgcgtgaaaaaggacttgatttcctacggaggcggctggcgatttcaggggctgtggaataccggagaggaagtccaagtgatagcggtagagcccggtaaaaacccaaagaatgtccagacgacacccggcactttcaaaacccctgaaggggaggtgggagctatcgccctcgactttaagccaggcacatcaggtagtcccattgttaaccgggaagggaagatcgtgggactgtacggcaatggcgtcgtgaccactagcgggacctatgtttccgcaattgcccaggctaaagcctctcaagagggacctcttccggagatcgaagatgaggtgttcaagaaacgcaacctgacaataatggacttgcacccaggttcgggcaagacgagaaggtacctacccgcaatcgtccgggaagctattaaacgaaagctgagaactctcatcttagcccctacccgcgtggtagcgagcgagatggccgaagcactgaaggggatgccaattaggtatcagacaaccgctgtgaaatcagagcatactggacgtgagatcgttgatcttatgtgtcacgccacatttaccatgcggctgctctcccccgtcagagtgcctaattacaacatgataattatggacgaagctcatttcacggatccggcaagtatcgccgccaggggctatatctctactcgcgtgggtatgggggaggctgcggcaatttttatgacagccacacccccaggaagcgtcgaggctttccctcagtccaatgccgtaatccaggacgaggaacgagatatacccgagagatcatggaactctggctacgactggattaccgattttccaggcaagactgtgtggttcgttcctagcatcaaaagtgggaatgacattgcaaactgcttgcggaagaacggaaaaagggtgatccaactgtcccgcaagacattcgataccgagtatcagaagaccaagaataacgactgggactacgtcgtgactacggatataagcgaaatgggtgccaattttcgtgctgacagagttattgatccccggaggtgcctcaagccagtgatcctgaaagacggcccggagcgcgtcatccttgcggggcctatgcccgtgaccgtagcctctgcagctcagcgaagaggacggattggcaggaaccagaataaggaaggtgatcaatacgtgtatatggggcagccactaaacaatgacgaggatcacgcccattggacagaggcaaaaatgctgttggacaacatcaatactcccgaaggcattatacctgccttattcgagccagaacgcgagaagtcagctgccatcgatggagaatacagactgaggggcgaggcgcggaagacctttgttgagctcatgcgtcgcggggacctgcccgtctggctttcctataaagtggcaagtgaaggattccagtacagcgatcgaagatggtgttttgacggtgagaggaacaatcaggtgctggaagagaacatggatgtcgaaatttggacaaaggagggcgagcggaaaaagctccgccctagatggttggacgccaggacctattcggacccgctggctctacgggagttcaaagagtttgccgctgggcgaagatctgtttccggagatctgatcctcgaaatcggcaaacttccacaacacctgactttacgcgcacagaatgccttggacaacctggtgatgctccacaatagcgagcagggtgggaaggcttacaggcatgccatggaggaactgcccgatacgattgagacccttatgctgctcgcattgatagcggtactgacaggcggagtgactttattctttctatcaggcaaggggctgggaaagaccagtatcggtctcctttgcgtcacagcctcttccgctctgttgtggatggccagcgtggaacctcactggattgcagcttcaatcattctggagttctttctcatggttctgcttatccccgaaccagaccggcagcgtacccctcaagataaccagctcgcctatgtggtcataggcctgttgttcatgatcctgactgtagcagccaacgagatggggttactagagacaacgaaaaaggacctgggaattggctacgtggctgcggaaaatcatcagcacgccaccatgctcgatgttgaccttcaccccgcaagtgcttggactctgtacgccgtggccacaaccgtcatcaccccaatgatgagacatacaattgagaacactacggcaaatatcagcttgaccgctatagccaaccaagcggctattctgatgggtctcgataaagggtggcctatctccaagatggacattggcgtgccgctgcttgccttaggatgttattctcaggtcaatcccctgacactcactgcagccgtgttgatgctggttgctcactacgcaatcataggcccagggctacaggccaaagcgaccagggaagctcagaagcgcacagccgcaggaatcatgaagaaccctaccgtggatggcattgtagccatcgacctggatcccgtggtctatgacgctaaatttgagaagcaactcggtcagattatgcttctgatcttgtgcactagccagatactgctcatgcggacgacatgggccctgtgtgaatccattaccttagcaactgggccacttaccacactgtgggagggatcacctggcaaattctggaatactaccatcgctgtttctatggccaacatcttccgaggtagttacctcgcgggcgccgggctagcattttcgctgatgaaaagcctaggaggcgggagaaggggaacaggcgctcagggtgagacgctgggggaaaaatggaagcgccaactcaatcagctttccaagtctgagttcaacacctataaacggtcaggaattatggaagtggacagaagcgaggccaaggaaggcctgaaacgtggtgagactacaaagcatgcagtctccaggggcaccgctaaattgcggtggtttgtggagcgcaatctggtaaagcccgaagggaaggtgatcgatctcggatgcggccgagggggatggagttactattgtgccggcttgaaaaaggttactgaggtgaaaggttacacaaaagggggaccgggccacgaagaaccaatacctatggccacctacggctggaacctggtcaaacttcattctgggaaggacgtgttctttatgcccccagaaaaatgcgatacgctgctatgtgacattggagagagctcacccaatcctaccatcgaggaaggtagaacactcagggtcctgaagatggtggagccgtggttgcggggcaaccagttctgcattaagatcctgaatccctatatgccatccgttgtagaaactctcgagcagatgcaacgcaaacacgggggaatgcttgtgagaaaccctctgagtaggaatagcacccacgagatgtactgggtctcttgtggcacaggtaacatagtgtccgcggttaacatgacttcacgaatgttactgaatcggtttaccatggctcatcgtaagcccacatatgaaagagatgtggacttgggggcaggaacccgccacgtcgccgtggagcctgaagtagctaacctcgatatcattggccagaggatcgagaatattaaaaacgaacataagagcacttggcactacgacgaggataatccatataaaacgtgggcctaccacggctcgtatgaggtgaagccctctgggagtgcatccagcatggttaacggagtcgtgcggctgctaacaaagccttgggacgtgatcccaatggtcacccagattgccatgactgataccacacccttcggtcaacagagagtttttaaagaaaaggtggacacgcgcaccccgagggctaaacgaggcactacacagatcatggaggtaaccgcgaagtggctttgggggttcctgtcacggaataaaaagcctagaatatgcactagggaagagtttacacgcaaggtgcgttccaacgccgcaattggagctgtcttcgtggacgaaaatcagtggaactctgccaaagaggcagttgaggatgaacggttttgggacctcgtgcatagagagagggaactgcacaagcaaggcaaatgcgccacctgtgtctacaatatgatgggtaagcgcgagaaaaagttgggggagttcggaaaggctaaaggcagccgagccatctggtacatgtggctgggcgcgcggttcctcgagtttgaggcacttgggttcatgaacgaagatcattggtttagtagagaaaattccctgagcggagtggaaggtgagggcttacacaagctggggtatatcttgagggacatttctaaaataccaggaggcaacatgtacgccgatgacacagctggttgggatactcgcatcaccgaggacgatctccagaatgaagccaagattacggacatcatggagcccgaacatgcactgctagctacctcaattttcaaacttacatatcagaacaaggtagttagagtgcagcggcctgccaaaaacgggactgtcatggatgtgatcagtaggcgtgaccaacgaggatccggccaggtgggcacctacgggctgaatacatttactaacatggaggtccagctcatacgccagatggaaagcgagggaatcttcctgccatctgagttggaaacccccaatttagctgagagagttctggattggctcgaaaagcacggtgccgagcggcttaagaggatggcaatttcgggcgacgactgcgtggtaaaaccgatcgatgaccgctttgcgacggccctgacagctctaaacgatatggggaaggtgagaaaagacattcctcaatgggaaccctcaaagggatggaatgattggcagcaggtcccattctgtagccaccattttcaccagctgatcatgaaagacggccgggagatagtggttccttgcaggaaccaagatgagctcgtgggtcgagcccgtgtctcccagggggcaggatggagtttgagagaaaccgcttgtctgggcaagtcttatgcccagatgtggcaacttatgtacttccatcgccgggacctgaggctcgcagccaatgcgatttgcagcgctgtgcccgtagattgggttccaacttccagaacaacctggtcaatccacgcccaccatcagtggatgactaccgaggacatgttaagtgtgtggaaccgcgtctggatcgaagagaatccctggatggaagataagacacacgtgtctagctgggaggaggttccttatctgggcaaacgggaagaccagtggtgtgggtccttgattggactgacggcaagggccacctgggctactaacatacaggtggccatcaatcaagtccgaagactcattggtaacgagaattaccttgactacatgacatcaatgaagcggtttaaaaacgaaagcgatccagagggcgcactgtggtga

SEQ ID NO: 13520 - RNA, 9879 nt, synthetic construct
  misc_feature 1..9879: note = derived and/or modified CDS sequence (opt3) from DENV-1__FJ639820__SS-prME
  source 1..9879: mol_type = other RNA
agcgtgaccatgctgctcatgcttctgcccacagccttggctttccacttaactacgagaggcggggagcctcatatgatcgtctccaagcaggaaaggggaaaatctctgctatttaagacctcagcaggtgttaacatgtgcacactcattgccatggacctgggcgagctttgtgaagatactatgacctacaaatgcccacggataacagaggcggaaccggacgatgtggactgttggtgcaatgctaccgatacttgggtaacatatgggacctgtagtcaaacgggagagcaccgccgagacaagcgtagcgtggccctggcaccccatgtcggcttgggtctcgagactagaaccgaaacatggatgtcctctgagggggcctggaaacagatccagagggtggaaacttgggctctgcggcaccctggattcaccgttattgcactgtttctcgcccatgctatcggcacatcgattacccagaagggcatcatattcatcttactgatgcttgtgacgccatcaatggccatgcgctgcgtcgggattggaaacagagattttgtggagggtttgagcggcgcgacttgggtagacgttgtgctggagcacgggagttgtgtcacaaccatggcaaagaataaacccactctagatatcgaactcctgaagacagaggtgaccaaccctgccgtgcttaggaaactgtgcattgaagctaagatctccaatacgaccacagactctcggtgtccaactcaaggagaggccaccttggtcgaagagcaggatgcaaacttcgtttgccgccgaacatttgtggacagaggctggggtaatgggtgtggactcttcggcaaaggcagcctgttaacttgcgctaagtttaagtgcgtaaccaaactggaggggaagatagtgcagtacgaaaacctcaaatattccgtcattgtgacagttcacaccggagatcagcatcaagtgggtaatgagactacggaacacggcacaatcgccaccattactccccaggcgcctacctcagagatccagcttacagactacggggccctgaccttggactgtagtccaaggactggactagatttcaacgaaatggtcctgctcacaatgaaggagaaaagctggctggtgcataagcagtggtttcttgacctgccgttgccctggacgtctggcgcatccacctcacaagagacttggaatcggcaggatctcctggtaacattcaaaaccgctcacgccaagaagcaggaagttgtggtcttaggtagccaagagggggctatgcacacagccctgactggcgcaaccgaaatccagacgagtggaaccacaactatttttgccggccatctaaaatgccgtctcaagatggacaaactgacccttaaggggatgtcttatgtgatgtgtacaggatccttcaaattggagaaggaagtcgctgagactcagcacggtaccgtgctggttcaggtgaagtacgagggcacggatgcgccttgcaaaataccattcagcacacaagacgaaaagggggtaacccagaacggacgcctcatcactgcaaatcccattgtcacagataaagagaagcctgtgaacatcgaaaccgagccaccctttggcgagtcgtatatagttgtgggtgccggggaaaaagctctgaagctttcttggttcaagaaaggctcctcaattggaaagatgtttgaggccactgcaagaggcgccaggcggatggctatcctgggggacaccgcctgggatttcggaagtatcggtggcgtctttacaagcgtggggaaattggtacatcaggtgttcggaacggcatacggcgttctcttttccggtgtctcttggaccatgaagattgggatcggcattctgttaacttggctgggactaaatagccgatcaacaagtctctccatgacctgtatagcggtgggcatggtgacactgtaccttggggtcatggttcaggctgacagcggatgcgtgatcaactggaaaggccgcgaattgaagtgtggttctgggattttcgtgactaacgaggtacacacctggacggaacaatataagtttcaggccgattcaccgaaaagactgagtgcagccatcggaaaggcttgggaggagggcgtctgcggtatcaggagcgccacacggctcgaaaatattatgtggaaacagatatccaacgagctgaatcatatcttactggaaaacgacatgaagttcaccgtggttgtgggcgacgcaaatgggattcttgctcagggaaaaaagatgatccgccctcaacccatggagcacaaatactcttggaagtcgtggggcaaggccaaaattatcggggcggatatacagaacactacctttatcattgacggaccagatacacctgaatgtcccgacggccagagagcctggaatatctgggaggtcgaggattatggtttcgggatttttactaccaacatctggttgaagctcagggacagctacacacagatgtgcgatcaccgtctgatgtccgctgcaataaaagactcaaaggccgtgcatgctgatatgggatattggattgaaagtgagaaaaatgaaacgtggaagctagcccgggcatctttcatcgaggttaagacctgtacttggccaaaaagccacacactgtggtccaacggcgtgctcgaatcagagatgattatccccaagatatacggtggccctatcagccaacataattatcgaccagggtacttcacccagactgcgggaccgtggcacctgggcaaacttgagttggactttgatctgtgcgaagggacaaccgtagtcgtggacgagcactgcggaaacagaggcccctctttaaggacgactaccgtgacaggtaagattatccatgaatggtgttgccgctcctgtaccctccctccactgcggttcagaggggaggatggatgctggtacggcatggagattaggcccgtcaaagaaaaggaggaaaatcttgttcgcagtatggtgagcgccggttctggcgaggtagactccttttcactggggatcttgtgtgtgagtataatgattgaagaggtcatgcgaagccggtggtcgcgtaagatgctcatgactggaacactggctgtgttcctactgctcatcatgggccagctgacctggaacgaccttatcagattgtgcattatggttggggccaatgcatccgataggatgggaatgggcacaacttatctggctttaatggccacctttaaaatgcgccctatgttcgcagtgggtctcctgtttcggagacttacgtctagggaggtcctgctactcacaatcgggctgagcttggtggcctcagttgaactgccaaacagtttagaggaactcggagacggcctggctatgggcattatgatgcttaagctgttgaccgagttccaaccccaccagctctggactaccctgctatccctgacatttgtgaaaactaccctttctctcgattacgcgtggaagacgacagccatggtcctgagcatagtatccttgttcccgctgtgtttatcaaccactagccagaaaacaacctggctccctgtgctgcttgggagttttggatgcaagccactgactatgttcttgatcacagaaaacaagatttggggtcgaaaatcttggcccctcaatgagggcatcatggcaattgggatcgtttccatactgctaagctcgctgcttaagaacgacgtgcctctcgctggacccctgatcgccggcggtatgttgattgcctgttatgtcatctcagggtctagtgctgatttatccctggagaaagcagccgaagtgagctgggagcaggaagcggagcattctggagctagccacaatattctcgtagaagtgcaagacgatggcaccatgaagatcaaagacgaggagcgcgatgacacgctgactatacttctgaaggccaccttgctagcagtctccggcgtttacccaatgtcaattcctgccacactgtttgtgtggtatttctggcagaaaaagaagcagcggagtggggtgctctgggatacccccagcccaccggaagtcgagagagctgtgctggacgatggaatctacaggatccttcagcgtggtttactgggccgctctcaagttggggtaggagtgttccaggacggcgtctttcatacaatgtggcacgtgactcggggtgcagttctcatgtatcaggggaaaagattggaaccttcctgggcctcagtgaagaaagacctgattagttacggaggcggctggaggttccaggggagctggaacaccggagaggaggtccaagtgatagcggtagaacccggtaagaatccaaaaaacgtccagacgacacccggcacttttaagacccctgagggggaagtgggagctatcgccctcgatttcaagccaggcacatccggttctcccattgttaatcgagaggggaaaatcgtgggactgtacggcaacggcgtcgtgaccacttcggggacctatgttagcgcaattgcccaggctaaggcctcacaagaaggacctcttccggagatcgaggacgaagtgtttaaaaagcggaatctgacaataatggatttgcacccaggttccggcaaaacgcgcagatacctacccgcaatcgtcagggaggctattaagcggaagctgcgaactctcatcttagcccctaccagagtggtagcgagtgaaatggccgaggcactgaaagggatgccaattcgctatcagacaaccgctgtgaagtctgaacatactggaagggagatcgttgaccttatgtgccacgccacattcaccatgcgtctgctcagccccgtccgggtgcctaactacaatatgataattatggatgaggctcattttacggacccggcatccatcgccgccagaggctatatctcaactagggtgggtatgggggaagctgcggcaattttcatgacagccacccccccaggatctgtcgaggcttttcctcagagcaacgccgtaatccaggatgaagagcgcgacatacccgaacgaagttggaattccggctacgattggattaccgacttcccaggcaaaactgtgtggtttgttcctagcatcaagtctgggaacgatattgcaaattgtttgagaaaaaacggaaagcgggtgatccaactgtcaaggaagacattcgacaccgagtatcagaaaacaaagaacaatgactgggattacgtcgtgactacggacatatccgagatgggtgccaacttccgcgctgatcgtgttattgaccccagacggtgcctcaaaccagtgatcctgaaggatggcccggaaagggtcatccttgcggggcctatgcccgtgaccgtagccagtgcagctcagcgccgaggaagaattggccggaatcagaacaaagagggtgaccaatacgtgtatatggggcagccactaaataacgatgaagaccacgcccattggacagaggcaaagatgctgttggataatatcaacactcccgagggcattatacctgccttatttgaaccagagagggaaaagagcgctgccatcgacggagagtaccgcctgagaggcgaagcgaggaaaaccttcgttgagctcatgcggcgtggggatctgcccgtctggctttcgtataaggtggcatctgagggatttcagtactccgaccgccgatggtgcttcgatggtgaaagaaataaccaggtgctggaggaaaatatggacgtcgagatttggacaaaagaaggcgagaggaagaaactccggcctcgctggttggacgccagaacctatagcgatccgctggctctaagggagtttaaggaattcgccgctgggcggcgatcagttagtggagacctgatcctcgagatcggcaaacttccacaacacctgactttaagagcacagaacgccttggataatctggctatgctccacaactctgaacagggtgggaaggcctaccgccatgcaatggaggaactgcccgacacgattgagacccttatgctgctcgcgttgatagccgtgctgacaggcggagtaactttatttttcctatccggcaaggggctgggaaaaaccagcatcggtctcctttgtgtgacagcttcaagtgccctgttgtggatggcaagcgtcgagcctcactggattgctgcctccatcattctggaatttttcctcatggtgctgcttatccccgagccagataggcagcggacccctcaagacaatcagctcgcatatgttgtgataggcctgttgtttatgatcctgactgtcgccgctaacgaaatggggttactagagacaacgaagaaagatctgggaattggctacgtagcggccgagaaccatcagcacgcaaccatgctcgacgtggatcttcgtcccgcttctgcctggactctgtacgccgttgcaacaaccgtgatcaccccaatgatgagacacacaattgaaaatactacggctaacatcagcttgaccgccatagcgaatcaagctgccattctgatgggtctcgacaaggggtggcctatctccaaaatggatattggcgtcccgctgcttgcattaggatgctattcacaggtgaaccccctgacactcactgccgctgtcttgatgctggtggcacattacgccatcataggcccagggctacaggcgaaggctaccagggaggcccagaagcgcacagcagccggaatcatgaaaaatcctaccgttgacggcattgtggctatcgatctggaccccgtagtgtatgacgccaagttcgaaaaacaactcggtcagattatgcttctgatcttgtgtacttctcagatactgctcatgcggacgacatgggcactgtgcgagagtattaccttagctactgggccacttaccacactgtgggaaggatcgcctggcaagttttggaacactaccatcgccgtcagcatggcgaatatcttccgaggttcctacctcgccggcgcagggctagctttctctctgatgaaatcattgggaggcgggagaaggggaacaggcgcccagggtgagacgctgggggagaagtggaagcgccaactcaaccagcttagcaaatccgaatttaatacctataagcggagtggaattatggaggttgatagatctgaagcaaaagagggcctgaagcgtggtgaaactacaaaacacgctgtgagcaggggcaccgccaagttgcggtggttcgtcgagcgcaacctggtgaagcccgaggggaaagtaatcgacctcggatgtggccgagggggatggtcatactattgcgccggcttaaagaaagtgactgaagttaagggttacacaaaagggggaccgggccatgaggaaccaatacctatggcgacctacggctggaatctggtgaagcttcactccgggaaagatgtctttttcatgcccccagagaagtgtgacacgctgctatgcgatattggagaaagtagccccaaccctaccatcgaggagggtagaacactcagggtgctgaagatggtcgaaccgtggttgaaaggcaatcagttttgtattaagatcctgaacccctatatgccatctgtggttgagactctcgaacagatgcaacggaaacatgggggaatgcttgtacgcaatcctctgtccagaaactcaacccacgagatgtactgggtgagctgcggcacaggtaatatagtctcggctgtgaacatgacttctaggatgttactgaaccgattcaccatggcacaccggaagcccacatatgagcgtgacgttgatttgggggccggaaccagacatgtggctgtcgaacctgaggtggccaatctcgacatcattggccagcgcatcgaaaacattaaaaatgagcacaagagtacttggcattacgatgaagacaacccatataagacgtgggcataccacggctcctatgaggtaaaacccagcgggtcagcctcctctatggtgaatggagttgtcaggctgctaacaaagccttgggatgtgatcccaatggtgacccagattgctatgactgacaccacaccctttggtcaacagcgggtcttcaaagagaaggttgacacgagaaccccgcgcgcgaaaaggggcactacacagatcatggaagtgaccgccaagtggctttgggggtttctgagccgaaacaagaaacctcggatatgtactagagaggaattcacaaggaaggtacgcagtaatgcagctattggagccgtgtttgtcgatgagaaccagtggaattccgcaaaagaagccgtggaggacgagcgtttctgggatctcgttcaccgggaaagagagctgcataagcaaggcaaatgcgctacctgcgtgtacaacatgatgggtaagagggaaaagaaattgggggagtttggaaaggccaaaggcagccgcgcgatctggtacatgtggctgggcgcacgattcctcgaattcgaggcccttgggtttatgaatgaggaccactggttctctcgggaaaactcactgagtggagtcgagggtgaaggcttacataagctggggtatatcttgagagatatttccaaaataccaggaggcaatatgtacgctgacgatacagccggttgggacactaggatcaccgaggatgacctccagaacgaggcaaagattacggatatcatggaacccgagcacgctctgctagccaccagcatttttaaacttacatatcagaataaggtggtacgcgttcagagacctgctaagaacgggactgtgatggacgtcatctctcggagggatcaacgtggatcgggccaggtgggcacctacgggctgaacacattcactaatatggaagtgcagctcatacgacagatggagtcagaaggaatctttctgccaagcgagttggagacccccaacttagccgaacgcgtcctggactggctcgagaaacatggtgcagaaagacttaagcggatggcgatttccggcgacgattgtgttgtgaaaccgatcgacgataggttcgccacggctctgacagccctaaatgacatggggaaggtacgcaaagatattcctcaatgggagcccagtaagggatggaacgactggcagcaggtgccattttgctctcaccacttccatcagctgatcatgaaggatggcagagaaatagtcgtgccttgtcggaatcaagacgagctcgttggtagggcacgagtgagccagggggctggatggtccttgcgtgagaccgcctgcctgggcaaatcatatgcacagatgtggcaacttatgtactttcacagacgcgatctgcggctcgccgcgaacgctatttgtagtgccgtccccgtggactgggtaccaacttctaggacaacctggagcatccatgcacaccaccagtggatgactaccgaagatatgttatccgtttggaatagagtgtggatcgaggaaaacccctggatggaggacaagacacatgtctcaagctgggaagaggtgccttatctgggcaaacgcgaggaccagtggtgcgggtctttgattggactgacggcccgggctacctgggccactaatatacaggttgcaatcaaccaagtgaggcgactcattggtaatgaaaactaccttgattacatgacatccatgaagagattcaaaaatgagagtgacccagaaggcgctctgtggtga

SEQ ID NO: 13521 - RNA, 9879 nt, synthetic construct
  misc_feature 1..9879: note = derived and/or modified CDS sequence (opt3) from DENV-1__FJ639821__SS-prME
  source 1..9879: mol_type = other RNA
agcgccaccatgctgctcatgcttctgcccacagctttggcattccacttaactacgaggggaggggaacctcatatgatcgtgtccaagcaggaaaggggaaaatctctgctatttaagacctcagccggtgtcaacatgtgcaccctcattgcgatggacctgggagaactttgtgaagatactatgacctacaaatgcccacggataacagaagctgaaccggacgatgttgactgttggtgcaatgccaccgatacttgggtgacatatgggacctgtagtcaaacgggagaacaccgccgagaaaagcgtagcgtagcactggccccacatgtgggcttgggtctcgaaactagaaccgaaacatggatgtcctctgaaggggcttggaaacagatccagagggtcgagacttgggcactgcggcaccctggattcaccgtgattgcctttttcctggctcatgccatcggcacatcgattacccagaagggcatcatatttatcctcttaatgctggttacgccatcaatggcgatgcgctgcgtggggattggaaacagagacttcgtcgagggtcttagcggcgcaacttgggtggatgtagttttggaacacgggagttgtgtgacaaccatggccaagaataaacccactctggacatcgagctactcaagacagaagtcaccaaccctgctgtgctgaggaaactttgcattgaggccaagatctccaatacgaccacagattctcggtgtccaactcaaggagaagcaaccctggtggaggagcaggacgctaactttgtctgccgccgaacattcgttgatagaggctggggtaatgggtgtggattgtttggcaaaggcagcctcctgacttgcgccaagttcaagtgcgtgaccaaattagaagggaagatagtacagtacgagaacctgaaatattccgtgattgtcacagtgcacaccggagaccagcatcaagttggtaatgaaactacggagcacggcacaatcgcgaccattactccccaggcccctacctcagaaatccagctcacagattacggggcacttaccctggactgtagtccaaggactggattggactttaacgagatggtgctactgacaatgaaggagaaaagctggctcgtccataagcagtggttcctggatcttccgctgccctggacgtctggcgcttccacctcacaagaaacttggaatcggcaggacttgctcgtgacatttaaaaccgcccacgctaagaagcaggaggtagttgtgctgggtagccaagaaggggccatgcacacagcattaactggcgccaccgagatccagacgagtggaaccacaactattttcgctggccatctgaaatgccgtctaaagatggataaactcaccctgaaggggatgtcttatgtcatgtgtacaggatccttcaaacttgaaaaggaggtggcggagactcagcacggtaccgtcttggtgcaggttcgctacgaaggcacggacgcaccttgcaagataccatttagcacacaagatgagaaaggggtgacccagaacggaagactgatcactgccaatcccattgtaacagacaaggaaaaacctgtcaacatcgagaccgagccacccttcggcgaatcgtatatagtggttggtgctggggagaaggccctcaaactgtcttggtttaagaggggctcctcaattggaaagatgttcgaagcaactgcccggggcgctcgacgcatggccatccttggggataccgcatgggactttggaagtatcggtggcgtgttcacaagcgtcgggaaactggtgcatcaggtatttggaacggcgtacggcgtgttgttctccggtgtttcttggaccatgaagattgggatcggcattctcctgacttggttaggactgaatagcagatcaacaagtctatccatgacctgtatagctgtcggcatggtgacactctacctgggggtgatggtccaggccgatagcggatgcgttatcaactggaaaggcagggagcttaagtgtggttctgggatttttgtgactaacgaagtgcacacctggacggagcaatataaattccaggcagactcaccgaagcggttgagtgccgctatcggaaaggcctgggaggaaggcgtatgcggtatccgcagcgcaacaagactggagaatattatgtggaaacagatatccaacgaactcaatcatatcctgttagagaacgatatgaagtttaccgtcgtggttggcgacgctaatgggattctggcccagggcaagaagatgatcaggcctcaacccatggaacacaaatactcttggaagtcgtggggcaaagcgaagattatcggggccgacatacagaacactaccttcatcattgatggaccagacacacctgagtgtcccgatggccagcgtgcttggaatatctgggaggtggaagactatggttttgggattttcactaccaacatctggcttaagttgcgggatagctacacacagatgtgcgaccaccgactcatgtccgcagccataaaagattcaaaggctgtccatgccgacatgggatattggattgagagtgagaaaaatgagacgtggaagctggcaagagcgtctttcatcgaagtgaaaacctgtacttggccaaagagccacacactatggtccaacggcgttctggagtcagagatgattatccccaagatatacggtggccctatcagccaacataattataggccagggtactacacccagactgccggaccgtggcacctcggcaaactggaacttgattttgacttgtgcgaggggacaaccgtggtagtcgatgaacactgcggaaaccgcggcccctctctgcggacgactaccgtgacaggtaagattatccatgagtggtgttgcagatcctgtaccttacctccactcaggttccgcggggaggacggatgctggtatggcatggaaattcgacccgtgaaagagaaggaagagaatctggtccggagtatggttagcgctggttctggcgaagtggataacttttcccttgggatcctgtgtgtatcaataatgattgaggaggtgatgcgtagtagatggagcaggaaaatgttgatgactggaacactcgccgtcttcctgctactgatcatgggccagctcacctggaatgacctgatccgcctttgcattatggtgggggcaaacgcttcggacggaatgggcatgggtacaacttacttggccctgatggcaacctttaagatgcggcctatgttcgccgttgggttactctttagaaggctgacgtcccgagaagtgcttctgctaacaatcggactctctctggtcgctagcgtggagttgccaaactcactggaagagttaggcgatggcctcgcgatggggattatgatgctgaaacttctgaccgagttccaaccccaccagttgtggactaccctcctgagtctaacatttgttaaaactaccctgtcccttgactatgcctggaagacgacagcaatggtgctctctatagtcagcctgttcccgttgtgtctgtccaccacttcacagaaaacaacctggttacctgtactcctgggcagctttggttgcaagccacttactatgttcctgatcacagagaataaaatttggggccgcaagagttggcccttgaacgaggggatcatggctattggaatcgtgtctatactcctgtccagcctactgaagaatgatgttcctcttgccggccccctcatcgccggtgggatgctgattgcttgttacgtgatctcgggatcatctgcagacttgagtttagataaagccgcggaagtctcctgggagcaggaagctgagcatagcggcgcctctcacaacattagcgtggaagtacaagacgatggcaccatgaagatcaaagacgaggagcgggatgacacgctgactatactcctgaaggcaacccttctggccgtgtccggggtctatccaatgtcaattcctgctacattgtttgtttggtacttctggcagaaaaagaaacagagaagtggagtgctatgggatacccccagcccaccggaagtggagagggcagtcctggacgatggtatctatcgtatcctccagcgcggcctgcttgggcggtctcaagtgggagttggcgtattccaggacggtgtgtttcatacaatgtggcacgtcactagaggggccgtgttaatgtaccagggaaagaggctggaaccttcctgggcgtgcgttaagaaagacctcatttcatacggcggcgggtggcgattccagggaagttggaataccggtgaggaggtgcaagtcatagctgtggaacccggcaagaaccccaaaaatgtacagacgacacccgggacttttaagacccctgagggagaagtcggcgccatcgcattggatttcaaaccaggtacaagcgggtcccccattgtgaaccgggagggaaagatcgttggcctgtatggcaatggggtggtcaccacttctggaacctacgtgtcggccattgctcaggccaaggcaagccaagaaggtcctctcccggagatcgaggacgaagtttttaaaaagcgcaacctgacaataatggatcttcacccaggctcagggaaaacgagaaggtatctgcccgctatcgtgcgggaggccattaagcgaaaattgagaactctaatcctggcgcctacccgcgtcgtggcctccgaaatggcagaggctctcaagggaatgccaattaggtaccagacaaccgccgtaaagagtgaacatactggccgtgagatcgtggacttaatgtgtcacgctacattcaccatgcggctgctttctcccgttagagtccctaattataacatgataattatggatgaggcacattttacggacccggccagcatcgccgctaggggttacatctccactcgcgtggggatgggagaagcggcagccattttcatgacagctacacccccaggctcagtggaggcctttcctcagtctaatgcagtcatccaggatgaagaacgagacatacccgaaagaagctggaacagtggctatgattggattaccgacttcccagggaaaactgtatggtttgtgccttccatcaagagcggaaatgatattgccaactgcctgcggaaaaacggtaagagggttatccaactctctcgcaaaacattcgacaccgagtaccagaagacaaagaataacgactgggattacgtggtcactacggacatatcagagatgggcgctaatttccgtgcggatagagtgattgacccccggaggtgcttgaaaccagttatcctgaaggatgggccggaacgcgtgatcctcgccggacctatgcccgtcaccgtggcatccgctgcccagcgaagaggccggattggtaggaaccagaataaagagggggaccaatatgtatacatgggccagccactgaacaatgatgaagaccacgcacattggacagaggccaagatgcttctagataacatcaatactcccgagggaattatacctgctctgtttgaaccagagcgcgagaaaagtgccgcgatcgacggcgagtatagattgagaggggaagcacggaagaccttcgtggagttaatgcgtcgcggagatctgcccgtttggctcagctacaaggtcgcctcggagggttttcagtattctgaccgaagatggtgtttcgatggcgaaaggaacaatcaggtgctggaggaaaacatggacgtggagatttggacaaaagaaggggagcggaagaaacttcgccctagatggctggacgctaggacctactccgatccgctcgccttgcgggagtttaaggagttcgctgcaggacgaagaagcgtctcaggcgacctgatcctagagatcggtaaactgccacaacacctcactcttcgcgcccagaatgctctggataacttagttatgttgcacaatagtgaacaagggggaaaggcctataggcatgcaatggaggaactgcccgacacgattgagaccctcatgctgcttgcgctgatagccgtgctcacaggaggcgtaactttgtttttcctgtctgggaaaggattaggtaagacctccatcggcctactgtgcgtgacagctagctcagccctcctttggatggcaagtgtcgagcctcactggattgctgccagcatcattctggaatttttcttgatggtgctgctcatccccgagccagatcggcagcgtacccctcaggacaaccagctggcatacgttgtgatagggcttctctttatgatcctgactgtcgccgctaacgaaatgggattgctggagacaacgaagaaagatttaggcattggttacgtagcggccgagaatcatcagcacgcaaccatgctagacgtggatctgcaccccgcttccgcctggactctctatgccgttgcaacaaccgtgatcaccccaatgatgagacatacaattgaaaacactacggctaatatctctcttaccgccatagcgaaccaagctgccattctgatggggttggacaagggctggcctatcagcaaaatggatattggagtcccgctgctcgcactgggctgttactcccaggtgaatccccttacattaactgccgctgtcctgatgctcgtggcacactatgccatcatagggccaggattgcaggcgaaggctaccagggaggcccagaaacgcacagcagccggcatcatgaagaaccctaccgttgacggtattgtggctatcgatctggaccccgtagtgtacgacgtcaagttcgaaaaacaactagggcagattatgctgctcatcctttgcacttcacagatactgttgatgcggacgacatgggccctgtgtgagtctattaccctcgcaactggaccactgaccacattatgggaaggcagtcctggtaagttttggaatactaccatcgctgtttcgatggccaacatcttccgaggcagctatcttgcgggggccggactggcattctccctcatgaaatctctaggcgggggaagaaggggcacaggtgctcagggggagacgctgggagagaagtggaaacgccaattgaatcagctgtcaaagagcgaatttaacacctacaagcggtccggcattatggaggtggatagaagtgaagccaaagagggtctcaagcgtggcgaaactacaaatcatgcagtctctagggggaccgctaaacttcggtggttcgtggagcgcaacctggtaaagcccgagggaaaagtgatcgacttgggctgcgggcgaggaggctggagctattactgtgccggtctgaagaaggttactgaagtgaaagggtacacaaagggaggcccgggccacgaggaaccaatacctatggccacctatgggtggaatctcgtcaaattacattcaggaaaggatgtgtttttcatgcccccagagaaatgcgacacgctgctttgtgatattggtgaatccagtcccaaccctaccatcgaggagggcagaacactgagggtcctaaagatggtggaaccgtggctccgggggaatcagttttgcattaaaatcctgaacccctacatgccaagcgttgtagagactttggaacagatgcaacgcaagcacggaggcatgctggtgagaaatcctctctctaggaactccacccacgagatgtattgggtctcatgtggtacagggaacatagtgagcgcggttaatatgacttcgcgaatgcttctgaaccggttcaccatggctcatcgtaagcccacatacgagagagacgtggatttaggagcaggcacccgccacgtcactgtggaacctgaggtagccaatctggacatcattggccagaggatcgaaaacattaaaaatgagcataagtctacgtggcactatgatgaagacaacccatacaaaacatgggcttatcacgggagttacgaggtgaagccctccggaagcgcctcatccatggttaatggtgtcgtgcggttgctcaccaaaccttgggatgtgatcccaatggtcactcagattgcaatgaccgacacaacgccctttggccaacagagagttttcaaggagaaggtggacacccgcactccgagggccaaacgagggacaacccagatcatggaagtaactgctaagtggctgtggggatttctatctcggaacaaaaagcctagaatatgcacaagggaggagttcacccgcaaagtgcgtagcaatgcggccattggcgcagtctttgtggatgagaaccagtggaatagtgctaaggaagccgttgaggacgagcggttctgggatcttgtgcatagagaaagggagctgcacaagcaaggtaaatgcgcaacatgtgtctacaacatgatggggaagcgcgagaaaaagctcggagagtttggcaaagccaagggctcccgagctatctggtatatgtggctgggggcccggttcttggagttcgaggcgctgggatttatgaatgaggaccattggttcagcagagaaaactctctctcaggtgtggagggcgaagggcttcacaagctgggatacatcttaagggatattagtaaaataccaggcggtaatatgtatgcagacgatactgccgggtgggacacccgcatcacggaggatgacctgcagaacgaggctaagattaccgatatcatggaacccgagcatgccttgctcgcaacatccatttttaaactgacttaccagaacaaggtagttagagtgcagcggcctgctaaaaatggaaccgtcatggacgtgatcagcaggcgtgatcaacgaggctctggccaggtggggacatatggactaaacactttcaccaatatggaagtccagcttatacgccagatggagtcggaaggtatctttctgccatcagagctcgagacgcccaacctggccgaaagagttttggactggttagagaagcacggcgctgaacggctgaaaaggatggccattagcggggacgattgcgtggtaaagccgatcgacgatcgcttcgcaacagcgctcaccgcccttaatgacatgggaaaggtgagaaaagatattcctcaatgggagccctccaagggctggaacgactggcagcaggtcccattttgtagtcaccatttccaccagctgatcatgaaagatggtcgggaaatagtggttccttgcaggaatcaagacgagctagtggggcgagctcgtgtctctcagggagccggctggagcctgagagagactgcatgtctcggcaagtcctacgctcagatgtggcaattgatgtattttcatcgccgggatctgaggcttgccgcaaacgccatttgctcagcggtgcccgtagactgggttccaacaagtagaaccacttggtctatccacgctcaccatcagtggatgaccacagaagatatgctgagcgtgtggaatcgcgtctggatcgaggaaaacccctggatggaggacaaaacgcacgtgtcctcatgggaagaggttccttacctcgggaagcgggaggaccagtggtgtggcagcttaattggtctgaccgccagggcaacttgggccacaaatatacaggtggctatcaaccaagtccgaagattgattggcaatgaaaactacctggattatatgacctctatgaagcggttcaaaaatgagtccgacccagaaggggccctctggtga

SEQ ID NO: 13522 - RNA, 9879 nt, synthetic construct
  misc_feature 1..9879: note = derived and/or modified CDS sequence (opt3) from DENV-1__FJ639824__SS-prME
  source 1..9879: mol_type = other RNA
agcgtgaccatgctgctcatgcttctgcccacagccttggctttccacttaactacgagaggcggggagcctcatatgatcgtctccaagcaggaaaggggaaaatctctgctatttaagacctcagcaggtgttaacatgtgcacactcattgccatggacctgggcgagctttgtgaagatactatgacctacaaatgcccacggataacagaggcggaaccggacgatgtggactgttggtgcaatgctaccgatacttgggtaacatatgggacctgtagtcaaacgggagagcaccgccgagacaagcgtagcgtggccctggcaccccatgtcggcttgggtctcgagactagaaccgaaacatggatgtcctctgagggggcctggaaacagatccagagggtggaaacttgggctctgcggcaccctggattcaccgttattgcactgtttctcgcccatgctatcggcacatcgattacccagaagggcatcatattcatcttactgatgcttgtgacgccatcaatggccatgcgctgcgtcgggattggaaacagagattttgtggagggtttgagcggcgcgacttgggtagacgttgtgctggagcacgggagttgtgtcacaaccatggcaaagaataaacccactctagatatcgaactcctgaagacagaggtgaccaaccctgccgtgcttaggaaactgtgcattgaagctaagatctccaatacgaccacagactctcggtgtccaactcaaggagaggccaccttggtcgaagagcaggatgcaaacttcgtttgccgccgaacatttgtggacagaggctggggtaatgggtgtggactcttcggcaaaggcagcctgttaacttgcgctaagtttaagtgcgtaaccaaactggaggggaagatagtgcagtacgaaaacctcaaatattccgtcattgtgacagttcacaccggagatcagcatcaagtgggtaatgagactacggaacacggcacaatcgccaccattactccccaggcgcctacctcagagatccagcttacagactacggggccctgaccttggactgtagtccaaggactggactagatttcaacgaaatggtcctgctcacaatgaaggagaaaagctggctggtgcataagcagtggtttcttgacctgccgttgccctggacgtctggcgcatccacctcacaagagacttggaatcggcaggatctcctggtaacattcaaaaccgctcacgccaagaagcaggaagttgtggtcttaggtagccaagagggggctatgcacacagccctgactggcgcaaccgaaatccagacgagtggaaccacaactatttttgccggccatctaaaatgccgtctcaagatggacaaactgacccttaaggggatgtcttatgtgatgtgtacaggatccttcaaattggagaaggaagtcgctgagactcagcacggtaccgtgctggttcaggtgaagtacgagggcacggatgcgccttgcaaaataccattcagcacacaagacgaaaagggggtaacccagaacggacgcctcatcactgcaaatcccattgtcacagataaagagaagcctgtgaacatcgaaaccgagccaccctttggcgagtcgtatatagttgtgggtgccggggaaaaagctctgaagctttcttggttcaagaaaggctcctcaattggaaagatgtttgaggccactgcaagaggcgccaggcggatggctatcctgggggacaccgcctgggatttcggaagtatcggtggcgtctttacaagcgtggggaaattggtacatcaggtgttcggaacggcatacggcgttctcttttccggtgtctcttggaccatgaagattgggatcggcattctgttaacttggctgggactaaatagccgatcaacaagtctctccatgacctgtatagcggtgggcatggtgacactgtaccttggggtcatggttcaggctgacagcggatgcgtgatcaactggaaaggccgcgaattgaagtgtggttctgggattttcgtgactaacgaggtacacacctggacggaacaatataagtttcaggccgattcaccgaaaagactgagtgcagccatcggaaaggcttgggaggagggcgtctgcggtatcaggagcgccacacggctcgaaaatattatgtggaaacagatatccaacgagctgaatcatatcttactggaaaacgacatgaagttcaccgtggttgtgggcgacgcaaatgggattcttgctcagggaaaaaagatgatccgccctcaacccatggagcacaaatactcttggaagtcgtggggcaaggccaaaattatcggggcggatatacagaacactacctttatcattgacggaccagatacacctgaatgtcccgacggccagagagcctggaatatctgggaggtcgaggattatggtttcgggatttttactaccaacatctggttgaagctcagggacagctacacacagatgtgcgatcaccgtctgatgtccgctgcaataaaagactcaaaggccgtgcatgctgatatgggatattggattgaaagtgagaaaaatgaaacgtggaagctagcccgggcatctttcatcgaggttaagacctgtacttggccaaaaagccacacactgtggtccaacggcgtgctcgaatcagagatgattatccccaagatatacggtggccctatcagccaacataattatcgaccagggtacttcacccagactgcgggaccgtggcacctgggcaaacttgagttggactttgatctgtgcgaagggacaaccgtagtcgtggacgagcactgcggaaacagaggcccctctttaaggacgactaccgtgacaggtaagattatccatgaatggtgttgccgctcctgtaccctccctccactgcggttcagaggggaggatggatgctggtacggcatggagattaggcccgtcaaagaaaaggaggaaaatcttgttcgcagtatggtgagcgccggttctggcgaggtagactccttttcactggggatcttgtgtgtgagtataatgattgaagaggtcatgcgaagccggtggtcgcgtaagatgctcatgactggaacactggctgtgttcctactgctcatcatgggccagctgacctggaacgaccttatcagattgtgcattatggttggggccaatgcatccgataggatgggaatgggcacaacttatctggctttaatggccacctttaaaatgcgccctatgttcgcagtgggtctcctgtttcggagacttacgtctagggaggtcctgctactcacaatcgggctgagcttggtggcctcagttgaactgccaaacagtttagaggaactcggagacggcctggctatgggcattatgatgcttaagctgttgaccgagttccaaccccaccagctctggactaccctgctatccctgacatttgtgaaaactaccctttctctcgattacgcgtggaagacgacagccatggtcctgagcatagtatccttgttcccgctgtgtttatcaaccactagccagaaaacaacctggctccctgtgctgcttgggagttttggatgcaagccactgactatgttcttgatcacagaaaacaagatttggggtcgaaaatcttggcccctcaatgagggcatcatggcaattgggatcgtttccatactgctaagctcgctgcttaagaacgacgtgcctctcgctggacccctggtcgccggcggtatgttgatcgcctgttatgtgatttcagggtctagtgctgatttatccctggagaaagcagccgaagtaagctgggagcaggaagcggagcattctggagctagccacaatatcctcgtggaagtccaagacgatggcaccatgaagattaaagacgaggagcgcgatgacacgctgactatccttctgaaggccaccttgctagcagtttccggcgtgtacccaatgtcaatacctgccacactgtttgtgtggtatttctggcagaaaaagaagcagcggagtggggtcctctgggatacccccagcccaccggaagtggagagagctgttctggacgatggaatttacaggatccttcagcgtggtttactgggccgctctcaagtaggggtgggagtcttccaggacggcgtgtttcatacaatgtggcacgttactcggggtgcagtgctcatgtatcaggggaaaagattggaaccttcctgggcctcagtcaagaaagacctgatcagttacggaggcggctggaggttccaggggagctggaacaccggagaggaggtgcaagtaattgcggtcgaacccggtaagaatccaaaaaacgtgcagacgacacccggcacttttaagacccctgagggggaagttggagctatagccctcgatttcaagccaggcacatccggttctcccatcgtgaatcgagaggggaaaattgtcggactgtacggcaacggcgtggttaccacttcggggacctatgtgagcgcaatcgcccaggctaaggcctcacaagaaggacctcttccggagattgaggacgaagtctttaaaaagcggaatctgacaatcatggatttgcacccaggttccggcaaaacgcgcagatacctacccgcaatagtgagggaggctatcaagcggaagctgcgaactctcattttagcccctaccagagtagtggcgagtgaaatggccgaggcactgaaagggatgccaatccgctatcagacaaccgctgttaagtctgaacatactggaagggagattgtcgaccttatgtgccacgccacattcaccatgcgtctgctcagccccgtgcgggtgcctaactacaatatgatcataatggatgaggctcattttacggacccggcatccattgccgccagaggctatatctcaactagggtcggtatgggggaagctgcggcaatcttcatgacagccacccccccaggatctgtagaggcttttcctcagagcaacgccgtgattcaggatgaagagcgcgacatccccgaacgaagttggaattccggctacgattggataaccgacttcccaggcaaaactgtttggtttgtgcctagcattaagtctgggaacgatatcgcaaattgtttgagaaaaaacggaaagcgggtcattcaactgtcaaggaagacattcgacaccgagtatcagaaaacaaagaacaatgactgggattacgtggttactacggacatctccgagatgggtgccaacttccgcgctgatcgtgtgatagaccccagacggtgcctcaaaccagtcattctgaaggatggcccggaaagggtgatccttgcggggcctatgcccgtaaccgtggccagtgcagctcagcgccgaggaagaatcggccggaatcagaacaaagagggtgaccaatacgtttatatggggcagccactaaataacgatgaagaccacgcccattggacagaggcaaagatgctgttggataatattaacactcccgagggcatcattcctgccttatttgaaccagagagggaaaagagcgctgccatagacggagagtaccgcctgagaggcgaagcgaggaaaaccttcgtcgagctcatgcggcgtggggatctgcccgtgtggctttcgtataaggtggcatctgagggatttcagtactccgaccgccgatggtgcttcgatggtgaaagaaataaccaggtcctggaggaaaatatggacgttgagatctggacaaaagaaggcgagaggaagaaactccggcctcgctggttggacgccagaacctatagcgatccgctggctctaagggagtttaaggaattcgccgctgggcggcgatcagtgagtggagacctgattctcgagatcggcaaacttccacaacacctgactttaagagcacagaacgccttggataatctggtaatgctccacaactctgaacagggtgggaaggcttaccgccatgccatggaggaactgcccgacacgatcgagacccttatgctgctcgcattgattgcggtgctgacaggcggagtcactttatttttcctatccggcaaggggctgggaaaaaccagcataggtctcctttgtgtgacagcctcaagtgctctgttgtggatggccagcgttgagcctcactggatcgcagcttccattatcctggaatttttcctcatggtgctgcttattcccgagccagataggcagcggacccctcaagacaatcagctcgcctatgtcgtaatcggcctgttgtttatgatactgactgtggcagccaacgaaatggggttactagagacaacgaagaaagatctgggaatcggctacgttgctgcggagaaccatcagcacgccaccatgctcgacgtggatcttcgtcccgcatctgcttggactctgtacgccgtcgccacaaccgtgattaccccaatgatgagacacacaatcgaaaatactacggcaaacattagcttgaccgctatcgccaatcaagcggctatactgatgggtctcgacaaggggtggcctatttccaaaatggatatcggcgtcccgctgcttgccttaggatgctattcacaggtgaaccccctgacactcactgcagccgttttgatgctggtggctcattacgcaattatcggcccagggctacaggccaaggcgaccagggaggctcagaagcgcacagccgcaggaataatgaaaaatcctaccgtagacggcatcgtggccattgatctggaccccgtcgtttatgacgctaagttcgaaaaacaactcggtcagatcatgcttctgattttgtgtacttctcagatcctgctcatgcggacgacatgggccctgtgcgagagtataaccttagcaactgggccacttaccacactgtgggaaggatcgcctggcaagttttggaacactaccattgctgtgagcatggccaatatcttccgaggttcctacctcgcgggcgccgggctagcattctctctgatgaaatcattgggaggcgggagaaggggaacaggcgctcagggtgagacgctgggggagaagtggaagcgccaactcaaccagcttagcaaatccgaatttaatacctataagcggagtggaatcatggaggtcgatagatctgaagccaaagagggcctgaagcgtggtgaaactacaaaacacgcagtgagcaggggcaccgctaagttgcggtggttcgtagagcgcaacctggtgaagcccgaggggaaagttattgacctcggatgtggccgagggggatggtcatactattgcgccggcttaaagaaagtgactgaagtcaagggttacacaaaagggggaccgggccatgaggaaccaatccctatggccacctacggctggaatctggtgaagcttcactccgggaaagatgtctttttcatgcccccagagaagtgtgacacgctgctatgcgatataggagaaagtagccccaaccctaccattgaggagggtagaacactcagggtgctgaagatggttgaaccgtggttgaaaggcaatcagttttgtatcaagattctgaacccctatatgccatctgtagtggagactctcgaacagatgcaacggaaacatgggggaatgcttgtccgcaatcctctgtccagaaactcaacccacgagatgtactgggtgagctgcggcacaggtaatatcgtttcggcggtgaacatgacttctaggatgttactgaaccgattcaccatggctcaccggaagcccacatatgagcgtgacgtcgatttgggggcaggaaccagacatgtggccgtagaacctgaggtggctaatctcgacataatcggccagcgcattgaaaacatcaaaaatgagcacaagagtacttggcattacgatgaagacaacccatataagacgtgggcctaccacggctcctatgaggttaaacccagcgggtcagcatcctctatggtcaatggagtggtgaggctgctaacaaagccttgggatgtcattccaatggttacccagatcgccatgactgacaccacaccctttggtcaacagcgggtgttcaaagagaaggtagacacgagaaccccgcgcgctaaaaggggcactacacagattatggaagtgaccgcgaagtggctttgggggtttctgagccgaaacaagaaacctcggatctgtactagagaggaattcacaaggaaggtccgcagtaatgccgcaataggagctgtgtttgttgatgagaaccagtggaattccgccaaagaagcagtggaggacgagcgtttctgggatctcgtccaccgggaaagagagctgcataagcaaggcaaatgcgccacctgcgtgtacaacatgatgggtaagagggaaaagaaattgggggagtttggaaaggctaaaggcagccgcgccatttggtacatgtggctgggcgcgcgattcctcgaattcgaggcacttgggtttatgaatgaggaccactggttctctcgggaaaactcactgagtggagtagagggtgaaggcttacataagctggggtatatcttgagagatatctccaaaattccaggaggcaatatgtacgccgacgatacagctggttgggacactaggataaccgaggatgacctccagaacgaggccaagatcacggatattatggaacccgagcacgcactgctagctaccagcatctttaaacttacatatcagaataaggttgtgcgcgtccagagacctgccaagaacgggactgtgatggacgtgatttctcggagggatcaacgtggatcgggccaggtcggcacctacgggctgaacacattcactaatatggaagttcagctcatccgacagatggagtcagaaggaatatttctgccaagcgagttggagacccccaacttagctgaacgcgtgctggactggctcgagaaacatggtgccgaaagacttaagcggatggcaatctccggcgacgattgtgtagtgaaaccgattgacgataggttcgcgacggccctgacagctctaaatgacatggggaaggtccgcaaagatatccctcaatgggagcccagtaagggatggaacgactggcagcaggtgccattttgctctcaccacttccatcagctgattatgaaggatggcagagaaatcgttgtgccttgtcggaatcaagacgagctcgtcggtagggcccgagtgagccagggggcaggatggtccttgcgtgagaccgcttgcctgggcaaatcatatgcccagatgtggcaacttatgtactttcacagacgcgatctgcggctcgcagccaacgcgatatgtagtgctgtacccgttgactgggtgccaacttctaggacaacctggagcattcatgcccaccaccagtggatgactaccgaagatatgttatccgtctggaatagagtgtggatcgaggaaaacccctggatggaggacaagacacatgtttcaagctgggaagaggtgccttatctgggcaaacgcgaggaccagtggtgcgggtctttgatcggactgacggcacgggccacctgggctactaatattcaggtcgccataaaccaagtgaggcgactcatcggtaatgaaaactaccttgattacatgacatccatgaagagattcaaaaatgagagtgacccagaaggcgcactgtggtga

SEQ ID NO: 13523 - RNA, 9879 nt, synthetic construct
  misc_feature 1..9879: note = derived and/or modified CDS sequence (opt3) from DENV-1__JN819425__SS-prME
  source 1..9879: mol_type = other RNA
agcgtgaccatgctgctcatgcttctgcccacagccttggctttccacttaactacgagaggcggggagcctcatatgatcgtctccaagcaggaaaggggaaaatctctgctatttaagacctcagcaggtgttaacatgtgcacactcattgccatggacctgggcgagctttgtgaagatactatgacctacaaatgcccacggataacagaggcggaaccggacgatgtggactgttggtgcaatgctaccgatacttgggtaacatatgggacctgtagtcaaacgggagagcaccgccgagagaagcgtagcgtggccctggcaccccatgtcggcttgggtctcgaaactagaaccgagacatggatgtcctctgaaggggcctggaaacagatccagagggtggagacttgggctctgcggcaccctggattcaccgttattgcatttttcctggcccatgctatcggcacatcgattacccagaagggcatcatatttatcctcttaatgctggtgacgccatcaatggccatgcgctgcgtcgggattggaaacagagacttcgtggagggtcttagcggcgcgacttgggtagatgttgtgttggaacacgggagttgtgtcacaaccatggcaaagaataaacccactctggacatcgagctactcaagacagaagtgaccaaccctgccgtgctgaggaaactttgcattgaggctaagatctccaatacgaccacagattctcggtgtccaactcaaggagaagccaccctggtcgaggagcaggacgcaaactttgtttgccgccgaacattcgtggatagaggctggggtaatgggtgtggattgtttggcaaaggcagcctcctgacttgcgctaagttcaagtgcgtaaccaaattagaagggaagatagtgcagtacgagaacctgaaatattccgtcattgtgacagttcacaccggagaccagcatcaagtgggtaatgaaactacggagcacggcacaatcgccaccattactccccaggcgcctacctcagaaatccagctcacagattacggggcccttaccctggactgtagtccaaggactggattggactttaacgagatggtcctactgacaatgaaggagaaaagctggctcgtgcataagcagtggttcctggatcttccgctgccctggacgtctggcgcatccacctcacaagaaacttggaatcggcaggacttgctcgtaacatttaaaaccgctcacgccaagaagcaggaggttgtggtcctgggtagccaagaaggggctatgcacacagccttaactggcgcaaccgagatccagacgagtggaaccacaactattttcgccggccatctgaaatgccgtctaaagatggataaactcaccctgaaggggatgtcttatgtgatgtgtacaggatccttcaaacttgaaaaggaggtcgctgagactcagcacggtaccgtgttggttcaggtgaagtacgaaggcacggacgcgccttgcaaaataccatttagcacacaagatgagaagggggtaacccagaacggacgcctgatcactgcaaatcccattgtcacagacaaagaaaagcctgtgaacatcgagaccgagccacccttcggcgaatcgtatatagttgtgggtgccggggagaaagctctcaagctgtcttggtttaagagaggctcctcaattggaaaaatgttcgaagccactgcaaggggcgcccggcgaatggctatccttggggataccgcctgggactttggaagtatcggtggcgtcttcacaagcgtggggaagctggtacatcaggtgtttggaacggcatacggcgttttgttctccggtgtctcttggaccatgaaaattgggatcggcattctcctgacttggttaggactgaatagccgctcaacaagtctatccatgacctgtatagcggtgggcatggtgacactctacctgggggtcatggttcaggctgatagcggatgcgtgatcaactggaagggcagagagcttaaatgtggttctgggatttttgtgactaacgaagtacacacctggacggagcaatataagttccaggccgactcaccgaagaggttgagtgcagccatcggaaaagcttgggaggaaggcgtctgcggtatccggagcgccacacgcctggagaatattatgtggaagcagatatccaacgaactcaatcatatcctgttagagaacgatatgaaatttaccgtggttgtgggcgacgcaaatgggattctggctcagggaaagaaaatgatcagacctcaacccatggaacacaagtactcttggaaatcgtggggcaaggccaagattatcggggcggacatacagaacactaccttcatcattgatggaccagacacacctgagtgtcccgatggccagagggcctggaatatctgggaggtcgaagactatggttttggggtgttcactaccaacatttggcttaaattgcgtgatagctacacacagatgtgcgaccaccggctcatgtccgctgcaatcaaggattcaaaagccgttcatgctgacatgggatattggatagagagtgaaaagaatgagacgtggaaactggcccgagcatctttcattgaagtgaagacctgtacttggccaaagagccacacactatggtccaacggcgtactggagtcagagatgatcattcccaaaatctacggtggccctataagccaacataattatagaccagggtactttacccagactgcgggaccgtggcacctcggcaagctggaacttgatttcgacttgtgcgaggggacaaccgtcgtggtggatgaacactgcggaaacaggggcccctctctgcgcacgactaccgtcacaggtaaaatcattcatgagtggtgttgccggtcctgtaccttacctccactcagatttaggggggaggacggatgctggtacggcatggaaatccgccccgttaaggagaaagaagagaatctggtgcgaagtatggtaagcgccggttctggcgaagtggattccttctcacttgggattctgtgtgtcagtatcatgatagaggaggtgatgcggagccgttggtcgagaaagatgttgatgactggaacactcgctgtttttctgctactgattatgggccagctcacctggaacgacctgatcaggctttgcatcatggtgggggccaatgcatccgaccgcatgggaatgggcacaacttatttggctctgatggccaccttcaagatgcggcctatgtttgcagtcggtttactcttcagaaggctgacgtctcgagaagtgcttctgctaacaattgggctcagcctggttgcctcagtggagttgccaaacagtctggaagagttaggagatggcctcgctatgggcatcatgatgctgaaacttctgaccgaatttcaaccccaccagttgtggactaccctcctgtccctaacattcgtcaagactaccctgtctcttgactacgcgtggaaaacgacagccatggtactcagcattgtgtccctgtttccgttgtgtctgtcaaccactagccagaagacaacctggttacctgttctcctggggagtttcggatgcaaaccacttactatgtttctgataacagagaacaagatctggggtcgcaagtcttggcccttgaatgagggcattatggcaatcgggattgtgtccatcctcctgagctcgctactgaaaaacgatgtccctcttgctggacccctcatagccggcggtatgctgatcgcctgttatgtgatttcagggtctagtgctgacttgtccttagaaaaggcagtaaaaatcagctgggagcaggaagccgagcattctggagcgagccacaatattctggtggaagtccaagatgacggcaccatgaagatcaaagatgaggagcgggacgatacgctcactatactgcttaaggctaccctgttggccgtttccggcgtgtacccaatgtcaattcctgcaacactattcgtgtggtatttctggcagaaaaagaagcagagaagtggggtcctgtgggacacccccagcccaccggaagtggagagggccgttctcgatgacggaatctaccgtatcctgcagcgcggtcttttaggccggtctcaagtaggggtgggagtctttcaggatggcgtgttccatacaatgtggcacgttactagaggtgctgtgctgatgtatcaggggaaaaggctcgaaccttcctgggcatcagtcaagaaagacttgattagttacggaggcggctggcgatttcaggggagctggaacaccggagaggaggtgcaagtaatagccgtcgaacccggtaagaatccaaaaaacgtgcagacgacacccggcactttcaagacccctgagggggaagttggagcgatcgctctggactttaagccaggcacatccggttctcccattgtgaatcgggaggggaaaatcgtcggactctacggcaacggcgtggttaccacttcggggacctatgtgagcgccattgcacaggccaaggcttcacaagaaggacctctgccggagatcgaggatgaagtcttcaaaaagcgcaatcttacaataatggacctgcacccaggttccggcaaaacgagaaggtacttgcccgccatcgtgcgggaggcaattaagcgaaagctaagaactctgatcctcgctcctacccgcgtagtggccagtgaaatggcggaggccttaaaagggatgccaattaggtatcagacaaccgcagttaagtctgaacatactggacgtgagatcgtcgatctgatgtgccacgctacatttaccatgcggcttctgagccccgtgagagtgcctaactacaatatgataattatggacgaggcccatttcacggatccggcttccatcgcagccaggggctatatctcaactcgcgtcggtatgggggaagccgctgcgatttttatgacagcaacccccccaggatctgtagaggccttccctcagagcaacgctgtgatccaggacgaagagcgagatatacccgaaagaagttggaattccggctacgactggattaccgattttccaggcaaaactgtttggttcgtgcctagcatcaagtctgggaacgacattgccaattgtctccggaaaaacggaaagagggtcatccaattgtcacgcaagacattcgataccgagtatcagaaaacaaagaacaatgactgggactacgtggttactacggatatatccgagatgggtgcaaactttcgtgccgacagagtgattgatccccggaggtgcctgaaaccagtcatcctcaaggacggcccggaacgcgtgatcctggctgggcctatgcccgtaaccgtggcgagtgccgcacagcgaagaggacggattggcaggaatcagaacaaagagggtgatcaatacgtttatatggggcagccacttaataacgacgaagatcacgctcattggacagaggccaagatgctactggacaatatcaacactcccgagggcattatacctgcattgttcgaaccagagcgcgaaaagagcgccgctatcgatggagagtacagattaaggggcgaagcccggaaaacctttgtcgagctgatgcgtcgcggggacctccccgtgtggctgtcgtataaggtggcgtctgagggattccagtactccgatcgaagatggtgctttgacggtgaaaggaataaccaggtccttgaggaaaatatggatgttgagatttggacaaaagaaggcgagcggaagaaactgcgccctagatggctcgacgcaaggacctatagcgacccgttggccctgcgggagttcaaggaatttgctgccgggcgaagatcagtgagtggagatctaatcctggagatcggcaaactcccacaacaccttactctgcgcgctcagaacgcattagacaatttggtaatgctgcacaactctgaacagggtgggaaggcctacaggcatgctatggaggaactccccgatacgattgagaccctgatgcttctggccctcatagcagtgttgacaggcggagtcactctgttctttttatccggcaaggggctaggaaaaaccagcatcggtctgctctgtgtgacagcgtcaagtgcccttctgtggatggctagcgttgagcctcactggattgccgcatccatcattttggaattctttctgatggtgctcctgatccccgagccagaccggcagcgtacccctcaagataatcagcttgcttatgtcgtaataggcctcctgttcatgatcttgactgtggccgcaaacgaaatggggctgttagagacaacgaagaaagacctaggaattggctacgttgccgctgagaaccatcagcacgcgaccatgctggatgtggacctccaccccgcctctgcatggactctttacgctgtcgccacaaccgtgatcaccccaatgatgagacatacaattgaaaatactacggccaacatcagcctgaccgcaatagctaatcaagccgcgattttgatgggtctggataaggggtggcctatctccaaaatggacattggcgtcccgctcctggctcttggatgctattcacaggtgaaccccttaacactgactgccgcagttctcatgttggtggcccactacgctatcataggcccagggctgcaggcaaaggccaccagggaggcgcagaagcgcacagctgccggaatcatgaaaaatcctaccgtagatggcattgtggcaatcgacctagatcccgtcgtttatgacgccaagtttgaaaaacaactgggtcagattatgctccttatcctgtgtacttctcagatattgctgatgcggacgacatgggctctctgcgagagtattaccctggccactgggccattaaccacactttgggaaggatcgcctggcaagttctggaacactaccatcgcagtgagcatggctaatatcttccgaggttcctacctggccggcgcggggctcgccttttctctaatgaaatcactgggaggcgggagaaggggaacaggcgcacagggtgagacgttgggggagaagtggaagcgccaactgaaccagctcagcaaatccgaattcaatacctataagcggagtggaattatggaggtcgacagatctgaagctaaagagggccttaagcgtggtgaaactacaaaacatgccgtgagcaggggcaccgcaaagctgcggtggtttgtagagcgcaacttggtgaagcccgaggggaaagttatcgatctgggatgtggccgagggggatggtcatactattgcgctggcctcaagaaagtgactgaagtcaagggttacacaaaagggggaccgggccacgaggaaccaatacctatggccacctacggctggaatttagtgaagctgcattccgggaaagacgtcttctttatgcccccagagaagtgtgatacgcttctgtgcgacattggagaaagtagccccaaccctaccatcgaggagggtagaacactaagggtgctcaagatggttgaaccgtggctgcggggcaatcagttctgtattaaaatcttgaacccctatatgccatctgtagtggagactctggaacagatgcaacgcaagcacgggggaatgctcgtcagaaatcctctttccaggaactcaacccacgagatgtactgggtgagctgcggcacaggtaatatagtttcggccgtgaacatgacttctcgaatgctgttaaaccggtttaccatggcgcatcgtaaacccacatatgagagagatgtcgacctgggggctggaacccgccacgtggcagtagaacctgaggtggccaatttggatatcattggccagaggatcgaaaacattaagaatgagcataaaagtacttggcactacgacgaagataacccatataagacgtgggcttaccacggctcctatgaggttaagcccagcgggtcagcctcctctatggtcaatggagtggtgcggctcctgacaaaaccttgggacgtcatcccaatggttacccagattgcaatgactgataccacacccttcggtcaacagagagtgtttaaggagaaagtagacacgcgcaccccgagggccaagcgaggcactacacagatcatggaagtgaccgctaaatggctatgggggttccttagccggaacaagaagcctagaatatgtactagggaggaatttacacgcaaagtccgtagtaatgcggccattggagcagtgttcgttgacgagaaccagtggaattccgctaaggaagccgtggaggatgagcggttttgggacctggtccatagagaaagggagctccacaaacaaggcaagtgcgcaacctgcgtgtacaacatgatgggtaaacgcgaaaagaagctgggggagttcggaaaagccaagggcagccgagctatctggtacatgtggttgggcgcccggttcctggaatttgaggcgctcgggttcatgaatgaggatcattggttttctagagaaaactcacttagtggagtagagggtgaaggcctgcacaaattagggtatatcctgagggacatttccaagataccaggaggcaatatgtacgcagatgacacagccggttgggatactcgcatcaccgaggacgatttgcagaacgaggctaaaattacggacatcatggaacccgagcatgccctcctggcaaccagcattttcaagctaacatatcagaataaagttgtgagagtccagcggcctgctaagaacgggactgtgatggatgtgatctctaggcgtgaccaacgaggatcgggccaggtcggcacctacgggcttaacacatttactaatatggaagttcagctgatacgccagatggagtcagaaggaatcttcctcccaagcgagctggagacccccaacttggccgaaagagctttagattggctggagaagcacggtgccgaacggctcaaaaggatggcaatttccggcgacgactgtgtggtaaagccgatcgatgaccgctttgcgacggcccttacagctctgaatgatatggggaaagtgagaaaggacattcctcaatgggagcccagtaaaggatggaacgattggcagcaggtcccattctgctctcaccattttcaccagctaatcatgaaggacggccgggaaatagtggttccttgtaggaatcaagatgagctggtgggtcgagcccgtgtcagccagggggcaggatggtccctcagagagaccgcttgcttgggcaagtcatatgcccagatgtggcaactgatgtacttccatcgccgggaccttaggctggcagccaacgcgatttgtagtgctgtgcccgtagattgggttccaacttctagaacaacctggagcatccacgcccaccatcagtggatgactaccgaagacatgctctccgtgtggaatcgcgtctggatcgaggaaaacccctggatggaggataaaacacacgtgtcaagctgggaagaggttccttatttaggcaagcgggaggaccagtggtgcgggtctctgattggattgacggcaagggccacctgggctactaatatacaggtggccatcaaccaagtccgaagactgattggtaatgaaaactacctcgactacatgacatccatgaaacggtttaagaatgagagtgatccagaaggcgcactttggtga

SEQ ID NO: 13524 - RNA, 9879 nt, synthetic construct
  misc_feature 1..9879: note = derived and/or modified CDS sequence (opt3) from DENV-1__FJ850099__SS-prME
  source 1..9879: mol_type = other RNA
agcgtgaccatgctgctcatgcttctgcccacagccttggctttccacttaactacgagaggcggggagcctcatatgatcgtctccaagcaggaaaggggaaaatctctgctatttaagacctcagcaggtgttaacatgtgcacactcattgccatggacctgggcgagctttgtgaagatactatgacctacaaatgcccacggataacagaggcggaaccggacgatgtggactgttggtgcaatgctaccgatacttgggtaacatatgggacctgtagtcaaacgggagagcaccgccgagacaagcgtagcgtggccctggcaccccatgtcggcttgggtctcgagactagaaccgaaacatggatgtcctctgagggggcctggaaacagatccagagggtggaaacttgggctctgcggcaccctggattcaccgttattgcactgtttctcgcccatgctatcggcacatcgattacccagaagggcatcatattcatcttactgatgcttgtgacgccatcaatggccatgcgctgcgtcgggattggaaacagagattttgtggagggtttgagcggcgcgacttgggtagacgttgtgctggagcacgggagttgtgtcacaaccatggcaaagaataaacccactctagatatcgaactcctgaagacagaggtgaccaaccctgccgtgcttaggaaactgtgcattgaagctaagatctccaatacgaccacagactctcggtgtccaactcaaggagaggccaccttggtcgaagagcaggatgcaaacttcgtttgccgccgaacatttgtggacagaggctggggtaatgggtgtggactcttcggcaaaggcagcctgttaacttgcgctaagtttaagtgcgtaaccaaactggaggggaagatagtgcagtacgaaaacctcaaatattccgtcattgtgacagttcacaccggagatcagcatcaagtgggtaatgagactacggaacacggcacaatcgccaccattactccccaggcgcctacctcagagatccagcttacagactacggggccctgaccttggactgtagtccaaggactggactagatttcaacgaaatggtcctgctcacaatgaaggagaaaagctggctggtgcataagcagtggtttcttgacctgccgttgccctggacgtctggcgcatccacctcacaagagacttggaatcggcaggatctcctggtaacattcaaaaccgctcacgccaagaagcaggaagttgtggtcttaggtagccaagagggggctatgcacacagccctgactggcgcaaccgaaatccagacgagtggaaccacaactatttttgccggccatctaaaatgccgtctcaagatggacaaactgacccttaaggggatgtcttatgtgatgtgtacaggatccttcaaattggagaaggaagtcgctgagactcagcacggtaccgtgctggttcaggtgaagtacgagggcacggatgcgccttgcaaaataccattcagcacacaagacgaaaagggggtaacccagaacggacgcctcatcactgcaaatcccattgtcacagataaagagaagcctgtgaacatcgaaaccgagccaccctttggcgagtcgtatatagttgtgggtgccggggaaaaagctctgaagctttcttggttcaagaaaggctcctcaattggaaagatgtttgaggccactgcaagaggcgccaggcggatggctatcctgggggacaccgcctgggatttcggaagtatcggtggcgtctttacaagcgtggggaaattggtacatcaggtgttcggaacggcatacggcgttctcttttccggtgtctcttggaccatgaagattgggatcggcattctgttaacttggctgggactaaatagccgatcaacaagtctctccatgacctgtatagcggtgggcatggtgacactgtaccttggggtcatggttcaggctgacagcggatgcgtgatcaactggaaaggccgcgaattgaagtgtggttctgggattttcgtgactaacgaggtacacacctggacggaacaatataagtttcaggccgattcaccgaaaagactgagtgcagccatcggaaaggcttgggaggagggcgtctgcggtatcaggagcgccacacggctcgaaaatattatgtggaaacagatatccaacgagctgaatcatatcttactggaaaacgacatgaagttcaccgtggttgtgggcgacgcaaatgggattcttgctcagggaaaaaagatgatccgccctcaacccatggagcacaaatactcttggaagtcgtggggcaaggccaaaattatcggggcggatatacagaacactacctttatcattgacggaccagatacacctgaatgtcccgacggccagagagcctggaatatctgggaggtcgaggattatggtttcgggatttttactaccaacatctggttgaagctcagggacagctacacacagatgtgcgatcaccgtctgatgtccgctgcaataaaagactcaaaggccgtgcatgctgatatgggatattggattgaaagtgagaaaaatgaaacgtggaagctagcccgggcatctttcatcgaggttaagacctgtacttggccaaaaagccacacactgtggtccaacggcgtgctcgaatcagagatgattatccccaagatatacggtggccctatcagccaacataattatcgaccagggtacttcacccagactgcgggaccgtggcacctgggcaaacttgagttggactttgatctgtgcgaagggacaaccgtagtcgtggacgagcactgcggaaacagaggcccctctttaaggacgactaccgtgacaggtaagattatccatgaatggtgttgccgctcctgtaccctccctccactgcggttcagaggggaggatggatgctggtacggcatggagattaggcccgtcaaagaaaaggaggaaaatcttgttcgcagtatggtgagcgccggttctggcgaggtagactccttttcactggggatcttgtgtgtgagtataatgattgaagaggtcatgcgaagccggtggtcgcgtaagatgctcatgactggaacactggctgtgttcctactgctcatcatgggccagctgacctggaacgaccttatcagattgtgcattatggttggggccaatgcatccgataggatgggaatgggcacaacttatctggctttaatggccacctttaaaatgcgccctatgttcgcagtgggtctcctgtttcggagacttacgtctagggaggtcctgctactcacaatcgggctgagcttggtggcctcagttgaactgccaaacagtttagaggaactcggagacggcctggctatgggcattatgatgcttaagctgttgaccgagttccaaccccaccagctctggactaccctgctatccctgacatttgtgaaaactaccctttctctcgattacgcgtggaagacgacagccatggtcctgagcatagtatccttgttcccgctgtgtttatcaaccactagccagaaaacaacctggctccctgtgctgcttgggagttttggatgcaagccactgactatgttcttgatcacagaaaacaagatttggggtcgaaaatcttggcccctcaatgagggcatcatggcaattgggatcgtttccatactgctaagctcgctgcttaagaacgacgtgcctctcgctggacccctgatcgccggcggtatgttgattgcctgttatgtcatctcagggtctagtgctgatttatccctggagaaagcagccgaagtgagctgggagcaggaagcggagcattctggagctagccacaatattctcgtagaagtgcaagacgatggcaccatgaagatcaaagacgaggagcgcgatgacacgctgactatacttctgaaggccaccttgctagcagtctccggcgtttacccaatgtcaattcctgccacactgtttgtgtggtatttctggcagaaaaagaagcagcggagtggggtgctctgggatacccccagcccaccggaagtcgagagagctgtgctggacgatggaatctacaggatccttcagcgtggtttactgggccgctctcaagttggggtaggagtgttccaggacggcgtctttcatacaatgtggcacgtgactcggggtgcagttctcatgtatcaggggaaaagattggaaccttcctgggcctcagtgaagaaagacctgattagttacggaggcggctggaggttccaggggagctggaacaccggagaggaggtccaagtgatagcggtagaacccggtaagaatccaaaaaacgtccagacgacacccggcacttttaagacccctgagggggaagtgggagctatcgccctcgatttcaagccaggcacatccggttctcccattgttaatcgagaggggaaaatcgtgggactgtacggcaacggcgtcgtgaccacttcggggacctatgttagcgcaattgcccaggctaaggcctcacaagaaggacctcttccggagatcgaggacgaagtgtttaaaaagcggaatctgacaataatggatttgcacccaggttccggcaaaacgcgcagatacctacccgcaatcgtcagggaggctattaagcggaagctgcgaactctcatcttagcccctaccagagtggtagcgagtgaaatggccgaggcactgaaagggatgccaattcgctatcagacaaccgctgtgaagtctgaacatactggaagggagatcgttgaccttatgtgccacgccacattcaccatgcgtctgctcagccccgtccgggtgcctaactacaatatgataattatggatgaggctcattttacggacccggcatccatcgccgccagaggctatatctcaactagggtgggtatgggggaagctgcggcaattttcatgacagccacccccccaggatctgtcgaggcttttcctcagagcaacgccgtaatccaggatgaagagcgcgacatacccgaacgaagttggaattccggctacgattggattaccgacttcccaggcaaaactgtgtggtttgttcctagcatcaagtctgggaacgatattgcaaattgtttgagaaaaaacggaaagcgggtgatccaactgtcaaggaagacattcgacaccgagtatcagaaaacaaagaacaatgactgggattacgtcgtgactacggacatatccgagatgggtgccaacttccgcgctgatcgtgttattgaccccagacggtgcctcaaaccagtgatcctgaaggatggcccggaaagggtcatccttgcggggcctatgcccgtgaccgtagccagtgcagctcagcgccgaggaagaattggccggaatcagaacaaagagggtgaccaatacgtgtatatggggcagccactaaataacgatgaagaccacgcccattggacagaggcaaagatgctgttggataatatcaacactcccgagggcattatacctgccttatttgaaccagagagggaaaagagcgctgccatcgacggagagtaccgcctgagaggcgaagcgaggaaaaccttcgttgagctcatgcggcgtggggatctgcccgtctggctttcgtataaggtggcatctgagggatttcagtactccgaccgccgatggtgcttcgatggtgaaagaaataaccaggtgctggaggaaaatatggacgtcgagatttggacaaaagaaggcgagaggaagaaactccggcctcgctggttggacgccagaacctatagcgatccgctggctctaagggagtttaaggaattcgccgctgggcggcgatcagttagtggagacctgatcctcgagatcggcaaacttccacaacacctgactttaagagcacagaacgccttggataatctggtgatgctccacaactctgaacagggtgggaaggcttaccgccatgccatggaggaactgcccgacacgattgagacccttatgctgctcgcattgatagcggtactgacaggcggagtgactttatttttcctatccggcaaggggctgggaaaaaccagcatcggtctcctttgtgtcacagcctcaagtgctctgttgtggatggccagcgtggagcctcactggattgcagcttccatcattctggaatttttcctcatggttctgcttatccccgagccagataggcagcggacccctcaagacaatcagctcgcctatgtggtcataggcctgttgtttatgatcctgactgtagcagccaacgaaatggggttactagagacaacgaagaaagatctgggaattggctacgtggctgcggagaaccatcagcacgccaccatgctcgacgttgatcttcgtcccgcatctgcttggactctgtacgccgtggccacaaccgtcatcaccccaatgatgagacacacaattgaaaatactacggcaaacatcagcttgaccgctatagccaatcaagcggctattctgatgggtctcgacaaggggtggcctatctccaaaatggatattggcgtgccgctgcttgccttaggatgctattcacaggtcaaccccctgacactcactgcagccgtgttgatgctggttgctcattacgcaatcataggcccagggctacaggccaaggcgaccagggaggctcagaagcgcacagccgcaggaatcatgaaaaatcctaccgtggacggcattgtagccatcgatctggaccccgtggtctatgacgctaagttcgaaaaacaactcggtcagattatgcttctgatcttgtgtacttctcagatactgctcatgcggacgacatgggccctgtgcgagagtattaccttagcaactgggccacttaccacactgtgggaaggatcgcctggcaagttttggaacactaccatcgctgttagcatggccaatatcttccgaggttcctacctcgcgggcgccgggctagcattctctctgatgaaatcattgggaggcgggagaaggggaacaggcgctcagggtgagacgctgggggagaagtggaagcgccaactcaaccagcttagcaaatccgaatttaatacctataagcggagtggaattatggaggtggatagatctgaagccaaagagggcctgaagcgtggtgaaactacaaaacacgcagtcagcaggggcaccgctaagttgcggtggttcgtggagcgcaacctggtaaagcccgaggggaaagtgatcgacctcggatgtggccgagggggatggtcatactattgcgccggcttaaagaaagttactgaagtgaagggttacacaaaagggggaccgggccatgaggaaccaatacctatggccacctacggctggaatctggtcaagcttcactccgggaaagatgtgtttttcatgcccccagagaagtgtgacacgctgctatgcgatattggagaaagtagccccaaccctaccatcgaggagggtagaacactcagggtcctgaagatggtggaaccgtggttgaaaggcaatcagttttgtattaagatcctgaacccctatatgccatctgttgtagagactctcgaacagatgcaacggaaacatgggggaatgcttgtgcgcaatcctctgtccagaaactcaacccacgagatgtactgggtcagctgcggcacaggtaatatagtgtcggcggttaacatgacttctaggatgttactgaaccgattcaccatggctcaccggaagcccacatatgagcgtgacgtggatttgggggcaggaaccagacatgtcgccgtggaacctgaggtagctaatctcgacatcattggccagcgcatcgaaaacattaaaaatgagcacaagagtacttggcattacgatgaagacaacccatataagacgtgggcctaccacggctcctatgaggtgaaacccagcgggtcagcatcctctatggttaatggagtcgtgaggctgctaacaaagccttgggatgtgatcccaatggtcacccagattgccatgactgacaccacaccctttggtcaacagcgggttttcaaagagaaggtggacacgagaaccccgcgcgctaaaaggggcactacacagatcatggaagtaaccgcgaagtggctttgggggtttctgagccgaaacaagaaacctcggatatgtactagagaggaattcacaaggaaggtgcgcagtaatgccgcaattggagctgtctttgtggatgagaaccagtggaattccgccaaagaagcagttgaggacgagcgtttctgggatctcgtgcaccgggaaagagagctgcataagcaaggcaaatgcgccacctgcgtctacaacatgatgggtaagagggaaaagaaattgggggagtttggaaaggctaaaggcagccgcgccatctggtacatgtggctgggcgcgcgattcctcgaattcgaggcacttgggtttatgaatgaggaccactggttctctcgggaaaactcactgagtggagtggagggtgaaggcttacataagctggggtatatcttgagagatatttccaaaataccaggaggcaatatgtacgccgacgatacagctggttgggacactaggatcaccgaggatgacctccagaacgaggccaagattacggatatcatggaacccgagcacgcactgctagctaccagcatttttaaacttacatatcagaataaggtagttcgcgtgcagagacctgccaagaacgggactgtcatggacgtgatctctcggagggatcaacgtggatcgggccaggtgggcacctacgggctgaacacattcactaatatggaagtccagctcatacgacagatggagtcagaaggaatctttctgagctccgagttggagaccccaaacttagctgaacgcgttctggactggctcgagaaacatggtgccgaaagacttaagcggatggcaattagtggcgacgattgtgtggtaaaacccatcgacgataggttcgcgacggccctgacagctctaaatgacatggggaaggtgcgcaaagatattccgcaatgggagccttctaagggatggaacgactggcagcaggtccccttttgcagccaccacttccatcagctgatcatgaaggatggcagagaaatagtggttccatgtcggaatcaagacgagctcgtgggtagggcccgagtctcccagggggcaggatggtcattgcgtgagaccgcttgcctgggcaaaagttatgcccagatgtggcaacttatgtactttcacagacgcgatctgcggctcgcagccaacgcgatttgttctgctgtgcctgtagactgggttcccactagcaggacaacctggtccatccatgcccaccaccagtggatgactaccgaagatatgttatcagtgtggaatagagtctggatcgaggaaaacccatggatggaggacaagacacatgtgagctcttgggaagaggttccctatctgggcaaacgcgaggaccagtggtgcgggtccttgattggactgacggcacgggccacctgggctactaatatacaggtggccatcaaccaagtcaggcgactcattggtaatgaaaactaccttgattacatgacaagtatgaagagattcaaaaatgagagcgaccctgaaggcgcactgtggtga

SEQ ID NO: 13525 - RNA, 9879 nt, synthetic construct
  misc_feature 1..9879: note = derived and/or modified CDS sequence (opt3) from DENV-1__FJ850100__SS-prME
  source 1..9879: mol_type = other RNA
agcgtgaccatgctgctcatgcttctgcccacagccttggctttccacttaactacgagaggcggggagcctcatatgatcgtctccaagcaggaaaggggaaaatctctgctatttaagacctcagcaggtgttaacatgtgcacactcattgccatggacctgggcgagctttgtgaagatactatgacctacaaatgcccacggataacagaggcggaaccggacgatgtggactgttggtgcaatgctaccgatacttgggtaacatatgggacctgtagtcaaacgggagagcaccgccgagacaagcgtagcgtggccctggcaccccatgtcggcttgggtctcgagactagaaccgaaacatggatgtcctctgagggggcctggaaacagatccagagggtggaaacttgggctctgcggcaccctggattcaccgttattgcactgtttctcgcccatgctatcggcacatcgattacccagaagggcatcatattcatcttactgatgcttgtgacgccatcaatggccatgcgctgcgtcgggattggaaacagagattttgtggagggtttgagcggcgcgacttgggtagacgttgtgctggagcacgggagttgtgtcacaaccatggcaaagaataaacccactctagatatcgaactcctgaagacagaggtgaccaaccctgccgtgcttaggaaactgtgcattgaagctaagatctccaatacgaccacagactctcggtgtccaactcaaggagaggccaccttggtcgaagagcaggatgcaaacttcgtttgccgccgaacatttgtggacagaggctggggtaatgggtgtggactcttcggcaaaggcagcctgttaacttgcgctaagtttaagtgcgtaaccaaactggaggggaagatagtgcagtacgaaaacctcaaatattccgtcattgtgacagttcacaccggagatcagcatcaagtgggtaatgagactacggaacacggcacaatcgccaccattactccccaggcgcctacctcagagatccagcttacagactacggggccctgaccttggactgtagtccaaggactggactagatttcaacgaaatggtcctgctcacaatgaaggagaaaagctggctggtgcataagcagtggtttcttgacctgccgttgccctggacgtctggcgcatccacctcacaagagacttggaatcggcaggatctcctggtaacattcaaaaccgctcacgccaagaagcaggaagttgtggtcttaggtagccaagagggggctatgcacacagccctgactggcgcaaccgaaatccagacgagtggaaccacaactatttttgccggccatctaaaatgccgtctcaagatggacaaactgacccttaaggggatgtcttatgtgatgtgtacaggatccttcaaattggagaaggaagtcgctgagactcagcacggtaccgtgctggttcaggtgaagtacgagggcacggatgcgccttgcaaaataccattcagcacacaagacgaaaagggggtaacccagaacggacgcctcatcactgcaaatcccattgtcacagataaagagaagcctgtgaacatcgaaaccgagccaccctttggcgagtcgtatatagttgtgggtgccggggaaaaagctctgaagctttcttggttcaagaaaggctcctcaattggaaagatgtttgaggccactgcaagaggcgccaggcggatggctatcctgggggacaccgcctgggatttcggaagtatcggtggcgtctttacaagcgtggggaaattggtacatcaggtgttcggaacggcatacggcgttctcttttccggtgtctcttggaccatgaagattgggatcggcattctgttaacttggctgggactaaatagccgatcaacaagtctctccatgacctgtatagcggtgggcatggtgacactgtaccttggggtcatggttcaggctgacagcggatgcgtgatcaactggaaaggccgcgaattgaagtgtggttctgggattttcgtgactaacgaggtacacacctggacggaacaatataagtttcaggccgattcaccgaaaagactgagtgcagccatcggaaaggcttgggaggagggcgtctgcggtatcaggagcgccacacggctcgaaaatattatgtggaaacagatatccaacgagctgaatcatatcttactggaaaacgacatgaagttcaccgtggttgtgggcgacgcaaatgggattcttgctcagggaaaaaagatgatccgccctcaacccatggagcacaaatactcttggaagtcgtggggcaaggccaaaattatcggggcggatatacagaacactacctttatcattgacggaccagatacacctgaatgtcccgacggccagagagcctggaatatctgggaggtcgaggattatggtttcgggatttttactaccaacatctggttgaagctcagggacagctacacacagatgtgcgatcaccgtctgatgtccgctgcaataaaagactcaaaggccgtgcatgctgatatgggatattggattgaaagtgagaaaaatgaaacgtggaagctagcccgggcatctttcatcgaggttaagacctgtacttggccaaaaagccacacactgtggtccaacggcgtgctcgaatcagagatgattatccccaagatatacggtggccctatcagccaacataattatcgaccagggtacttcacccagactgcgggaccgtggcacctgggcaaacttgagttggactttgatctgtgcgaagggacaaccgtagtcgtggacgagcactgcggaaacagaggcccctctttaaggacgactaccgtgacaggtaagattatccatgaatggtgttgccgctcctgtaccctccctccactgcggttcagaggggaggatggatgctggtacggcatggagattaggcccgtcaaagaaaaggaggaaaatcttgttcgcagtatggtgagcgccggttctggcgaggtagactccttttcactggggatcttgtgtgtgagtataatgattgaagaggtcatgcgaagccggtggtcgcgtaagatgctcatgactggaacactggctgtgttcctactgctcatcatgggccagctgacctggaacgaccttatcagattgtgcattatggttggggccaatgcatccgataggatgggaatgggcacaactcacctggctttaatggccacctttaaaatgcgccctatgttcgcagtgggtctcctgtttcggagacttacgtctagggaggtcctgctactcacaatcgggctgagcttgatggcctcaatggaactgccaaacagtttagaggaactcggagacggcctggctatgggcattatgatgcttaagctgttgaccgagttccaaccccatcagctctggactaccctgctatccctgacatttgtgaaaactaccctttctctcgattatgcgtggaagacgacagccatgatactgagcatcgtttccttgttcccgctgtgtttatcaaccactagccagaaaacaacctggctccctgtgctgcttgggagttttggatgcaagccactgactatgttcttgattacagaaaacaagatctggggtcgaaaatcttggcccctcaatgagggcattatggcaatcgggatagtctccatcctgctaagctcgctgcttaagaacgacgtacctctcgctggacccctgattgccggcggtatgttgatcgcctgttacgtgatttcagggtctagtgctgatttatccctggagaaagcagccgaagttagctgggagcaggaagcggagcactctggagctagccataatatcctcgtggaagtccaagacgatggcaccatgaagataaaagacgaggagcgcgatgacacgctgactattcttctgaaggccaccttgctagcagtgtccggcgtatatccaatgtcaatccctgccacactgtttgtgtggtacttctggcagaaaaagaagcagcggagtggggtcctctgggatacccccagcccaccggaagttgagagagctgtgctggacgatggaatctataggattcttcagcgtggtttactgggccgctctcaagtgggggtcggagtgttccaggacggcgtttttcacacaatgtggcacgtaactcggggtgcagtgctcatgtaccaggggaaaagattggaaccttcctgggcctcagtcaagaaagacctgataagttatggaggcggctggaggttccaggggagctggaacaccggagaggaggtgcaagttatcgcggtggaacccggtaagaatccaaaaaacgtccagacgacacccggcacttttaagacccctgagggggaagtgggagctattgccctcgatttcaagccaggcacatccggttctcccatcgtaaatcgagaggggaaaattgtcggactgtacggcaacggcgtggttaccacttcggggacctacgtgagcgcaatcgcccaggctaaggcctcacaagaaggacctcttccggagatagaggacgaagtctttaaaaagcggaatctgacaatcatggatttgcatccaggttccggcaaaacgcgcagatatctacccgcaattgtgagggaggctatcaagcggaagctgcgaactctcattttagcccctaccagagttgtggcgagtgaaatggccgaggcactgaaagggatgccaatccgctaccagacaaccgctgtcaagtctgaacacactggaagggagatagtggaccttatgtgccatgccacattcaccatgcgtctgctcagccccgtacgggtgcctaactataatatgattatcatggatgaggctcactttacggacccggcatccatcgccgccagaggctacatttcaactagggttggtatgggggaagctgcggcaatcttcatgacagccacccccccaggatctgtcgaggcttttcctcagagcaacgccgtgatacaggatgaagagcgcgacattcccgaacgaagttggaattccggctatgattggatcaccgacttcccaggcaaaactgtgtggtttgtccctagcattaagtctgggaacgatatcgcaaattgtttgagaaaaaacggaaagcgggtaatacaactgtcaaggaagacattcgacaccgagtaccagaaaacaaagaacaatgactgggattatgtggttactacggacatttccgagatgggtgccaacttccgcgctgatcgtgtgatcgaccccagacggtgcctcaaaccagtcatcctgaaggatggcccggaaagggtgattcttgcggggcctatgcccgttaccgtggccagtgcagctcagcgccgaggaagaatcggccggaatcagaacaaagagggtgaccaatacgtctacatggggcagccactaaataacgatgaagaccatgcccactggacagaggcaaagatgctgttggataatattaacactcccgagggcataatccctgccttatttgaaccagagagggaaaagagcgctgccattgacggagagtatcgcctgagaggcgaagcgaggaaaaccttcgtggagctcatgcggcgtggggatctgcccgtatggctttcgtacaaggtggcatctgagggatttcagtattccgaccgccgatggtgcttcgatggtgaaagaaataaccaggttctggaggaaaatatggacgtcgagatctggacaaaagaaggcgagaggaagaaactccggcctcgctggttggacgccagaacctacagcgatccgctggctctaagggagtttaaggaattcgccgctgggcggcgatcagtgagtggagacctgatcctcgagattggcaaacttccacaacacctgactttaagagcacagaacgccttggataatctggtgatgctccataactctgaacagggtgggaaggcttatcgccacgccatggaggaactgcccgacacgatagagacccttatgctgctcgcattgatcgcggtcctgacaggcggagttactttatttttcctatccggcaaggggctgggaaaaaccagcattggtctcctttgtgtgacagcctcaagtaccctgttgtggatggctagcgtagagcctcattggatcgccgcatccattatcctggaatttttcctcatggtgctgcttatacccgagccagataggcagcggactcctcaagacaatcagctcgcttacgtcgtgatcggcctgttgtttatgattctgacagttgccgcaaacgaaatggggttactagagacgaccaagaaagatctgggaatcggctatgtggccgctgagaaccaccagcacgcgactatgctcgacgtcgatcttcgtcccgcctctgcatggacactgtacgctgtagccaccaccgtgattacaccaatgatgagacatactatcgaaaatacgaccgccaacataagcttgacagcaattgctaatcaagccgcgatcctgatgggtctcgacaaggggtggcctatttccaaaatggatatcggcgttccgctgcttgctttaggatgctactcacaggtgaaccccctgactctcaccgccgcagtcttgatgctggtggcccactatgctataatcggcccagggctacaggcaaaggccacaagggaggcgcagaagcgcaccgctgccggaattatgaaaaatcctactgtcgacggcatcgtggcaattgatctggaccccgttgtgtacgacgccaagttcgaaaaacaactcggtcagatcatgcttctgatattgtgtacgtctcagattctgctcatgcggacaacctgggctctgtgcgagagtatcactttagccaccgggccacttacaactctgtgggaaggatcgcctggcaagttttggaacaccacaatcgcagtaagcatggctaatattttccgaggttcctatctcgccggcgcggggctagccttctctctgatgaaatcattgggaggcgggagaaggggaacgggcgcacagggtgagaccctgggggagaagtggaagcgccaactcaaccagcttagcaaatccgaatttaatacttacaagcggagtggaatcatggaggtggatagatctgaagctaaagagggcctgaagcgtggtgaaacaaccaaacatgccgtcagcaggggcactgcaaagttgcggtggttcgttgagcgcaacctggtgaagcccgaggggaaagtcatagacctcggatgtggccgagggggatggtcatattactgcgctggcttaaagaaagtgacagaagtaaagggttataccaaagggggaccgggccacgaggaaccaattcctatggccacgtacggctggaatctggtgaagcttcattccgggaaagatgtttttttcatgcccccagagaagtgtgacaccctgctatgcgatatcggagaaagtagccccaaccctacaattgaggagggtagaactctcagggtgctgaagatggtcgaaccgtggttgaaaggcaatcagttttgtatcaagatactgaacccctacatgccatctgtggtcgagaccctcgaacagatgcaacggaaacacgggggaatgcttgtgcgcaatcctctgtccagaaactcaacacacgagatgtattgggttagctgcggcactggtaatatcgtatcggccgtgaacatgacctctaggatgttactgaaccgattcacaatggcgcatcggaagcccacctacgagcgtgacgtcgatttgggggctggaactagacacgtggcagttgaacctgaggtggccaatctcgacattatcggccagcgcattgaaaacatcaaaaatgagcataagagtacgtggcactatgatgaagacaacccatacaagacatgggcttatcacggctcctacgaggtcaaacccagcgggtcagcctcctctatggtgaatggagtagtgaggctgctaaccaagccttgggatgttattccaatggtcactcagatcgcaatgaccgacacaacgccctttggtcaacagcgggtgttcaaagagaaggtggacaccagaactccgcgcgccaaaaggggcacaacccagataatggaagtcactgctaagtggctttgggggtttctgagccgaaacaagaaacctcggatttgtacaagagaggaattcaccaggaaggttcgcagtaatgcggccatcggagcagtgtttgtagatgagaaccagtggaattccgctaaagaagccgtggaggacgagcgtttctgggatctcgtccatcgggaaagagagctgcacaagcaaggcaaatgcgcaacatgcgtgtataacatgatgggtaagagggaaaagaaattgggggagtttggaaaggccaaaggcagccgcgctatctggtacatgtggctgggcgcccgattcctcgaattcgaggcgcttgggtttatgaatgaggaccattggttctctcgggaaaactcactgagtggagttgagggtgaaggcttacacaagctggggtacattttgagagatatatccaaaatcccaggaggcaatatgtatgcagacgatactgccggttgggacaccaggattacggaggatgacctccagaacgaggctaagatcaccgatattatggaacccgagcatgccctgctagcaacaagcatctttaaacttacttaccagaataaggtggtccgcgtgcagagacctgctaagaacgggaccgtaatggacgttatatctcggagggatcaacgtggatcgggccaggtgggcacatatgggctgaacactttcaccaatatggaagtccagctcatccgacagatggagtcagaaggaatttttctgccaagcgagttggagacgcccaacttagccgaacgcgtgctggactggctcgagaaacacggtgctgaaagacttaagcggatggccatctccggcgacgattgtgtggtcaaaccgattgacgataggttcgcaacagcgctgaccgccctaaatgacatggggaaggttcgcaaagatatccctcaatgggagcccagtaagggatggaacgactggcagcaggtgccattttgctctcaccatttccaccagctgataatgaaggatggcagagaaattgtagtgccttgtcggaatcaagacgagctcgtcggtagggctcgagtgagccagggggccggatggtccttgcgtgagactgcatgcctgggcaaatcatacgctcagatgtggcaacttatgtattttcatagacgcgatctgcggctcgccgcaaacgccatctgtagtgcggttcccgtggactgggtcccaacatctaggaccacttggagcatccacgctcaccatcagtggatgaccacagaagatatgttatccgtgtggaatagagtatggattgaggaaaacccctggatggaggacaagacgcacgtttcaagctgggaagaggtgccttacctgggcaaacgcgaggaccagtggtgcgggtctttgataggactgaccgcccgggcaacttgggccacaaatatccaggtcgctattaaccaagtgaggcgactcatcggtaatgaaaactatcttgattacatgacctccatgaagagattcaaaaatgagagtgacccagaaggcgccctgtggtga

SEQ ID NO: 13526 - RNA, 9879 nt, synthetic construct
  misc_feature 1..9879: note = derived and/or modified CDS sequence (opt3) from DENV-1__FJ882579__SS-prME
  source 1..9879: mol_type = other RNA
agcgtgaccatgctgctcatgcttctgcccacagccttggctttccacttaactacgagaggcggggagcctcatatgatcgtctccaagcaggaaaggggaaaatctctgctatttaagacctcagcaggtgttaacatgtgcacactcattgccatggacctgggcgagctttgtgaagatactatgacctacaaatgcccacggataacagaggcggaaccggacgatgtggactgttggtgcaatgctaccgatacttgggtaacatatgggacctgtagtcaaacgggagagcaccgccgagacaagcgtagcgtggccctggcaccccatgtcggcttgggtctcgagactagaaccgaaacatggatgtcctctgagggggcctggaaacagatccagagggtggaaacttgggctctgcggcaccctggattcaccgttattgcatttttcctggcccatgctatcggcacatcgattacccagaagggcatcatatttatcctcttaatgctggtgacgccatcaatggccatgcgctgcgtcgggattggaaacagagatttcgtggagggtcttagcggcgcgacttgggtagacgttgtgttggagcacgggagttgtgtcacaaccatggcaaagaataaacccactctggatatcgaactactcaagacagaggtgaccaaccctgccgtgctgaggaaactttgcattgaagctaagatctccaatacgaccacagactctcggtgtccaactcaaggagaggccaccctggtcgaagagcaggatgcaaactttgtttgccgccgaacattcgtggacagaggctggggtaatgggtgtggattgtttggcaaaggcagcctcctgacttgcgctaagttcaagtgcgtaaccaaattagaggggaagatagtgcagtacgaaaacctgaaatattccgtcattgtgacagttcacaccggagatcagcatcaagtgggtaatgagactacggaacacggcacaatcgccaccattactccccaggcgcctacctcagagatccagctcacagactacggggcccttaccctggactgtagtccaaggactggattggattttaacgaaatggtcctactgacaatgaaggagaaaagctggctcgtgcataagcagtggttcctggaccttccgctgccctggacgtctggcgcatccacctcacaagagacttggaatcggcaggatttgctcgtaacatttaaaaccgctcacgccaagaagcaggaagttgtggtcctgggtagccaagagggggctatgcacacagccttaactggcgcaaccgaaatccagacgagtggaaccacaactattttcgccggccatctgaaatgccgtctaaagatggacaaactcaccctgaaggggatgtcttatgtgatgtgtacaggatccttcaaacttgagaaggaagtcgctgagactcagcacggtaccgtgttggttcaggtgaagtacgagggcacggatgcgccttgcaaaataccatttagcacacaagacgaaaagggggtaacccagaacggacgcctgatcactgcaaatcccattgtcacagataaagagaagcctgtgaacatcgaaaccgagccacccttcggcgagtcgtatatagttgtgggtgccggggaaaaagctctcaagctgtcttggtttaagaaaggctcctcaattggaaagatgttcgaggccactgcaagaggcgccaggcggatggctatccttggggacaccgcctgggattttggaagtatcggtggcgtcttcacaagcgtggggaaactggtacatcaggtgtttggaacggcatacggcgttttgttctccggtgtctcttggaccatgaagattgggatcggcattctcctgacttggttaggactgaatagccgatcaacaagtctatccatgacctgtatagcggtgggcatggtgacactctacctgggggtcatggttcaggctgacagcggatgcgtgatcaactggaaaggccgcgaacttaagtgtggttctgggatttttgtgactaacgaggtacacacctggacggaacaatataagttccaggccgattcaccgaaaagattgagtgcagccatcggaaaggcttgggaggagggcgtctgcggtatcaggagcgccacacggctggaaaatattatgtggaaacagatatccaacgagctcaatcatatcctgttagaaaacgacatgaagtttaccgtggttgtgggcgacgcaaatgggattctgactcagggaaaaaagatgatccgccctcaacccatggagcacaaatactcttggaagtcgtggggcaaggctaaaattatcggggccgatatacagaacaccacattcatcattgacggaccagatactcctgaatgtcccgacggccagagagcgtggaatatctgggaggtcgaggattatggttttgggattttcaccacaaacatctggcttaagttgagggacagctacacgcagatgtgcgatcaccgtctcatgtccgccgctataaaagactcaaaggcagtgcatgccgatatgggatattggattgaaagtgagaaaaatgaaacctggaagctggctcgggcctctttcatcgaggttaagacttgtacatggccaaaaagccacaccctatggtccaacggcgtgctggaatcagagatgattatccccaagatatacggtggccctatcagccaacataattatcgaccagggtactttactcagacagcaggaccgtggcacctcggcaaactggagcttgacttcgatttgtgcgaagggaccacggtagtcgtggacgagcactgcggaaacagaggcccctctctgaggactaccacagtgaccggtaagattatccatgaatggtgttgccgctcctgtactttacctccactccggtttagaggggaggatggatgctggtacggcatggagattaggcccgtcaaagaaaaggaggaaaatctggttcgcagtatggtgagcgcgggttctggcgaggtagactccttctcacttgggatcctgtgtgtgagtataatgattgaagaggtcatgcgaagccggtggtcgcgtaagatgttgatgacaggaaccctcgccgtgtttctgctactgatcatgggccagctcacatggaacgacctgatcagactttgcattatggttggggctaatgcctccgataggatgggaatgggcactacctatttggcactgatggctacgttcaaaatgcgccctatgtttgccgtgggtttactcttccggagactgacatctagggaggtccttctgctaaccatcgggctcagcctggtggcatcagttgaattgccaaacagtctggaggaattaggagacggcctcgccatgggcattatgatgctgaagcttctgactgagtttcaaccccaccagttgtggaccacactcctgtccctaactttcgtgaaaaccacgctgtctcttgattacgcttggaagacaaccgcgatggtcctcagcatagtatccctgtttccgttgtgtctgtcaactacaagccagaaaaccacttggttacctgtgctcctggggagtttcggatgcaagccacttacaatgtttctgatcaccgaaaacaagatttggggtcgaaaatcttggcccttgaatgagggcatcatggccattgggatcgtttccatactcctgagctcgctactgaagaacgacgtgcctcttgcaggacccctcatcgctggcggtatgctgattgcctgttatgtcatctcagggtctagtgccgatttgttactggagaaagctgcagaagtgtcctgggagcaggaagccgagcatagcggagcgtctcacaatattctcgtagaagtgcaagacgatggcacgatgaagatcaaagacgaggagcgcgatgacactctgaccatacttctgaaggctacattgctagccgtcagcggcgtttacccaatgtccattcctgcaaccctgttcgtgtggtatttctggcagaaaaagaagcagcggtcaggggtgctctgggatacacccagtccaccggaagtcgagagagccgtgctggacgatggaatctacaggatccttcagcgtggtttactgggccgcagccaagttggggtaggagtgtttcaggacggcgtcttccatactatgtggcacgtgacccggggtgctgttctcatgtatcaggggaaaagattggaaccttcttgggcatccgtgaagaaagacctgatttcatacggaggcggctggaggtttcaggggagttggaacacgggagaggaggtccaagtgatagccgtagaacccggtaagaatccaaaaaacgtccagacaactcccggcaccttcaagacacctgagggggaagtgggagcgatcgctctcgattttaagccaggcaccagcggttcccccattgttaatcgagaggggaaaatcgtgggactgtacggcaacggcgtcgtgactacctctgggacatatgtttcggccattgcacaggccaaggctagccaagaaggacctcttccggagatcgaggacgaagtgttcaaaaagcggaatctgacgataatggatttgcacccaggttcaggcaaaactcgcagatacctacccgccatcgtcagggaggcaattaagcggaagctgcgaaccctcatcttagctcctacaagagtggtagcctccgaaatggcggaggccctgaaagggatgccaattcgctatcagaccactgcagtgaagagtgaacatacaggaagggagatcgttgaccttatgtgccacgctacctttacgatgcgtctgctctctcccgtccgggtgcctaactacaatatgataattatggatgaggcccatttcactgacccggctagcatcgcagccagaggctatatctccacaagggtgggtatgggggaagccgctgcgatttttatgaccgcaacccccccaggatcagtcgaggccttccctcagtctaacgctgtaatccaggatgaagagcgcgacatacccgaacgaagctggaatagtggctacgattggattactgactttccaggcaaaacagtgtggttcgttccttccatcaagagcgggaacgatattgccaattgtttgagaaaaaacggaaagcgggtgatccaactgtctaggaagaccttcgacacagagtatcagaaaactaagaacaatgactgggattacgtcgtgacgaccgacatatcagagatgggtgcaaactttcgcgccgatcgtgttattgaccccagacggtgcctcaaaccagtgatcctgaaggatggcccggaaagggtcatccttgctgggcctatgcccgtgacagtagcgtccgccgcacagcgccgaggaagaattggccggaatcagaacaaagagggtgaccaatacgtgtatatggggcagccactaaataacgatgaagaccacgctcattggactgaggccaagatgctgttggataatatcaacacccccgagggcattatacctgcattattcgaaccagagagggaaaagagtgccgctatcgacggagagtaccgcctgagaggcgaagccaggaaaacatttgttgagctcatgcggcgtggggatctgcccgtctggcttagctataaggtggcgtcggagggattccagtactctgaccgccgatggtgctttgatggtgaaagaaataaccaggtgctggaggaaaatatggacgtcgagatttggaccaaagaaggcgagaggaagaaactccggcctcgctggttggacgcaagaacttattccgatccgctggccctaagggagttcaaggaatttgctgccgggcggcgaagcgtttcaggagacctgatcctcgagatcggcaaacttccacaacacctgacgttaagagctcagaacgcattggataatctggtgatgctccacaacagtgaacagggtgggaaggcctaccgccatgctatggaggaactgcccgacaccattgagacacttatgctgctcgccttgatagcagtactgactggcggagtgaccttattctttctatctggcaaggggctgggaaaaacatccatcggtctcctttgtgtcaccgcgagctcagccctgttgtggatggctagtgtggagcctcactggattgccgcaagcatcattctggaattctttctcatggttctgcttatccccgagccagataggcagcggactcctcaagacaatcagctcgcttatgtggtcataggcctgttgttcatgatcctgacagtagccgcaaacgaaatggggttactagagacgaccaagaaagatctgggaattggctacgtggccgctgagaaccatcagcacgcgactatgctcgacgttgatcttcgtcccgcctccgcatggacactgtacgctgtggccaccaccgtcatcacaccaatgatgagacacactattgaaaatacgaccgccaacatctctttgacagcaatagctaatcaagccgcgattctgatgggtctcgacaaggggtggcctatcagcaaaatggatattggcgtgccgctgcttgctttaggatgctattcccaggtcaaccccctgactctcaccgccgcagtgttgatgctggttgcccattacgctatcataggcccagggctacaggcaaaggccacaagggaggcgcagaagcgcaccgctgccggaatcatgaaaaatcctactgtggacggcattgtagcaatcgatctggaccccgtggtctatgacgccaagtttgaaaaacaactcggtcagattatgcttctgatcttgtgtacgtcacagatactgctcatgcggacaacctgggctctgtgcgagtctattactttagccaccgggccacttacaactctgtgggaaggaagtcctggcaagttctggaacaccacaatcgcagtttcgatggctaatatcttccgaggtagctacctcgccggcgcggggctagccttttccctgatgaaatctttgggaggcgggagaaggggaacgggcgcacagggtgagaccctgggggagaagtggaagcgccaactcaaccagctttcaaaaagcgaattcaatacttataagcggtccggaattatggaggtggatagaagtgaagctaaagagggcctgaagcgtggtgaaacaaccaaacacgccgtctctaggggcactgcaaagttgcggtggtttgtggagcgcaacctggtaaagcccgaggggaaagtgatcgacctcggatgtggccgagggggatggagctactattgcgctggcttaaagaaagttacagaagtgaagggttacaccaaagggggaccgggccatgaggaaccaatacctatggccacgtacggctggaatctggtcaagcttcactcagggaaagatgtgttctttatgcccccagagaagtgtgacaccctgctatgcgatattggagaatccagtcccaaccctacaatcgaggagggtagaactctcagggtcctgaagatggtggaaccgtggttgaaaggcaatcagttctgtattaagatcctgaacccctatatgccaagcgttgtagagaccctcgaacagatgcaacggaaacatgggggaatgcttgtgcgcaatcctctgtctagaaactccacacacgagatgtactgggtctcatgcggcactggtaatatagtgagcgccgttaacatgacctcgaggatgttactgaaccgatttacaatggcgcaccggaagcccacctatgagcgtgacgtggatttgggggctggaactagacatgtcgcagtggaacctgaggtagccaatctcgacatcattggccagcgcatcgaaaacattaaaaatgagcacaagtctacgtggcattacgatgaagacaacccatataagacatgggcttaccacggcagttatgaggtgaaaccctccgggagcgcctcatccatggttaatggagtcgtgaggctgctaaccaagccttgggatgtgatcccaatggtcactcagattgcaatgaccgacacaacgcccttcggtcaacagcgggtttttaaagagaaggtggacaccagaactccgcgcgccaaaaggggcacaacccagatcatggaagtaactgctaagtggctttgggggttcctgtctcgaaacaagaaacctcggatatgtacaagagaggaatttaccaggaaggtgcgcagcaatgcggccattggagcagtcttcgtggatgagaaccagtggaatagtgctaaagaagccgttgaggacgagcgtttttgggatctcgtgcaccgggaaagagagctgcataagcaaggcaaatgcgcaacatgcgtctacaacatgatgggtaagagggaaaagaaattgggggagttcggaaaggccaaaggctcccgcgctatctggtacatgtggctgggcgcccgattcctcgaatttgaggcgcttgggttcatgaatgaggaccactggtttagccgggaaaactctctgtcaggagtggagggtgaaggcttacataagctggggtatatcttgagagatattagtaaaataccaggaggcaatatgtacgcagacgatactgccggttgggacaccaggatcacggaggatgacctccagaacgaggctaagattaccgatatcatggaacccgagcacgccctgctagcaacatccattttcaaacttacttatcagaataaggtagttcgcgtgcagagacctgctaagaacgggaccgtcatggacgtgatcagccggagggatcaacgtggatctggccaggtgggcacatacgggctgaacacttttaccaatatggaagtccagctcatacgacagatggagtcggaaggaatcttcctgccatcagagttggagacgcccaacttagccgaacgcgttctggactggctcgagaaacatggtgctgaaagacttaagcggatggccattagcggcgacgattgtgtggtaaaaccgatcgacgataggtttgcaacagcgctgaccgccctaaatgacatggggaaggtgcgcaaagatattcctcaatgggagccctccaagggatggaacgactggcagcaggtcccattctgcagtcaccactttcatcagctgatcatgaaggatggcagagaaatagtggttccttgtcggaatcaagacgagctcgtgggtagggctcgagtctctcagggggccggatggagcttgcgtgagactgcatgcctgggcaaatcctatgctcagatgtggcaacttatgtacttccacagacgcgatctgcggctcgccgcaaacgccatttgttcagcggtgcccgtagactgggttccaacaagtaggaccacttggtctatccatgctcaccaccagtggatgaccacagaagatatgttaagcgtgtggaatagagtctggatcgaggaaaacccctggatggaggacaagacgcatgtgtcctcatgggaagaggttccttatctgggcaaacgcgaggaccagtggtgcgggagcttgattggactgaccgcccgggcaacttgggccacaaatatacaggtggctatcaaccaagtcaggcgactcattggtaatgaaaactaccttgattacatgacctctatgaagagatttaaaaatgagtccgacccagaaggcgccctgtggtga

SEQ ID NO: 13527 - RNA, 9879 nt, synthetic construct
  misc_feature 1..9879: note = derived and/or modified CDS sequence (opt3) from DENV-1__JN819414__SS-prME
  source 1..9879: mol_type = other RNA
agcgtgaccatgctgctcatgcttctgccaacagcattggctttccacttaactacgagaggcggggaacctcatatgatcgtctccaagcaggaaagaggaaaatctctgctatttaagacctcagccggtgttaacatgtgcaccctcattgccatggacctgggcgagctttgtgaagatactatgacctacaaatgcccacggataacagaggcggaaccggacgatgtggactgttggtgcaatgctaccgatacttgggtaacatatgggacctgtagtcagacgggagagcaccgccgagacaagcgtagcgtggccctggcaccccatgtcggcttgggtctcgagactagaaccgaaacatggatgtcctctgagggggcctggaaacagatccagagggtggaaacttgggctctgcggcaccctggattcaccgttattgcactgtttctcgcctacgctatcggcacatcgattacccagaagggcatcatattcatcttactgatgcttgtgacgccatcaatggccatgcgctgcgtcgggattggaaacagagattttgtggagggtttgagcggcgcgacttgggtagacgttgtgctggagcatgggagttgtgtcacaaccatggcaaagaataaacccactctagatatcgaactcctgaagacagaggtgaccaaccctgccgtgcttaggaaactgtgcattgaagctaagatctccaatacgaccacagactctcggtgtccaactcaaggagaggccaccttggtcgaagaacaggatgcaaacttcgtttgccgccgaacatttgtggacagaggctggggtaatgggtgtggactcttcggcaaaggcagcctgttaacttgcgctaagtttaagtgcgtaaccaaactggaggggaagatagtgcagtatgaaaacctcaaatactccgtcattgtgacagttcacaccggagatcagcaccaagtgggtaatgagactacggaacatggcacaatcgccaccattactccccaggcgcctacctcagagatccagcttacagactatggggccctgaccttggactgtagtccaaggactggactagatttcaacgaaatggtcctgctcacaatgaaggagaaaagctggctggtgcacaagcagtggtttcttgacctgccgttgccctggacgtctggcgcatccacctcacaagagacttggaatcggcaggatctcctggtaacattcaaaaccgctcatgccaagaagcaggaagttgtggtcttaggtagccaagagggggctatgcacacagccctgactggcgcaaccgaaatccagacgagtggaaccacaactatttttgccggccacctaaaatgccgtctcaagatggacaaactgacccttaaggggatgtcttacgtgatgtgtacaggatccttcaaattggagaaggaagtcgctgagactcagcatggtaccgtgctggttcaggtgaagtatgagggcacggatgcgccttgcaaaataccattcagcacacaagacgaaaagggggtaacccagaacggacgcctcatcactgcaaatcccattgtcacagataaagagaagcctgtgaacatcgaaaccgagccaccctttggcgagtcgtacatagttgtgggtgccggggaaaaagctctgaaactttcttggttcaagaaaggctcctcaattggaaagatgtttgaggccactgcaagaggcgccaggcggatggctatcctgggggacaccgcctgggatttcggaagtatcggtggcgtctttacaagcgtggggaaattggtacaccaggtgttcggaacggcatacggcgttctcttttccggtgtctcttggaccatgaagattgggatcggcattctgttaacttggctgggactaaatagccgatcaacaagtctctccatgacctgtatagcggtgggcatggtgacactgtatcttggggtcatggttcaggctgacagcggatgcgtgatcaactggaaaggccgcgaattgaagtgtggttctgggattttcgtgactaacgaggtacatacctggacggaacaatacaagtttcaggccgattcaccgaaaagactgagtgcagccatcggaaaggcttgggaggagggcgtctgcggtatcaggagcgccacacggctcgaaaatattatgtggaaacagatatccaacgagctgaatcacatcttactggaaaacgacatgaagttcaccgtggttgtgggcgacgcaaatgggattcttgctcagggcaagaagatgatccgccctcaacccatggagcataaatattcttggaagtcgtggggcaaggccaaaattatcggggcggatatacagaacactacctttatcattgacggaccagatacacctgaatgtcccgacggccagagagcctggaatatctgggaggtcgaggattacggtttcgggatttttactaccaacatctggttgaagctcagggacagctatacacagatgtgcgatcaccgtctgatgtccgctgcaataaaagactcaaaggccgtgcacgctgatatgggatactggattgaaagtgagaaaaatgaaacgtggaagctagcccgggcatctttcatcgaggttaagacctgtacttggccaaaaagccatacactgtggtccaacggcgtgctcgaatcagagatgattatccccaagatatatggtggccctatcagccaacacaattaccgaccagggtacttcacccagactgcgggaccgtggcatctgggcaaacttgagttggactttgatctgtgcgaagggacaaccgtagtcgtggacgagcactgcggaaacagaggcccctctttaaggacgactaccgtgacaggtaagattatccacgaatggtgttgccgctcctgtaccctccctccactgcggttcagaggggaggatggatgctggtatggcatggagattaggcccgtcaaagaaaaggaggaaaatcttgttcgcagtatggtgagcgccggttctggcgaggtagactccttttcactggggatcttgtgtgtgagtataatgattgaagaggtcatgcgaagccggtggtcgcgtaagatgctcatgactggaacactggctgtgttcctactgctcatcatgggccagctgacctggaacgaccttatcagattgtgcattatggttggggccaatgcatccgataggatgggaatgggcacaacttacctggctttaatggccacctttaaaatgcgccctatgttcgcagtgggtctcctgtttcggagacttacgtctagggaggtcctgctactcacaatcgggctgagcttggtggcctcagttgaactgccaaacagtttagaggaactcggagacggcctggctatgggcattatgatgcttaagctgttgaccgagttccaaccccatcagctctggactaccctgctatccctgacatttgtgaaaactaccctttctctcgattatgcgtggaagacgacagccatggtcctgagcatagtatccttgttcccgctgtgtttatcaaccactagccagaaaacaacctggctccctgtgctgcttgggagttttggatgcaagccactgactatgttcttgatcacagaaaacaagatttggggtcgaaaatcttggcccctcaatgagggcatcatggcaattgggatcgtttccatactgctaagctcgctgcttaagaacgacgtgcctctcgctggacccctgatcgccggcggtatgttgattgcctgttacgtcatctcagggtctagtgctgatttactgctcgagaaagcagccgaagtgtcctgggagcaggaagcggagcacagcggagcttctcataatattctggtagaagtgcaagacgatggcaccatgaagatcaaagacgaggagcgcgatgacacgcttactatactgttgaaggccaccctactggcagtcagcggcgtttatccaatgtccattcctgccacactctttgtgtggtacttctggcagaaaaagaagcagcggtcaggggtgctgtgggatacccccagtccaccggaagtcgagagagctgtgcttgacgatggaatctataggatcttacagcgtggtctgctcggccgcagccaagttggggtaggagtgttccaggacggcgtctttcacacaatgtggcatgtgactcggggtgcagttttgatgtaccaggggaaaagactggaaccttcttgggcctccgtgaagaaagacctcatttcatacggaggcggctggaggttccaggggagttggaacaccggagaggaggtccaagtgatagcggtagaacccggtaagaatcccaaaaacgtccagacgacacccggcacttttaagacccctgagggggaagtgggagctatcgccctggatttcaagccaggcacaagcggttcccccattgttaatcgagaggggaaaatcgtgggactttatggcaacggcgtcgtgaccactgggggaacctacgtttctgcaattgcccaggctaaggcctcgcaagaaggtcctctgccggagatcgaggacgaagtgtttaaaaagcggaatttgacaataatggatctacacccaggcagcgggaaaacgcgcagatatctgcccgcaatcgtcagggaggctattaagcggaagctccgaactttaatcctggcccctaccagagtggtagcgtcagaaatggccgaggcacttaaaggaatgccaattcgctaccagacaaccgctgtgaagtccgaacacactggcagggagatcgttgacctgatgtgccatgccacattcaccatgcgtctcttgagtcccgtccgggtgcctaactataatatgataattatggatgaggctcactttacggacccggcatctatcgccgccagaggttacatcagcactagggtggggatgggagaagctgcggcaattttcatgacagccacacccccaggctccgtcgaggcttttcctcagtcaaacgccgtaatccaggatgaagaacgcgacatacccgaacgatcttggaatagcggctatgattggattaccgacttcccagggaaaactgtgtggtttgttcctagtatcaagtccggaaacgatattgcaaattgtctgaggaaaaacggtaagcgggtgatccaactcagcaggaagacattcgacaccgagtaccagaaaacaaagaacaatgactgggattacgtcgtgactacggacatatctgagatgggcgccaacttccgcgctgatcgtgttattgaccccagacggtgcctgaaaccagtgatccttaaggatgggccggaaagggtcatcctagcgggacctatgcccgtgaccgtagcctcagcagctcagcgccgaggcagaattggtcggaatcagaacaaagagggggaccaatatgtgtacatgggccagccactgaataacgatgaagaccatgcccactggacagaggcaaagatgttgttagataatatcaacactcccgagggaattatacctgccctgtttgaaccagagagggaaaagtccgctgccatcgacggcgagtatcgcctcagaggggaagcgaggaaaaccttcgttgagctgatgcggcgtggagatcttcccgtctggctgagttacaaggtggcaagcgagggttttcagtattcggaccgccgatggtgcttcgatggcgaaagaaataaccaggtgctcgaggaaaatatggacgtcgagatttggacaaaagaaggggagaggaagaaattgcggcctcgctggctggacgccagaacctactctgatccgctagctctgagggagtttaaggagttcgccgctggacggcgatccgttagcggcgacctcatccttgagatcggtaaactgccacaacatttaactttgagagcacagaacgccctggataatctcgtgatgctgcacaactcagaacaagggggaaaggcttatcgccacgccatggaggaacttcccgacacgattgagaccctgatgctcttggcactgatagcggtattaacaggaggcgtgactctatttttcctgagtgggaagggactcggtaaaacctctatcggccttctgtgtgtcacagcctccagcgctttgctgtggatggcctcagtggagcctcattggattgcagctagtatcattctcgaatttttcctgatggttcttctcatccccgagccagataggcagcggacccctcaggacaatcagctggcctacgtggtcatagggttgctgtttatgatcttaactgtagcagccaacgaaatgggactactggagacaacgaagaaagatctcggcattggttacgtggctgcggagaaccaccagcatgccaccatgcttgacgttgatctgcgtcccgcaagcgcttggactttgtatgccgtggccacaaccgtcatcaccccaatgatgagacacacaattgaaaatactacggcaaacatctccctgaccgctatagccaatcaagcggctattctcatggggctggacaagggctggcctatctctaaaatggatattggagtgccgcttttagccctgggctgctacagccaggtcaaccccctcacattgactgcagccgtgctgatgctagttgctcactatgcaatcatagggccaggactgcaggccaaggcgaccagggaggctcagaagcgcacagccgcaggcatcatgaaaaatcctaccgtggacggtattgtagccatcgatctcgaccccgtggtctacgacgctaagttcgaaaaacaacttgggcagattatgctgttgatcctgtgtacttcccagatactcctgatgcggacgacatgggccttatgcgagtcaattacccttgcaactggaccactgaccacactctgggaaggctctcctggtaagttttggaacactaccatcgctgttagtatggccaatatcttccgaggctcgtatctagcgggggccggactggcattcagcttgatgaaatccctgggcgggggaagaaggggcacaggtgctcagggggagacgctcggagagaagtggaagcgccaacttaaccagctgtctaaatcagaatttaatacctacaagcggagcggcattatggaggtggatagatccgaagccaaagagggtttgaagcgtggcgaaactacaaaacatgcagtcagtagggggaccgctaagctgcggtggttcgtggagcgcaacctcgtaaagcccgagggaaaagtgatcgacttaggctgtgggcgaggaggctggtcttattactgcgccggtctgaagaaagttactgaagtgaaggggtacacaaaaggaggcccgggccacgaggaaccaatacctatggccacctatgggtggaatcttgtcaagctgcatagcggaaaagatgtgtttttcatgcccccagagaagtgtgacacgctactctgcgatattggtgaatcatcccccaaccctaccatcgaggagggcagaacactgagggtcttgaagatggtggaaccgtggctgaaagggaatcagttttgtattaagatcctcaacccctacatgccaagtgttgtagagactcttgaacagatgcaacggaaacacggaggcatgctggtgcgcaatcctttaagcagaaactctacccatgagatgtattgggtctcctgcggtacagggaatatagtgtcagcggttaacatgactagcaggatgctgttgaaccgattcaccatggctcaccggaagcccacatacgagcgtgacgtggatctcggagcaggcaccagacacgtcgccgtggaacctgaggtagctaatctggacatcattggccagcgcatcgaaaacattaaaaatgagcataagtcgacttggcactatgatgaagacaacccatacaagacgtgggcctatcatgggtcttacgaggtgaaacccagtggatccgcaagctcaatggttaatggtgtcgtgaggctacttacaaagccttgggatgtgatcccaatggtcacccagattgccatgactgacaccacaccctttggccaacagcgggttttcaaagagaaggtggacacgagaaccccgcgcgctaaaagggggactacacagatcatggaagtaaccgcgaagtggctgtggggatttctctcccgaaacaagaaacctcggatatgtactagagaggagttcacaaggaaggtgcgctctaatgccgcaattggcgctgtctttgtggatgagaaccagtggaataccgccaaagaagcagttgaggacgagcgtttctgggatctggtgcaccgggaaagagagttgcacaagcaaggtaaatgcgccacatgcgtctacaacatgatggggaagagggaaaagaaactgggagagtttggcaaggctaaaggcagccgcgccatctggtatatgtggctcggggcgcgattccttgagttcgaggcactgggatttatgaatgaggaccattggttcagtcgggaaaactccttaagcggtgtggagggcgaagggctgcacaagttgggatacatcctcagagatatttctaaaataccaggcggtaatatgtatgccgacgatactgctgggtgggacaccaggatcacggaggatgacctgcagaacgaggccaagattaccgatatcatggaacccgagcatgcactacttgctacatcaatttttaaactgacttaccagaataaggtagttcgcgtgcagagacctgccaagaacggaaccgtcatggacgtgatcagtcggagggatcaacgtggctccggccaggtggggacatatggactcaacactttcaccaatatggaagtccagctgatacgacagatggagagcgaaggtatctttttgccatctgagttagagacgcccaacctggctgaacgcgccctcgactggcttgagaaacacggcgcagaaagactgaagcggatggcgatttcgggggacgattgtgttgtgaaaccgatcgacgataggttcgccacagctctaaccgccctgaatgacatgggaaaggtacgcaaagatattcctcaatgggagccctcaaagggctggaacgactggcaacaggtgccattttgcagccatcacttccaccagctcatcatgaaggatggtagagaaatagtcgtgccttgtcggaatcaagacgagttggttgggagggcacgagtgtcccagggagctggctggagtctgcgtgagactgcctgccttggcaaatcttacgcacagatgtggcaactgatgtattttcatagacgcgatctccggttagccgcgaacgctatttgtagcgccgtccccgtggactgggtaccaacatccaggaccacttggtcaatccacgcacatcaccagtggatgaccacagaagatatgctgagtgtttggaatagagtgtggatcgaggaaaacccctggatggaggacaagacgcacgtctctagctgggaagaggtgccttacttggggaaacgcgaggaccagtggtgcggatccctgattggtctcaccgcccgggctacttgggccacaaatatacaggttgcaatcaaccaagtgaggcgacttattggcaatgaaaactacctggattatatgacctcaatgaagagattcaaaaatgagagcgacccagaaggggctctatggtga

SEQ ID NO: 13528 - RNA, 9879 nt, synthetic construct
  misc_feature 1..9879: note = derived and/or modified CDS sequence (opt3) from DENV-1__FJ873810__SS-prME
  source 1..9879: mol_type = other RNA
agcgtgaccatgctgctcatgcttctgcccacagccttggctttccacttaactacgagaggcggggagcctcatatgatcgtctccaagcaggaaaggggaaaatctctgctatttaagacctcagttggtgtgaacatgtgcacactcattgcaatggacctgggcgagctttgtgaagatactatgacctacaaatgcccacggataacagaggccgaaccggacgatgtagactgttggtgcaatgcgaccgatacttgggtgacatatgggacctgtagtcaaacgggagagcaccgccgagagaagcgtagcgtcgctctggccccccatgtgggcttgggtctcgaaactagaaccgagacatggatgtcctctgaaggggcatggaaacagatccagagggttgagacttgggccctgcggcaccctggattcaccgtgattgcttttttcctggcacatgccatcggcacatcgattacccagaagggcatcatatttatcctcttaatgctggtcacgccatcaatggctatgcgctgcgtggggattggaaacagagacttcgtagagggtcttagcggcgccacttgggttgatgtggtcttggaacacgggagttgtgtgacaaccatggcgaagaataaacccactctggacatcgagctactcaagacagaagtgaccaaccctgcagtcctgaggaaactttgcattgaggccaagatctccaatacgaccacagattctcggtgtccaactcaaggagaagctaccctggttgaggagcaggacgccaactttgtgtgccgccgaacattcgtagatagaggctggggtaatgggtgtggattgtttggcaaaggcagcctcctgacttgcgcaaagttcaagtgcgtgaccaaattagaagggaagatagtccagtacgagaacctgaaatattccgtgattgttacagtgcacaccggagaccagcatcaagtcggtaatgaaactacggagcacggcacaatcgctaccattactccccaggcccctacctcagaaatccagctcacagattacggggcgcttaccctggactgtagtccaaggactggattggactttaacgagatggtgctactgacaatgaaggagaaaagctggctcgtacataagcagtggttcctggatcttccgctgccctggacgtctggcgcctccacctcacaagaaacttggaatcggcaggacttgctcgttacatttaaaaccgcacacgctaagaagcaggaggtggtcgtgctgggtagccaagaaggggccatgcacacagctttaactggcgccaccgagatccagacgagtggaaccacaactattttcgcaggccatctgaaatgccgtctaaagatggataaactcaccctgaaggggatgtcttatgtcatgtgtacaggatccttcaaacttgaaaaggaggtggccgagactcagcacggtaccgttttggtgcaggtaaagtacgaaggcacggacgctccttgcaaaataccatttagcacacaagatgagaagggggtcacccagaacggacgcctgatcactgcgaatcccattgtgacagacaaagaaaagcctgttaacatcgagaccgagccacccttcggcgaatcgtatatagtggtcggtgcaggggagaaagccctcaagctgtcttggtttaagagaggctcctcaattggaaaaatgttcgaagctactgccaggggcgcacggcgaatggccatccttggggataccgcttgggactttggaagtatcggtggcgtgttcacaagcgtagggaagctggtgcatcaggtttttggaacggcctacggcgtcttgttctccggtgtgtcttggaccatgaaaattgggatcggcattctcctgacttggttaggactgaatagccgctcaacaagtctatccatgacctgtatagcagtgggcatggtcacactctacctgggggttatggtgcaggcggatagcggatgcgtgatcaactggaagggcagagagcttaaatgtggttctgggatttttgtaactaacgaagtccacacctggacggagcaatataagttccaggctgactcaccgaagaggttgagtgccgcaatcggaaaagcctgggaggaaggcgtgtgcggtatccggagcgctacacgcctggagaatattatgtggaagcagatatccaacgaactcaatcatatcctgttagagaacgatatgaaatttaccgttgtggtcggcgacgccaatgggattctggcacagggaaagaaaatgatcagacctcaacccatggaacacaagtactcttggaaatcgtggggcaaggctaagattatcggggccgacatacagaacactaccttcatcattgatggaccagacacacctgagtgtcccgatggccagagggcgtggaatatctgggaggtggaagactatggttttggggttttcactaccaacatttggcttaaattgcgtgatagctacacacagatgtgcgaccaccggctcatgtccgccgctatcaaggattcaaaagcagtgcatgccgacatgggatattggatagagagtgaaaagaatgagacgtggaaactggctcgagcctctttcattgaagtaaagacctgtacttggccaaagagccacacactatggtccaacggcgtcctggagtcagagatgatcattcccaaaatctacggtggccctataagccaacataattatagaccagggtactttacccagactgcaggaccgtggcacctcggcaagctggaacttgatttcgacttgtgcgaggggacaaccgtggtggtcgatgaacactgcggaaacaggggcccctctctgcgcacgactaccgttacaggtaaaatcattcatgagtggtgttgccggtcctgtaccttacctccactcagatttaggggggaggacggatgctggtacggcatggaaatccgccccgtgaaggagaaagaagagaatctggtacgaagtatggtgagcgcgggttctggcgaagtcgattccttctcacttgggattctgtgtgtgagtatcatgatagaggaggttatgcggagccgttggtcgagaaagatgttgatgactggaacactcgccgtgtttctgctactgattatgggccagctcacctggaacgacctgatcaggctttgcatcatggtcggggctaatgcctccgaccgcatgggaatgggcacaacttatttggcactgatggctaccttcaagatgcggcctatgtttgccgtgggtttactcttcagaaggctgacgtctcgagaagttcttctgctaacaattgggctcagcctggtggcatcagtcgagttgccaaacagtctggaagagttaggagatggcctcgccatgggcatcatgatgctgaaacttctgaccgaatttcaaccccaccagttgtggactaccctcctgtccctaacattcgtaaagactaccctgtctcttgactacgcttggaaaacgacagcgatggtgctcagcattgtttccctgtttccgttgtgtctgtcaaccactagccagaagacaacctggttacctgtgctcctggggagtttcggatgcaaaccacttactatgtttctgataacagagaacaagatctggggtcgcaagtcttggcccttgaatgagggcattatggccatcgggattgtctccatcctcctgagctcgctactgaaaaacgatgtgcctcttgcaggacccctcatagctggcggtatgctgatcgcctgttatgtaatttcagggtctagtgccgacttgtccttagaaaaggctgcagaggtgagctgggaacaggaggccgaacattctggagcgagccacaatatcctggtcgaggttcaagatgacggcaccatgaaaattaaggatgaggaacgggacgatacgctcactatcctgcttaaagctaccctgttggccgtgtccggcgtgtacccaatgtcaatacctgcaacactattcgtctggtatttctggcagaagaaaaagcagagaagtggggtgctgtgggacacccccagcccaccggaggttgaaagggccgtactcgatgacggaatttaccgtatcctgcagcgcggtcttttaggccggtctcaagtgggggtcggagtgtttcaggatggcgttttccatacaatgtggcacgtgactagaggtgctgtcctgatgtatcaggggaagaggctcgagccttcctgggcatcagtgaaaaaggacttgatcagttacggaggcggctggcgatttcaggggagctggaacaccggagaggaagtacaagtcattgccgtggagcccggtaaaaatccaaagaacgttcagacgacacccggcactttcaaaacccctgaaggggaggtgggagcgatagctctggactttaagccaggcacatccggttctcccatcgtcaatcgggaagggaagattgtgggactctacggcaacggcgttgtgaccacttcggggacctatgtcagcgccatcgcacaggccaaagcttcacaagagggacctctgccggagattgaagatgaggtgttcaagaaacgcaatcttacaatcatggacctgcacccaggttccggcaagacgagaaggtacttgcccgccatagtacgggaagcaatcaaacgaaagctaagaactctgattctcgctcctacccgcgtggttgccagtgagatggcggaagccttaaaggggatgccaatcaggtatcagacaaccgcagtcaaatctgagcatactggacgtgagattgtggatctgatgtgccacgctacatttaccatgcggcttctgagccccgtgagagtccctaactacaatatgatcataatggacgaagcccatttcacggatccggcttccattgcagccaggggctatatctcaactcgcgtaggtatgggggaggccgctgcgatctttatgacagcaacccccccaggatctgtggaagccttccctcagagcaacgctgttattcaggacgaggaacgagatatccccgagagaagttggaattccggctacgactggataaccgattttccaggcaagactgtgtggttcgtccctagcattaaatctgggaacgacatcgccaattgtctccggaagaacggaaaaagggtgattcaattgtcacgcaagacattcgataccgagtatcagaagacaaaaaacaatgactgggactacgttgtgactacggatatctccgaaatgggtgcaaactttcgtgccgacagagtcatagatccccggaggtgcctgaagccagtgattctcaaagacggcccggagcgcgtaatcctggctgggcctatgcccgtgaccgttgcgagtgccgcacagcgaagaggacggatcggcaggaatcagaacaaggaaggtgatcaatacgtctatatggggcagccacttaataacgacgaggatcacgctcattggacagaggccaaaatgctactggacaatattaacactcccgaaggcatcattcctgcattgttcgagccagaacgcgagaagagcgccgctatagatggagaatacagattaaggggcgaggcccggaagacctttgtggagctgatgcgtcgcggggacctccccgtgtggctgtcgtataaagtcgcgtctgaaggattccagtactccgatcgaagatggtgctttgacggtgagaggaataaccaggttcttgaagagaatatggatgtggaaatctggacaaaggagggcgagcggaaaaagctgcgccctagatggctcgacgcaaggacctatagcgacccgttggccctgcgggaattcaaagagtttgctgccgggcgaagatcagtaagtggagatctaattctggaaatcggcaagctcccacaacaccttactctgcgcgctcagaacgcattagacaatttggtgatgctgcacaactctgagcagggtgggaaagcctacaggcatgctatggaagagctccccgatacgatcgagaccctgatgcttctggccctcattgcagtcttgacaggcggagtgactctgttctttttatccggcaaggggctaggaaagaccagcataggtctgctctgtgttacagcgtcaagtgcccttctgtggatggctagcgtggaacctcactggatcgccgcatccattatcttggagttctttctgatggtcctcctgattcccgaaccagaccggcagcgtacccctcaagataatcagcttgcttatgtagtgatcggcctcctgttcatgatattgactgttgccgcaaacgagatggggctgttagagacaacgaaaaaggacctaggaatcggctacgtggccgctgaaaaccatcagcacgcgaccatgctggatgtcgacctccaccccgcctctgcatggactctttacgctgtggccacaaccgtcattaccccaatgatgagacatacaatcgagaatactacggccaacattagcctgaccgcaatcgctaatcaagccgcgatattgatgggtctggataaagggtggcctatttccaagatggacatcggcgtgccgctcctggctcttggatgctattcacaggttaaccccttaacactgactgccgcagtgctcatgttggtagcccactacgctattatcggcccagggctgcaggcaaaagccaccagggaagcgcagaagcgcacagctgccggaataatgaagaatcctaccgtggatggcatcgtcgcaattgacctagatcccgttgtgtatgacgccaaatttgagaagcaactgggtcagatcatgctccttattctgtgtacttctcagatcttgctgatgcggacgacatgggctctctgcgaaagtataaccctggccactgggccattaaccacactttgggagggatcgcctggcaaattctggaacactaccattgcagtcagcatggctaatatcttccgaggttcctacctggccggcgcggggctcgccttttctctaatgaagtcactgggaggcgggagaaggggaacaggcgcacagggtgagacgttgggggaaaaatggaagcgccaactgaaccagctcagcaagtccgagttcaatacctataaacggagtggaatcatggaagtggacagatctgaggctaaggaaggccttaaacgtggtgagactacaaagcatgccgtaagcaggggcaccgcaaaactgcggtggtttgtggagcgcaacttggttaagcccgaagggaaggtgattgatctgggatgtggccgagggggatggtcatactattgcgctggcctcaaaaaggtcactgaggtgaaaggttacacaaaggggggaccgggccacgaagagccaatccctatggccacctacggctggaatttagtcaaactgcattccgggaaggacgtgttctttatgcccccagaaaaatgtgatacgcttctgtgcgacataggagagagtagccccaaccctaccattgaggaaggtagaacactaagggttctcaagatggtagagccgtggctgcggggcaatcagttctgtatcaagattttgaacccctatatgccatctgtggtcgaaactctggagcagatgcaacgcaaacacgggggaatgctcgtgagaaatcctctttccaggaactcaacccacgagatgtactgggttagctgcggcacaggtaatatcgtgtcggccgtcaacatgacttctcgaatgctgttaaaccggtttaccatggcgcatcgtaagcccacatatgaaagagatgtggacctgggggctggaacccgccacgtagcagtggagcctgaagttgccaatttggatataatcggccagaggattgagaacatcaaaaatgaacataagagtacttggcactacgacgaggataacccatataaaacgtgggcttaccacggctcctatgaggtcaagcccagcgggtcagcctcctctatggtgaatggagtggtccggctcctgacaaagccttgggacgttattccaatggtgacccagatcgcaatgactgataccacacccttcggtcaacagagagtatttaaagaaaaggtggacacgcgcaccccgagggccaaacgaggcactacacagattatggaggtcaccgctaagtggctatgggggttccttagccggaacaaaaagcctagaatctgtactagggaagagtttacacgcaaggtgcgtagtaatgcggccataggagcagttttcgtggacgaaaaccagtggaattccgctaaagaggccgtcgaggatgaacggttttgggacctggtgcatagagagagggaactccacaagcaaggcaaatgcgcaacctgcgtatacaacatgatgggtaagcgcgagaaaaagctgggggaattcggaaaggccaaaggcagccgagctatttggtacatgtggttgggcgcccggttcctggagtttgaggcgctcgggttcatgaatgaagatcattggttttctagagagaactcacttagtggagttgaaggtgagggcctgcacaagttagggtatatcctgagggacatctccaaaattccaggaggcaatatgtacgcagatgacacagccggttgggatactcgcataaccgaggacgatttgcagaacgaagctaagatcacggacattatggagcccgaacatgccctcctggcaaccagcatcttcaaactaacatatcagaataaggtggtcagagtgcagcggcctgctaaaaacgggactgtgatggatgtcatttctaggcgtgaccaacgaggatcgggccaggttggcacctacgggcttaacacatttactaatatggaggtgcagctgatccgccagatggaatcagagggaatattcctcccaagcgagctggaaacccccaacttggccgagagagctttagattggctggaaaagcacggtgccgagcggctcaagaggatggcaatctccggcgacgactgtgtagtgaaaccgattgatgaccgctttgcgacggcccttacagctctgaatgatatggggaaggtcagaaaagacatccctcaatgggaacccagtaagggatggaacgattggcagcaggtgccattctgctctcaccattttcaccagctaattatgaaagacggccgggagatcgttgtgccttgtaggaatcaagatgagctggtcggtcgagcccgtgtgagccagggggcaggatggtccctcagagaaaccgcttgcttgggcaagtcatatgcccagatgtggcaactgatgtacttccatcgccgggaccttaggctggcagccaacgcgatatgtagtgctgtacccgttgattgggtgccaacttctagaacaacctggagcattcacgcccaccatcagtggatgactaccgaggacatgctctccgtctggaatcgcgtgtggatcgaagagaacccctggatggaagataagacacacgtttcaagctgggaggaggtgccttatttaggcaaacgggaagaccagtggtgcgggtctctgatcggattgacggcaagggccacctgggctactaatattcaggtcgccataaaccaagtgcgaagactgatcggtaatgagaactacctcgactacatgacatccatgaagcggtttaaaaatgaaagtgatccagagggcgcactttggtga

SEQ ID NO: 13529 - RNA, 9879 nt, synthetic construct
  misc_feature 1..9879: note = derived and/or modified CDS sequence (opt3) from DENV-1__FJ850103__SS-prME
  source 1..9879: mol_type = other RNA
agcgtgaccatgctgctcatgcttctgcccacagccttggctttccacttaactacgagaggcggggagcctcatatgatcgtctccaagcaggaaaggggaaaatctctgctatttaagacctcagcaggtgttaacatgtgcacactcattgccatggacctgggcgagctttgtgaagatactatgacctacaaatgcccacggataacagaggcggaaccggacgatgtggactgttggtgcaatgctaccgatacttgggtaacatatgggacctgtagtcaaacgggagagcaccgccgagagaagcgtagcgtggccctggcaccccatgtcggcttgggtctcgaaactagaaccgagacatggatgtcctctgaaggggcctggaaacagatccagagggtggagacttgggctctgcggcaccctggattcaccgttattgcatttttcctggcccatgctatcggcacatcgattacccagaagggcatcatatttatcctcttaatgctggtgacgccatcaatggccatgcgctgcgtcgggattggaaacagagacttcgtggagggtcttagcggcgcgacttgggtagatgttgtgttggaacacgggagttgtgtcacaaccatggcaaagaataaacccactctggacatcgagctactcaagacagaagtgaccaaccctgccgtgctgaggaaactttgcattgaggctaagatctccaatacgaccacagattctcggtgtccaactcaaggagaagccaccctggtcgaggagcaggacgcaaactttgtttgccgccgaacattcgtggatagaggctggggtaatgggtgtggattgtttggcaaaggcagcctcctgacttgcgctaagttcaagtgcgtaaccaaattagaagggaagatagtgcagtacgagaacctgaaatattccgtcattgtgacagttcacaccggagaccagcatcaagtgggtaatgaaactacggagcacggcacaatcgccaccattactccccaggcgcctacctcagaaatccagctcacagattacggggcccttaccctggactgtagtccaaggactggattggactttaacgagatggtcctactgacaatgaaggagaaaagctggctcgtgcataagcagtggttcctggatcttccgctgccctggacgtctggcgcatccacctcacaagaaacttggaatcggcaggacttgctcgtaacatttaaaaccgctcacgccaagaagcaggaggttgtggtcctgggtagccaagaaggggctatgcacacagccttaactggcgcaaccgagatccagacgagtggaaccacaactattttcgccggccatctgaaatgccgtctaaagatggataaactcaccctgaaggggatgtcttatgtgatgtgtacaggatccttcaaacttgaaaaggaggtcgctgagactcagcacggtaccgtgttggttcaggtgaagtacgaaggcacggacgcgccttgcaaaataccatttagcacacaagatgagaagggggtaacccagaacggacgcctgatcactgcaaatcccattgtcacagacaaagaaaagcctgtgaacatcgagaccgagccacccttcggcgaatcgtatatagttgtgggtgccggggagaaagctctcaagctgtcttggtttaagagaggctcctcaattggaaaaatgttcgaagccactgcaaggggcgcccggcgaatggctatccttggggataccgcctgggactttggaagtatcggtggcgtcttcacaagcgtggggaagctggtacatcaggtgtttggaacggcatacggcgttttgttctccggtgtctcttggaccatgaaaattgggatcggcattctcctgacttggttaggactgaatagccgctcaacaagtctatccatgacctgtatagcggtgggcatggtgacactctacctgggggtcatggttcaggctgatagcggatgcgtgatcaactggaagggcagagagcttaaatgtggttctgggatttttgtgactaacgaagtacacacctggacggagcaatataagttccaggccgactcaccgaagaggttgagtgcagccatcggaaaagcttgggaggaaggcgtctgcggtatccggagcgccacacgcctggagaatattatgtggaagcagatatccaacgaactcaatcatatcctgttagagaacgatatgaaatttaccgtggttgtgggcgacgcaaatgggattctggctcagggaaagaaaatgatcagacctcaacccatggaacacaagtactcttggaaatcgtggggcaaggccaagattatcggggcggacatacagaacactaccttcatcattgatggaccagacacacctgagtgtcccgatggccagagggcctggaatatctgggaggtcgaagactatggttttggggtgttcactaccaacatttggcttaaattgcgtgatagctacacacagatgtgcgaccaccggctcatgtccgctgcaatcaaggattcaaaagccgttcatgctgacatgggatattggatagagagtgaaaagaatgagacgtggaaactggcccgagcatctttcattgaagtgaagacctgtatctggccaaagagccacactctatggtccaacggcgtactggagtcagagatgattatccccaaaatatacggtggccctatcagccaacataattatagaccagggtactttacacagaccgcgggaccgtggcacctcggcaagctggaacttgatttcgacttgtgcgaggggactacagtcgtggtggatgaacactgcggaaacaggggcccctctctgcgcaccacgactgtcaccggtaaaattatccatgagtggtgttgccggtcctgtacattacctccactcagatttaggggggaggacggatgctggtacggcatggaaattcgccccgttaaggagaaagaagagaatctggtgcgaagtatggtaagcgccggttctggcgaagtggattccttctcacttgggatcctgtgtgtcagtataatgattgaggaggtgatgcggagccgttggtcgagaaagatgttgatgaccggaactctcgctgtttttctgctactgatcatgggccagctcacatggaacgacctgatcaggctttgcattatggtgggggccaatgcatccgaccgcatgggaatgggcaccacatatttggctctgatggccactttcaagatgcggcctatgtttgcagtcggtttactcttcagaaggctgacctctcgagaagtgcttctgctaacgatcgggctcagcctggttgcctcagtggagttgccaaacagtctggaagagttaggagatggcctcgctatgggcattatgatgctgaaacttctgacagaatttcaaccccaccagttgtggaccactctcctgtccctaaccttcgtcaagacaactctgtctcttgactacgcgtggaaaaccacggccatggtactcagcatagtgtccctgtttccgttgtgtctgtcaacaaccagccagaagactacatggttacctgttctcctggggagtttcggatgcaaaccacttaccatgtttctgatcactgagaacaagatttggggtcgcaagtcttggcccttgaatgagggcatcatggcaattgggatcgtgtccatactcctgagctcgctactgaaaaacgatgtccctcttgctggacccctcatcgccggcggtatgctgattgcctgttatgtgatctcagggtctagtgctgacttgtccttagaaaaggcagccgaggtaagctgggaacaggaggcggaacattctggagctagccacaatattctggtggaggtccaagatgacggcacaatgaaaatcaaggatgaggaacgggacgataccctcacgatactgcttaaagccactctgttggcagtttccggcgtgtacccaatgtcaattcctgccaccctattcgtgtggtatttctggcagaagaaaaagcagagaagtggggtcctgtgggacacacccagcccaccggaggtggaaagggctgttctcgatgacggaatctaccgtatcctgcagcgcggtcttttaggccggtctcaagtaggggtgggagtctttcaggatggcgtgttccataccatgtggcacgttacaagaggtgcagtgctgatgtatcaggggaagaggctcgagccttcctgggcctcagtcaaaaaggacttgattagttacggaggcggctggcgatttcaggggagctggaacactggagaggaagtgcaagtaatagcggtcgagcccggtaaaaatccaaagaacgtgcagaccacgcccggcacattcaaaactcctgaaggggaggttggagctatcgccctggactttaagccaggcacctccggttctcccattgtgaatcgggaagggaagatcgtcggactctacggcaacggcgtggttacaacctcggggacttatgtgagcgcaattgcccaggctaaagcctcacaagagggacctctgccggagatcgaagatgaggtcttcaagaaacgcaatcttaccataatggacctgcacccaggttccggcaagacaagaaggtacttgcccgcaatcgtgcgggaaagtattaaacgaaagctaagaacgctgatcctcgctcctactcgcgtagtggcctctgagatggcggaagccttaaaggggatgccaattaggtatcagaccacagcagttaaaagcgagcataccggacgtgagatcgtcgatctgatgtgccacgctacttttacaatgcggcttctgtcccccgtgagagtgcctaactacaatatgataattatggacgaagcccatttcaccgatccggcttcaatcgcagccaggggctatatctctacgcgcgtcggtatgggggaggccgctgcgatttttatgactgcaacacccccaggaagcgtagaagccttccctcagagtaacgctgtgatccaggacgaggaacgagatatacccgagagatcctggaatagcggctacgactggattaccgattttccaggcaagaccgtttggttcgtgccttctatcaaatcagggaacgacattgccaattgtctccggaagaacggaaaaagggtcatccaattgtcccgcaagactttcgatacagagtatcagaagaccaaaaacaatgactgggactacgtggttacaactgatataagtgaaatgggtgcaaactttcgtgccgacagagtgattgatccccggaggtgcctgaagccagtcatcctcaaagacggcccggagcgcgtgatcctggctgggcctatgcccgtaacggtggcgagcgccgcacagcgaagaggacggattggcaggaatcagaacaaggaaggtgatcaatacgtttatatggggcagccacttaataacgacgaggatcacgctcattggaccgaggccaaaatgctactggacaatatcaacacacccgaaggcattatacctgcattgttcgagccagaacgcgagaagtcggccgctatcgatggagaatacagattaaggggcgaggcccggaagacttttgtcgagctgatgcgtcgcggggacctccccgtgtggctgtcttataaagtggcgtccgaaggattccagtacagcgatcgaagatggtgctttgacggtgagaggaataaccaggtccttgaagagaatatggatgttgaaatttggaccaaggagggcgagcggaaaaagctgcgccctagatggctcgacgcaaggacatattcagacccgttggccctgcgggaattcaaagagtttgctgccgggcgaagaagtgtgtctggagatctaatcctggaaatcggcaagctcccacaacaccttaccctgcgcgctcagaacgcattagacaatttggtaatgctgcacaactccgagcagggtgggaaagcctacaggcatgctatggaagagctccccgatactattgagacgctgatgcttctggccctcatagcagtgttgaccggcggagtcacactgttctttttaagcggcaaggggctaggaaagacttcaatcggtctgctctgtgtgaccgcgagtagcgcccttctgtggatggcttccgttgaacctcactggattgccgcatctatcattttggagttctttctgatggtgctcctgatccccgaaccagaccggcagcgtacacctcaagataatcagcttgcttatgtcgtaataggcctcctgttcatgatcttgaccgtggccgcaaacgagatggggctgttagagactacaaaaaaggacctaggaattggctacgttgccgctgaaaaccatcagcacgcgacgatgctggatgtggacctccaccccgccagcgcatggaccctttacgctgtcgccactacagtgatcaccccaatgatgagacataccattgagaatacaactgccaacatctccctgacggcaatagctaatcaagccgcgattttgatgggtctggataaagggtggcctatctcaaagatggacattggcgtcccgctcctggctcttggatgctattctcaggtgaaccccttaaccctgacagccgcagttctcatgttggtggcccactacgctatcataggcccagggctgcaggcaaaagccactagggaagcgcagaagcgcaccgctgccggaatcatgaagaatcctacagtagatggcattgtggcaatcgacctagatcccgtcgtttatgacgccaaatttgagaagcaactgggtcagattatgctccttatcctgtgtaccagtcagatattgctgatgcggactacgtgggctctctgcgaatcgattacactggccaccgggccattaactaccctttgggagggaagccctggcaaattctggaacacaactatcgcagtgtccatggctaatatcttccgaggttcttacctggccggcgcggggctcgccttttcactaatgaagagcctgggaggcgggagaaggggaaccggcgcacagggtgagacattgggggaaaaatggaagcgccaactgaaccagctctccaagagtgagttcaatacgtataaacggtctggaattatggaagtcgacagaagcgaggctaaggaaggccttaaacgtggtgagaccactaagcatgccgtgtcaaggggcacagcaaaactgcggtggtttgtagagcgcaacttggtgaagcccgaagggaaggttatcgatctgggatgtggccgagggggatggtcctactattgcgctggcctcaaaaaggtgaccgaggtcaaaggttacactaaggggggaccgggccacgaagagccaatacctatggccacatacggctggaatttagtgaaactgcatagtgggaaggacgtcttctttatgcccccagaaaaatgtgatacccttctgtgcgacattggagagagctctcccaaccctacgatcgaggaaggtagaaccctaagggtgctcaagatggttgagccgtggctgcggggcaatcagttctgtattaagatcttgaacccctatatgccatccgtagtggaaacactggagcagatgcaacgcaaacacgggggaatgctcgtcagaaatcctctttcaaggaacagcactcacgagatgtactgggtgtcgtgcggcaccggtaatatagtttctgccgtgaacatgacaagtcgaatgctgttaaaccggtttactatggcgcatcgtaagcccacctatgaaagagatgtcgacctgggggctggaacacgccacgtggcagtagagcctgaagtggccaatttggatatcattggccagaggatcgagaacattaaaaatgaacataagtccacctggcactacgacgaggataacccatataaaacttgggcttaccacggcagctatgaggttaagccctcagggtccgcctctagcatggtcaatggagtggtgaagctcctgacgaaaccttgggacgtcatcccaatggttacacagattgcaatgaccgatactacccccttcggtcaacagcgggtgtttaaggaaaaagtagacacaagaacgccgcgcgccaagaggggcaccactcagatcatggaggtgacagctaaatggctatgggggttccttagtcgaaacaagaagcctcggatatgtaccagagaagagtttactaggaaagtccgctccaatgcggccattggagcagtgttcgttgacgaaaaccagtggaatagcgctaaggaggccgtggaggatgaacgtttttgggacctggtccatcgggagagagaactccacaaacaaggcaagtgcgcaacatgcgtgtacaacatgatgggtaaaagggagaagaagctgggggaattcggaaaagccaagggctctcgcgctatctggtacatgtggttgggcgcccgattcctggagtttgaggcgctcgggttcatgaatgaagatcattggttttcacgggagaacagtctttccggagtagaaggtgagggcctgcacaaattagggtatatcctgagagacattagcaagataccaggaggcaatatgtacgcagatgacaccgccggttgggatacaaggatcactgaggacgatttgcagaacgaagctaaaattaccgacatcatggagcccgaacatgccctcctggcaacgtctattttcaagctaacctatcagaataaagttgtgcgcgtccagagacctgctaagaacgggacagtgatggatgtgatctcgcggagggaccaacgtggatcaggccaggtcggcacttacgggcttaacacctttacaaatatggaggttcagctgatacgacagatggaaagcgagggaatcttcctcccatccgagctggaaactcccaacttggccgagcgcgctttagattggctggaaaagcacggtgccgagagactcaaacggatggcaattagtggcgacgactgtgtggtaaagccgatcgatgacaggtttgcgaccgcccttacggctctgaatgatatggggaaagtgcgcaaggacattcctcaatgggaaccctctaaaggatggaacgattggcagcaggtcccattctgcagccaccattttcaccagctaatcatgaaggacggcagagagatagtggttccttgtcggaatcaagatgagctggtgggtagggcccgagtctcccagggggcaggatggtcactccgtgaaacagcttgcttgggcaagagttatgcccagatgtggcaactgatgtacttccatagacgcgaccttcggctggcagccaacgcgatttgttctgctgtgcccgtagattgggttccaaccagcaggactacatggtccatccacgcccaccatcagtggatgaccactgaggacatgctctcagtgtggaatagagtctggatcgaagagaacccctggatggaagataaaacccacgtgagctcttgggaggaggttccttatttaggcaagcgcgaagaccagtggtgcgggtccctgattggattgacagcacgggccacgtgggctaccaatatacaggtggccatcaaccaagtcaggcgactgattggtaatgagaactacctcgactacatgactagtatgaaaagatttaagaatgaaagcgatccagagggcgcactttggtga

SEQ ID NO: 13530 - RNA, 9879 nt, synthetic construct
  misc_feature 1..9879: note = derived and/or modified CDS sequence (opt3) from DENV-1__FJ850104__SS-prME
  source 1..9879: mol_type = other RNA
agcgtgaccatgctgctcatgcttctgcccacagccttggctttccacttaactacgagaggcggggagcctcatatgatcgtctccaagcaggaaaggggaaaatctctgctatttaagacctcagcaggtgttaacatgtgcacactcattgccatggacctgggcgagctttgtgaagatactatgacctacaaatgcccacggataacagaggcggaaccggacgatgtggactgttggtgcaatgtaaccgatacttgggtgacatatgggacctgtagtcaaacgggagagcaccgccgagacaagcgtagcgtcgctctggccccccatgtgggcttgggtctcgagactagaaccgaaacatggatgtcctctgagggggcatggaaacagatccagagggttgaaacttgggccctgcggcaccctggattcaccgtgattgctctgtttctcgcacatgccatcggcacatcgattacccagaagggcatcatattcatcttactgatgcttgtcacgccatcaatggctatgcgctgcgtggggattggaaacagagattttgtagagggtttgagcggcgccacttgggttgacgtggtcctggagcacgggagttgtgtgacaaccatggcgaagaataaacccactctagatatcgaactcctgaagacagaggtgaccaaccctgcagtccttaggaaactgtgcattgaagccaagatctccaatacgaccacagactctcggtgtccaactcaaggagaggctaccttggttgaagagcaggatgccaacttcgtgtgccgccgaacatttgtagacagaggctggggtaatgggtgtggactcttcggcaaaggcagcctgttaacttgcgcaaagtttaagtgcgtgaccaaactggaggggaagatagtccagtacgaaaacctcaaatattccgtgattgttacagtgcacaccggagatcagcatcaagtcggtaatgagactacggaacacggcacaatcgctaccattactccccaggcccctacctcagagatccagcttacagactacggggcgctgaccttggactgtagtccaaggactggactagatttcaacgaaatggtgctgctcacaatgaaggagaaaagctggctggtacataagcagtggtttcttgacctgccgttgccctggacgtctggcgcctccacctcacaagagacttggaatcggcaggatctcctggttacattcaaaaccgcacacgctaagaagcaggaagtggtcgtgttaggtagccaagagggggccatgcacacagctctgactggcgccaccgaaatccagacgagtggaaccacaactatttttgcaggccatctaaaatgccgtctcaagatggacaaactgacccttaaggggatgtcttatgtcatgtgtacaggatccttcaaattggagaaggaagtggccgagactcagcacggtaccgttctggtgcaggtaaagtacgagggcacggatgctccttgcaaaataccattcagcacacaagacgaaaagggggtcacccagaacggacgcctcatcactgcgaatcccattgtgacagataaagagaagcctgttaacatcgaaaccgagccaccctttggcgagtcgtatatagtggtcggtgcaggggaaaaagccctgaagctttcttggttcaagaaaggctcctcaattggaaagatgtttgaggctactgccagaggcgcaaggcggatggccatcctgggggacaccgcttgggatttcggaagtatcggtggcgtgtttacaagcgtagggaaattggtgcatcaggttttcggaacggcctacggcgtcctcttttccggtgtgtcttggaccatgaagattgggatcggcattctgttaacttggctgggactaaatagccgatcaacaagtctctccatgacctgtatagcagtgggcatggtcacactgtaccttggggttatggtgcaggcggacagcggatgcgtgatcaactggaaaggccgcgaattgaagtgtggttctgggattttcgtaactaacgaggtccacacctggacggaacaatataagtttcaggctgattcaccgaaaagactgagtgccgcaatcggaaaggcctgggaggagggcgtgtgcggtatcaggagcgctacacggctcgaaaatattatgtggaaacagatatccaacgagctgaatcatatcttactggaaaacgacatgaagttcaccgttgtggtcggcgacgccaatgggattcttgcacagggaaaaaagatgatccgccctcaacccatggagcacaaatactcttggaagtcgtggggcaaggctaaaattatcggggccgatatacagaacactacctttatcattgacggaccagatacacctgaatgtcccgacggccagagagcgtggaatatctgggaggtggaggattatggtttcgggatttttactaccaacatctggttgaagctcagggacagctacacacagatgtgcgatcaccgtctgatgtccgccgctataaaagactcaaaggcagttcatgccgatatgggatattggattgaaagtgagaaaaatgaaacgtggaagctagctcgggcctctttcatcgaggtgaagacctgtacttggccaaaaagccacacactgtggtccaacggcgtactcgaatcagagatgattatccccaagatatacggtggccctatcagccaacataatcaccgaccagggtatttcacccagactgcaggaccgtggcacctgggcaaacttgagttggactttgatctgtgcgaagggacaaccgtcgtggtggacgagcattgcggaaacagaggcccctctttaaggacgactaccgtcacaggtaagattatccacgaatggtgttgccgctcctgtaccctccctccactgcggttcagaggggaggatggatgctggtacggcatggagattaggcccgttaaagaaaaggaggaaaatcttgtgcgcagtatggtaagcgcgggttctggcgaggtggactccttttcactggggatcttgtgtgtcagtataatgattgaagaggtgatgcgaagccggtggtcgcgtaagatgctcatgactggaacactggccgttttcctactgctcatcatgggccagctgacctggaacgaccttatcagattgtgcattatggtgggggctaatgcctccgataggatgggaatgggcacaacttacctggcattaatggctacctttaaaatgcgccctatgttcgccgtcggtctcctgtttcggagacttacgtctagggaggtgctgctactcacaatcgggctgagcttggttgcatcagtggaactgccaaacagtttagaggaactcggagacggcctggccatgggcattatgatgcttaagctgttgaccgagttccaaccccatcagctctggactaccctgctatccctgacatttgtcaaaactaccctttctctcgattatgcttggaagacgacagcgatggtactgagcatagtgtccttgttcccgctgtgtttatcaaccactagccagaaaacaacctggctccctgttctgcttgggagttttggatgcaagccactgactatgttcttgatcacagaaaacaagatttggggtcgaaaatcttggcccctcaatgagggcatcatggccattgggatcgtgtccatactgctaagctcgctgcttaagaacgacgtccctctcgcaggacccctgatcgctggcggtatgttgattgcctgttacgtgatctcagggtctagtgccgatttatccctggagaaagctgcagaagtaagctgggagcaggaagccgagcactctggagcgagccataatattctcgtggaagtccaagacgatggcaccatgaagatcaaagacgaggagcgcgatgacacgctgactatacttctgaaggctaccttgctagccgtttccggcgtgtatccaatgtcaattcctgcaacactgtttgtgtggtacttctggcagaaaaagaagcagcggagtggggtcctctgggatacccccagcccaccggaagtggagagagccgttctggacgatggaatctataggatccttcagcgtggtttactgggccgctctcaagtaggggtgggagtcttccaggacggcgtgtttcacacaatgtggcacgttactcggggtgctgtgctcatgtaccaggggaaaagattggaaccttcctgggcatcagtcaagaaagacctgattagttatggaggcggctggaggttccaggggagctggaacaccggagaggaggtgcaagtaatagccgtcgaacccggtaagaatccaaaaaacgtgcagacgacacccggcacttttaagacccctgagggggaagttggagcgatcgctctcgatttcaagccaggcacatccggttctcccattgtgaatcgagaggggaaaatcgtcggactgtacggcaacggcgtggttaccacttcggggacctacgtgagcgccattgcacaggccaaggcttcacaagaaggacctcttccggagatcgaggacgaagtctttaaaaagcggaatctgacaataatggatttgcatccaggttccggcaaaacgcgcagatatctacccgccatcgtgagggaggcaattaagcggaagctgcgaactctcatcttagctcctaccagagtagtggccagtgaaatggcggaggccctgaaagggatgccaattcgctaccagacaaccgcagttaagtctgaacacactggaagggagatcgtcgaccttatgtgccatgctacattcaccatgcgtctgctcagccccgtgcgggtgcctaactataatatgataattatggatgaggcccactttacggacccggcttccatcgcagccagaggctacatctcaactagggtcggtatgggggaagccgctgcgattttcatgacagcaacccccccaggatctgtagaggcctttcctcagagcaacgctgtgatccaggatgaagagcgcgacatacccgaacgaagttggaattccggctatgattggattaccgacttcccaggcaaaactgtttggtttgtgcctagcatcaagtctgggaacgatattgccaattgtttgagaaaaaacggaaagcgggtcatccaactgtcaaggaagacattcgacaccgagtaccagaaaacaaagaacaatgactgggattatgtggttactacggacatatccgagatgggtgcaaacttccgcgccgatcgtgtgattgaccccagacggtgcctcaaaccagtcatcctgaaggatggcccggaaagggtgatccttgctgggcctatgcccgtaaccgtggcgagtgccgcacagcgccgaggaagaattggccggaatcagaacaaagagggtgaccaatacgtttacatggggcagccactaaataacgatgaagaccatgctcactggacagaggccaagatgctgttggataatatcaacactcccgagggcattatacctgcattatttgaaccagagagggaaaagagcgccgctatcgacggagagtatcgcctgagaggcgaagccaggaaaaccttcgtcgagctcatgcggcgtggggatctgcccgtgtggctttcgtacaaggtggcgtctgagggatttcagtattccgaccgccgatggtgcttcgatggtgaaagaaataaccaggtcctggaggaaaatatggacgttgagatttggacaaaagaaggcgagaggaagaaactccggcctcgctggttggacgcaagaacctacagcgatccgctggccctaagggagtttaaggaattcgctgccgggcggcgatcagtgagtggagacctgatcctcgagatcggcaaacttccacaacacctgactttaagagctcagaacgcattggataatctggtaatgctccataactctgaacagggtgggaaggcctatcgccacgctatggaggaactgcccgacacgattgagacccttatgctgctcgccttgatagcagtgctgacaggcggagtcactttatttttcctatccggcaaggggctgggaaaaaccagcatcggtctcctttgtgtgacagcgtcaagtgccctgttgtggatggctagcgttgagcctcattggattgccgcatccatcattctggaatttttcctcatggtgctgcttatccccgagccagataggcagcggacccctcaagacaatcagctcgcttacgtcgtaataggcctgttgtttatgatcctgactgtggccgcaaacgaaatggggttactagagacaacgaagaaagatctgggaattggctatgttgccgctgagaaccaccagcacgcgaccatgctcgacgtggatcttcgtcccgcctctgcatggactctgtacgctgtcgccacaaccgtgatcaccccaatgatgagacatacaattgaaaatactacggccaacatcagcttgaccgcaatagctaatcaagccgcgattctgatgggtctcgacaaggggtggcctatctccaaaatggatattggcgtcccgctgcttgctttaggatgctactcacaggtgaaccccctgacactcactgccgcagttttgatgctggtggcccactatgctatcataggcccagggctacaggcaaaggccaccagggaggcgcagaagcgcacagctgccggaatcatgaaaaatcctaccgtagacggcattgtggcaatcgatctggaccccgtcgtttacgacgccaagttcgaaaaacaactcggtcagattatgcttctgatcttgtgtacttctcagatactgctcatgcggacgacatgggctctgtgcgagagtattaccttagccactgggccacttaccacactgtgggaaggatcgcctggcaagttttggaacactaccatcgcagtgagcatggctaatatcttccgaggttcctatctcgccggcgcggggctagccttctctctgatgaaatcattgggaggcgggagaaggggaacaggcgcacagggtgagacgctgggggagaagtggaagcgccaactcaaccagcttagcaaatccgaatttaatacctacaagcggagtggaattatggaggtcgatagatctgaagctaaagagggcctgaagcgtggtgaaactacaaaacatgccgtgagcaggggcaccgcaaagttgcggtggttcgtagagcgcaacctggtgaagcccgaggggaaagttatcgacctcggatgtggccgagggggatggtcatattactgcgctggcttaaagaaagtgactgaagtcaagggttatacaaaagggggaccgggccacgaggaaccaatacctatggccacctacggctggaatctggtgaagcttcattccgggaaagatgtctttttcatgcccccagagaagtgtgacacgctgctatgcgatattggagaaagtagccccaaccctaccatcgaggagggtagaacactcagggtgctgaagatggttgaaccgtggttgcggggcaatcagttttgtattaaaatcctgaacccctacatgccatctgtagtggagactctcgaacagatgcaacgcaagcacgggggaatgcttgtcagaaatcctctgtccaggaactcaacccacgagatgtattgggtgagctgcggcacaggtaatatagtttcggccgtgaacatgacttctcgaatgttactgaaccggttcaccatggcgcatcgtaaacccacatacgagagagacgtcgatttgggggctggaacccgccacgtggcagtagaacctgaggaagccaatctcgacatcattggccagaggatcgagaacattaagaatgaacataaaagtacttggcactatgatgaggacaacccatacaagacgtgggcttatcacggctcctacgaggtgaagcccagcgggtcagcctcctctatggttaatggagtcgtgcggctgctaacaaaaccttgggatgtgatcccaatggtcacccagattgcaatgactgacaccacaccctttggtcaacagagagttttcaaggaaaaagtggacacgcgcaccccgagggccaagcgaggcactacacagatcatggaggtaaccgctaaatggctttgggggtttctgagccggaacaagaagcctagaatatgtactagggaagagttcacacgcaaagtgcgtagtaatgcggccattggagcagtctttgtggatgaaaaccagtggaattccgctaaggaggccgttgaggacgaacggttctgggatctcgtgcatagagagagggaactgcacaaacaaggcaagtgcgcaacctgcgtctataacatgatgggtaaacgcgagaagaagttgggggaatttggaaaagccaagggcagccgagctatctggtacatgtggctgggcgcccggttcctcgagttcgaggcgcttgggtttatgaatgaagaccattggttctctagagagaactcactgagtggagtggaaggtgagggcttacacaaactggggtacatcttgagggatatttccaagataccaggaggcaatatgtatgcagacgatacagccggttgggacactcgcatcaccgaggatgacctccagaacgaagctaaaattacggatatcatggagcccgaacatgccctgctagcaaccagcatttttaagcttacataccagaataaagtagttagagtgcagcggcctgctaagaacgggactgtcatggacgtgatctctaggcgtgatcaacgaggatcgggccaggtgggcacctatgggctgaacacattcactaatatggaggtccagctcatacgccagatggaatcagagggaatctttctgccaagcgagttggaaacccccaacttagccgagagagttctggactggctcgaaaagcacggtgctgagcggcttaaaaggatggccatttccggcgacgattgtgtggtaaagccgatcgacgatcgcttcgcaacggcgctgacagccctaaatgacatggggaaagtgagaaaggatattcctcaatgggaacccagtaaaggatggaacgactggcagcaggtcccattttgctctcaccatttccaccagctgatcatgaaggatggccgggagatagtggttccttgtaggaatcaagacgagctcgtgggtcgagctcgtgtcagccagggggccggatggtccttgagagaaaccgcatgcctgggcaagtcatacgctcagatgtggcaacttatgtattttcatcgccgggatctgaggctcgccgcaaacgccatttgtagtgcggtgcccgtagactgggttccaacttctagaacaacctggagcatccacgctcaccatcagtggatgactaccgaggatatgttatccgtgtggaatcgcgtctggatcgaagagaacccctggatggaagacaaaacacacgtgtcaagctgggaggaggttccttacctgggcaagcgggaagaccagtggtgcgggtctttgattggactgacggccagggcaacctgggccactaatatacaggtggctatcaaccaagtccgaagactcattggtaatgagaactatcttgattacatgacatccatgaaacggttcaagaatgaaagtgacccagagggcgccctgtggtga

SEQ ID NO: 13531 - RNA, 9879 nt, synthetic construct
  misc_feature 1..9879: note = derived and/or modified CDS sequence (opt3) from DENV-1__JN819405__SS-prME
  source 1..9879: mol_type = other RNA
agcgtgaccatgctgctcatgcttctgcccacagccttggctttccacttaactacgagaggcggggagcctcatatgatcgtctccaagcaggaaaggggaaaatctctgctatttaagacctcagcaggtgttaacatgtgcacactcattgccatggacctgggcgagctttgtgaagatactatgacctacaaatgcccacggataacagaggcggaaccggacgatgtggactgttggtgcaatgctaccgatacttgggtaacatatgggacctgtagtcaaacgggagagcaccgccgagacaagcgtagcgtggccctggcaccccatgtcggcttgggtctcgagactagaaccgaaacatggatgtcctctgagggggcctggaaacagatccagagggtggaaacttgggctctgcggcaccctggattcaccgttattgcactgtttctcgcccatgctatcggcacatcgattacccagaagggcatcatattcatcttactgatgcttgtgacgccatcaatggccatgcgctgcgtcgggattggaaacagagattttgtggagggtttgagcggcgcgacttgggtagacgttgtgctggagcacgggagttgtgtcacaaccatggcaaagaataaacccactctagatatcgaactcctgaagacagaggtgaccaaccctgccgtgcttaggaaactgtgcattgaagctaagatctccaatacgaccacagactctcggtgtccaactcaaggagaggccaccttggtcgaagagcaggatgcaaacttcgtttgccgccgaacatttgtggacagaggctggggtaatgggtgtggactcttcggcaaaggcagcctgttaacttgcgctaagtttaagtgcgtaaccaaactggaggggaagatagtgcagtacgaaaacctcaaatattccgtcattgtgacagttcacaccggagatcagcatcaagtgggtaatgagactacggaacacggcacaatcgccaccattactccccaggcgcctacctcagagatccagcttacagactacggggccctgaccttggactgtagtccaaggactggactagatttcaacgaaatggtcctgctcacaatgaaggagaaaagctggctggtgcataagcagtggtttcttgacctgccgttgccctggacgtctggcgcatccacctcacaagagacttggaatcggcaggatctcctggtaacattcaaaaccgctcacgccaagaagcaggaagttgtggtcttaggtagccaagagggggctatgcacacagccctgactggcgcaaccgaaatccagacgagtggaaccacaactatttttgccggccatctaaaatgccgtctcaagatggacaaactgacccttaaggggatgtcttatgtgatgtgtacaggatccttcaaattggagaaggaagtcgctgagactcagcacggtaccgtgctggttcaggtgaagtacgagggcacggatgcgccttgcaaaataccattcagcacacaagacgaaaagggggtaacccagaacggacgcctcatcactgcaaatcccattgtcacagataaagagaagcctgtgaacatcgaaaccgagccaccctttggcgagtcgtatatagttgtgggtgccggggaaaaagctctgaagctttcttggttcaagaaaggctcctcaattggaaagatgtttgaggccactgcaagaggcgccaggcggatggctatcctgggggacaccgcctgggatttcggaagtatcggtggcgtctttacaagcgtggggaaattggtacatcaggtgttcggaacggcatacggcgttctcttttccggtgtctcttggaccatgaagattgggatcggcattctgttaacttggctgggactaaatagccgatcaacaagtctctccatgacctgtatagcggtgggcatggtgacactgtaccttggggtcatggttcaggctgacagcggatgcgtgatcaactggaaaggccgcgaattgaagtgtggttctgggattttcgtgactaacgaggtacacacctggacggaacaatataagtttcaggccgattcaccgaaaagactgagtgcagccatcggaaaggcttgggaggagggcgtctgcggtatcaggagcgccacacggctcgaaaatattatgtggaaacagatatccaacgagctgaatcatatcttactggaaaacgacatgaagttcaccgtggttgtgggcgacgcaaatgggattcttgctcagggaaaaaagatgatccgccctcaacccatggagcacaaatactcttggaagtcgtggggcaaggccaaaattatcggggcggatatacagaacactacctttatcattgacggaccagatacacctgaatgtcccgacggccagagagcctggaatatctgggaggtcgaggattatggtttcgggatttttactaccaacatctggttgaagctcagggacagctacacacagatgtgcgatcaccgtctgatgtccgctgcaataaaagactcaaaggccgtgcatgctgatatgggatattggattgaaagtgagaaaaatgaaacgtggaagctagcccgggcatctttcatcgaggttaagacctgtacttggccaaaaagccacacactgtggtccaacggcgtgctcgaatcagagatgattatccccaagatatacggtggccctatcagccaacataattatcgaccagggtacttcacccagactgcgggaccgtggcacctgggcaaacttgagttggactttgatctgtgcgaagggacaaccgtagtcgtggacgagcactgcggaaacagaggcccctctttaaggacgactaccgtgacaggtaagattatccatgaatggtgttgccgctcctgtaccctccctccactgcggttcagaggggaggatggatgctggtacggcatggagattaggcccgtcaaagaaaaggaggaaaatcttgttcgcagtatggtgagcgccggttctggcgaggtagactccttttcactggggatcttgtgtgtgagtataatgattgaagaggtcatgcgaagccggtggtcgcgtaagatgctcatgactggaacactggctgtgttcctactgctcatcatgggccagctgacctggaacgaccttatcagattgtgcattatggttggggccaatgcatccgataggatgggaatgggcacaactcacctggctttaatggccacctttaaaatgcgccctatgttcgcagtgggtctcctgtttcggagacttacgtctagggaggtcctgctactcacaatcgggctgagcttgatggcctcaatggaactgccaaacagtttagaggaactcggagacggcctggctatgggcattatgatgcttaagctgttgaccgagttccaaccccatcagctctggactaccctgctatccctgacatttgtgaaaactaccctttctctcgattatgcgtggaagacgacagccatgatactgagcatcgtttccttgttcccgctgtgtttatcaaccactagccagaaaacaacctggctccctgtgctgcttgggagttttggatgcaagccactgactatgttcttgattacagaaaacaagatctggggtcgaaaatcttggcccctcaatgagggcattatggcaatcgggatagtctccatcctgctaagctcgctgcttaagaacgacgtacctctcgctggacccctgattgccggcggtatgttgatcgcctgttacgtgatttcagggtctagtgctgatttatccctggagaaagcagccgaagttagctgggagcaggaagcggagcactctggagctagccataatatcctcgtggaagtccaagacgatggcaccatgaagataaaagacgaggagcgcgatgacacgctgactattcttctgaaggccaccttgctagcagtgtccggcgtatatccaatgtcaatccctgccacactgtttgtgtggtacttctggcagaaaaagaagcagcggagtggggtcctctgggatacccccagcccaccggaagttgagagagctgtgctggacgatggaatctataggattcttcagcgtggtttactgggccgctctcaagtgggggtcggagtgttccaggacggcgtttttcacacaatgtggcacgtaactcggggtgcagtgctcatgtaccaggggaaaagattggaaccttcctgggcctcagtcaagaaagacctgataagttatggaggcggctggaggttccaggggagctggaacaccggagaggaggtgcaagttatcgcggtggaacccggtaagaatccaaaaaacgtccagacgacacccggcacttttaagacccctgagggggaagtgggagctattgccctcgatttcaagccaggcacatccggttctcccatcgtaaatcgagaggggaaaattgtcggactgtacggcaacggcgtggttaccacttcggggacctacgtgagcgcaatcgcccaggctaaggcctcacaagaaggacctcttccggagatagaggacgaagtctttaaaaagcggaatctgacaatcatggatttgcatccaggttccggcaaaacgcgcagatatctacccgcaattgtgagggaggctatcaagcggaagctgcgaactctcattttagcccctaccagagttgtggcgagtgaaatggccgaggcactgaaagggatgccaatccgctaccagacaaccgctgtcaagtctgaaactacaggaagggagatagtggaccttatgtgccacgccaccttcacgatgcgtctgctcagccccgtacgggtgcctaactataatatgattatcatggatgaggctcattttactgacccggcatccatcgccgccagaggctacatttcaacaagggttggtatgggggaagctgcggcaatcttcatgaccgccacccccccaggatctgtcgaggcttttcctcagagcaacgccgtgatacaggatgaagagcgcgacattcccgaacgaagttggaattccggctatgattggatcactgacttcccaggcaaaacagtgtggtttgtccctagcattaagtctgggaacgatatcgcaaattgtttgagaaaaaacggaaagcgggtaatacaactgtcaaggaagaccttcgacacagagtaccagaaaactaagaacaatgactgggattatgtggttacgaccgacatttccgagatgggtgccaacttccgcgctgatcgtgtgatcgaccccagacggtgcctcaaaccagtcatcctgaaggatggcccggaaagggtgattcttgcggggcctatgcccgttacagtggccagtgcagctcagcgccgaggaagaatcggccggaatcagaacaaagagggtgaccaatacgtctacatggggcagccactaaataacgatgaagaccacgcccattggactgaggcaaagatgctgttggataatattaacacccccgagggcataatccctgccttatttgaaccagagagggaaaagagcgctgccattgacggagagtatcgcctgagaggcgaagcgaggaaaacattcgtggagctcatgcggcgtggggatctgcccgtatggctttcgtacaaggtggcatctgagggatttcagtattccgaccgccgatggtgcttcgatggtgaaagaaataaccaggttctggaggaaaatatggacgtcgagatctggaccaaagaaggcgagaggaagaaactccggcctcgctggttggacgccagaacttacagcgatccgctggctctaagggagtttaaggaattcgccgctgggcggcgatcagtgagtggagacctgatcctcgagattggcaaacttccacaacacctgacgttaagagcacagaacgccttggataatctggtgatgctccacaactctgaacagggtgggaaggcttatcgccatgccatggaggaactgcccgacaccatagagacacttatgctgctcgcattgatcgcggtcctgactggcggagttaccttatttttcctatccggcaaggggctgggaaaaacaagcattggtctcctttgtgtgaccgcctcaagtgctctgttgtggatggccagcgtagagcctcactggatcgcagcttccattatcctggaatttttcctcatggtgctgcttatacccgagccagataggcagcggactcctcaagacaatcagctcgcctacgtcgtgatcggcctgttgtttatgattctgacagttgcagccaacgaaatggggttactagagacgaccaagaaagatctgggaatcggctatgtggctgcggagaaccatcagcacgccactatgctcgacgtcgatcttcgtcccgcatctgcttggacactgtacgccgtagccaccaccgtgattacaccaatgatgagacacactatcgaaaatacgaccgcaaacataagcttgacagctattgccaatcaagcggctatcctgatgggtctcgacaaggggtggcctatttccaaaatggatatcggcgttccgctgcttgccttaggatgctactcacaggtgaaccccctgactctcaccgcagccgtcttgatgctggtggctcattatgcaataatcggcccagggctacaggccaaggcgacaagggaggctcagaagcgcaccgccgcaggaattatgaaaaatcctactgtcgacggcatcgtggccattgatctggaccccgttgtgtacgacgctaagttcgaaaaacaactcggtcagatcatgcttctgatattgtgtacgtctcagattctgctcatgcggacaacctgggccctgtgcgagagtatcactttagcaaccgggccacttacaactctgtgggaaggatcgcctggcaagttttggaacaccacaatcgctgtaagcatggccaatattttccgaggttcctatctcgcgggcgccgggctagcattctctctgatgaaatcattgggaggcgggagaaggggaacgggcgctcagggtgagaccctgggggagaagtggaagcgccaactcaaccagcttagcaaatccgaatttaatacttacaagcggagtggaatcatggaggtggatagatctgaagccaaagagggcctgaagcgtggtgaaacaaccaaacacgcagtcagcaggggcactgctaagttgcggtggttcgttgagcgcaacctggtgaagcccgaggggaaagtcatagacctcggatgtggccgagggggatggtcatattactgcgccggcttaaagaattttacagaagtgaaaggttatacctccgggggaccgggccatgaggaaccaattcctatggccacgtacggctggaacctggtaaagcttcacagtgggaaagatgtgttctttatgcccccagagaagtgtgacaccctgctatgcgatatcggagaaagctctcccaatcctacaattgaggagggtagaactctcagggttctgaaaatggtggaaccgtggttgaagggcaaccagttctgtatcaagatactgaatccctacatgccatccgtcgtggagaccctcgaacagatgcaacggaaacatgggggaatgcttgtccgcaaccctctgtcaagaaatagcacacacgagatgtattgggtgtcgtgcggcactggtaacatcgtttctgcggtaaacatgaccagtaggatgttactgaatcgatttacaatggctcaccggaagcccacctacgagcgtgacgtggatttgggggcaggaactagacatgtcgccgtggaacctgaggttgctaacctcgacattatcggccagcgcattgaaaatatcaaaaacgagcacaagtccacgtggcattatgatgaagacaatccatacaaaacatgggcctatcacggcagctacgaggtgaagccctcagggtccgcatctagcatggtcaacggagtggtaaggctgctaaccaagccttgggatgtgattccaatggttactcagatcgccatgaccgacacaacgcccttcggtcaacagcgggtctttaaagagaaggtggacaccagaactccgcgcgctaaaaggggcacaacccagataatggaagtgactgcgaagtggctttgggggttcctgagtcgaaataaaaagcctcggatttgtacaagagaggaatttaccaggaaggtccgctccaacgccgcaatcggagctgttttcgtggatgagaatcagtggaacagcgccaaagaagcagtagaggacgagcgtttttgggatctcgtgcaccgggaaagagagctgcataagcaaggcaaatgcgccacatgcgtctataatatgatgggtaagagggaaaaaaagttgggggagttcggaaaggctaaaggctctcgcgccatctggtacatgtggctgggcgcgcgattcctcgaatttgaggcacttgggttcatgaacgaggaccactggttttcacgggaaaatagtctgtccggagtggagggtgaaggcttacataagctggggtacattttgagagatataagcaaaatcccaggaggcaacatgtatgccgacgatactgctggttgggacaccaggattacggaggatgacctccagaatgaggccaagatcaccgatattatggaacccgagcacgcactgctagctacatctatcttcaaacttacttaccagaacaaggttgtgcgcgtccagagacctgccaaaaacgggaccgtgatggacgtaatatcgcggagggatcaacgtggatcaggccaggttggcacatatgggctgaatacttttaccaacatggaagtgcagctcatccgacagatggagagcgaaggaattttcctgccatccgagttggagacgcccaatttagctgaacgcgtcctggactggctcgagaagcatggtgccgaaagacttaagcggatggcaatcagtggcgacgattgtgtggtgaaaccgattgacgataggtttgcgacagccctgaccgctctaaacgacatggggaaggtccgcaaagatatccctcaatgggagccctctaagggatggaatgactggcagcaggttccattctgcagccaccactttcatcagctgataatgaaagatggcagagaaattgtggtaccttgtcggaaccaagacgagctcgtgggtagggcccgagtctcccagggggcaggatggtcattgcgtgagactgcttgcctgggcaagagttacgcccagatgtggcaacttatgtatttccacagacgcgatctgcggctcgcagccaatgcgatctgttctgctgtgcccgttgactgggtgccaacaagcaggaccacttggtccatccatgcccaccaccagtggatgaccacagaagatatgttatcagtctggaacagagtgtggattgaggaaaatccctggatggaggacaagacgcatgtaagctcttgggaagaggttccttacctgggcaaacgcgaggaccagtggtgcgggtccttgataggactgaccgcacgggccacttgggctacaaacatccaggtggccattaatcaagtcaggcgactcatcggtaacgaaaattatcttgattacatgaccagtatgaagagatttaaaaacgagagcgacccagaaggcgcactgtggtga

SEQ ID NO: 13532 - RNA, 9879 nt, synthetic construct
  misc_feature 1..9879: note = derived and/or modified CDS sequence (opt3) from DENV-1__GQ199877__SS-prME
  source 1..9879: mol_type = other RNA
agcgtgaccatgctgctcatgcttctgcccactgccttggctttccacttaactacgaggggcggggagcctcatatgatcgtctccaaacaggaaaggggaaaatctctgctatttaagacctcagctggtgttaacatgtgcactctcattgccatggacctgggcgagctttgtgaagatactatgacctacaaatgcccacggataacagaggcggaaccggacgatgtggactgttggtgcaatgctaccgatacttgggtaacctatgggacctgtagtcaaacgggagagcaccgccgagagaagcgtagcgtggccctggctccccatgtcggcttgggtctcgaaactagaaccgagacatggatgtcctctgaaggggcctggaaacagatccagagggtggagacttgggccctgcggcaccctggattcaccgttattgcatttttcctggcccatgctatcggcacatcgattacccagaagggcatcatatttatcctcttaatgctggtgacgccatcaatggccatgcgctgcgtcgggattggaaacagagacttcgtggagggtcttagcggcgcgacttgggtagatgttgtgttggaacacgggagttgtgtcacaaccatggcaaagaataaacccactctggacatcgagctactcaagacagaagtgaccaaccctgccgtgctgaggaaactttgcattgaggctaagatctccaatacgaccacagattctcggtgtccaactcaaggagaagccaccctggtcgaggagcaggacgcaaactttgtttgccgccgaacattcgtggatagaggctggggtaatgggtgtggattgtttggcaaaggcagcctcctgacttgcgctaagttcaagtgcgtaaccaaattagaagggaagatagtgcagtacgagaacctgaaatattccgtcattgtgacagttcacaccggagaccagcatcaagtgggtaatgaaactacggagcacggcacaatcgccaccattactccccaggcgcctacctcagaaatccagctcacagattacggggcccttaccctggactgtagtccaaggactggattggactttaacgagatggtcctactgacaatgaaggagaaaagctggctcgtgcataagcagtggttcctggatcttccgctgccctggacgtctggcgcatccacctcacaagaaacttggaatcggcaggacttgctcgtaacatttaaaaccgctcacgccaagaagcaggaggttgtggtcctgggtagccaagaaggggctatgcacacagccttaactggcgcaaccgagatccagacgagtggaaccacaactattttcgccggccatctgaaatgccgtctaaagatggataaactcaccctgaaggggatgtcttatgtgatgtgtacaggatccttcaaacttgaaaaggaggtcgctgagactcagcacggtaccgtgttggttcaggtgaagtacgaaggcacggacgcgccttgcaaaataccatttagcacacaagatgagaagggggtaacccagaacggacgcctgatcactgcaaatcccattgtcacagacaaagaaaagcctgtgaacatcgagaccgagccacccttcggcgaatcgtatatagttgtgggtgccggggagaaagctctcaagctgtcttggtttaagagaggctcctcaattggaaaaatgttcgaagccactgcaaggggcgcccggcgaatggctatccttggggataccgcctgggactttggaagtatcggtggcgtcttcacaagcgtggggaagctggtacatcaggtgtttggaacggcatacggcgttttgttctccggtgtctcttggaccatgaaaattgggatcggcattctcctgacttggttaggactgaatagccgctcaacaagtctatccatgacctgtatagcggtgggcatggtgacactctacctgggggtcatggttcaggctgatagcggatgcgtgatcaactggaagggcagagagcttaaatgtggttctgggatttttgtgactaacgaagtacacacctggacggagcaatataagttccaggccgactcaccgaagaggttgagtgcagccatcggaaaggcttgggaggaaggcgtctgcggtatccggagcgccacacgcctggagaatattatgtggaagcagatatccaacgaactcaatcatatcctgttagagaacgatatgaaatttaccgtggttgtgggcgacgcaaatgggattctggctcagggaaagaaaatgatcagacctcaacccatggaacacaagtactcttggaaatcgtggggcaaggccaagattatcggggcggacatacagaacactaccttcatcattgatggaccagacacacctgagtgtcccgatggccagagggcctggaatatctgggaggtcgaagactatggttttggggtgttcactaccaacatttggcttaaattgcgtgatagctacacacagatgtgcgaccaccggctcatgtccgctgcaatcaaggattcaaaagccgttcatgctgacatgggatattggatagagagtgaaaagaatgagacgtggaaactggcccgagcatctttcattgaagtgaagacctgtacttggccaaagagccacacactatggtccaacggcgtactggagtcagagatgatcattcccaaaatctacggtggccctataagccaacataattatagaccagggtactttacccagactgcgggaccgtggcacctcggcaagctggaacttgatttcgacttgtgcgaggggacaaccgtcgtggtggatgaacactgcggaaacaggggcccctctctgcgcacgactaccgtcacaggtaaaatcattcatgagtggtgttgccggtcctgtaccttacctccactcagatttagaggggaagacggatgctggtacggcatggaaatccgccccgttaaggagaaagaagagaatctggtgcgaagtatggtaagcgccggttctggcgaagtggattccttctcacttgggattctgtgtgtcagtatcatgatagaggaggtgatgcggagccgttggtcgagaaagatgttgatgactggaacactcgctgtttttctgctactgattatgggccagctcacctggaacgacctgatcaggctttgcatcatggtgggggccaatgcatccgaccgcatgggaatgggcacaacttatttggctctgatggccaccttcaagatgcggcctatgtttgcagtcggtttactcttcagaaggctgacgtctcgagaagtgcttctgctaacaattgggctcagcctggttgcctcagtggagttgccaagttccctggaagagttaggagatggcctcgctatgggcatcatgatgctgaaacttctgaccgaatttcaaccccaccagttgtggactaccctcctgtctctaacattcgtcaagactaccctgagccttgactacgcgtggaaaacgacagccatggtactctccattgtgtcactgtttccgttgtgtctgagcaccacaagtcagaagacaacctggttacctgttctcctggggtctttcggatgcaaaccacttactatgtttctgataacagagaacaagatctggggtcgcaagtcctggcccttgaacgagggcattatggcaatcgggattgtgagcatcctcctgtcgtcactactgaaaaatgatgtccctcttgctggacccctcatagccggcggtatgctgatcgcctgttatgtgatttctgggagttccgctgacttgagcttagaaaaggcagccgaggtatcttgggaacaggaggcggaacatagcggagcttcccacaacatcctggtggaggtccaagatgacggcaccatgaaaattaaggatgaggaacgggacgatacgctcactatcctgcttaaagccaccctgttggcagtttcaggcgtgtacccaatgagtatacctgccacactattcgtgtggtatttctggcagaagaaaaagcagagaagcggggtcctgtgggacaccccctctccaccggaggtggaaagggctgttctcgatgacggaatttaccgtatcctgcagcgcggtcttttaggccggtcccaagtaggggtgggagtctttcaggatggcgtgttccatacaatgtggcacgttactagaggtgcagtgctgatgtatcaggggaagaggctcgagccttcatgggccagtgtcaaaaaggacttgatcagctacggaggcggctggcgatttcaggggtcctggaataccggagaggaagtgcaagtaattgcggtcgagcccggtaaaaacccaaagaatgtgcagacgacacccggcactttcaaaacccctgaaggggaggttggagctatagccctggactttaagccaggcacatctggttcgcccatcgtgaaccgggaagggaagattgtcggactctacggcaatggcgtggttaccactagcgggacctatgtgtcagcaatcgcccaggctaaagcctcccaagagggacctctgccggagattgaagatgaggtcttcaagaaacgcaaccttacaatcatggacctgcacccaggtagtggcaagacgagaaggtacttgcccgcaatagtgcgggaagctatcaaacgaaagctaagaactctgattctcgcccctacccgcgtagtggcgtctgagatggccgaagcattaaaggggatgccaatcaggtatcagacaaccgctgttaaaagcgagcatactggacgtgagattgtcgatctgatgtgccacgccacatttaccatgcggcttctgtcccccgtgagagtgcctaattacaacatgatcataatggacgaagctcatttcacggatccggcatcaattgccgccaggggctatatctctactcgcgtcggtatgggggaggctgcggcaatctttatgacagccacacccccaggaagcgtagaggctttccctcagagtaatgccgtgattcaggacgaggaacgagatatccccgagagatcctggaacagcggctacgactggataaccgattttccaggcaagactgtttggttcgtgccttctattaaatcagggaatgacatcgcaaactgtctccggaagaatggaaaaagggtcattcaattgtcccgcaagacattcgataccgagtatcagaagactaaaaacaacgactgggactacgtggttactacggatatcagtgaaatgggtgccaattttcgtgctgacagagtgatagatccccggaggtgcctgaagccagtcattctcaaagacggcccggagcgcgtgatcctggcggggcctatgcccgtaaccgtggccagcgcagctcagcgaagaggacggatcggcaggaaccagaataaggaaggtgatcaatacgtttatatggggcagccacttaacaatgacgaggatcacgcccattggacagaggcaaaaatgctactggacaacattaatactcccgaaggcatcattcctgccttgttcgagccagaacgcgagaagtcggctgccatagatggagaatacagattaaggggcgaggcgcggaagacctttgtcgagctgatgcgtcgcggggacctccccgtgtggctgtcttataaagtggcatccgaaggattccagtacagcgatcgaagatggtgctttgacggtgagaggaacaatcaggtccttgaagagaacatggatgttgaaatctggacaaaggagggcgagcggaaaaagctgcgccctagatggctcgacgccaggacctattcagacccgttggctctgcgggagttcaaagagtttgccgctgggcgaagaagtgtgtctggagatctaattctggaaatcggcaagctcccacaacaccttactctgcgcgcacagaatgccttagacaacttggtaatgctgcacaattccgagcagggtgggaaggcttacaggcatgccatggaagaactccccgatacgatcgagaccctgatgcttctggcactcattgcggtgttgacaggcggagtcactctgttctttttaagcggcaaggggctaggaaagacctcaataggtctgctctgtgtgacagccagtagcgcacttctgtggatggcctccgttgaacctcactggatcgcagcttctattatcttggagttctttctgatggtgctcctgattcccgaaccagaccggcagcgtacccctcaagataaccagcttgcctatgtcgtaatcggcctcctgttcatgatattgactgtggcagccaatgagatggggctgttagagacaacgaaaaaggacctaggaatcggctacgttgctgcggaaaaccatcagcacgccaccatgctggatgtggacctccaccccgcaagcgcttggactctttacgccgtcgccacaaccgtgattaccccaatgatgagacatacaatcgagaacactacggcaaatatttccctgaccgctatcgccaaccaagcggctatattgatgggtctggataaagggtggcctatttcaaagatggacatcggcgtcccgctcctggcccttggatgctattctcaggtgaatcccttaacactgactgcagccgttctcatgttggtggctcactacgcaattatcggcccagggctgcaggccaaagcgaccagggaagctcagaagcgcacagccgcaggaataatgaagaaccctaccgtagatggcatcgtggccattgacctagatcccgtcgtttatgacgctaaatttgagaagcaactgggtcagatcatgctccttattctgtgtacaagtcagatcttgctgatgcggacgacatgggccctctgcgaatcgataaccctggcaactgggccattaaccacactttgggagggaagccctggcaaattctggaatactaccattgctgtgtccatggccaacatcttccgaggttcttacctggcgggcgccgggctcgcattttcactaatgaaaagcctgggaggcgggagaaggggaacaggcgctcagggtgagacgttgggggaaaaatggaagcgccaactgaatcagctctccaagagtgagttcaacacctataaaaagtctggaatcatggaagtcgaccggagcgaggccaaagaaggccttaagagaggtgagactacaaaacatgcagtgtcacgtggcaccgctaagctgaggtggtttgtagagcggaatttggtgaagcccgaagggaaagttattgatctgggatgtggccgcgggggatggtcctactattgcgccggcctcaagaaagtgactgaggtcaagggttacacaaaagggggaccgggccacgaagaaccaatccctatggccacctacggctggaacttagtgaagctgcatagtgggaaagacgtcttctttatgcccccagaaaagtgtgatacgcttctgtgcgacataggagagagctctcccaatcctaccattgaggaaggtcgaacactaagagtgctcaagatggttgagccgtggctgaggggcaaccagttctgtatcaaaattttgaatccctatatgccatccgtagtggaaactctggagcagatgcaacggaagcacgggggaatgctcgtccgcaaccctctttcaagaaatagcacccacgagatgtactgggtgtcgtgcggcacaggtaacatcgtttctgcggtgaatatgacaagtaggatgctgttaaaccgatttaccatggctcatcggaaacccacatatgaacgtgatgtcgacctgggggcaggaaccagacacgtggccgtagagcctgaagtggctaacttggatataatcggccagcgcattgagaatatcaagaacgaacataaatccacttggcactacgacgaggataatccatataagacgtgggcctaccacggcagctatgaggttaagccctcagggtccgcatctagcatggtcaacggagtggtgaggctcctgacaaaaccttgggacgtcattccaatggttacccagatcgccatgactgataccacacccttcggtcaacagcgggtgtttaaggaaaaagtagacacgagaaccccgcgcgctaagaggggcactacacagattatggaggtgaccgcgaaatggctatgggggttccttagtcgaaataagaagcctcggatctgtactagagaagagtttacaaggaaagtccgctccaacgccgcaataggagctgtgttcgttgacgaaaatcagtggaacagcgccaaggaggcagtggaggatgaacgtttttgggacctggtccatcgggagagagaactccacaaacaaggcaagtgcgcaacctgcgtgtacaatatgatgggtaaaagggagaagaagctgggggagttcggaaaagctaagggctctcgcgccatttggtacatgtggttgggcgcgcgattcctggagtttgaggcactcgggttcatgaacgaagatcattggttttcacgggagaatagtctttccggagtagaaggtgagggcctgcacaaattagggtatatcctgagagacatcagcaagattccaggaggcaacatgtacgccgatgacacagctggttgggatactaggataaccgaggacgatttgcagaatgaagccaaaatcacggacattatggagcccgaacatgcactcctggctacctctatcttcaagctaacatatcagaacaaagttgtgcgcgtccagagacctgccaagaatgggactgtgatggatgtgatttcgcggagggaccaacgtggatcaggccaggtcggcacctacgggcttaacacatttactaacatggaggttcagctgatccgacagatggaaagcgagggaatattcctcccatccgagctggaaacccccaatttggctgagcgcgccttagattggctggaaaagcacggtgcagagagactcaaacggatggcgatcagtggcgacgactgtgtggtaaagccgattgatgacaggtttgccacggctcttacagccctgaacgatatggggaaagtgcgcaaggacatccctcaatgggaaccctctaaaggatggaatgattggcagcaggtcccattctgcagccaccattttcaccagctaattatgaaggacggcagagagatcgtggttccttgtcggaaccaagatgagctggtgggtagggcacgagtctcccagggggctggatggtcactccgtgaaaccgcctgcttgggcaagagttatgcacagatgtggcaactgatgtacttccatagacgcgaccttcggctggccgcgaatgctatatgttctgccgtgcccgtagattgggttccaactagcaggacaacctggtccattcacgcacaccatcagtggatgactaccgaggacatgctctcagtgtggaacagagtctggatcgaagagaatccctggatggaagataaaacacacgtgagctcttgggaggaggttccttatttaggcaagcgcgaagaccagtggtgcgggtccctgatcggattgacggcccgggctacctgggccactaacattcaggtggcaataaatcaagtcaggcgactgatcggtaacgagaattacctcgactacatgacaagtatgaaaagatttaagaacgaaagcgatccagagggcgctctttggtga

SEQ ID NO: 13533 - RNA, 9879 nt, synthetic construct
  misc_feature 1..9879: note = derived and/or modified CDS sequence (opt3) from DENV-1__GU056029__SS-prME
  source 1..9879: mol_type = other RNA
agcgtgacaatgctgctcatgcttctgcccacagccttggctttccacttaactacgaggggcggggagcctcatatgatcgtctccaagcaggaaaggggaaaatctctgctatttaagacctcagctggtgttaacatgtgcacactcattgccatggacctgggcgagctttgtgaagatactatgacctacaaatgcccacggataacagaggcggaaccggacgatgtggactgttggtgcaatgctaccgatacttgggtaacatatgggacctgtagtcagacgggagagcaccgccgagagaagcgtagcgtggccctggcaccccatgtcggcttgggtctcgaaactagaaccgagacatggatgtcctctgaaggggcctggaaacagatccagagggtggagacttgggctctgcggcaccctggattcaccgttattgcatttttcctggcccatgctatcggcacatcgattacccagaagggcatcatatttatcctcttaatgctggtgacgccatcaatggccatgcgctgcgtcgggattggaaacagggacttcgtggagggtcttagcggcgcgacttgggtagatgttgtgttggaacacgggagttgtgtcacaaccatggcaaagaataaacccactctggacatcgagctactcaagacagaagtgaccaaccctgccgtgctgaggaaactttgcattgaggctaagatctccaatacgaccacagattctcggtgtccaactcaaggagaagccaccctggtcgaggagcaggacgcaaactttgtttgccgccgaacattcgtggatagaggctggggtaatgggtgtggattgtttggcaaaggcagcctcctgacttgcgctaagttcaagtgcgtaaccaaattagaagggaagatagtgcagtacgagaacctgaaatattccgtcattgtgacagttcacaccggagaccagcatcaagtgggtaatgaaactacggagcacggcacaatcgccaccattactccccaggcgcctacctcagaaatccagctcacagattacggggcccttaccctggactgtagtccaaggactggattggactttaacgagatggtcctactgacaatgaaggagaaaagctggctcgtgcataagcagtggttcctggatcttccgctgccctggacgtctggcgcatccacctcacaagaaacttggaatcggcaggacttgctcgtaacatttaaaaccgctcacgccaagaagcaggaggttgtggtcctgggtagccaagaaggggctatgcacacagccttaactggcgcaaccgagatccagacgagtggaaccacaactattttcgccggccatctgaaatgccgtctaaagatggataaactcaccctgaaggggatgtcttatgtgatgtgtacaggatccttcaaacttgaaaaggaggtcgctgagactcagcacggtaccgtgttggttcaggtgaagtacgaaggcacggacgcgccttgcaaaataccatttagcacacaagatgagaagggggtaacccagaacggacgcctgatcactgcaaatcccattgtcacagacaaagaaaagcctgtgaacatcgagaccgagccacccttcggcgaatcgtatatagttgtgggtgccggggagaaagctctcaagctgtcttggtttaagagaggctcctcaattggaaaaatgttcgaagccactgcaaggggcgcccggcgaatggctatccttggggataccgcctgggactttggaagtatcggtggcgtcttcacaagcgtggggaagctggtacatcaggtgtttggaacggcatacggcgttttgttctccggtgtctcttggaccatgaaaattgggatcggcattctcctgacttggttaggactgaatagccgctcaacaagtctatccatgacctgtatagcggtgggcatggtgacactctacctgggggtcatggttcaggctgatagcggatgcgtgatcaactggaagggcagagagcttaaatgtggttctgggatttttgtgactaacgaagtacacacctggacggagcaatataagttccaggccgactcaccgaagaggttgagtgcagccatcggaaaggcttgggaggaaggcgtctgcggtatccggagcgccacacgcctggagaatattatgtggaagcagatatccaacgaactcaatcatatcctgttagagaacgatatgaaatttaccgtggttgtgggcgacgcaaatgggattctggtccagggaaagaaaatgatcagacctcaacccatggaacacaagtactcttggaaatcgtggggcaaggctaagattatcggggccgacatacagaacactaccttcatcattgatggaccagacacacctgagtgtcccgatggccagagggcgtggaatatctgggaggtggaagactatggttttggggttttcactaccaacatttggcttaaattgcgtgatagctacacacagatgtgcgaccaccggctcatgtccgccgctatcaaggattcaaaagcagtgcatgccgacatgggatattggatagagagtgaaaagaatgagacgtggaaactggctcgagcctctttcattgaagtaaagacctgtacttggccaaagagccacacactatggtccaacggcgtcctggagtcagagatgatcattcccaaaatctacggtggccctataagccaacataattatagaccagggtactttacccagactgcaggaccgtggcacctcggcaagctggaacttgatttcgacttgtgcgaggggacaaccgtggtggtcgatgaacactgcggaaacaggggcccctctctgcgcacgactaccgttacaggtaaaatcattcatgagtggtgttgccggtcctgtaccttacctccactcagatttagaggggaagacggatgctggtacggcatggaaatccgccccgtgaaggagaaagaagagaatctggtacgaagtatggtgagcgcgggttctggcgaagtcgattccttctcacttgggattctgtgtgtgagtatcatgatagaggaggttatgcggagccgttggtcgagaaagatgttgatgactggaacactcgccgtgtttctgctactgattatgggccagctcacctggaacgacctgatcaggctttgcatcatggtcggggctaatgcctccgaccgcatgggaatgggcacaacttatttggcactgatggctaccttcaagatgcggcctatgtttgccgtgggtttactcttcagaaggctgacgtctcgagaagttcttctgctaacaattgggctcagcctggtggcatcagtcgagttgccaaacagtctggaagagttaggagatggcctcgccatgggcatcatgatgctgaaacttctgaccgaatttcaaccccaccagttgtggactaccctcctgtccctaacattcgtaaagactgctctgtctcttgactacgcgtggaaaaccacggccatggtgctcagcattgtttccctgtttccgttgtgtctgtcaacaaccagccagaagactacatggttacctgtgctcctggggagtttcggatgcaaaccacttaccatgtttctgataactgagaacaagatctggggtcgcaagtcttggcccttgaatgagggcattatggcaatcgggattgtctccatcctcctgagctcgctactgaaaaacgatgtgcctcttgctggacccctcatagccggcggtatgctgatcgcctgttatgtaatttcagggtctagtgctgacttgtccttagaaaaggcagccgaggtgagctgggaacaggaggcggaacattctggagctagccacaatatcctggtcgaggttcaagatgacggcacaatgaaaattaaggatgaggaacgggacgataccctcacgatcctgcttaaagccactctgttggcagtgtccggcgtgtacccaatgtcaatacctgccaccctattcgtctggtatttctggcagaagaaaaagcagagaagtggggtgctgtgggacacacccagcccaccggaggttgaaagggctgtactcgataacggaatttaccgtatcctgcagcgcggtcttttaggccggtctcaagtgggggtcggagtgtttcaggacggcgttttccataccatgtggcacgtgacaagaggtgcagtcctgatgtatcaggggaagaggctcgagccttcctgggcctcagtgaaaaaggatttgatcagttacggaggcggctggcgatttcaggggagctggaatactggagaggaagtacaagtcattgcggtggagcccggtaaaaacccaaagaatgttcagaccacgcccggcacattcaaaactcctgaaggggaggtgggagctatagccctggactttaagccaggcacctccggttctcccatcgtcaaccgggaagggaagattgtgggactctacggcaatggcgttgtgacaacctcggggacttatgtcagcgcaatcgcccaggctaaagcctcacaagagggacctctgccggagattgaagacgaggtgttcaagaaacgcaaccttaccatcatggatctgcacccaggttccggcaagacaagaaggtacttgcccgcaatagtacgggaagctatcaaacgaaagctaagaacgctgattctcgcccctactcgcgtggttgcgagtgagatggccgaagcattaaaggggatgccaatcaggtatcagaccacagctgtcaaatctgagcataccggacgtgagattgtggacctgatgtgccacgccacttttacaatgcggcttctgagccccgtgagagtccctaattacaacatgatcataatggatgaagctcatttcaccgacccggcatccattgccgccaggggctatatctcaacgcgcgtaggtatgggggaggctgcggcaatctttatgactgccacacccccaggatctgtggaggctttccctcagagcaatgccgttattcaggatgaggaacgagacatccccgagagaagttggaactccggctacgattggataaccgactttccaggcaagaccgtgtggttcgtccctagcattaaatctgggaatgatatcgcaaactgtctccggaagaacggaaaaagggtgattcaattgtcacgcaagactttcgacacagagtatcagaagaccaaaaataacgattgggactacgttgtgacaactgacatctccgaaatgggtgccaattttcgtgctgatagagtcatagacccccggaggtgcctgaagccagtgattctcaaagatggcccggagcgcgtaatcctggcggggcctatgcccgtgacggttgccagtgcagctcagcgaagaggacggatcggcaggaaccagaataaggaaggtgaccaatacgtctatatggggcagccacttaacaatgatgaggaccacgcccattggaccgaggcaaaaatgctactggataacattaatacacccgaaggcatcattcctgccttgttcgagccagaacgcgagaaaagcgctgccatagacggagaatacagattaaggggcgaagcgcggaagacttttgtggagctgatgcgtcgcggggatctccccgtgtggctgtcgtataaagtcgcatctgaaggattccagtactccgaccgaagatggtgctttgatggtgagaggaacaatcaggttcttgaagagaacatggacgtggaaatctggaccaaggagggcgagcggaaaaagctgcgccctagatggctcgatgccaggacatatagcgacccgttggctctgcgggagttcaaagagtttgccgctgggcgaagatcagtaagtggagacctaattctggaaatcggcaagctcccacaacaccttaccctgcgcgcacagaatgccttagataacttggtgatgctgcacaattctgagcagggtgggaaggcttacaggcatgccatggaggaactccccgacactatcgagacgctgatgcttctggcactcattgcggtcttgaccggcggagtgacactgttctttttatccggcaaggggctaggaaagactagcataggtctgctctgtgttaccgcctcaagtgcacttctgtggatggccagcgtggaacctcactggatcgcagcttccattatcttggagttctttctgatggtcctcctgattcccgaaccagatcggcagcgtacacctcaagacaaccagcttgcctatgtagtgatcggcctcctgttcatgatattgaccgttgcagccaacgagatggggctgttagagactaccaaaaaggatctaggaatcggctacgtggctgcggaaaatcatcagcacgccacgatgctggacgtcgatctccaccccgcatctgcttggaccctttacgccgtggccactacagtcattaccccaatgatgagacataccatcgagaacacaactgcaaatattagcctgacggctatcgccaaccaagcggctatattgatgggtctggacaaagggtggcctatttccaagatggatatcggcgtgccgctcctggcccttggatgctattcacaggttaatcccttaaccctgacagcagccgtgctcatgttggtagctcactacgcaattatcggcccagggctgcaggccaaagcgactagggaagctcagaagcgcaccgccgcaggaataatgaagaaccctacagtggacggcatcgtcgccattgatctagaccccgttgtgtatgatgctaaatttgagaagcaactgggtcagatcatgctccttattctgtgtacctctcagatcttgctgatgcggactacgtgggccctctgcgaaagtataacactggcaaccgggccattaactaccctttgggagggatcgcctggcaaattctggaatacaactattgctgtcagcatggccaacatcttccgaggttcctacctggcgggcgccgggctcgcattttctctaatgaagtcactgggaggcgggagaaggggaaccggcgctcagggtgagacattgggggaaaaatggaagcgccaactgaatcagctcagcaagtccgagttcaacacgtataaacggagtggaatcatggaagtggacagatctgaggccaaggaaggccttaaacgtggtgagaccactaagcatgcagtaagcaggggcacagctaaactgcggtggtttgtggagcgcaatttggttaagcccgaagggaaggtgattgacctgggatgtggccgagggggatggtcatactattgcgccggcctcaaaaaggtcaccgaggtgaaaggttacactaaagggggaccgggccacgaggaaccaatccctatggccacatacggctggaacttagtcaaactgcattccgggaaggatgtgttctttatgcccccagaaaaatgtgacacccttctgtgcgatataggagagagtagccccaatcctacgattgaggaaggtagaaccctaagggttctcaagatggtagagccgtggctgcggggcaaccagttctgtatcaagattttgaatccctatatgccatctgtggtcgaaacactggagcagatgcaacgcaaacacgggggaatgctcgtgagaaaccctctttccagaaattcaactcacgagatgtactgggttagctgcggcaccggtaacatcgtgtcggcggtcaacatgacatctcgaatgctgttaaatcggtttactatggctcatcgtaagcccacctatgaaagagacgtggatctgggggcaggaacacgccacgtagccgtggagcctgaagttgctaacttggacataatcggccagaggattgagaatatcaaaaacgaacataagagtacctggcactacgatgaggacaatccatataaaacttgggcctaccacggctcctatgaggtcaagcccagcgggtcagcatcctctatggtgaacggagtggtccggctcctgacgaagccttgggatgttattccaatggtgacacagatcgccatgaccgacactacccccttcggtcaacagagagtatttaaagaaaaggtggatacacgcacgccgagggctaaacgaggcaccactcagattatggaggtcacagcgaagtggctatgggggttccttagccggaataaaaagcctagaatctgtaccagggaagagtttactcgcaaggtgcgtagtaacgccgcaataggagctgttttcgtggacgaaaatcagtggaactccgccaaagaggcagtcgaggacgaacggttttgggatctggtgcatagagagagggaactccacaagcaaggcaaatgcgccacatgcgtatacaatatgatgggtaagcgcgagaaaaagctgggggagttcggaaaggctaaaggcagccgagccatttggtacatgtggttgggcgcgcggttcctggagtttgaggcactcgggttcatgaacgaagaccattggttttctagagaaaattcacttagtggagttgaaggtgagggcctgcacaagttagggtatatcctgagggatatctccaaaattccaggaggcaacatgtacgccgacgataccgctggttgggacacacgcataactgaggatgacttgcagaatgaagccaagatcaccgatattatggagcccgaacatgcactcctggctacgagcatcttcaaactaacctatcagaacaaggtggtcagagtgcagcggcctgccaaaaacgggacagtgatggacgtcatttctaggcgtgatcaacgaggatcgggccaggttggcacttacgggcttaatacctttacaaacatggaggtgcagctgatccgccagatggaatcagagggaatattcctcccaagcgagctggaaactcccaatttggctgagagagccttagactggctggaaaagcacggtgcagagcggctcaagaggatggcgatctccggcgatgactgtgtagtgaaaccgattgacgatcgctttgccaccgctcttacggccctgaacgacatggggaaggtcagaaaagatatccctcaatgggaacccagtaagggatggaatgactggcaacaggtgccattctgctctcaccattttcaccagctaattatgaaagatggccgggagatcgttgtgccttgtaggaaccaagacgagctggtcggtcgagcacgtgtgagccagggggctggatggtccctcagagaaacagcctgcttgggcaagtcatatgcacagatgtggcaactgatgtacttccatcgccgggatcttaggctggccgcgaatgctatatgtagtgccgtacccgttgactgggtgccaacctctagaactacatggagcattcacgcacaccatcagtggatgaccactgaggatatgctctccgtctggaaccgcgtgtggatcgaagagaatccctggatggaagacaagacccacgtttcaagctgggaggaggtgccttatttaggcaaacgggaagatcagtggtgcgggtctctgatcggattgacagccagggctacgtgggccaccaacattcaggtcgcaataaatcaagtgcgaagactgatcggtaacgagaattacctcgactacatgacttccatgaagcggtttaaaaacgaaagtgacagcgagggcgctctttggtga

SEQ ID NO: 13534 - RNA, 9879 nt, synthetic construct
  misc_feature 1..9879: note = derived and/or modified CDS sequence (opt3) from DENV-1__GU056030__SS-prME
  source 1..9879: mol_type = other RNA
agcgtgaccatgctgctcatgcttctgcccaccgcattggctttccacttaactacgaggggaggggaacctcatatgatcgtctccaagcaggaaaggggaaaatctctgctatttaagacctcagccggtgttaacatgtgcacactcattgcaatggacctgggagaactttgtgaagatactatgacctacaaatgcccacggataacagaagcggaaccggacgatgtggactgttggtgcaatgctaccgatacttgggtaacatatgggacctgtagtcagacgggagaacaccgccgagaaaagcgtagcgtggccctggcaccccatgtcggcttgggtctcgaaactagaaccgagacatggatgtcctctgaaggggcctggaaacagatccagagggtggaaacttgggctctgcggcaccctggattcaccgttattgcatttttcctggcccatgctatcggcacatcgattacccagaagggcatcatatttatcctcttaatgctggtgacgccatcaatggccatgcgctgcgtcgggattggaaacagagacttcgtggagggtcttagcggcgcgacttgggtagatgttgtgttggaacacgggagttgtgtcacaaccatggcaaagaataaacccactctggacatcgagctactcaagacagaagtgaccaaccctgccgtgctgaggaaactttgcattgaggctaagatctccaatacgaccacagattctcggtgtccaactcaaggagaagccaccctggtcgaggagcaggacgcaaactttgtttgccgccgaacattcgtggatagaggctggggtaatgggtgtggattgtttggcaaaggcagcctcctgacttgcgctaagttcaagtgcgtaaccaaattagaagggaagatagtgcagtacgagaacctgaaatattccgtcattgtgacagttcacaccggagaccagcatcaagtgggtaatgaaactacggagcacggcacaatcgccaccattactccccaggcgcctacctcagaaatccagctcacagattacggggcccttaccctggactgtagtccaaggactggattggactttaacgagatggtcctactgacaatgaaggagaaaagctggctcgtgcataagcagtggttcctggatcttccgctgccctggacgtctggcgcatccacctcacaagaaacttggaatcggcaggacttgctcgtaacatttaaaaccgctcacgccaagaagcaggaggttgtggtcctgggtagccaagaaggggctatgcacacagccttaactggcgcaaccgagatccagacgagtggaaccacaactattttcgccggccatctgaaatgccgtctaaagatggataaactcaccctgaaggggatgtcttatgtgatgtgtacaggatccttcaaacttgaaaaggaggtcgctgagactcagcacggtaccgtgttggttcaggtgcgctacgaaggcacggacgcgccttgcaagataccatttagcacacaagatgagaaaggggtaacccagaacggaagactgatcactgcaaatcccattgtcacagacaaggaaaaacctgtgaacatcgagaccgagccacccttcggcgaatcgtatatagttgtgggtgccggggagaaggctctcaaactgtcttggtttaagaggggctcctcaattggaaagatgttcgaagccactgcacggggcgcccgacgcatggctatccttggggataccgcctgggactttggaagtatcggtggcgtcttcacaagcgtggggaaactggtacatcaggtgtttggaacggcatacggcgttttgttctccggtgtctcttggaccatgaagattgggatcggcattctcctgacttggttaggactgaatagcagatcaacaagtctatccatgacctgtatagcggtgggcatggtgacactctacctgggggtcatggttcaggctgatagcggatgcgtgatcaactggaaaggcagggagcttaagtgtggttctgggatttttgtgactaacgaagtacacacctggacggagcaatataaattccaggccgactcaccgaagcggttgagtgcagccatcggaaaggcttgggaggaaggcgtctgcggtatccgcagcgccacaagactggagaatattatgtggaaacagatatccaacgaactcaatcatatcctgttagagaacgatatgaagtttaccgtggttgtgggcgacgcaaatgggattctggctcagggcaagaagatgatcaggcctcaacccatggaacacaaatactcttggaagtcgtggggcaaagccaagattatcggggcggacatacagaacactaccttcatcattgatggaccagacacacctgagtgtcccgatggccagcgtgcctggaatatctgggaggtcgaagactatggttttgggattttcactaccaacatctggcttaagttgcgggatagctacacacagatgtgcgaccaccgactcatgtccgctgcaataaaagattcaaaggccgtgcatgctgacatgggatattggattgagagtgagaaaaatgagacgtggaagctggccagagcatctttcatcgaagttaaaacctgtacttggccaaagagccacacactatggtccaacggcgtgctggagtcagagatgattatccccaagatatacggtggccctatcagccaacataattataggccagggtactacacccagactgcgggaccgtggcacctcggcaaactggaacttgattttgacttgtgcgaggggacaaccgtagtcgtggatgaacactgcggaaaccgcggcccctctctgcggacgactaccgtgacaggtaagattatccatgagtggtgttgcagatcctgtaccttacctccactcaggttccgcggggaggacggatgctggtatggcatggaaattcgacccgtcaaagagaaggaagagaatctggttcggagtatggtgagcgccggttctggcgaagtagataacttttcccttgggatcctgtgtgtgtcaataatgattgaggaggtcatgcgtagtagatggagcaggaaaatgttgatgactggaacactcgctgtgttcctgctactgatcatgggccagctcacctggaatgacctgatccgcctttgcattatggttggggccaacgcatcggacggaatgggcatgggtacaacttacttggctctgatggccacctttaagatgcggcctatgttcgcagtggggttactctttagaaggctgacgtcccgagaagtccttctgctaacaatcggactctctctggtggccagcgttgagttgccaaactcactggaagagttaggcgatggcctcgctatggggattatgatgctgaaacttctgaccgagttccaaccccaccagttgtggactaccctcctgagtctaacatttgtgaaaactaccctgtcccttgactatgcgtggaagacgacagccatggtcctctctatagtaagcctgttcccgttgtgtctgtccaccacttcacagaaaacaacctggttacctgtgctcctgggcagctttggttgcaagccacttactatgttcctgatcacagagaataaaatttggggccgcaagagttggcccttgaacgaggggatcatggcaattggaatcgtttctatactcctgtccagcctactgaagaatgatgtgcctcttgctggccccctcatcgccggtgggatgctgattgcctgttacgtcatctcgggatcatctgctgacttgagtttagataaagcagccgaagtgtcctgggagcaggaagcggagcatagcggcgcttctcacaacattagcgtagaagtgcaagacgatggcaccatgaagatcaaagacgaggagcgggatgacacgctgactatactcctgaaggccacccttctggcagtctccggggtttatccaatgtcaattcctgccacattgtttgtgtggtacttctggcagaaaaagaaacagagaagtggagtgctatgggatacccccagcccaccggaagtcgagagggctgtgctggacgatggtatctatcgtatcctccagcgcggcctgcttgggcggtctcaagttggagtaggcgtgttccaggacggtgtctttcatacaatgtggcacgtgactagaggggcagttttaatgtaccagggaaagaggctggaaccttcctgggcctgcgtgaagaaagacctcatttcatacggcggcgggtggcgattccagggaagttggaataccggtgaggaggtccaagtgatagcggtagaacccggcaagaaccccaaaaatgtccagacgacacccgggacttttaagacccctgagggagaagtgggcgctatcgccttggatttcaaaccaggtacaagcgggtcccccattgttaaccgggagggaaagatcgtgggcctgtatggcaatggggtcgtgaccacttctggaacctacgtttcggcaattgcccaggctaaggccagccaagaaggtcctctcccggagatcgaggacgaagtgtttaaaaagcgcaacctgacaataatggatcttcacccaggctcagggaaaacgagaaggtatctgcccgcaatcgtccgggaggctattaagcgaaaattgagaactctaatcctggcccctacccgcgtggtagcgtccgaaatggccgaggcactcaagggaatgccaattaggtaccagacaaccgctgtgaagagtgaacatactggccgtgagatcgttgacttaatgtgtcacgccacattcaccatgcggctgctttctcccgtcagagtgcctaattataacatgataattatggatgaggctcattttacggacccggcaagcatcgccgccaggggttacatctccactcgcgtggggatgggagaagctgcggcaattttcatgacagccacaccaccaggctcagtcgaggcttttcctcagtctaatgccgtaatccaggatgaagaacgagacatacccgaaagaagctggaacagtggctatgattggattaccgacttcccagggaaaactgtgtggtttgttccttccatcaagagcggaaatgatattgcaaactgcctgcggaaaaacggtaagagggtgatccaactctctcgcaaaacattcgacaccgagtaccagaagacaaagaataacgactgggattacgtcgtgactacggacatatcagagatgggcgccaatttccgtgctgatagagttattgacccccggaggtgcttgaaaccagtgatcctgaaggatgggccggaacgcgtcatcctcgcgggacctatgcccgtgaccgtagcctccgcagctcagcgaagaggccggattggtaggaaccagaataaagagggggaccaatatgtgtacatgggccagccactgaacaatgatgaagaccacgcccattggacagaggcaaagatgcttctagataacatcaatactcccgagggaattatacctgccctgtttgaaccagagcgcgagaaaagtgctgccatcgacggcgagtatagattgagaggggaagcgcggaagaccttcgttgagttaatgcgtcgcggagatctgcccgtctggctcagctacaaggtggcatcggagggttttcagtattctgaccgaagatggtgtttcgatggcgaaaggaacaatcaggtgctggaggaaaacatggacgtcgagatttggacaaaagaaggggagcggaagaaacttcgccctagatggctggacgccaggacctactccgatccgctcgctttgcgggagtttaaggagttcgccgctggacgaagaagcgtttcaggcgacctgatcctagagatcggtaaactgccacaacacctcactcttcgcgcacagaatgccctggataacttagtgatgttgcacaatagtgaacaagggggaaaggcttataggcatgccatggaggaactgcccgacacgattgagaccctcatgctgcttgcactgatagcggtactcacaggaggcgtgactttgtttttcctgtctgggaaaggattaggtaagacctccatcggcctactgtgcgtcacagccagctcagctctcctttggatggccagtgtggagcctcactggattgcagctagcatcattctggaatttttcttgatggttctgctcatccccgagccagatcggcagcgtacccctcaggacaaccagctggcctacgtggtcatagggcttctctttatgatcctgactgtagcagccaacgaaatgggattgctggagacaacgaagaaagatttaggcattggttacgtggctgcggagaatcatcagcacgccaccatgctagacgttgatctgcaccccgcatccgcttggactctctatgccgtggccacaaccgtcatcaccccaatgatgagacatacaattgaaaacactacggcaaatatctctcttaccgctatagccaaccaagcggctattctgatggggttggacaagggctggcctatcagcaaaatggatattggagtgccgctgctcgccctgggctgttactcccaggtcaatccccttacattaactgcagccgtgctgatgctcgttgctcactatgcaatcatagggccaggattgcaggccaaggcgaccagggaggctcagaaacgcacagccgcaggcatcatgaagaaccctaccgtggacggtattgtagccatcgatctggaccccgtggtctacgacgttaagttcgaaaaacaactagggcagattatgctgctcatcctttgcacttcacagatactgttgatgcggacgacatgggctctgtgtgagtctattaccctcgccactggaccactgaccacattatgggaaggcagtcctggtaagttttggaatactaccatcgcagtgtcgatggctaacatcttccgaggcagctatcttgccggggcgggactggccttctccctcatgaaatctctaggcgggggaagaaggggcacaggtgcacagggggagacgctgggagagaagtggaaacgccaattgaatcagctgtcaaagagcgaatttaacacctacaagcggtccggcattatggaggtcgatagaagtgaagctaaagagggtctcaagcgtggcgaaactacaaatcatgccgtgtctagggggaccgcaaaacttcggtggttcgtagagcgcaacctggtgaagcccgagggaaaagttatcgacttgggctgcgggcgaggaggctggagctattactgtgctggtctgaagaaggtgactgaagtcaaagggtacacaaagggaggcccgggccacgaggaaccaatacctatggccacctatgggtggaatctcgtgaaattacattcaggaaaggatgtctttttcatgcccccagagaaatgcgacacgctgctttgtgatattggtgaatccagtcccaaccctaccatcgaggagggcagaacactgagggtgctaaagatggttgaaccgtggctccgggggaatcagttttgcattaaaatcctgaacccctacatgccaagcgtagtggagactttggaacagatgcaacgcaagcacggaggcatgctggtcagaaatcctctctctaggaactccacccacgagatgtattgggtgtcatgtggtacagggaacatagttagcgccgtgaatatgacttcgcgaatgcttctgaaccggttcaccatggcgcatcgtaagcccacatacgagagagacgtcgatttaggagctggcacccgccacgtgactgtagaacctgaggtggcaaatctggacatcattggccagaggatcgaaaacattaaaaatgagcataagtctacgtggcactatgatgaagacaacccatacaaaacatgggcctatcacgggagttacgaggttaagccctccggaagcgcttcatccatggtcaatggtgtggtgcggttgctcaccaaaccttgggatgtcatcccaatggttactcagattgccatgaccgacacaacgccctttggccaacagagagtgttcaaggagaaggtagacacccgcactccgagggcaaaacgagggacaacccagatcatggaagtgactgccaagtggctgtggggatttctatctcggaacaaaaagcctagaatatgcacaagggaggagttcacccgcaaagtccgtagcaatgctgcgattggcgccgtgtttgttgatgagaaccagtggaatagtgcaaaggaagctgtggaggacgagcggttctgggatcttgtccatagagaaagggagctgcacaagcaaggtaaatgcgccacatgtgtgtacaacatgatggggaagcgcgagaaaaagctcggagagtttggcaaagcaaagggctcccgagccatctggtatatgtggctgggggctcggttcttggagttcgaggccctgggatttatgaatgaggaccattggttcagcagagaaaactctctctcaggtgtagagggcgaagggcttcacaagctgggatacatcttaagggatattagtaaaataccaggcggtaatatgtatgcggacgatactgcagggtgggacacccgcatcacggaggatgacctgcagaacgaggccaagattaccgatatcatggaacccgagcatgctttgctcgccacatccatttttaaactgacttaccagaacaaggttgtgagagtccagcggcctgccaaaaatggaaccgtgatggacgtgatcagcaggcgtgatcaacgaggctctggccaggtcgggacatatggactaaacactttcaccaatatggaagttcagcttatacgccagatggagtcggaaggtatctttctgccatcagagctcgagacgcccaacctggctgaaagagtgttggactggttagagaagcacggcgccgaacggctgaaaaggatggctattagcggggacgattgcgtagtgaagccgatcgacgatcgcttcgccacagcactcaccgcgcttaatgacatgggaaaggtcagaaaagatattcctcaatgggagccctccaagggctggaacgactggcaacaggtgccattttgtagtcaccatttccaccagctgatcatgaaagatggtcgggaaatagttgtgccttgcaggaatcaagacgagctagtcgggcgagcccgtgtgtctcagggagctggctggagcctgagagagactgcctgtctcggcaagtcctacgcacagatgtggcaattgatgtattttcatcgccgggatctgaggcttgctgccaacgcaatttgctcagccgtacccgttgactgggtgccaacaagtagaaccacttggtctatccacgcgcaccatcagtggatgaccacagaagatatgctgagcgtctggaatcgcgtgtggatcgaggaaaacccctggatggaggacaaaacgcacgtttcctcatgggaagaggtgccttacctcgggaagcgggaggaccagtggtgtggcagcttaattggtctgaccgctagggccacttgggcaacaaatatacaggtcgccatcaaccaagtgcgaagattgattggcaatgaaaactacctggattatatgacctctatgaagcggttcaaaaatgagtccgacccagaaggggctctctggtga

SEQ ID NO: 13535 - RNA, 9879 nt, synthetic construct
  misc_feature 1..9879: note = derived and/or modified CDS sequence (opt3) from DENV-1__GU056031__SS-prME
  source 1..9879: mol_type = other RNA
agcgtgaccatgctgctaatgcttctgcccactgccttggctttccacttaactacgaggggcggggagcctcatatgatcgtctccaagcaggaaaggggaaaatctctgctatttaagacctcagccggtgttaacatgtgcacactcattgccatggacctgggcgagctttgtgaagatactatgacctacaaatgcccacggataaccgaggcggaaccggacgatgtggactgttggtgcaatgctaccgatacttgggtaacatatgggacctgtagtcaaacgggagagcaccgccgagagaagcgtagcgtggccctggcaccccatgtcggcttgggtctcgaaactagaaccgagacatggatgtcctctgaaggggcctggaaacagatccagagggtggagacttgggctctgcggcaccctggattcaccgttattgcatttttcctggcccatgctatcggcacatcgattacccagaagggcatcatatttatcctcttaatgctggtgacgccatcaatggccatgcgctgcgtcgggattggaaacagagacttcgtggagggtcttagcggcgcgacttgggtagatgttgtgttggaacacgggagttgtgtcacaaccatggcaaagaataaacccactctggacatcgagctactcaagacagaagtgaccaaccctgccgtgctgaggaaactttgcattgaggctaagatctccaatacgaccacagattctcggtgtccaactcaaggagaagccaccctggtcgaggagcaggacgcaaactttgtttgccgccgaacattcgtggatagaggctggggtaatgggtgtggattgtttggcaaaggcagcctcctgacttgcgctaagttcaagtgcgtaaccaaattagaagggaagatagtgcagtacgagaacctgaaatattccgtcattgtgacagttcacaccggagaccagcatcaagtgggtaatgaaactacggagcacggcacaatcgccaccattactccccaggcgcctacctcagaaatccagctcacagattacggggcccttaccctggactgtagtccaaggactggattggactttaacgagatggtcctactgacaatgaaggagaaaagctggctcgtgcataagcagtggttcctggatcttccgctgccctggacgtctggcgcatccacctcacaagaaacttggaatcggcaggacttgctcgtaacatttaaaaccgctcacgccaagaagcaggaggttgtggtcctgggtagccaagaaggggctatgcacacagccttaactggcgcaaccgagatccagacgagtggaaccacaactattttcgccggccatctgaaatgccgtctaaagatggataaactcaccctgaaggggatgtcttatgtgatgtgtacaggatccttcaaacttgaaaaggaggtcgctgagactcagcacggtaccgtgttggttcaggtgaagtacgaaggcacggacgcgccttgcaaaataccatttagcacacaagatgagaagggggtaacccagaacggacgcctgatcactgcaaatcccattgtcacagacaaagaaaagcctgtgaacatcgagaccgagccacccttcggcgaatcgtatatagttgtgggtgccggggagaaagctctcaagctgtcttggtttaagagaggctcctcaattggaaaaatgttcgaagccactgcaaggggcgcccggcgaatggctatccttggggataccgcctgggactttggaagtatcggtggcgtcttcacaagcgtggggaagctggtacatcaggtgtttggaacggcatacggcgttttgttctccggtgtctcttggaccatgaaaattgggatcggcattctcctgacttggttaggactgaatagccgctcaacaagtctatccatgacctgtatagcggtgggcatggtgacactctacctgggggtcatggttcaggctgatagcggatgcgtgatcaactggaagggcagagagcttaaatgtggttctgggatttttgtgactaacgaagtacacacctggacggagcaatataagttccaggccgactcaccgaagaggttgagtgcagccatcggaaaggcttgggaggaaggcgtctgcggtatccggagcgccacacgcctggagaatattatgtggaagcagatatccaacgaactcaatcatatcctgttagagaacgatatgaaatttaccgtggttgtgggcgacgcaaatgggattctggctcagggaaagaaaatgatcagacctcaacccatggaacacaagtactcttggaaatcgtggggcaaggccaagattatcggggcggacatacagaacactaccttcatcattgatggaccagacacacctgagtgtcccgatggccagagggcctggaatatctgggaggtcgaagactatggttttggggtgttcactaccaacatttggcttaaattgcgtgatagctacacacagatgtgcgaccaccggctcatgtccgctgcaatcaaggattcaaaagccgttcatgctgacatgggatattggatagagagtgaaaagaatgagacgtggaaactggcccgagcatctttcattgaagtgaagacctgtacttggccaaagagccacacactatggtccaacggcgtactggagtcagagatgatcattcccaaaatctacggtggccctataagccaacataattatagaccagggtactttacccagactgcgggaccgtggcacctcggcaagctggaacttgatttcaacttgtgcgaggggacaaccgtcgtggtggacgaacactgcggaaataggggcccctctctgcgcacgactaccgtcacaggtaaaatcattcatgagtggtgttgccggtcctgtaccttacctccactcagatttagaggggaagatggatgctggtacggcatggaaatccgccccgttaaggagaaagaagagaacctggtgcgaagtatggtaagcgccggttctggcgaagtggactccttctcacttgggattctgtgtgtcagtatcatgatagaggaggtgatgcggagccgttggtcgagaaagatgttgatgactggaacactcgctgtttttctgctactgattatgggccagctcacctggaatgatctgatcaggctttgcatcatggtgggggccaacgcatccgaccgcatgggaatgggcacaacttatttggctctgatggccaccttcaagatgcggcctatgtttgcagtcggtttactcttcagaaggctgacgtctcgagaagtgcttctgctaacaattgggctcagcctggttgcctcagtggagttgccaaacagtctggaagagttaggagacggcctcgctatgggcatcatgatgctgaaacttctgaccgaatttcaaccccaccagttgtggactaccctcctgtccctaacattcgtcaagactaccctgtctcttgattacgcgtggaaaacgacagccatggtactcagcattgtgtccctgtttccgttgtgtctgtcaaccactagccagaagacaacctggttacctgttctcctggggagtttcggatgcaaaccatctactatgtttcttataacagagaataagatctggggtcgcaagtcctggcccctgaacgagggcattatggcaatcgggattgtgagcatcttgctctcgtcactgctcaagaatgacgtccctctggctggaccccttatagccggcggtatgctcatcgcctgttatgtgatttctgggagttccgctgatctgagcttggaaaaggcagccgaggtatcttgggaacaggaggcggaacatagcggagcttcccacaacatcttagtggaggtccaagacgatggcaccatgaaaattaaggacgaggaacgggatgacacgctgactatcctcctgaaagccacccttctggcagtttcaggcgtgtacccaatgagtatacctgccacattgttcgtgtggtatttctggcagaagaaaaagcagagaagcggggtcctatgggataccccctctccaccggaggtggaaagggctgttctggacgatggaatttaccgtatcctccagcgcggtctgcttggccggtcccaagtaggggtgggagtctttcaggacggcgtgttccatacaatgtggcacgttactagaggtgcagtgttaatgtatcaggggaagaggctggagccttcatgggccagtgtcaaaaaggatctcatcagctacggaggcggctggcgatttcaggggtcctggaataccggagaggaagtgcaagtaattgcggtcgagcccggtaaaaacccaaagaatgtgcagacgacacccggcactttcaaaacccctgaaggggaggttggagctatagccttggactttaagccaggcacatctggttcgcccatcgtgaaccgggaagggaagattgtcggactgtacggcaatggcgtggttaccactagcgggacctatgtgtcagcaatcgcccaggctaaagcctcccaagagggacctctcccggagattgaagacgaggtcttcaagaaacgcaacctgacaatcatggatcttcacccaggtagtggcaagacgagaaggtacctgcccgcaatagtgcgggaagctatcaaacgaaagttgagaactctaattctggcccctacccgcgtagtggcgtctgagatggccgaagcactcaaggggatgccaatcaggtatcagacaaccgctgttaaaagcgagcatactggacgtgagattgtcgacttaatgtgccacgccacatttaccatgcggctgctttcccccgtgagagtgcctaattacaacatgatcataatggatgaagctcatttcacggacccggcatcaattgccgccaggggctatatctctactcgcgtcggtatgggggaggctgcggcaatctttatgacagccacacccccaggaagcgtagaggctttccctcagagtaatgccgtgattcaggatgaggaacgagacatccccgagagatcctggaacagcggctacgattggataaccgactttccaggcaagactgtttggttcgtgccttctattaaatcagggaatgatatcgcaaactgtctgcggaagaacggaaaaagggtcattcaactctcccgcaagacattcgacaccgagtatcagaagactaaaaataacgattgggactacgtggttactacggacatcagtgaaatgggtgccaattttcgtgctgatagagtgatagacccccggaggtgcttgaagccagtcattctgaaagatggcccggagcgcgtgatcctcgcggggcctatgcccgtaaccgtggccagcgcagctcagcgaagaggacggatcggcaggaaccagaataaggaaggtgaccaatacgtttatatggggcagccactgaacaatgatgaggaccacgcccattggacagaggcaaaaatgcttctagataacattaatactcccgaaggcatcattcctgccctgttcgagccagaacgcgagaagtcggctgccatagacggagaatacagattgaggggcgaggcgcggaagacctttgtcgagttaatgcgtcgcggggatctgcccgtgtggctctcttataaagtggcatccgaaggattccagtacagcgaccgaagatggtgctttgatggtgagaggaacaatcaggtcctggaagagaacatggacgttgaaatctggacaaaggagggcgagcggaagaaacttcgccctagatggctggatgccaggacctattcagacccgctcgctttgcgggagttcaaagagtttgccgctgggcgaagaagtgtgtctggagacctgattctagaaatcggcaaactgccacaacacctcactcttcgcgcacagaatgccctggataacttagtaatgttgcacaattccgagcagggtgggaaggcttacaggcatgccatggaagaactgcccgacacgatcgagaccctcatgctgcttgcactgattgcggtgctcacaggcggagtcactttgttctttctgagcggcaaggggttaggaaagacctcaataggtctactgtgtgtgacagccagtagcgctctcctttggatggcctccgttgaacctcactggatcgcagcttctattatcctggagttctttttgatggtgctgctcattcccgaaccagatcggcagcgtacccctcaagacaaccagctggcctatgtcgtaatcggccttctcttcatgatactgactgtggcagccaacgagatggggttgctggagacaacgaaaaaggatttaggaatcggctacgttgctgcggaaaatcatcagcacgccaccatgctagacgtggatctgcaccccgcaagcgcttggactctctacgccgtcgccacaaccgtgattaccccaatgatgagacatacaatcgagaacactacggcaaatatttcccttaccgctatcgccaaccaagcggctatactgatgggtttggacaaagggtggcctatttcaaagatggatatcggcgtcccgctgctcgccctgggatgctattctcaggtgaatccccttacattaactgcagccgttctgatgctcgtggctcactacgcaattatcggcccagggttgcaggccaaagcgaccagggaagctcagaagcgcacagccgcaggaataatgaagaaccctaccgtagacggcatcgtggccattgatctggaccccgtcgtttatgatgctaaatttgagaagcaactaggtcagatcatgctgctcattctttgtacaagtcagatcctgttgatgcggacgacatgggccctgtgcgaatcgataaccctcgcaactgggccactgaccacattatgggagggaagccctggcaaattctggaatactaccattgctgtgtccatggccaacatcttccgaggttcttaccttgcgggcgccgggctggcattttcactcatgaaaagcctaggaggcgggagaaggggaacaggcgctcagggtgagacgctgggggaaaaatggaagcgccaattgaatcagctgtccaagagtgagttcaacacctataaacggtctggaatcatggaagtcgacagaagcgaggccaaggaaggcctcaaacgtggtgagactacaaagcatgcagtgtcaaggggcaccgctaaacttcggtggtttgtagagcgcaatctggtgaagcccgaagggaaggttattgacttgggatgtggccgagggggatggtcctactattgcgccggcctgaaaaaggtgactgaggtcaaaggttacacaaaagggggaccgggccacgaagaaccaatccctatggccacctacggctggaacctcgtgaaattacatagtgggaaggatgtcttctttatgcccccagaaaaatgtgacacgctgctttgcgatataggagagagctctcccaatcctaccattgaggaaggtagaacactgagggtgctaaagatggttgagccgtggctccggggcaaccagttctgtatcaagattctgaatccctatatgccatccgtagtggaaactttggagcagatgcaacgcaaacacgggggaatgctggtcagaaaccctctctcaaggaatagcacccacgagatgtactgggtgtcgtgcggcacaggtaacatcgtttctgcggtgaacatgacaagtcgaatgcttctgaatcggtttaccatggctcatcgtaagcccacatatgaaagagacgtcgatttaggggcaggaacccgccacgtggccgtagagcctgaagtggctaacctggacataatcggccagaggattgagaatatcaaaaacgaacataagtccacttggcactacgatgaggacaatccatataaaacgtgggcctaccacggcagctatgaggttaagccctcagggtccgcatctagcatggtcaacggagtggtgcggttgctcacaaagccttgggatgtcattccaatggttacccagatcgccatgactgacaccacacccttcggtcaacagagagtgtttaaagaaaaggtagatacgcgcaccccgagggctaaacgaggcactacacagattatggaggtgaccgcgaagtggctgtgggggttcctaagtcggaataaaaagcctagaatctgtactagggaagagtttacacgcaaggtccgttccaacgccgcaataggagctgtgttcgttgacgaaaatcagtggaacagcgccaaagaggcagtggaggacgaacggttttgggatcttgtccatagagagagggaactgcacaagcaaggcaaatgcgcaacctgcgtgtacaatatgatgggtaagcgcgagaaaaagctcggggagttcggaaaggctaaaggctctcgagccatttggtacatgtggctgggcgcgcggttcttggagtttgaggcactggggttcatgaacgaagaccattggttttcaagagagaatagtctctccggagtagaaggtgagggccttcacaagctggggtatatcttaagggatatcagcaaaattccaggaggcaacatgtacgccgacgatacagctggttgggacactcgcataaccgaggatgacctgcagaatgaagccaagatcacggatattatggagcccgaacatgcattgctcgctacctctatcttcaaactgacatatcagaacaaggttgtgagagtccagcggcctgccaaaaacgggactgtgatggacgtgatttcgaggcgtgatcaacgaggatcaggccaggtcggcacctacgggctaaatacatttactaacatggaggttcagcttatccgccagatggaaagcgagggaatattcctgccatccgagctcgaaacccccaatctggctgagagagccttggactggttagaaaagcacggtgcagagcggctgaagaggatggcgatcagtggcgatgactgtgtggtaaaaccgattgacgatcgctttgccacggctctcacagcccttaacgacatggggaaggtgagaaaagatatccctcaatgggaaccctctaagggatggaatgactggcagcaggtcccattctgcagccaccattttcaccagctgattatgaaagatggccgggagatcgtggttccttgtaggaaccaagacgagctagtgggtcgagcacgtgtctcccagggggctggatggtcactgagagaaaccgcctgcctcggcaagagttatgcacagatgtggcaattgatgtacttccatcgccgggatctgaggcttgccgcgaatgctatatgttctgccgtgcccgtagactgggttccaactagcagaacaacctggtccattcacgcacaccatcagtggatgactaccgaggatatgctgtcagtgtggaaccgcgtctggatcgaagagaatccctggatggaagacaagacacacgtgagctcttgggaggaggttccttatctcggcaaacgggaagatcagtggtgcgggtccttaatcggactgacggccagggctacctgggccactaacattcaggtggcaataaatcaagtccgaagattgatcggtaacgagaattacagtgactacatgacaagcatgaagcggtttaaaaacgaatcggacccagagggcgctctgtggtga

SEQ ID NO: 13536 - RNA, 9879 nt, synthetic construct
  misc_feature 1..9879: note = derived and/or modified CDS sequence (opt3) from DENV-1__GU056032__SS-prME
  source 1..9879: mol_type = other RNA
agcgtggccatgctgctcatgcttctgcccaccgctttggcattccacttaacaactagaggcggggagcctcatatgatcgtctccaagcaggaaaggggaaaatctctgctatttaagacgtcagccggtgttaacatgtgcaccctcattgcgatggacctgggcgagctttgtgaagatacaatgacttacaaatgcccacggataaccgaggctgaaccggacgatgtggactgttggtgcaatgccacagatacctgggtaacttatgggacatgtagtcaaaccggagagcaccgccgagacaagcgtagcgtggcactggccccccatgtcggcttgggtctcgagacgagaactgaaacctggatgtcctctgagggggcttggaaacagatccagagggtggaaacatgggcactgcggcaccctggattcactgttattgccctgtttctcgctcatgccatcggcacctcgattacacagaagggcatcatattcatcttactgatgcttgtgaccccatcaatggcgatgcgctgcgtcgggattggaaacagagattttgtggagggtttgagcggcgcaacgtgggtagacgttgtgctggagcacgggagttgtgtcactacaatggccaagaataaacccaccctagatatcgaactcctgaagactgaggtgacaaaccctgctgtgcttaggaaactgtgcattgaagccaagatctccaataccacgaccgactctcggtgtccaacacaaggagaggcaactttggtcgaagagcaggatgctaacttcgtttgccgccgaacctttgtggacagaggctggggtaatgggtgtggactcttcggcaaaggcagcctgttaacatgcgccaagtttaagtgcgtaactaaactggaggggaagatagtgcagtacgaaaacctcaaatattccgtcattgtgaccgttcacacaggagatcagcatcaagtgggtaatgagaccactgaacacggcacgatcgcgacaattaccccccaggcccctacttcagagatccagcttaccgactacggggcactgacattggactgtagtccaaggaccggactagatttcaacgaaatggtcctgctcactatgaaggagaaaagctggctggtgcataagcagtggtttcttgacctgccgttgccctggacatctggcgcttccacgtcacaagagacctggaatcggcaggatctcctggtaactttcaaaacagcccacgctaagaagcaggaagttgtggtcttaggtagccaagagggggccatgcacaccgcactgacaggcgccactgaaatccagaccagtggaacgaccacaatttttgctggccatctaaaatgccgtctcaagatggacaaactgactcttaaggggacctcttatgtgatgtgtacaggatccttcaaattggagaaggaagtcgcggagactcagcacggtaccgtgctggttcaggtgaagtacgagggcacggatgcaccttgcaaaataccattcagcacacaagacgaaaagggggtaacccagaacggacgcctcatcactgccaatcccattgtcacagataaagagaagcctgtgaacatcgaaaccgagccaccctttggcgagtcgtatatagttgtgggtgctggggaaaaagccctgaagctttcttggttcaagaaaggctcctcaattggaaagatgtttgaggcaactgccagaggcgctaggcggatggccatcctgggggacaccgcatgggatttcggaagtatcggtggcgtctttacaagcgtggggaaattggtacatcaggtgttcggaacggcgtacggcgttctcttttccggtgtctcttggaccatgaagattgggatcggcattctgttaacttggctgggactaaatagccgatcaacaagtctctccatgacctgtatagctgtgggcatggtgacactgtaccttggggtcatggttcaggccgacagcggatgcgtgatcaactggaaaggccgcgaattgaagtgtggttctgggattttcgtgactaacgaggtacacacctggacggaacaatataagtttcaggcagattcaccgaaaagactgagtgccgctatcggaaaggcctgggaggagggcgtctgcggtatcaggagcgcaacacggctcgaaaatattatgtggaaacagatatccaacgagctgaatcatatcttactggaaaacgacatgaagttcaccgtggttgtgggcgacgctaatgggattcttgcccagggaaaaaagatgatccgccctcaacccatggagcacaaatactcttggaagtcgtggggcaaggcgaaaattatcggggccgatatacagaacactacctttatcattgacggaccagatacacctgaatgtcccgacgatcagagagcttggaatatctgggaggtcgaggactatggcttcggtatttttactaccaacatctggttgaagctcagggatagctacacacagatgtgcgaccaccgtctgatgtccgcagccataaaagattcaaaggctgtgcatgccgacatggggtattggattgaaagtgagaaaaatgaaacgtggaagctagcacgggcgtctttcatcgaggttaagacctgtacttggccaaaaagccacacactgtggtccaacggagtgctcgaatcagagatgattatccccaagatatacggcggtcctatcagccaacataattatcgaccaggctacttcacccagactgccgggccgtggcacctgggaaaacttgagttggattttgacctgtgcgaaggcacaaccgtagtcgtggatgagcactgcgggaacagaggaccctctttaaggacgactaccgtgacaggcaagattatccatgaatggtgttgccgctcctgtaccctccctccactgcggttcagaggtgaggacgggtgctggtacggaatggagattaggcccgtcaaagaaaaggaggaaaatcttgttcgcagtatggtgagcgctggctctggtgaggtagactccttttcactgggcatcttgtgtgtgagtataatgattgaagaggtcatgcgaagccggtggtcgcgtaagatgctcatgactgggacactggccgtgttcctactgctcatcatgggacagctgacctggaacgatcttatcagattgtgcattatggttggcgcaaatgcttccgacaggatggggatgggaacaacttatctggccttaatggcaacctttaaaatgcgccctatgttcgccgtgggcctcctgtttcggagacttacgtctagggaggtcctgctactcacaatcggtctgagcttggtggcttcagttgaactgccaaacagtttagaggaactcggggatggactggcgatgggcattatgatgcttaagctgttgaccgagttccaaccccaccagctctggactaccctgctatccctgacatttataaaaactaccctttctctcgactacgcctggaagacgacagcaatggtgctgagcatcgtctccttgttcccgctgtgtttatcaaccactagccagaaaacaacctggctccctgtactgcttggcagttttgggtgcaagccactgactatgttcttgattacagaaaacaagatctggggacgaaaatcttggcccctcaatgagggtattatggctgtgggcatcgtttccatgctgctaagctcgctgcttaagaacgatgtgcctctcgccgggcccctgatagccggaggcatgttgatcgcttgttatgtcatttcaggttctagtgcagacttatccctggagaaagccgcggaagtgagctgggagcaggaagctgagcattctgggaccagccacaatatcctcgtagaagtgcaagatgacggaacgatgaagattaaagatgaggagcgcgacgatactctgaccatccttctgaaggccacattgctagcagtctccggcgtttacccaatgtcaatacctgccaccctgtttgtgtggtatttctggcagaaaaagaagcagcggagtggcgtgctctgggacacacccagcccaccggaagtcgagagagctgtgctggatgacgggatttacaggatccttcagcgtggattactgggtcgctctcaagttggcgtaggggtgttccaggacggagtctttcatactatgtggcacgtgacccggggcgcagttctcatgtatcagggtaaaagattggaaccttcctgggcctcagtgaagaaagatctgatcagttacgggggaggctggaggttccagggcagctggaacacgggggaggaggtccaagtgattgcggtagaacccggaaagaatccaaaaaacgtccagacaactcccggtacctttaagacacctgagggcgaagtgggggctatagccctcgacttcaagccaggaacctccggctctcccatcgttaatcgagagggtaaaattgtggggctgtacggaaacggcgtcgtgactacctcgggcacatatgttagcgcaatcgcccaggctaaggcctcacaagaagggcctcttccggagattgaggatgaagtgtttaaaaagcggaatctgacgatcatggacttgcacccaggatccggtaaaactcgcagatacctacccgcaatagtcagggaggctatcaagcggaagctgcgaaccctcattttagcccctacaagagtggtagcgagtgaaatggccgaggcactgaaaggcatgccaatccgctatcagaccactgctgtgaagtctgaacatacagggagggagattgttgatcttatgtgccacgccaccttcacgatgcgtctgctcagccccgtccgggtgcctaactacaatatgatcataatggacgaggctcattttactgatccggcatccattgccgccagaggatatatctcaacaagggtgggcatgggtgaagctgcggcaatcttcatgaccgccacccccccagggtctgtcgaggcttttcctcagagcaacgccgtaattcaggacgaagagcgcgatatccccgaacgaagttggaattccggatacgactggataactgatttcccaggcaaaacagtgtggtttgttcctagcattaagtctggcaacgacatcgcaaattgtttgagaaaaaacgggaagcgggtgattcaactgtcaaggaagaccttcgacacagagtatcagaaaactaagaacaatgattgggactacgtcgtgacgaccgatatctccgagatgggagccaacttccgcgctgaccgtgttatagatcccagacggtgcctcaaaccagtgattctgaaggacggtccggaaagggtcatccttgcgggccctatgcccgtgacagtagccagtgcagctcagcgccgagggagaatcggacggaatcagaacaaagagggcgatcaatacgtgtatatgggtcagccactaaataacgacgaagatcacgcccattggactgaggcaaagatgctgttggacaatattaacacccccgaggggatcattcctgccttatttgaaccagagagggaaaagagcgctgccatagatggcgagtaccgcctgagaggagaagcgaggaaaacattcgttgagctcatgcggcgtggcgacctgcccgtctggctttcgtataaggtggcatctgaggggtttcagtactccgatcgccgatggtgcttcgacggagaaagaaataaccaggtgctggaggaaaatatggacgtcgagatctggaccaaagaaggtgagaggaagaaactccggcctcgctggttggatgccagaacttatagcgacccgctggctctaagggagtttaaggaattcgccgctggccggcgatcagttagtggggatctgattctcgagatcggaaaacttccacaacacctgacgttaagagcacagaacgccttggacaatctggtgatgctccacaactctgaacagggcggtaaggcttaccgccatgccatggaggaactgcccgataccatcgagacacttatgctgctcgcattgattgcggtactgactgggggcgtgaccttatttttcctatccggaaagggcctggggaaaacaagcataggactcctttgtgtcaccgcctcaagtgctctgttgtggatggccagcgtggagcctcactggatcgcagcttccattatcctggaatttttcctcatggttctgcttattcccgagccagacaggcagcggactcctcaagataatcagctcgcctatgtggtcatcggtctgttgtttatgatactgacagtagcagccaacgaaatgggcttactagagacgaccaagaaagacctggggatcggacatgtggctgcggagaaccaccagcacgccactatgctcgatgttgaccttcgtcccgcatctgcttggacactgtacgccgtggccaccaccgtcattacaccaatgatgagacatactatcgaaaatacgaccgcaaacattagcttgacagctatcgccaatcaagcggctatactgatgggcctcgataagggttggcctatttccaaaatggacatcggggtgccgctgcttgccttaggctgctactcacaggtcaaccccctgactctcaccgcagccgtgttgatgctggttgctcactatgcaattatcggaccaggcctacaggccaaggcgacaagggaggctcagaagcgcaccgccgcagggataatgaaaaatcctactgtggatggaatcgtagccattgacctggaccccgtggtctacgatgctaagttcgaaaaacaactcggccagatcatgcttctgattttgtgtacgtctcagatcctgctcatgcggacaacctgggccctgtgcgagagtataactttagcaaccggtccacttacaactctgtgggaagggtcgcctggaaagttttggaacaccacaattgctgttagcatggccaatatcttccgaggctcctatctcgcgggtgccggcctagcattctctctgatgaaatcattggggggaggcagaagggggacgggagctcagggcgagaccctgggtgagaagtggaagcgccaactcaaccagcttagcaaatccgaatttaatacttacaagcggagtgggatcatggaggtggacagatctgaagccaaagagggactgaagcgtggcgaaacaaccaaacatgcagtcagcaggggtactgctaagttgcggtggttcgtggagcgcaacctggtaaagcccgagggcaaagtgattgatctcgggtgtggacgaggcgggtggtcatattactgcgccggattaaagaaagttacagaagtgaagggctataccaaaggtgggccgggacacgaggaaccaatccctatggccacgtacggctggaatctggtcaagcttcattccggcaaagacgtgtttttcatgcccccagagaagtgtgataccctgctatgcgacataggggaaagtagccccaaccctacaattgaggagggaagaactctcagggtcctgaagatggtggaaccgtggttgcggggtaatcagttttgtatcaaaattctgaacccctacatgccatctgttgtagagaccctcgaacagatgcaacgcaagcacggcgggatgcttgtgagaaatcctctgtccaggaactcaacacacgagatgtattgggtcagctgcggaactggcaatatcgtgtcggcggttaacatgacctctcgaatgttactgaaccggttcacaatggctcatcgtaaacccacctacgagagagatgtggacttgggtgcagggactcgccacgtcgccgtggaacctgaggtagctaatctcgatataatcggacagaggattgaaaacatcaagaatgagcataaaagtacgtggcactatgacgaagataacccatacaagacatgggcctatcacggctcctacgaggtgaagcccagcggctcagcatcctctatggttaatggggtcgtgcggctgctaaccaaaccttgggacgtgattccaatggtcactcagatcgccatgaccgacacaacgccctttggacaacagagagttttcaaggagaaagtggatacccgcactccgagggctaagcgaggtacaacccagattatggaagtaactgcgaaatggctttggggctttctgagccggaacaagaagcctagaatctgtacaagggaggaattcacccgcaaagtgcgtagtaatgccgcaataggggctgtctttgtggacgagaaccagtggaattccgccaaggaagcagttgaggatgagcggttctgggacctcgtgcatagagaaagggagctgcacaaacaaggaaagtgcgccacatgcgtctataacatgatgggcaaacgcgaaaagaagttgggtgagtttgggaaagctaagggaagccgagccatttggtacatgtggctgggcgcgcggttcctcgaattcgaggcacttggctttatgaatgaggatcattggttctctagagaaaactcactgagtggggtggagggagaaggtttacacaaactgggctacatcttgagggacatctccaagattccagggggaaatatgtatgccgatgacactgctggctgggatacccgcataacggaggacgatctccagaacgaggccaaaatcaccgacattatggaacccgagcatgcactgctagctacaagcatctttaagcttacttaccagaataaagtagttagagtgcagcggcctgccaagaacggtaccgtcatggatgtgatttctaggcgtgaccaacgagggtcgggacaggtgggcacatatggcctgaacactttcaccaatatggaagtccagctcatccgccagatggagtcagaagggatatttctgccaagcgagttggagacgcccaacttagctgaaagagttctggactggctcgagaagcacggagccgaacggcttaaaaggatggcaatctccggtgatgactgtgtggtaaagccgattgatgaccgcttcgcgacagccctgaccgctctaaatgatatgggcaaaatcagaaaggacattcctcaatgggagcccagtaaagggtggaacgattggcagcaggtgccattttgctctcaccatttccaccagctgatcatgaaggacggacgggaaatagtcgtgccttgtaggaatcaagatgagctcgttggccgagcccgtgtgagccagggtgcagggtggtccttgagagagactgcttgcctgggaaagtcatacgcccagatgtggcaacttatgtattttcatcgccgggacctgaggctcgcagccaacgcgatttgtagtgctgtccccgtggattgggtaccaacatctagaaccacttggagcatccacgcccaccatcagtggatgaccacagaagacatgttatccgtttggaatcgcgtgtggatcgaggaaaacccctggatggaggacaaaacgcacgtctcaagctgggaagaggtgccttacctgggcaagcgggaggatcagtggtgcggctctttgattgggctgaccgcaagggccacttgggctacaaatatacaggttgccatcaaccaagtgcgaagactcattggaaatgaaaactatcttgactacatgacctccatgaaacggttcaagaatgagagtgatactgaaggtgcactgtggtga

SEQ ID NO: 13537 - RNA, 9879 nt, synthetic construct
  misc_feature 1..9879: note = derived and/or modified CDS sequence (opt3) from DENV-1__GU056033__SS-prME
  source 1..9879: mol_type = other RNA
agcgtgaccatgctgctcatgcttctgcccacagccttggctttccacttaactacgagaggcggggagcctcatatgatcgtctccaagcaggaaaggggaaaatctctgctatttaagacctcagttggtgtgaacatgtgcacactcattgcaatggacctgggcgagctttgtgaagatactatgacctacaaatgcccacggataacagaggccgaaccggacgatgtagactgttggtgcaatgcgaccgatacttgggtgacatatgggacctgtagtcaaacgggagagcaccgccgagacaagcgtagcgtcgctctggccccccatgtgggcttgggtctcgagactagaaccgaaacatggatgtcctctgagggggcatggaaacagatccagagggttgaaacttgggccctgcggcaccctggattcaccgtgattgctctgtttctcgcacatgccatcggcacatcgattacccagaagggcatcatattcatcttactgatgcttgtcacgccatcaatggctatgcgctgcgtggggattggaaacagagattttgtagagggtttgagcggcgccacttgggttgacgtggtcctggagcacgggagttgtgtgacaaccatggcgaagaataaacccactctagatatcgaactcctgaagacagaggtgaccaaccctgcagtccttaggaaactgtgcattgaagccaagatctccaatacgaccacagactctcggtgtccaactcaaggagaggctaccttggttgaagagcaggatgccaacttcgtgtgccgccgaacatttgtagacagaggctggggtaatgggtgtggactcttcggcaaaggcagcctgttaacttgcgcaaagtttaagtgcgtgaccaaactggaggggaagatagtccagtacgaaaacctcaaatattccgtgattgttacagtgcacaccggagatcagcatcaagtcggtaatgagactacggaacacggcacaatcgctaccattactccccaggcccctacctcagagatccagcttacagactacggggcgctgaccttggactgtagtccaaggactggactagatttcaacgaaatggtgctgctcacaatgaaggagaaaagctggctggtacataagcagtggtttcttgacctgccgttgccctggacgtctggcgcctccacctcacaagagacttggaatcggcaggatctcctggttacattcaaaaccgcacacgctaagaagcaggaagtggtcgtgttaggtagccaagagggggccatgcacacagctctgactggcgccaccgaaatccagacgagtggaaccacaactatttttgcaggccatctaaaatgccgtctcaagatggacaaactgacccttaaggggatgtcttatgtcatgtgtacaggatccttcaaattggagaaggaagtggccgagactcagcacggtaccgttctggtgcaggtaaagtacgagggcacggatgctccttgcaaaataccattcagcacacaagacgaaaagggggtcacccagaacggacgcctcatcactgcgaatcccattgtgacagataaagagaagcctgttaacatcgaaaccgagccaccctttggcgagtcgtatatagtggtcggtgcaggggaaaaagccctgaagctttcttggttcaagaaaggctcctcaattggaaagatgtttgaggctactgccagaggcgcaaggcggatggccatcctgggggacaccgcttgggatttcggaagtatcggtggcgtgtttacaagcgtagggaaattggtgcatcaggttttcggaacggcctacggcgtcctcttttccggtgtgtcttggaccatgaagattgggatcggcattctgttaacttggctgggactaaatagccgatcaacaagtctctccatgacctgtatagcagtgggcatggtcacactgtaccttggggttatggtgcaggcggacagcggatgcgtgatcaactggaaaggccgcgaattgaagtgtggttctgggattttcgtaactaacgaggtccacacctggacggaacaatataagtttcaggctgattcaccgaaaagactgagtgccgcaatcggaaaggcctgggaggagggcgtgtgcggtatcaggagcgctacacggctcgaaaatattatgtggaaacagatatccaacgagctgaatcatatcttactggaaaacgacatgaagttcaccgttgtggtcggcgacgtgaatgggattcttgcccagggaaaaaagatgatccgccctcaacccatggagcacaaatactcttggaagtcgtggggcaaggcaaaaattatcggggctgatatacagaacactacctttatcattgacggaccagatacacctgaatgtcccgacgatcagagagcctggaatatctgggaggttgaggactatggcttcggtatttttactaccaacatctggttgaagctcagggatagctacacacagatgtgcgaccaccgtctgatgtccgcggccataaaagattcaaaggctgtgcatgcagacatggggtattggattgaaagtgagaaaaatgaaacgtggaagctagccaaggcttctttcatcgaggtaaaaacctgtatttggccaaagagccacactctgtggtccaacggagtcctcgaatcagagatgatcatacccaaaatctacggcggtcctattagccaacataattatcggccaggctacttcacacagaccgccgggccgtggcacctgggaaagcttgagttggattttgacctgtgcgaaggcactacagtggtggtcgatgagcactgcgggaaccgaggaccctctttaagaaccacgactgttaccggcaaaatcattcatgaatggtgttgcaggtcctgtacactccctccactgcgcttccggggtgaggacgggtgctggtacggaatggagatcagacccgtgaaggaaaaggaggaaaatcttgtaaggagtatggtgagcgcaggctctggtgaggtcgactccttttcactgggcatattgtgtgtgagtattatgatcgaagaggttatgcgcagccgatggtcgcggaaaatgctcatgaccgggactctggcggtgttcctactgctcatcatgggacagctgacatggaacgatcttattcgtttgtgcatcatggtcggcgccaatgcttccgacagaatggggatgggaaccacatatctggccttaatggcaacttttaagatgaggcctatgttcgctgtgggcctcctgtttcgccggcttacctctagagaggttctgctactcacgattggtctgagcttggtggcctcagtcgaactgccaaacagtttagaggaactcggggatggactggcaatgggcataatgatgcttaaactgttgacagagttccaaccccaccagctctggaccactctgctatccctgacctttatcaagacaactctttctctcgactacgcctggaaaaccacggctatggcgctgagcattgtatccttgttcccgctgtgtttatcaacaaccagccagaagactacatggctccctgtgctgcttggcagttttgggtgcaagccactgaccatgttcttgatcactgaaaacaaaatttggggaaggaagtcttggcccctcaatgagggtatcatggccataggcatcgtttccattctgctaagctcgctgcttaaaaacgatgtgcctctcgcagggcccctgatcgctggaggcatgttgattgcctgttatgtcatctcaggttctagtgccgacttatccctggagaaggctgcagaagtgagctgggagcaggaagccgagcattctgggacaagccacaatatactcgtagaagtgcaagatgacggaaccatgaaaattaaggatgaggagcgagacgatacgctgactatccttctgaaagcgaccttgctagctgtctccggcgtttacccaatgtcaatccctgccacactgtttgtgtggtatttctggcagaagaagaaacagcgcagtggcgtgctctgggacacccccagcccaccggaagtcgagcgggcagtgctggatgacgggatttacagaatatctcagaggggacttttaggtcgttcccaagttggcgtaggggtgttccaggacggagtctttcatacaatgtggcacgtgactcgcggcgccgttctgatgtatcagggtaagcggctcgaaccttcatgggctagtgtgaaaaaggatttgatcagctacgggggaggctggagattccagggctcctggaacaccggggaggaggtccaagtgattgcagtagaacccggaaaaaatccaaagaacgtccagacgacacccggtacttttaagacccctgagggcgaagtgggggccatcgcgctggacttcaaaccaggaacatctggctcgcccattgttaatagggagggtaagatcgtggggctctacggaaacggcgtcgtgaccactagcggcacctatgtttcagctatagcccaggcaaaagcctcccaagaagggcctctgccggagatcgaggatgaagtgtttaagaaacgaaatcttacaattatggacctgcacccaggaagtggtaagacgcggcgctacttgcccgctatcgtcagagaggccattaagaggaaactacggactctgatcctcgcacctacccgagtggtagcttctgaaatggccgaggcgttaaagggcatgccaataagatatcagacaaccgccgtgaaaagcgaacatactgggcgcgagattgttgatctgatgtgccacgcaacattcaccatgaggcttctgtcccccgtccgtgtgcctaactacaatatgatcatcatggacgaggctcattttacggatccggcctcaattgctgcacggggatatatctctactagagtgggcatgggtgaagccgccgctatattcatgacagcgacccccccagggagcgtcgaggcatttcctcagagtaacgccgtaattcaggacgaagagagggatatccccgaacgctcctggaatagcggatacgactggattaccgatttcccaggcaagactgtgtggtttgttccttctatcaaatcaggcaacgacatagctaattgtctccgaaagaacgggaagagagtgattcaattgtcccggaaaacattcgacaccgagtatcagaagacaaaaaacaatgattgggactacgtcgtgactacggatatcagtgagatgggagccaacttcagggcagaccgcgttatcgatccccgtagatgcctgaagccagtgattctcaaagacggtccggaacgggtcatcctggccggccctatgcccgtgaccgtagctagcgcggcccagaggcgcgggcgaattggaagaaatcagaacaaggagggcgatcaatacgtgtatatgggtcagccacttaataacgacgaagatcacgcacattggacagaggctaagatgctactggacaatataaacactcccgaggggatcattcctgccttgtttgaaccagagcgggaaaaatcggcagccatcgatggcgagtacaggttacgcggagaagctagaaagaccttcgttgagctgatgaggcggggcgacctccccgtctggctgtcttataaagtggcctccgaggggtttcagtacagcgatcgtcgctggtgcttcgacggagaacgaaataaccaggtgcttgaggaaaatatggacgtcgagatctggacaaaggaaggtgagagaaaaaagctgaggcctcggtggctcgatgcgcgcacctattcagacccgttggcactgagagagtttaaagaattcgccgctggcaggcggagtgtttctggggatctaattctggagataggaaagctcccacaacaccttactctgcgagcccagaacgctttagacaatttggtgatgctgcacaactccgaacagggcggtaaggcatacagacatgccatggaggaactccccgatacgatcgagaccctgatgcttctggctctcattgccgtattgacagggggcgtgactctgtttttcttaagcggaaaaggcctagggaagacctcaatcggactgctctgtgtcacagcaagtagcgcgcttctgtggatggcctccgtggagcctcactggattgctgcctctatcatattggaatttttcctgatggttctcctgatccccgagccagaccgccagaggacccctcaagataatcagcttgcatatgtggtcattggtctcctgtttatgatcttgactgtagctgccaacgaaatgggcctgttagagacaacgaaaaaggacctagggattggacatgtggcagccgagagccaccagcacgctaccatgctggatgttgacctccggcccgcgtccgcctggactctttacgcagtggctacaaccgtcatcaccccaatgatgcgtcatacaatagaaaacactacggccaatatttcactgaccgccatcgcaaaccaagctgccattttgatgggcctggataaaggttggcctatctctaagatggacataggggtgccgctcctggcgcttggctgctacagtcaggtcaatcccttaacactgactgctgccgtgctcatgttggttgcacactatgccatcattggaccaggcctgcaggctaaggcaaccagagaggcccagaaaaggacagcggctgggatcatgaagaaccctaccgtggatggaattgtagccatcgacctagaccccgtggtctacgatgcaaaattcgaaaagcaactgggccagataatgctccttattctgtgtacttcgcagatcttgctgatgcgcacgacatgggccctctgcgagagcatcaccctggctactggtccattaaccacactttgggaagggtcccctggaaaattttggaatactaccattgccgtttctatggcaaacatcttccggggctcatatctggctggtgccggcctcgcgttcagcctaatgaagtccctggggggaggccgaagagggacaggagcccagggcgagacgttgggtgagaagtggaaaaggcaactgaatcagctcagtaagaccgaatttaacacttacaaacgctctgggataatggaggtggaccggagcgaagcaaaggagggacttaaaagaggcgaaacaaccaagcatgctgtctcacgtggtactgccaagctgaggtggttcgtggagcggaatttggtaaaacccgagggcaaggtgattgatctggggtgtggacgcggcgggtggtcctattactgcgcaggactcaaaaaggttacagaagtgaaaggctataccaagggtgggttaggacacgaggaaccgatcccaatggctacgtacggctggaacctggtcaaacttcatagtggcaaggacgtgtttttcatgcctcccgagaagtgtgataccctgctatgcgacattggggaaagctctccaaatcccacaatcgaggagggacgaactctcagagtcctgaaaatggtggaaccttggttgaggggtaaccagttttgtataaagatcctgaatccgtacatgccctccgttgtagagaccctcgaacagatgcaacggaaacacggcgggatgcttgtgcgcaacccactgtcaagaaatagcacacacgagatgtattgggtctcgtgcggaactggcaacattgtgtctgccgttaatatgaccagtaggatgttactgaaccgattcacaatggcccatcggaagcctacctacgagcgtgatgtggacttgggtgcggggactagacacgtcgctgtggaacccgaggtagcaaacctcgatatcattggacagcgcatcgaaaatattaaaaacgagcataagtccacgtggcactatgacgaagataatccttacaagacatgggcctatcacggcagctacgaggtgaaaccatcaggctccgcttctagcatggttaacggggtcgtgaagctgctaaccaaaccctgggacgtgatccctatggtcactcagatagccatgaccgacacaacgccatttggacaacagagggttttcaaggagaaagtggatacccggactcccagagcaaagcgcggtacaacccagattatggaagtaactgccaagtggctttggggctttctgagtaggaataaaaagccgcgaatctgtacacgggaggaattcaccagaaaagtgaggtccaacgctgcgatcggggccgtctttgtggacgagaatcagtggaacagcgcaaaggaagctgttgaggatgagcgcttctggaatctcgtgcatcgtgaacgggagctgcacaaacaaggaaagtgcgccacatgcgtctataacatgatgggcaagagagaaaaaaagttgggtgagtttgggaaagcaaagggatctagggccatttggtacatgtggctgggcgctcgcttcctcgaattcgaggcccttggctttatgaatgaggaccattggttctcacgagaaaacagtctgtccggggtggagggagaaggtttacacaaactgggctacatattgcgggatatcagcaagattcctgggggaaatatgtatgcggacgatactgcaggctgggacaccagaatcacggaggatgacctccagaacgaggccaaaattaccgatatcatggaaccagagcatgctctgctagccacatctatatttaagcttacttaccagaataaggtagttagggtgcagcgccccgcaaaaaacggtaccgtcatggacgtgatctcgagacgggatcaaagggggtcaggacaggtgggcacatatggcctgaacactttcaccaatatggaagtccagctcattcgtcagatggagagcgaagggatctttctgccttccgagttggagacgccaaacttagctgaacgagttctggactggctcgagaagcacggagccgaacgccttaaaagaatggctattagtggtgacgattgtgtggtaaagcccatcgacgatcggttcgccacagcactgaccgcgctaaatgacatgggcaaagtgaggaaggatataccgcaatgggagccttctaaggggtggaacgactggcagcaggtccccttttgcagccaccatttccaccagctgattatgaaagatggacgcgaaatcgtggttccatgtagaaatcaagacgagctcgtgggccgggccagggtctcccagggtgctgggtggtcattgcgagagactgcctgcctgggaaagagttacgcacagatgtggcaacttatgtattttcatcgtagagatctgcgcctcgctgccaacgcaatctgttctgccgtgcctgtagactgggttcccacaagccggaccacttggtccattcacgcgcaccatcagtggatgaccacagaagatatgttatcagtgtggaatagggtctggatagaggaaaacccatggatggaggacaaaacgcacgtgagctcttgggaagaggttccctacctgggcaagagagaggaccagtggtgcggctccttgatcgggctgaccgctcgcgccacttgggcaacaaatattcaggtggccatcaaccaagtccggaggctcattggaaatgaaaactatcttgattacatgaccagtatgaaacgattcaagaatgagagcgaccctgaaggtgctctgtggtga

SEQ ID NO: 13538 - RNA, 9879 nt, synthetic construct
  misc_feature 1..9879: note = derived and/or modified CDS sequence (opt3) from DENV-1__GU131833__SS-prME
  source 1..9879: mol_type = other RNA
agcgtgaccatgctgctcatgcttctgcccacagccttggctttccacttaactacgagaggcggggagcctcatatgatcgtctccaagcaggaaaggggaaaatctctgctatttaagacctcagcaggtgttaacatgtgcacactcattgccatggacctgggcgagctttgtgaagatactatgacctacaaatgcccacggataacagaggcggaaccggacgatgtggactgttggtgcaatgctaccgatacttgggtaacatatgggacctgtagtcaaacgggagagcaccgccgagacaagcgtagcgtggccctggcaccccatgtcggcttgggtctcgagactagaaccgaaacatggatgtcctctgagggggcctggaaacagatccagagggtggaaacttgggctctgcggcaccctggattcaccgttattgcactgtttctcgcccatgctatcggcacatcgattacccagaagggcatcatattcatcttactgatgcttgtgacgccatcaatggccatgcgctgcgtcgggattggaaacagagattttgtggagggtttgagcggcgcgacttgggtagacgttgtgctggagcacgggagttgtgtcacaaccatggcaaagaataaacccactctagatatcgaactcctgaagacagaggtgaccaaccctgccgtgcttaggaaactgtgcattgaagctaagatctccaatacgaccacagactctcggtgtccaactcaaggagaggccaccttggtcgaagagcaggatgcaaacttcgtttgccgccgaacatttgtggacagaggctggggtaatgggtgtggactcttcggcaaaggcagcctgttaacttgcgctaagtttaagtgcgtaaccaaactggaggggaagatagtgcagtacgaaaacctcaaatattccgtcattgtgacagttcacaccggagatcagcatcaagtgggtaatgagactacggaacacggcacaatcgccaccattactccccaggcgcctacctcagagatccagcttacagactacggggccctgaccttggactgtagtccaaggactggactagatttcaacgaaatggtcctgctcacaatgaaggagaaaagctggctggtgcataagcagtggtttcttgacctgccgttgccctggacgtctggcgcatccacctcacaagagacttggaatcggcaggatctcctggtaacattcaaaaccgctcacgccaagaagcaggaagttgtggtcttaggtagccaagagggggctatgcacacagccctgactggcgcaaccgaaatccagacgagtggaaccacaactatttttgccggccatctaaaatgccgtctcaagatggacaaactgacccttaaggggacatcttatgtgatgtgtactggatccttcaaattggagaaggaagtcgctgagacccagcacggtacggtgctggttcaggtgaagtacgagggcacagatgcgccttgcaaaataccattcctcacccaagacgaaaagggggtaactcagaacggacgcctgatcacagcaaatcccattgtcaccgataaagagaagcctgtgaacatcgaaactgagccaccctttggcgagagctatatagttgtgggtgccggggaaaaagctcttaagctgtcgtggttcaagaaaggctcttccattggaaagatgtttgaggccaccgcaagaggcgccaggcggatggctatcttgggggacacagcctgggatttcggatcaatcggtggcgtctttacgagtgtggggaaactcgtacatcaggtgttcggaaccgcatacggcgttctgtttagcggtgtctcctggactatgaagattgggatcggcattttactgacatggctaggactcaattctcgaagcacctcactgagtatgacatgtatagcggtgggcatggtgactctttacttgggggtcatggttcaggctgactccggatgcgtgatcaactggaaaggccgcgaactgaagtgtggtagcgggattttcgtgaccaacgaggtacacacgtggacagaacaatataagtttcaggccgattctccgaaaagactctcagcagccatcggaaaggcttgggaggagggcgtctgcggtatcaggagtgccacccggctggaaaatattatgtggaaacagataagcaacgagttaaatcatatcctgcttgaaaacgacatgaagttcactgtggttgtgggcgacgcaaatgggattttggctcagggaaaaaagatgatccgccctcaacccatggagcacaaatactcctggaagtcttggggcaaggccaaaattatcggggcggatatacagaacaccacatttatcattgacggaccagatactcctgaatgtcccgacgatcagagagcctggaatatctgggaggtcgaggactatggcttcggtatttttaccacaaacatctggctcaagctgagggattcgtacacgcagatgtgcgaccaccgtctaatgagcgctgcaataaaagattccaaggccgtgcatgctgacatggggtattggattgaatcagagaaaaatgaaacctggaagctggcccgggcaagtttcatcgaggttaagacttgtacatggccaaaatctcacaccctctggagcaacggagtgctggaatccgagatgattatccccaagatatacggcggtcctatctcacaacataattatcgaccaggctacttcactcagacagcggggccgtggcaccttggaaaattggagctggattttgacttatgcgaaggcaccacggtagtcgtggatgagcactgcgggaacagaggacccagcctcaggactaccacagtgaccggcaagattatccatgaatggtgttgccgctcttgtactctgcctccacttcggttcagaggtgaggacgggtgctggtacggaatggagattaggcccgtcaaagaaaaggaggaaaatctggttcgctccatggtgagtgccggcagcggtgaggtagactctttttccttgggcatcctctgtgtgtcaataatgattgaagaggtcatgcgaagtcggtggagccgtaagatgctgatgacagggaccctagctgtgttcctgctcctgatcatgggacagcttacatggaacgatttgatcagactgtgcattatggttggcgccaatgcatcggacaggatggggatgggaactacctatttagctctcatggccacgtttaaaatgcgccctatgttcgcagtgggcctgctttttcggagactgacatccagggaggtcctactcctgaccatcggtttgtctctggtggccagcgttgaattaccaaactcactcgaggaactgggggatggacttgctatgggcattatgatgctgaagttgctcactgagttccaaccccaccagctgtggaccacactactgagtcttacttttataaaaaccacgctctccctggactacgcgtggaagacaaccgccatggcattgtctatcgtgagcctgttcccgttatgtctctccactacatcacagaaaaccacttggctgcctgtccttctgggcagctttgggtgcaagccattgacaatgttcctcattaccgaaaacaagatctggggacgaaaaagttggcccctgaatgagggtattatggctatcggcatagtatctatcctactgtccagccttctcaagaacgatgtgcctctggccgggcccttgattgccggaggcatgttaatcgcttgttatgttatttcgggttcatctgcagacctgagtctcgagaaagccgcggaagtgtcctgggagcaggaagctgagcatagcgggacgtctcacaatatcctggtcgaagtgcaagatgacggaactatgaagataaaagatgaggagaaggacgatacccttacaattctgttgaaagccaccctactggcagtaagcggcgtgtacccaatgtccatccctgccacactctttgtctggtatttctggcagaagaagaaacagcgctcaggcgttctgtgggacactcccagtccaccggaagtggagcgggctgtgcttgatgacgggatctacagaattttacagaggggactgctcggtcgtagccaagtcggcgtgggggttttccagaacggagtatttcataccatgtggcacgtgacgcgcggcgcagtcttgatgtatcagggtaagcggctggaaccttcttgggcctccgtgaaaaaggacctcatatcatacgggggaggctggagattccagggcagttggaatacaggggaggaggttcaagtgatcgcggtcgaacccggaaaaaacccaaagaatgtgcagactacccccggtacatttaagacccctgagggcgaagtaggggctattgccctggatttcaaaccaggaactagcggctcccccatcgtcaacagggagggtaagattgtggggctttacggaaatggcgttgtgaccacatctggcacgtatgtctcggcaatcgcccaggctaaagccagccaagaagggcctctgccggagatagaggacgaagtgtttaagaaacgaaacttgactatcatggatctacacccaggatcaggtaagacccggcgctacctgcccgcaattgttagagaggctatcaagaggaaactccggacattaattctggcccctacccgagtggtcgcgtccgaaatggccgaggcacttaagggcatgccaatcagatatcagactacagctgtgaaaagtgaacataccgggcgcgagatagtagacctgatgtgccacgccacgttcactatgaggctcttgtctcccgtgcgtgttcctaattacaacatgattatcatggatgaggctcattttacagacccggcaagcatcgccgcccggggatatatttccaccagagtcggcatgggtgaagctgcggcaatcttcatgaccgccactcccccagggtcagtggaggcttttcctcagtctaatgccgtgatacaggatgaagagagggacattcccgaacgcagctggaacagtggatacgattggatcacagacttcccaggcaagaccgtctggtttgtaccttccattaaaagcggcaatgatatcgcaaactgtctgcgaaagaacgggaagagagtgatacaactctctcggaaaacattcgacactgagtatcagaagacgaaaaataacgactgggattacgttgtgaccacagacatttcagagatgggagccaatttcagggctgatcgcgtcatcgacccccgtagatgcctgaagccagtgatccttaaagatggtccggaacgggttattctagcgggccctatgcccgtgactgtcgcctccgcagctcagaggcgcgggcgaatcggaagaaaccagaataaggagggcgaccaatacgtgtatatgggtcagccactgaacaatgatgaagaccacgcccattggaccgaggcaaagatgttgttagataacattaatacacccgaggggataatccctgccctgtttgaaccagagcgggaaaaaagtgctgccattgacggcgagtacaggctccgcggagaagcgagaaagaccttcgtagagctgatgaggcggggcgatcttcccgtgtggctgagctataaagttgcatcggaggggtttcagtactctgaccgtcgctggtgcttcgatggagaacgaaacaatcaggtcctcgaggaaaacatggacgtggagatctggactaaggaaggtgagagaaaaaagttgaggcctcggtggctggacgcccgcacgtattccgatccgctagctctgagagagtttaaagaattcgccgctggcaggcggagcgtgtcaggggacctcatccttgagattggaaagctgccacaacacttaaccttgcgagcacagaatgccctggataacctcgtcatgctgcacaatagtgaacagggcggtaaggcttacagacatgccatggaggaacttcccgacacaatagagactctgatgctcttggcactgatcgcggttttaaccgggggcgtgacactatttttcctgtctggaaaaggcctcgggaagacctccattggacttctgtgtgtaactgccagctcagctttgctgtggatggccagtgtggagcctcactggatcgcagctagcattatcctcgaatttttcctgatggtccttctcatacccgagccagatcgccagaggacacctcaagacaaccagctggcctatgtggttatcggtttgctgtttatgattttaacggtggcagccaacgaaatgggcctactggagaccactaaaaaggatctcgggatcggacatgtcgctgcggagaatcaccagcacgccacaatgcttgacgtagatctgcggcccgcatccgcttggaccttgtacgccgtggccaccacagttattactccaatgatgcgtcatacgatcgaaaacaccacagcaaatatatctctgactgctattgccaaccaagcggctatcctcatgggcctggacaaaggttggcctattagcaagatggatatcggggtgccgcttttagccctgggctgctactcccaggtcaatcccctcaccttgacagcagccgtgctgatgctagtcgctcactatgcaataatcggaccaggcctgcaggccaaggcgaccagagaggctcagaaaaggactgccgcagggattatgaagaaccctacggtggacggaatcgttgccattgatctcgaccccgtggtatacgacgctaaattcgaaaagcaacttggccagatcatgctgttgatactgtgtacatcacagattctcctgatgcgcaccacttgggccttatgcgagtctatcacccttgcaacaggtccactgactaccctctgggaagggagtcctggaaaattttggaatacaacgatcgctgtgtcgatggccaacattttccggggcagctatctagcgggtgccggcctggcattctccttgatgaagtctctggggggaggccgaagagggaccggagctcagggcgagactctcggtgagaagtggaaaaggcaacttaatcagctgtcaaagagcgaatttaacacatacaaacgctccgggatcatggaggtcgatcggagtgaagccaaggagggattgaaaagaggcgaaaccactaagcatgcagtttctcgtggtacagctaagctgaggtggttcgtggagcggaatctcgtcaaacccgagggcaaggtgatagacttagggtgtggacgcggcgggtggagctattactgcgccggactgaaaaaggtaaccgaagtgaaaggctatacgaagggtgggccgggacacgaggaaccaattcctatggccacctacggctggaaccttgttaaactgcattcaggcaaggatgtgtttttcatgcccccagagaagtgtgacacactactctgcgatatcggggaatccagtcccaatcctactattgaggagggacgaaccctgagagtcttgaaaatggtggaaccgtggctgaggggtaaccagttttgtatcaagatactcaatccctacatgccaagcgtcgtggagacacttgaacagatgcaacggaaacacggcgggatgctggttcgcaaccctttatctagaaattccactcacgagatgtattgggtatcatgcggaaccggcaacatcgtgagcgcggtcaacatgacatcgaggatgctgttgaatcgattcaccatggctcatcggaagcccacttacgagcgtgacgtggatctcggtgcagggacgagacacgttgccgtggaacctgaggtcgctaacctggacattatcggacagcgcattgaaaatatcaaaaacgagcataagtctacatggcactatgatgaagacaatccatacaagacctgggcctatcacggcagttacgaggtgaaaccctccggcagcgcatcatccatggtaaacggggtggttaggctacttactaagccttgggatgtcattccaatggtgacccagatcgccatgacagacacgaccccctttggacaacagcgggtgttcaaagagaaggtcgacactagaacaccgcgcgctaaaaggggtaccactcagataatggaagttacagcgcgatggctgtggggctttctctctcggaataagaagcctagaatttgtaccagggaggaattcacacgcaaagtgcgtagcaacgccgcaatcggggctgtatttgtggatgagaatcagtggaacagtgccaaggaagcagtcgaggacgagcggttctgggatctggtgcatagagaaagggagttgcacaaacaaggaaagtgcgccacttgcgtttataatatgatgggcaaacgcgaaaagaagctgggtgagtttgggaaagctaagggatcccgagccatctggtacatgtggctcggcgcgcggttccttgaattcgaggcactgggctttattaacgaggaccattggttcagcagagaaaattctttatcaggggtggagggagaaggtctgcacaaattgggctacatactcagggatatcagtaagattccagggggaaacatgtatgccgacgataccgctggctgggacacgcgcatcaccgaggatgacctgcagaatgaggccaaaattacagatatcatggaacccgagcatgcactacttgctacttccatatttaagctgacctaccagaacaaagtcgtgagagtacagcggcctgccaagaacggtacagttatggacgtgatcagcaggcgtgatcaacgagggtctggacaggtcggcacttatggcctcaataccttcacgaacatggaagtgcagctgattcgccagatggagtcggaagggatctttttgccatcagagttagagacacccaatctggctgaaagagtgctcgactggcttgagaagcacggagccgaacggctgaaaaggatggcaattagcggtgacgattgtgtcgttaagccgatcgacgatcgcttcgcgaccgccctaactgctctgaacgacatgggcaaagtgagaaaggatatacctcaatgggagccctccaaagggtggaatgactggcagcaggtaccattttgcagtcaccatttccaccagctcattatgaaggatggacgggaaatcgtggtcccttgtaggaaccaagacgagttggtgggccgagcccgtgtttctcagggtgcagggtggagcctgagagagacagcttgccttggaaagtcctacgcccagatgtggcaactgatgtattttcatcgccgggatctcaggttagcagccaatgcgatctgttcagctgtgcccgtcgactgggtgccaaccagtagaactacctggtctattcacgcccaccatcagtggatgacaacggaagatatgctgagcgtatggaaccgcgtttggatagaggaaaatccctggatggaggacaaaacccacgtgtcctcatgggaagaggtcccttacttgggcaagcgggaggaccagtggtgcggcagcctgatcgggctcactgcaagggccacatgggctaccaacattcaggtggccatcaatcaagttcgaagacttattggaaacgaaaattatctggattacatggcatctatgaaacggttcaagaacgagtccgacccagaaggtgctctatggtga

SEQ ID NO: 13539 - RNA, 9879 nt, synthetic construct
  misc_feature 1..9879: note = derived and/or modified CDS sequence (opt3) from DENV-1__GU131834__SS-prME
  source 1..9879: mol_type = other RNA
agcgtgaccatgctgctcatgcttctgccaacagcattggctttccacttaactacgagaggaggggaacctcatatgatcgtctccaagcaggaaagaggaaaatctctgctatttaagacctcagccggtgttaacatgtgcacactcattgccatggacctgggcgagctttgtgaagatactatgacctacaaatgcccacggataacagaggcggaaccggacgatgtggactgttggtgcaatgctaccgatacttgggtaacatatgggacctgtagtcaaacgggagagcaccgccgagacaagcgtagcgtggccctggcaccccatgtcggcttgggtctcgagactagaaccgaaacatggatgtcctctgagggggcctggaaacagatccagagggtggaaacttgggctctgcggcaccctggattcaccgttattgcactgtttctcgcccatgctatcggcacatcgattacccagaagggcatcatattcatcttactgatgcttgtgacgccatcaatggccatgcgctgcgtcgggattggaaacagagattttgtggagggtttgagcggcgcgacttgggtagacgttgtgctggagcacgggagttgtgtcacaaccatggcaaagaataaacccactctagatatcgaactcctgaagacagaggtgaccaaccctgccgtgcttaggaaactgtgcattgaagctaagatctccaatacgaccacagactctcggtgtccaactcaaggagaggccaccttggtcgaagaacaggatgcaaacttcgtttgccgccgaacatttgtggacagaggctggggtaatgggtgtggactcttcggcaaaggcagcctgttaacttgcgctaagtttaagtgcgtaaccaaactggaggggaagatagtgcagtacgaaaacctcaaatattccgtcattgtgacagttcacaccggagatcagcatcaagtgggtaatgagactacggaacacggcacaatcgccaccattactccccaggcgcctacctcagagatccagcttacagactacggggccctgaccttggactgtagtccaaggactggactagatttcaacgaaatggtcctgctcacaatgaaggagaaaagctggctggtgcataagcagtggtttcttgacctgccgttgccctggacgtctggcgcatccacctcacaagagacttggaatcggcaggatctcctggtaacattcaaaaccgctcacgccaagaagcaggaagttgtggtcttaggtagccaagagggggctatgcacacagccctgactggcgcaaccgaaatccagacgagtggaaccacaactatttttgccggccatctaaaatgccgtctcaagatggacaaactgacccttaaggggatgtcttatgtgatgtgtacaggatccttcaaattggagaaggaagtcgctgagactcagcacggtaccgtgctggttcaggtgaagtacgagggcacggatgcgccttgcaaaataccattcagcacacaagacgaaaagggggtaacccagaacggacgcctcatcactgcaaatcccattgtcacagataaagagaagcctgtgaacatcgaaaccgagccaccctttggcgagtcgtatatagttgtgggtgccggggagaagactctgaaactttcttggttcaagaaaggctcctcaattggaaagatgtttgaggctaccgccagaggcgcaaggcggatggccatcctgggggacacagcttgggatttcggaagtatcggtggcgtctttacgagcgtggggaaattggtacatcaggtgttcggaaccgcctacggcgttctcttttccggtgtctcttggactatgaagattgggatcggcattctgttaacatggctgggactaaatagccgatcaaccagtctctccatgacatgtatagcagtgggcatggtgactctgtaccttggggtcatggttcaggcggacagcggatgcgtgatcaactggaaaggccgcgaattgaagtgtggttctgggattttcgtgaccaacgaggtacacacgtggacagaacaatataagtttcaggctgattcaccgaaaagactgagtgccgcaatcggaaaggcctgggaggagggcgtctgcggtatcaggagcgctacccggctcgaaaatattatgtggaaacagatatccaacgagctgaatcatatcttactggaaaacgacatgaagttcactgtggttgtgggcgacgccaatgggattcttgcacagggcaaaaagatgatccgccctcaacccatggagcacaaatactcttggaagtcgtggggcaaggctaaaattatcggggccgatatacagaacaccacatttatcattgacggaccagatactcctgaatgtcccgacggccagagagcgtggaatatctgggaggtcgaggattatggtttcgggatttttaccacaaacatctggttgaagctcagggacagctacacgcagatgtgcgatcaccgtctgatgtccgccgctataaaagactcaaaggcagtgcatgccgatatgggatattggattgaaagtgagaaaaatgaaacctggaagctagctcgggcctctttcatcgaggttaagacttgtacatggccaaaaagccacaccctgtggtccaacggcgtgctcgaatcagagatgattatccccaagatatacggtggccctatcagccaacataattatcgaccagggtacttcactcagacagcaggaccgtggcacctgggcaaacttgagttggactttgatctgtgcgaagggaccacggtagtcgtggacgagcactgcggaaacagaggcccctctttaaggactaccacagtgaccggtaagattatccatgaatggtgttgccgctcctgtactctccctccactgcggttcagaggggaggatggatgctggtacggcatggagattaggcccgtcaaagaaaaggaggaaaatcttgttcgcagtatggtgagcgcgggttctggcgaggtagactccttttcactggggatcttgtgtgtgagtataatgattgaagaggtcatgcgaagccggtggtcgcgtaagatgctcatgacaggaaccctggccgtgttcctactgctcatcatgggccagctgacatggaacgaccttatcagattgtgcattatggttggggctaatgcctccgataggatgggaatgggcactacctatctggcattaatggctacgtttaaaatgcgccctatgttcgccgtgggtctcctgtttcggagacttacatctagggaggtcctgctactcaccatcgggctgagcttggtggcatcagttgaactgccaaacagtttagaggaactcggagacggcctggccatgggcattatgatgcttaagctgttgactgagttccaaccccaccagctctggaccacactgctatccctgacttttgtgaaaaccacgctttctctcgattacgcttggaagacaaccgcgatggtcctgagcatagtatccttgttcccgctgtgtttatcaactacaagccagaaaaccacttggctccctgtgctgcttgggagttttggatgcaagccactgacaatgttctttatcaccgaaaacaagatttggggtcgaaaatcttggcccttgaatgagggcatcatggccattgggatcgtttccatactcctgagctcgctactgaagaacgacgtgcctcttgcaggacccctcatcgctggcggtatgctgattgcctgttatgtcatctcagggtctagtgccgatttgtccttagagaaagctgcagaagtgagctgggagcaggaagccgagcattctggagcgagccacaatattctggtagaagtgcaagacgatggcacgatgaagatcaaagacgaggagcgcgatgacactctcaccatactgcttaaggctacactgttggccgtctccggcgtttacccaatgtcaattcctgcaaccctattcgtgtggtatttctggcagaaaaagaagcagcggagtggggtgctgtgggatacacccagcccaccggaagtcgagagagccgtgctcgacgatggaatctacaggatcctgcagcgtggtcttttaggccgctctcaagttggggtaggagtgtttcaggacggcgtcttccatactatgtggcacgtgacccggggtgctgttctgatgtatcaggggaaaagactcgaaccttcctgggcatcagtgaagaaagacttgattagttacggaggcggctggaggtttcaggggagctggaacacgggagaggaggtccaagtgatagccgtagaacccggtaagaatcccaaaaatgtccagacaactcccggcaccttcaagacacctgagggggaagtgggagcgatcgctctggattttaagccaggcacctccggttctcccattgttaatcgagaggggaaaatcgtgggactctacggcaacggcgtcgtgactacctcggggacatatgttagcgccattgcacaggccaaggcttcacaagaaggacctctgccggagatcgaggacgaagtgttcaaaaagcggaatcttacgataatggatctgcacccaggttccggcaaaactcgcagatacttgcccgccatcgtcagggaggcaattaagcggaagctacgaaccctgatcctcgctcctacaagagtggtagccagtgaaatggcggaggccttaaaagggatgccaattcgctatcagaccactgcagtgaagtctgaacatacaggaagggagatcgttgacctgatgtgccacgctacctttacgatgcgtcttctgagccccgtccgggtgcctaactacaatatgataattatggatgaggcccatttcactgacccggcttccatcgcagccagaggctatatctcaacaagggtgggtatgggggaagccgctgcgatttttatgaccgcaactcccccaggatctgtcgaggccttccctcagagcaacgctgtaatccaggatgaagaacgcgacatacccgaacgaagttggaactccggctacgattggattaccgactttccaggcaaaacagtgtggttcgttcctagcatcaagtctgggaacgatattgccaattgtctcaggaaaaatggaaagcgggtgatccaattgtcaaggaagaccttcgacacagagtatcagaaaactaagaacaatgactgggattacgtcgtgacgaccgacatatccgagatgggtgcaaactttcgcgccgatcgtgttattgaccccagacggtgcctgaaaccagtgatcctcaaggatggcccggaaagggtcatcctggctgggcctatgcccgtgacagtagcgagtgccgcacagcgccgaggaagaattggccggaatcagaacaaagagggtgaccaatacgtgtatatggggcagccacttaataacgatgaagaccacgctcattggactgaggccaagatgctactggataatatcaacacccccgagggcattatacctgcattgttcgaaccagagagggaaaagagcgccgctatcgacggagagtaccgcttaagaggcgaagccaggaaaacatttgttgagctgatgcggcgtggggatctccccgtctggctgtcgtataaggtggcgtctgagggattccagtactccgaccgccgatggtgctttgatggtgaaagaaataaccaggtgcttgaggaaaatatggacgtcgagatttggaccaaagaaggcgagaggaagaaactgcggcctcgctggctcgacgcaagaacttatagcgatccgttggccctgagggagttcaaggaatttgctgccgggcggcgatcagttagtggagacctaatcctggagatcggcaaactcccacaacaccttacgctgagagctcagaacgcattagataatttggtgatgctgcacaactctgaacagggtgggaaggcctaccgccatgctatggaggaactccccgacaccattgagacactgatgcttctggccctcatagcagtattgactggcggagtgaccctgttctttttatccggcaaggggctaggaaaaacaagcatcggtctgctctgtgtcaccgcgtcaagtgcccttctgtggatggctagcgtggagcctcactggattgccgcatccatcattttggagttctttctgatggttctcctgatccccgagccagataggcagcggactcctcaagacaatcagcttgcttatgtggtcataggcctcctgttcatgatcttgacagtagccgcaaacgaaatggggctgttagagacgaccaagaaagatctaggaattggctacgtggccgctgagaaccatcagcacgcgactatgctggacgttgatctccgtcccgcctctgcatggacactttacgctgtggccaccaccgtcatcacaccaatgatgagacacactattgaaaatacgaccgccaacatcagcctgacagcaatagctaatcaagccgcgattttgatgggtctggacaaggggtggcctatctccaaaatggatattggcgtgccgctcctggctcttggatgctattcacaggtcaaccccttaactctgaccgccgcagtgctcatgttggttgcccattacgctatcataggcccagggctgcaggcaaaggccacaagggaggcgcagaagcgcaccgctgccggaatcatgaaaaatcctactgtggacggcattgtagcaatcgatctagaccccgtggtctatgacgccaagtttgaaaaacaactgggtcagattatgctccttatcctgtgtacgtctcagatattgctgatgcggacaacctgggctctctgcgagagtattactctggccaccgggccattaacaactctttgggaaggatcgcctggcaagttctggaacaccacaatcgcagttagcatggctaatatcttccgaggttcctacctggccggcgcggggctcgccttttctctaatgaaatcactgggaggcgggagaaggggaacgggcgcacagggtgagaccttgggggagaagtggaagcgccaactgaaccagctcagcaaatccgagttcaatacttataagcggagtggaattatggaggtggatagatctgaagctaaagagggccttaagcgtggtgaaacaaccaaacacgccgtcagcaggggcactgcaaagctgcggtggtttgtggagcgcaacttggtaaagcccgaggggaaagtgatcgacctgggatgtggccgagggggatggtcatactattgcgctggcctcaagaaagttacagaagtgaagggttacaccaaagggggaccgggccatgaggaaccaatacctatggccacgtacggctggaatttagtcaagctgcactccgggaaagatgtgttctttatgcccccagagaagtgtgacacccttctgtgcgatattggagaaagtagccccaaccctacaatcgaggagggtagaactctaagggtcctcaagatggtggaaccgtggctgcggggcaatcagttctgtattaaaatcttgaacccctatatgccatctgttgtagagaccctggaacagatgcaacgcaagcatgggggaatgctcgtgagaaatcctctttccaggaactcaacacacgagatgtactgggtcagctgcggcactggtaatatagtgtcggccgttaacatgacctctcgaatgctgttaaaccggtttacaatggcgcaccgtaaacccacctatgagagagacgtggatctgggggctggaactcgccatgtcgcagtggaacctgaggtagccaatttggacatcattggccagaggatcgaaaacattaagaatgagcacaaaagtacgtggcattacgatgaagacaacccatataagacatgggcttaccacggctcctatgaggtgaagcccagcgggtcagcctcctctatggttaatggagtcgtgcggctcctgaccaaaccttgggatgtgatcccaatggtcactcagattgcaatgaccgacacaacgcccttcggtcaacagagagtttttaaggagaaagtggacacccgcactccgagggccaagcgaggcacaacccagatcatggaagtaactgctaaatggctatgggggttccttagccggaacaagaagcctagaatatgtacaagggaggaatttacccgcaaagtgcgtagtaatgcggccattggagcagtcttcgtggatgagaaccagtggaactccgctaaggaagccgttgaggacgagcggttttgggatctggtgcacagagaaagggagctccataaacaaggcaagtgcgcaacatgcgtctacaacatgatgggtaaacgcgaaaagaagctgggggagttcggaaaagccaagggcagccgagctatctggtacatgtggttgggcgcccggttcctggaatttgaggcgctcgggttcatgaatgaggaccactggttttctagagaaaactcacttagtggagtggagggtgaaggcctgcataaattagggtatatcctgagggatatttccaagataccaggaggcaatatgtacgcagacgatactgccggttgggacacccgcatcacggaggatgacttgcagaacgaggctaaaattaccgatatcatggaacccgagcacgccctcctggcaacaagcattttcaagctaacttatcagaataaagtagttagagtgcagcggcctgctaagaacgggaccgtcatggacgtgatctctaggcgtgatcaacgaggatcgggccaggtgggcacatacgggcttaacacttttaccaatatggaagtccagctgatacgccagatggagtcagaaggaatcttcctcccaagcgagctggagacgcccaacttggccgaaagagttttagactggctggagaagcatggtgctgaacggctcaaaaggatggccatttccggcgacgattgtgtggtaaagccgatcgacgatcgctttgcaacagcgcttaccgccctgaatgacatggggaaagtgagaaaggatattcctcaatgggagcccagtaaaggatggaacgactggcagcaggtcccattctgctctcaccactttcatcagctaatcatgaaggatggccgggaaatagtggttccttgtaggaatcaagacgagctggtgggtcgagctcgtgtcagccagggggccggatggtccctcagagagactgcatgcttgggcaagtcatatgctcagatgtggcaactgatgtacttccaccgccgggatcttaggctggccgcaaacgccatttgtagtgcggtgcccgtagactgggttccaacatctagaaccacttggagcatccatgctcaccaccagtggatgaccacagaagatatgctctccgtgtggaatcgcgtctggatcgaggaaaacccctggatggaggacaaaacgcatgtgtcaagctgggaagaggttccttatttaggcaagcgggaggaccagtggtgcgggtctctgattggattgaccgccagggcaacttgggccacaaatatacaggtggctatcaaccaagtccgaagactgattggtaatgaaaactacctcgattacatgacctccatgaaacggtttaagaatgagagtgacccagaaggcgccctttggtga

SEQ ID NO: 13540 - RNA, 9879 nt, synthetic construct
  misc_feature 1..9879: note = derived and/or modified CDS sequence (opt3) from DENV-1__GU131835__SS-prME
  source 1..9879: mol_type = other RNA
agcgtgaccatgctgctcatgcttctgcccacagccttggctttccacttaactacgagaggcggggagcctcatatgatcgtctccaagcaggaaaggggaaaatctctgctatttaagacctcagcaggtgttaacatgtgcacactcattgccatggacctgggcgagctttgtgaagatactatgacctacaaatgcccacggataacagaggcggaaccggacgatgtggactgttggtgcaatgctaccgatacttgggtaacatatgggacctgtagtcaaacgggagagcaccgccgagacaagcgtagcgtggccctggcaccccatgtcggcttgggtctcgagactagaaccgaaacatggatgtcctctgagggggcctggaaacagatccagagggtggaaacttgggttctgcggcaccctggattcaccgtgattgcttttttcctggcacatgccatcggcacatcgattacccagaagggcatcatatttatcctcttaatgctggtcacgccatcaatggctatgcgctgcgtggggattggaaacagagatttcgtagagggtcttagcggcgccacttgggttgacgtggtcttggagcacgggagttgtgtgacaaccatggcgaagaataaacccactctggatatcgaactactcaagacagaggtgaccaaccctgcagtcctgaggaaactttgcattgaagccaagatctccaatacgaccacagactctcggtgtccaactcaaggagaggctaccctggccgaagagcaggatgcaaactttgtttgccgccgaacattcgtggacagaggctggggtaatgggtgtggattgtttggcaaaggcagcctcctgacttgcgctaagttcaagtgcgtaaccaaattagaggggaagatagtgcagtacgaaaacctgaaatattccgtcattgtgacagttcacaccggagatcagcatcaagtgggtaatgagactacggaacacggcacaatcgccaccattactccccaggcgcctacctcagagatccagctcacagactacggggcccttaccctggactgtagtccaaggactggattggattttaacgaaatggtcctactgacaatgaaggagaaaagctggctcgtgcataagcagtggttcctggaccttccgctgccctggacgtctggcgcatccacctcacaagagacttggaatcggcaggatttgctcgtaacatttaaaaccgctcacgccaagaagcaggaagttgtggtcctgggtagccaagagggggctatgcacacagccttaactggcgcaaccgaaatccagacgagtggaaccacaactattttcgccggccatctgaaatgccgtctaaagatggacaaactcaccctgaaggggacatcttatgtgatgtgtactggatccttcaaacttgagaaggaagtcgctgagacccagcacggtacggtgttggttcaggtgaagtacgagggcacagatgcgccttgcaaaataccatttagcacccaagacgaaaagggggtaactcagaacggacgcctgatcacagcaaatcccattgtcaccgataaagagaagcctgtgaacatcgaaactgagccacccttcggcgagtcgtatatagttgtgggtgccggggaaaaagctctcaagctgtcttggtttaagaaaggctcctcaattggaaagatgttcgaggccaccgcaagaggcgccaggcggatggctatccttggggacacagcctgggattttggaagtatcggtggcgtcttcacgagcgtggggaaactggtacatcaggtgtttggaaccgcatacggcgttttgttctccggtgtctcttggactatgaagattgggatcggcattctcctgacatggttaggactgaatagccgatcaaccagtctatccatgacatgtatagcggtgggcatggtgactctctacctgggggtcatggttcaggctgacagcggatgcgtgatcaactggaaaggccgcgaacttaagtgtggttctgggatttttgtgaccaacgaggtacacacgtggacagaacaatataagttccaggccgattcaccgaaaagattgagtgcagccatcggaaaggcttgggaggagggcgtctgcggtatcaggagcgccacccggctggaaaatattatgtggaaacagatatccaacgagctcaatcatatcctgttagaaaacgacatgaagtttactgtggttgtgggcgacgcaaatgggattctggctcagggaaaaaagatgatccgccctcaacccatggagcacaaatactcttggaagtcgtggggcaaggccaaaattatcggggcggatatacagaacaccacattcatcattgacggaccagatactcctgaatgtcccgacgatcagagagcctggaatatctgggaggtcgaggactatggctttggtattttcaccacaaacatctggcttaagttgagggatagctacacgcagatgtgcgaccaccgtctcatgtccgctgcaataaaagattcaaaggccgtgcatgctgacatggggtattggattgaaagtgagaaaaatgaaacctggaagctggcccgggcatctttcatcgaggttaagacttgtacatggccaaaaagccacaccctatggtccaacggagtgctggaatcagagatgattatccccaagatatacggcggtcctatcagccaacataattatcgaccaggctactttactcagacagcggggccgtggcacctcggaaaactggagcttgatttcgacttgtgcgaaggcaccacggtagtcgtggatgagcactgcgggaacagaggaccctctctgaggactaccacagtgaccggcaagattatccatgaatggtgttgccgctcctgtactttacctccactccggtttagaggtgaggacgggtgctggtacggaatggagattaggcccgtcaaagaaaaggaggaaaatctggttcgcagtatggtgagcgccggctctggtgaggtagactccttctcacttggcatcctgtgtgtgagtataatgattgaagaggtcatgcgaagccggtggtcgcgtaagatgttgatgacagggaccctcgctgtgtttctgctactgatcatgggacagctcacatggaacgatctgatcagactttgcattatggttggcgccaatgcatccgacaggatggggatgggaactacctatttggctctgatggccacgttcaaaatgcgccctatgtttgcagtgggcttactcttccggagactgacatctagggaggtccttctgctaaccatcggtctcagcctggtggcctcagttgaattgccaaacagtctggaggaattaggggatggactcgctatgggcattatgatgctgaagcttctgactgagtttcaaccccaccagttgtggaccacactcctgtccctaactttcataaaaaccacgctgtctcttgactacgcgtggaagacaaccgccatggtgctcagcatcgtctccctgtttccgttgtgtctgtcaactacaagccagaaaaccacttggttacctgtactcctgggcagtttcgggtgcaagccacttacaatgtttctgattaccgaaaacaagatctggggacgaaaatcttggcccttgaatgagggtattatggcaatcggcatagtgtccatcctcctgagctcgctactgaagaacgatgttcctcttgctgggcccctcattgccggaggcatgctgatcgcctgttatgtgatttcaggttctagtgctgacttgtccttagagaaagcagccgaagtcagctgggagcaggaagcggagcattctgggacgagccacaatatcctggtggaagtacaagatgacggaactatgaagataaaagatgaggagcgcgacgataccctcacaattctgcttaaggctaccctgttggccgtgtccggcgtctacccaatgtcaatccctgcaacactattcgtttggtatttctggcagaaaaagaagcagcggagtggcgtgctgtgggacactcccagcccaccggaagtggagagagccgtcctcgatgacgggatctacaggattctgcagcgtggacttttaggtcgctctcaagtgggcgttggggtatttcaggacggagtgttccataccatgtggcacgtcacgcggggcgctgtgctgatgtatcagggtaaaagactcgaaccttcctgggcatcagttaagaaagatttgataagttacgggggaggctggaggtttcagggcagctggaacacaggggaggaggtgcaagtcatcgccgtggaacccggaaagaatccaaaaaacgtacagactacccccggtacattcaagacccctgagggcgaagtcggggcgattgctctggactttaagccaggaacttccggctctcccatcgtgaatcgagagggtaaaattgttgggctctacggaaacggcgtggtcaccacatcgggcacgtatgtgagcgccatcgcacaggccaaggcttcacaagaagggcctctgccggagatagaggatgaagttttcaaaaagcggaatcttactatcatggacctgcacccaggatccggtaaaacccgcagatacttgcccgccattgtgagggaggcaatgaagcggaagctacgaacactgatcctcgctcctaccagagtcgtggccagtgaaatggcggaggccttaaaaggcatgccaattcgctatcagactacagcagtaaagtctgaacataccgggagggagatcgtggatctgatgtgccacgctacgtttactatgcgtcttctgagccccgttcgggtccctaactacaatatgataattatggacgaggcccatttcacagatccggcttccatcgcagccagaggatatatctcaaccagggtgggcatgggtgaagccgctgcgatttttatgaccgcaactcccccagggtctgtggaggccttccctcagagcaacgctgtcatccaggacgaagagcgcgatatacccgaacgaagttggaattccggatacgagtggattacagactttccaggcaaaaccgtatggttcgtgcctagcatcaagtctggcaacgatattgccaattgtctcagaaaaaacgggaagcgggttatccaattgtcaaggaagacattcgacactgagtatcagaaaacgaagaacaatgactgggattacgtggtcaccacagacatatccgaaatgggagcaaactttcgcgccgatcgtgtgattgaccccagacggtgcctgaaaccagttatcctcaaggatggtccggagagggtgatcctggctggccctatgcccgtcactgtggcgagtgccgcacagcgccgagggagaattggacggaatcagaacaaagaaggcgaccaatacgtatatatgggtcagccacttaataacgatgaggaccacgctcattggaccgaggccaagatgctactggataatatcaacacacccgaagggattatacctgcattgttcgagccagaaagggagaagagcgccgctatcgacggcgaataccgcttaagaggagaggccaggaaaacctttgtggagctgatgcggcgtggcgatctccccgtttggctgtcgtataaggtcgcgtctgaagggttccagtactccgaccgccgatggtgctttgatggagagagaaataaccaggtgcttgaagagaatatggacgtggaaatttggactaaagagggtgagaggaagaaactgcggcctcgctggctcgacgcaagaacgtatagcgatccgttggccctgagggaattcaaggagtttgctgccggccggcgatcagtcagtggggacctaatcctggaaatcggaaaactcccacaacaccttaccctgagagctcagaacgcattagataatttggttatgctgcacaactctgagcagggcggtaaggcctaccgccatgctatggaagagctccccgacacaattgagactctgatgcttctggccctcatagcagtgttgaccgggggcgtaatgctgttctttttatccggaaagggcctagggaaaacaagcatcggactgctctgtgtgaccgcgtcaagtgcccttctgtggatggctagcgtcgaacctcactggattgccgcatccatcgtgttggagttctttctgatggttctcctgattcccgaaccagataggcagcggactcctcaagacaatcagcttgcttatgtggtcatcggtctcctgttcatgatattgacagtagccgcaaacgagatgggcctgttagagacgaccaagaaagatctagggatcggacatgccgctgcggaaaaccaccagcacgccactatgctggacgtggatctccgtcccgcatctgcttggacactttacgccgttgccaccaccgtgattacaccaatgatgagacatactatcgagaatacgaccgcaaacattagcctgacagctatcgccaatcaagcggctatattgatgggcctggacaagggttggcctatttccaaaatggatatcggggtcccgctcctggcccttggctgctactcacaggtgaaccccttaactctgaccgcagccgtcctcatgttggtggctcactatgcaattatcggaccaggcctgcaggccaaggcgacaagggaagctcagaagcgcaccgccgcagggataatgaaaaatcctactgttgacggaatcgtggccattgatctagaccccgtagtgtacgacgctaagtttgagaaacaactgggccagatcatgctccttattctgtgtacgtctcagatcttgctgatgcggacaacctgggccctctgcgaaagtataactctggcaaccggtccattaacaactctttgggaggggtcgcctggaaagttctggaacaccacaattgctgtcagcatggccaatatcttccgaggctcctatctggcgggtgccggcctcgcattttctctaatgaaatcactggggggaggcagaagggggacgggagctcagggcgagaccttgggtgaaaagtggaagcgccaactgaaccagctcagcaaacccgagttcaatacttacaagcggtccgggatcatggaagttgatagaagtgaggccaaagaaggacttaagcgtggcgagacaaccaaacatgcagtgtctaggggtactgctaagctgcggtggtttgtcgagcgcaacttggtgaagccggaaggcaaagtaattgacctggggtgtggacgaggcgggtggagctattactgcgccggactcaagaaagtgacagaggttaagggctataccaaaggtgggccaggacacgaagagcctatccccatggccacgtacggctggaatttagtgaagctgcattcaggcaaagatgtcttctttatgccacccgaaaagtgtgacacccttctgtgcgatataggggagtccagtcctaacccgacaattgaggaaggaagaactctaagggtgctcaagatggtcgagccctggctgcggggtaatcagttctgtatcaaaattttgaacccatacatgcctaccgtggttgaaacactggagcagatgcaacgcaagcacggcgggatgctcgtaagaaatccccttagcaggaactctactcacgagatgtattgggtgtcctgcggaaccggcaatatcgtctcagcggtgaacatgacaagccgaatgctgttaaaccggtttaccatggctcatcgtaaacctacttacgaaagagacgttgatctgggtgcagggacgcgccacgtggccgtcgagccagaagtggctaatttggacataatcggacagaggattgagaacatcaagaatgaacataaatcgacatggcactatgatgaggacaacccctacaagacctgggcctatcacggctcttacgaggtaaagcctagtggctccgcaagctcaatggtgaatggggttgtccggctcctgactaaaccatgggatgtgattcccatggtgacccagatcgccatgacagacacgaccccgttcggacaacagagagtctttaaggaaaaagttgacactcgcacacctagggctaagcgaggtaccactcagattatggaggtgacagcgaaatggctatggggcttcctttcccggaacaagaagccaagaatctgtaccagggaagagtttacacgcaaagtacgttctaatgccgcaataggggctgtgttcgtcgatgaaaaccagtggaatagcgccaaggaggcagtggaggacgaacggttttgggatctggttcatagagagagggaactccacaaacaaggaaagtgcgccacttgcgtgtataacatgatgggcaaacgcgagaagaagctgggtgaattcgggaaagctaagggaagtcgagccatttggtacatgtggttgggcgcgcggttcctggagtttgaggcactcggcttcatgaatgaagaccattggttttccagagagaacagcctttctggggtcgaaggagagggtctgcacaaattaggctacatcctgagggatatctcacgcattcccgggggaaatatgtatgccgacgataccgctggctgggacacgagaataaccgaggatgacttgcagaacgaagccaagatcacagatattatggagcctgaacatgcactcctggctactagtatcttcaaactaacctaccagaataaggtggtacgggttcagaggccagccaaaaacggtacagtgatggacgtcatttcccgtcgagatcaacgcgggagcggacaggtgggcacttatggccttaacacctttacgaatatggaggtgcagctgatcagacagatggaatctgaggggatattcctcccctcggagctggaaacaccgaacttggctgagcgggtcttagactggctggaaaagcacggagccgagaggctcaagcgcatggcaatctcaggtgacgattgtgttgtgaaacctattgacgatagatttgcgaccagccttactgccctgaatgacatgggcaaggtacggaaagatatcccccaatgggaaccatccaaggggtggaacgactggcagcaggtgcctttctgcagtcaccattttcaccagctaattatgaaagatggaagggagatcgtcgtgccctgtcgaaatcaagacgagctggttggccgtgctagagtgtctcagggtgccgggtggagcctccgcgaaacagcatgcttgggaaagtcctacgctcagatgtggcaactgatgtatttccatcggagggatcttagactggccgcaaacgccatatgttcagcggtcccagtggactgggtacccaccagtcgcactacctggtctattcacgctcaccatcagtggatgacaacggaggatatgctcagcgtttggaatcgggtgtggatcgaagagaacccttggatggaagacaagacccacgtctcctcatgggaggaggtgccatacttaggcaaaagggaagaccagtggtgcggcagcctgatcgggttgactgcccgagcaacatgggccaccaatattcaggttgctataaaccaagtgagacggctgatcggaaatgagaactatctcgattacatgacttctatgaagaggtttaaaaatgaatccgaccttgagggtgccctgtggtga

SEQ ID NO: 13541 - RNA, 9879 nt, synthetic construct
  misc_feature 1..9879: note = derived and/or modified CDS sequence (opt3) from DENV-1__GU131836__SS-prME
  source 1..9879: mol_type = other RNA
agcgtgaccatgctgctcatgcttctgcccacagcattggctttccacttaactacgagaggaggggaacctcatatgatcgtctccaagcaggaaagaggaaaatctctgttatttaagacctcagccggtgttaacatgtgcacactcattgccatggacctgggagaactttgtgaagatactatgacctacaaatgcccacggataacagaggcggaaccggacgatgtggactgttggtgcaatgctaccgatacttgggtaacatatgggacctgtagtcagacgggagagcaccgccgagacaagcgtagcgtggccctggcaccccatgtcggcttgggtctcgagactagaaccgaaacatggatgtcctctgagggggcctggaaacagatccagagagtggaaacttgggctctgcggcaccctggattcaccgttattgcactgtttctcgcccatgctatcggcacatcgattacccagaagggcatcatattcatcttactgatgcttgtgacgccatcaatggccatgcgctgcgtcgggattggaaacagagattttgtggagggtttgagcggcgcgacttgggtagacgttgtgctggagcacgggagttgtgtcacaaccatggcaaagaataaacccactttggatatcgaactcctgaagacagaggtgaccaaccctgccgtgcttaggaaactgtgcattgaagctaagatctccaatacgaccacagactctcggtgtccaactcaaggagaggccaccttggtcgaagaacaggatgcaaacttcgtttgccgccgaacatttgtggacagaggctggggtaatgggtgtggactcttcggcaaaggcagcctgttaacttgcgctaagtttaagtgcgtaaccaaactggaggggaagatagtgcagtacgaaaacctcaaatattccgtcattgtgacagttcacaccggagatcagcatcaagtgggtaatgagactacggaacacggcacaatcgccaccattactccccaggcgcctacctcagagatccagcttacagactacggggccctgaccttggactgtagtccaaggactggactagatttcaacgaaatggtcctgctcacaatgaaggagaaaagctggctggtgcataagcagtggtttcttgacctgccgttgccctggacgtctggcgcatccacctcacaagagacttggaatcggcaggatctcctggtaacattcaaaaccgctcacgccaagaagcaggaagttgtggtcttaggtagccaagagggggctatgcacacagccctgactggcgcaaccgaaatccagacgagtggaaccacaactatttttgccggccatctaaaatgccgtctcaagatggacaaactgacccttaaggggacatcttatgtgatgtgtactggatccttcaaattggagaaggaagtcgctgagacccagcacggtacggtgctggttcaggtgaagtacgagggcacagatgcgccttgcaaaataccattcagcacccaagacgaaaagggggtaactcagaacggacgcctcatcacagcaaatcccattgtcaccgataaagagaagcctgtgaacatcgaaactgagccaccctttggcgagtcgtatatagttgtgggtgccggggaaaaagctctgaaactttcttggttcaagaaaggctcctcaattggaaagatgtttgaggccaccgcaagaggcgccaggcggatggctatcctgggggacacagcctgggatttcggaagtatcggtggcgtctttacgagcgtggggaaattggtacatcaggtgttcggaaccgcatacggcgttctcttttccggtgtctcttggactatgaagattgggatcggcattctgttaacatggctgggactaaatagccgatcaaccagtctctccatgacatgtatagcggtgggcatggtgactctgtaccttggggtcatggttcaggctgacagcggatgcgtgatcaactggaaaggccgcgaattgaagtgtggttctgggattttcgtgaccaacgaggtacacacgtggacagaacaatataagtttcaggccgattcaccgaaaagactgagtgcagccatcggaaaggcttgggaggagggcgtctgcggtatcaggagcgccacccggctcgaaaatattatgtggaaacagatatccaacgagctgaatcatatcttactggaaaacgacatgaagttcactgtggttgtgggcgacgcaaatgggattcttgtccagggcaagaagatgatccgccctcaacccatggagcacaaatactcttggaagtcgtggggcaaggctaaaattatcggggccgatatacagaacaccacatttatcattgacggaccagatactcctgaatgtcccgacgatcagagagcgtggaatatctgggaggtggaggactatggcttcggtatttttaccacaaacatctggttgaagctcagggatagctacacgcagatgtgcgaccaccgtctgatgtccgccgctataaaagattcaaaggcagttcatgccgacatggggtattggattgaaagtgagaaaaatgaaacctggaagctatctcgggctagcttcatcgaggtgaagacttgtacatggccaaaatcccacaccctgtggtcaaacggagtactcgaaagcgagatgattatccccaagatatacggcggtcctatctctcaacataattatcgaccaggctacttcactcagacagccgggccgtggcacctgggaaaacttgagttggattttgacctgtgcgaaggcaccacggtcgtggtggatgagcactgcgggaacagaggaccctccttaaggactaccacagtcaccggcaagattatccatgaatggtgttgccgcagttgtactctccctccactgcggttcagaggtgaggacgggtgctggtacggaatggagattaggcccgttaaagaaaaggaggaaaatcttgtgcgcagcatggtatctgcaggctccggtgaggtggactcatttagtctgggcatcttgtgtgtcagcataatgattgaagaggtgatgcgatcgcggtggtcccgtaagatgctcatgacagggaccctggcggttttcctactgctcatcatgggacagctgacatggaacgatcttatcagattgtgcattatggtgggcgccaatgcttctgacaggatggggatgggaactacctatctggccttaatggcaacgtttaaaatgcgccctatgttcgctgtcggcctcctgtttcggagacttacaagcagggaggtgctgctactcaccatcggtctgtcattggttgccagtgtggaactgccaaactccttagaggaactcggggatggactggcaatgggcattatgatgcttaagctgttgactgagttccaaccccaccagctctggaccacactgctatctctgacttttataaaaaccacgcttagcctcgactacgcctggaagacaaccgctatggcgctgtccatcgtctcattgttcccgctgtgtttaagcactacaagtcagaaaaccacttggctccctgtactgcttggctcttttgggtgcaagccactgacaatgttcttgattaccgaaaacaagatctggggacgaaaatcctggcccctcaatgagggtattatggccatcggcatagtgagcatcctgctatcgtcactgcttaagaacgatgttcctctcgcagggcccctgattgctggaggcatgttgatcgcctgttatgtgatttctggtagttccgccgacttaagcctggagaaagctgcagaagtctcttgggagcaggaagccgagcatagcgggacgtcccacaatatcctcgtggaagtacaagatgacggaactatgaagataaaagatgaggagaaggacgataccctgacaattcttctgaaagcgaccttgctagctgtgtcaggcgtctacccaatgagtatccctgccacactgtttgtttggtatttctggcagaagaagaaacagcgcagcggcgtgctctgggacactccctctccaccggaagtggagcgggcagtcctggatgacgggatctacaggattcttcagaggggattactgggtcgttcccaagtgggcgttggggtattccaggacggagtgtttcataccatgtggcacgtcacgcgcggcgccgtgctcatgtatcagggtaagcggttggaaccttcatgggctagtgttaaaaaggatctgataagctacgggggaggctggagattccagggctcctggaacacaggggaggaggtgcaagtcatcgcagtggaacccggcaagaatccaaagaacgtacagactacccccggtacatttaagacccctgagggcgaagtcggggccattgcgctcgacttcaaaccaggaacttctggctcgcccatcgtgaatagggagggtaagattgttgggctgtacggaaacggcgtggtcaccacaagcggcacgtatgtgtcagctatcgcccaggcaaaagcctcccaagaagggcctcttccggagatagaggatgaagtttttaagaaacgaaatctgactatcatggacttgcacccaggaagtggtaagacccggcgctacctacccgctattgtgagagaggccatcaagaggaaactgcggacactcattttagcacctacccgagtcgtggcttctgaaatggccgaggcgctgaagggcatgccaatcagatatcagactacagccgtaaaaagcgaacataccgggcgcgagatagtggatcttatgtgccacgcaacgttcactatgaggctgctctcccccgttcgtgtccctaactacaatatgattatcatggacgaggctcattttacagatccggcctcaatcgctgcacggggatatatttctaccagagtgggcatgggtgaagccgccgctatcttcatgaccgcgactcccccagggagcgtggaggcatttcctcagagtaacgccgtcatacaggacgaagagagggatattcccgaacgctcctggaatagcggatacgactggatcacagatttcccaggcaagaccgtatggtttgtgccttctattaaatcaggcaacgacatcgctaattgtttgcgaaagaacgggaagagagttatacaactgtcccggaaaacattcgacactgagtatcagaagacgaaaaacaatgattgggactacgtggtcaccacagatattagtgagatgggagccaacttcagggcagaccgcgtgatcgatccccgtagatgcctcaagccagttatcctgaaagacggtccggaacgggtgattcttgccggccctatgcccgtcactgtggctagcgcggcccagaggcgcgggcgaatcggaagaaatcagaacaaggagggcgatcaatacgtatatatgggtcagccactaaataacgacgaagatcacgcacattggaccgaggctaagatgctgttggacaatattaacacacccgaggggataatccctgccttatttgaaccagagcgggaaaaatcggcagccattgatggcgagtacaggctgcgcggagaagctagaaagaccttcgtggagctcatgaggcggggcgacctgcccgtttggctttcttataaagtcgcctccgaggggtttcagtacagcgatcgtcgctggtgcttcgacggagaacgaaataaccaggtgctggaggaaaatatggacgtggagatctggactaaggaaggtgagaggaagaagctcaggcctcggtggttggatgcgcgcacgtattcagacccgctggcactaagagagtttaaagagttcgccgctggcaggcggagtgtctctggggatctgatcctcgagattggaaaacttccacaacacctgaccttacgagcccagaacgctttggacaatctggttatgctccacaactccgaacagggcggtaaggcatacagacatgccatggaggaactgcccgatacaatagagactcttatgctgctcgctttgatcgccgtgctgaccgggggcgtaacattatttttcctaagcggaaaaggcctggggaagacctcaattggactcctttgtgtgatggcaagtagcgcgctgttgtggatggcctccgtcgagcctcactggatcgctgcctctattatcctggaatttttcctcatggtgctgcttatacccgagccagaccgccagaggactcctcaagataatcagctcgcatatgttgtgatcggtctgttgtttatgattctgacagtcgctgccaacgaaatgggcttactagagacgaccaaaaaggacctggggatcggacatgtagcagccgagaaccaccagcacgctactatgctcgatgtggaccttcggcccgcgagcgcctggacactgtacgcagttgctaccaccgtgattacaccaatgatgcgtcatactatcgaaaatacgaccgccaacatatccttgacagccattgcaaatcaagctgccatcctgatgggcctcgataaaggttggcctatttcaaagatggacatcggggtcccgctgcttgcgttaggctgctactctcaggtgaaccccctgactctcaccgctgccgtcttgatgctggtggcacactatgccataatcggaccaggcctacaggctaaggcaacaagagaggcccagaaaaggaccgcggctgggattatgaagaatcctactgttgatggaatcgtggccattgacctggaccccgtagtgtacgatgcaaaattcgaaaagcaactcggccagatcatgcttctgatattgtgtacgagtcagattctgctcatgcgcacaacctgggccctgtgcgagtcgatcactttagctaccggtccacttacaactctgtgggaagggagccctggaaaattttggaacaccacaatcgccgtctccatggcaaatattttccggggctcttatctcgctggtgccggcctagcgttctcactgatgaaaagcctagggggaggccgaagagggacgggagcccagggcgagaccctgggtgagaagtggaaaaggcaactcaaccagctttccaagagtgaatttaatacttacaaacgctctgggatcatggaggttgaccggagcgaagcaaaggagggactgaaaagaggcgaaacaaccaagcatgctgtgtcacgtggtactgccaagttgaggtggttcgtcgagcggaacctggtgaaacccgagggcaaggtaatagatctcgggtgtggacgcggcgggtggtcctattactgcgcaggactgaaaaaggtgacagaagttaaaggctataccaagggtgggccgggacacgaggaaccaattcctatggctacgtacggctggaatctagtgaaacttcatagtggcaaggacgtctttttcatgcccccagagaagtgtgataccctgctatgcgacatcggggaaagctctcccaaccctacaattgaggagggacgaactctcagagtgctgaaaatggtcgaaccgtggttgaggggtaatcagttttgtatcaagatactgaacccctacatgccatccgtggttgagaccctcgaacagatgcaacggaaacacggcgggatgcttgtacgcaatcctctgtcaagaaacagcacacacgagatgtattgggtgtcgtgcggaactggcaatatcgtctctgccgtgaacatgaccagtaggatgttactgaaccgattcacaatggcccatcggaagcccacctacgagcgtgatgttgacttgggtgcggggactagacacgtggctgtcgaacctgaggtgccaaatctcgatattatcggacagcgcattgaaaacatcaaaaatgagcataagtccacgtggcactatgacgaagataacccctacaagacatgggcatatcacggcagctacgaggtaaaaccttcaggctccgcctctagcatggtgaatggggttgtcaggctgctaaccaagccatgggacgtgattcccatggtgactcagatcgctatgaccgacacaacgccgtttggacaacagcgggtcttcaaagagaaggttgataccagaactcctcgcgccaaaaggggtacaacccagataatggaagtgactgcaaagtggctttggggctttctgagtcgaaacaagaaaccacggatttgtacaagagaggagttcaccaggaaggtacgctccaatgccgctatcggggcggtgtttgtcgacgagaaccagtggaatagcgccaaagaagcagtggaggatgagcgtttctgggacctcgttcatcgggaaagagagctgcacaagcaaggaaaatgcgctacatgcgtgtataacatgatgggcaagagggaaaagaaattgggtgagtttgggaaggccaaaggatctcgcgcaatctggtacatgtggctgggcgcccgattcctcgagttcgaggctcttggctttatgaatgaggatcattggttctcacgggaaaacagtctgtccggggtcgagggagaaggtttacacaagctgggctacattttgagagacataagcaaaatccccgggggaaatatgtatgccgatgacactgcgggctgggataccaggattacggaggacgatctccagaacgaggcaaagatcaccgacattatggaacctggtcatgccctgctagctacatctatctttaaacttacttaccagaataaggtggtacgcgttcagagaccagccaagaacgggaccgtgatggatgtcatatcgcggagggaccaacgtggatcaggccaggtgggcacatatgggctgaacactttcaccaatatggaggtgcagctcatccgacagatggaaagcgagggaatttttctgccctccgaattggagacgccgaacttagcagagcgcgtcctggactggctcgaaaaacacggtgctgagagacttaagcggatggccatcagtggcgatgactgtgttgtgaaacctattgatgacaggttcgctacagccctgaccgcactaaatgatatggggaaggtacgcaaagacatcccccaatgggaaccatctaagggatggaacgattggcaacaggtgcctttttgcagccaccatttccaccagctgataatgaaggacggcagagagattgtcgtgccctgtcggaatcaagatgaactcgttggtagggcgcgagtgtcccagggggccggatggtcattgcgtgagactgcttgcctgggcaaaagttacgcccagatgtggcaacttatgtattttcatagacgcgacctgcggctcgcagctaacgccatctgttctgcagtcccagtggattgggtacccacaagcaggaccacttggtccatccacgcccaccatcagtggatgaccacagaggacatgttatcagtttggaatagagtgtggattgaagagaacccttggatggaagacaagacgcacgtcagctcttgggaggaagtgccatacctgggcaaacgcgaggatcagtggtgcgggtccttgataggactgaccgcgcgggctacttgggccacaaatatccaggttgcaattaaccaagtgaggcgactcatcggtaatgagaactatcttgactacatgaccagtatgaagagattcaaaaatgaaagcgatccggagggcgccctgtggtga

SEQ ID NO: 13542 - RNA, 9879 nt, synthetic construct
  misc_feature 1..9879: note = derived and/or modified CDS sequence (opt3) from DENV-1__GU131837__SS-prME
  source 1..9879: mol_type = other RNA
agcgtgaccatgctgctcatgcttctgcccacagccttggctttccacttaactacgagaggcggggagcctcatatgatcgtctccaagcaggaaaggggaaaatctctgctatttaagacctcagcaggtgttaacatgtgcacactcattgccatggacctgggcgagctttgtgaagatactatgacctacaaatgcccacggataacagaggcggaaccggacgatgtggactgttggtgcaatgctaccgatacttgggtaacatatgggacctgtagtcaaacgggagagcaccgccgagacaagcgtagcgtggccctggcaccccatgtcggcttgggtctcgagactagaaccgaaacatggatgtcctctgagggggcctggaaacagatccagagggtggaaacttgggctctgcggcaccctggattcaccgttattgcactgtttctcgcccatgctatcggcacatcgattacccagaagggcatcatattcatcttactgatgcttgtgacgccatcaatggccatgcgctgcgtcgggattggaaacagagattttgtggagggtttgagcggcgcgacttgggtagacgttgtgctggagcacgggagttgtgtcacaaccatggcaaagaataaacccactctagatatcgaactcctgaagacagaggtgaccaaccctgccgtgcttaggaaactgtgcattgaagctaagatctccaatacgaccacagactctcggtgtccaactcaaggagaggccaccttggtcgaagagcaggatgcaaacttcgtttgccgccgaacatttgtggacagaggctggggtaatgggtgtggactcttcggcaaaggcagcctgttaacttgcgctaagtttaagtgcgtaaccaaactggaggggaagatagtgcagtacgaaaacctcaaatattccgtcattgtgacagttcacaccggagatcagcatcaagtgggtaatgagactacggaacacggcacaatcgccaccattactccccaggcgcctacctcagagatccagcttacagactacggggccctgaccttggactgtagtccaaggactggactagatttcaacgaaatggtcctgctcacaatgaaggagaaaagctggctggtgcataagcagtggtttcttgacctgccgttgccctggacgtctggcgcatccacctcacaagagacttggaatcggcaggatctcctggtaacattcaaaaccgctcacgccaagaagcaggaagttgtggtcttaggtagccaagagggggctatgcacacagccctgactggcgcaaccgaaatccagacgagtggaaccacaactatttttgccggccatctaaaatgccgtctcaagatggacaaactgacccttaaggggatgtcttatgtgatgtgtacaggatccttcaaattggagaaggaagtcgctgagactcagcacggtaccgtgctggttcaggtgaagtacgagggcacggatgcgccttgcaaaataccattcagcacacaagacgaaaagggggtaacccagaacggacgcctcatcactgcaaatcccattgtcacagataaagagaagcctgtgaacatcgaaaccgagccaccctttggcgagtcgtatatagttgtgggtgccggggaaaaagctctgaagctttcttggttcaagaaaggctcctcaattggaaagatgtttgaggccactgcaagaggcgccaggcggatggctatcctgggggacaccgcctgggatttcggaagtatcggtggcgtctttacaagcgtggggaaattggtacatcaggtgttcggaacggcatacggcgttctcttttccggtgtctcttggaccatgaagattgggatcggcattctgttaacttggctgggactaaatagccgatcaacaagtctctccatgacctgtatagcggtgggcatggtgacactgtaccttggggtcatggttcaggctgacagcggatgcgtgatcaactggaaaggccgcgaattgaagtgtggttctgggattttcgtgactaacgaggtacacacctggacggaacaatataagtttcaggccgattcaccgaaaagactgagtgcagccatcggaaaggcttgggaggagggcgtctgcggtatcaggagcgccacacggctcgaaaatattatgtggaaacagatatccaacgagctgaatcatatcttactggaaaacgacatgaagttcaccgtggttgtgggcgacgcaaatgggattcttgctcagggaaaaaagatgatccgccctcaacccatggagcacaaatactcttggaagtcgtggggcaaggccaaaattatcggggcggatatacagaacactacctttatcattgacggaccagatacacctgaatgtcccgacggccagagagcctggaatatctgggaggtcgaggattatggtttcgggatttttactaccaacatctggttgaagctcagggacagctacacacagatgtgcgatcaccgtctgatgtccgctgcaataaaagactcaaaggccgtgcatgctgatatgggatattggattgaaagtgagaaaaatgaaacgtggaagctagcccgggcatctttcatcgaggttaagacctgtacttggccaaaaagccacacactgtggtccaacggcgtgctcgaatcagagatgattatccccaagatatacggtggccctatcagccaacataattatcgaccagggtacttcacccagactgcgggaccgtggcacctgggcaaacttgagttggactttgatctgtgcgaagggacaaccgtagtcgtggacgagcactgcggaaacagaggcccctctttaaggacgactaccgtgacaggtaagattatccatgaatggtgttgccgctcctgtaccctccctccactgcggttcagaggggaggatggatgctggtacggcatggagattaggcccgtcaaagaaaaggaggaaaatcttgttcgcagtatggtgagcgccggttctggcgaggtagactccttttcactggggatcttgtgtgtgagtataatgattgaagaggtcatgcgaagccggtggtcgcgtaagatgctcatgactggaacactggctgtgttcctactgctcatcatgggccagctgacctggaacgaccttatcagattgtgcattatggttggggccaatgcatccgataggatgggaatgggcacaacttatctggctttaatggccacctttaaaatgcgccctatgttcgcagtgggtctcctgtttcggagacttacgtctagggaggtcctgctactcacaatcgggctgagcttggtggcctcagttgaactgccaaacagtttagaggaactcggagacggcctggctatgggcattatgatgcttaagctgttgaccgagttccaaccccaccagctctggactaccctgctatccctgacatttgtgaaaactaccctttctctcgattacgcgtggaagacgacagccatggtcctgagcatagtatccttgttcccgctgtgtttatcaaccactagccagaaaacaacctggctccctgtgctgcttgggagttttggatgcaagccactgactatgttcttgatcacagaaaacaagatttggggtcgaaaatcttggcccctcaatgagggcatcatggcaattgggatcgtttccatactgctaagctcgctgcttaagaacgacgtgcctctcgctggacccctgatcgccggcggtatgttgattgcctgttatgtcatctcagggtctagtgctgatttatccctggagaaagcagccgaagtgagctgggagcaggaagcggagcattctggagctagccacaatattctcgtagaagtgcaagacgatggcaccatgaagatcaaagacgaggagcgcgatgacacgctgactatacttctgaaggccaccttgctagcagtctccggcgtttacccaatgtcaattcctgccacactgtttgtgtggtatttctggcagaaaaagaagcagcggagtggggtgctctgggatacccccagcccaccggaagtcgagagagctgtgctggacgatggaatctacaggatccttcagcgtggtttactgggccgctctcaagttggggtaggagtgttccaggacggcgtctttcatacaatgtggcacgtgactcggggtgcagttctcatgtatcaggggaaaagattggaaccttcctgggcctcagtgaagaaagacctgattagttacggaggcggctggaggttccaggggagctggaacaccggagaggaggtccaagtgatagcggtagaacccggtaagaatccaaaaaacgtccagacgacacccggcacttttaagacccctgagggggaagtgggagctatcgccctcgatttcaagccaggcacatccggttctcccattgttaatcgagaggggaaaatcgtgggactgtacggcaacggcgtcgtgaccacttcggggacctatgttagcgcaattgcccaggctaaggcctcacaagaaggacctcttccggagatcgaggacgaagtgtttaaaaagcggaatctgacaataatggatttgcacccaggttccggcaaaacgcgcagatacctacccgcaatcgtcagggaggctattaagcggaagctgcgaactctcatcttagcccctaccagagtggtagcgagtgaaatggccgaggcactgaaagggatgccaattcgctatcagacaaccgctgtgaagtctgaacatactggaagggagatcgttgaccttatgtgccacgccacattcaccatgcgtctgctcagccccgtccgggtgcctaactacaatatgataattatggatgaggctcattttacggacccggcatccatcgccgccagaggctatatctcaactagggtgggtatgggggaagctgcggcaattttcatgacagccacccccccaggatctgtcgaggcttttcctcagagcaacgccgtaatccaggatgaagagcgcgacatacccgaacgaagttggaattccggctacgattggattaccgacttcccaggcaaaactgtgtggtttgttcctagcatcaagtctgggaacgatattgcaaattgtttgagaaaaaacggaaagcgggtgatccaactgtcaaggaagacattcgacaccgagtatcagaaaacaaagaacaatgactgggattacgtcgtgactacggacatatccgagatgggtgccaacttccgcgctgatcgtgttattgaccccagacggtgcctcaaaccagtgatcctgaaggatggcccggaaagggtcatccttgcggggcctatgcccgtgaccgtagccagtgcagctcagcgccgaggaagaattggccggaatcagaacaaagagggtgaccaatacgtgtatatggggcagccactaaataacgatgaagaccacgcccattggacagaggcaaagatgctgttggataatatcaacactcccgagggcattatacctgccttatttgaaccagagagggaaaagagcgctgccatcgacggagagtaccgcctgagaggcgaagcgaggaaaaccttcgttgagctcatgcggcgtggggatctgcccgtctggctttcgtataaggtggcatctgagggatttcagtactccgaccgccgatggtgcttcgatggtgaaagaaataaccaggtgctggaggaaaatatggacgtcgagatttggacaaaagaaggcgagaggaagaaactccggcctcgctggttggacgccagaacctatagcgatccgctggctctaagggagtttaaggaattcgccgctgggcggcgatcagttagtggagacctgatcctcgagatcggcaaacttccacaacacctgactttaagagcacagaacgccttggataatctggtgatgctccacaactctgaacagggtgggaaggcttaccgccatgccatggaggaactgcccgacacgattgagacccttatgctgctcgcattgatagcggtactgacaggcggagtgactttatttttcctatccggcaaggggctgggaaaaaccagcatcggtctcctttgtgtcacagcctcaagtgctctgttgtggatggccagcgtggagcctcactggattgcagcttccatcattctggaatttttcctcatggttctgcttatccccgagccagataggcagcggacccctcaagacaatcagctcgcctatgtggtcataggcctgttgtttatgatcctgactgtagcagccaacgaaatggggttactagagacaacgaagaaagatctgggaattggctacgtggctgcggagaaccatcagcacgccaccatgctcgacgttgatcttcgtcccgcatctgcttggactctgtacgccgtggccacaaccgtcatcaccccaatgatgagacacacaattgaaaatactacggcaaacatcagcttgaccgctatagccaatcaagcggctattctgatgggtctcgacaaggggtggcctatctccaaaatggatattggcgtgccgctgcttgccttaggatgctattcacaggtcaaccccctgacactcactgcagccgtgttgatgctggttgctcattacgcaatcataggcccagggctacaggccaaggcgaccagggaggctcagaagcgcacagccgcaggaatcatgaaaaatcctaccgtggacggcattgtagccatcgatctggaccccgtggtctatgacgctaagttcgaaaaacaactcggtcagattatgcttctgatcttgtgtacttctcagatactgctcatgcggacgacatgggccctgtgcgagagtattaccttagcaactgggccacttaccacactgtgggaaggatcgcctggcaagttttggaacactaccatcgctgttagcatggccaatatcttccgaggttcctacctcgcgggcgccgggctagcattctctctgatgaaatcattgggaggcgggagaaggggaacaggcgctcagggtgagacgctgggggagaagtggaagcgccaactcaaccagcttagcaaatccgaatttaatacctataagcggagtggaattatggaggtggatagatctgaagccaaagagggcctgaagcgtggtgaaactacaaaacacgcagtcagcaggggcaccgctaagttgcggtggttcgtggagcgcaacctggtaaagcccgaggggaaagtgatcgacctcggatgtggccgagggggatggtcatactattgcgccggcttaaagaaagttactgaagtgaagggttacacaaaagggggaccgggccatgaggaaccaatacctatggccacctacggctggaatctggtcaagcttcactccgggaaagatgtgtttttcatgcccccagagaagtgtgacacgctgctatgcgatattggagaaagtagccccaaccctaccatcgaggagggtagaacactcagggtcctgaagatggtggaaccgtggttgcggggcaatcagttttgtattaaaatcctgaacccctatatgccatctgttgtagagactctcgaacagatgcaacgcaagcatgggggaatgcttgtgagaaatcctctgtccaggaactcaacccacgagatgtactgggtcagctgcggcacaggtaatatagtgtcggcggttaacatgacttctcgaatgttactgaaccggttcaccatggctcaccgtaaacccacatatgagagagacgtggatttgggggcaggaacccgccatgtcgccgtggaacctgaggaagctaatctcgacatcattggccagaggatcgagaacattaagaatgaacacaaaagtacttggcattacgatgaggacaacccatataagacgtgggcctaccacggctcctatgaggtaaagcccagcgggtcagcatcctctatggtgaatggagttgtccggctgctaacaaaaccttgggatgtgatcccaatggtgacccagattgccatgactgacaccacaccctttggtcaacagagagtcttcaaggaaaaagttgacacgcgcaccccgagggctaagcgaggcactacacagatcatggaggtgaccgcgaaatggctttgggggtttctgagccggaacaagaagcctagaatatgtactagggaagagttcacacgcaaagtacgtagtaatgccgcaattggagctgtgtttgtcgatgaaaaccagtggaattccgccaaggaggcagtggaggacgaacggttctgggatctcgttcacagagagagggaactgcataaacaaggcaagtgcgccacctgcgtgtacaacatgatgggtaaacgcgagaagaagttgggggaatttggaaaagctaagggcagccgagccatctggtacatgtggctgggcgcgcggttcctcgagttcgaggcacttgggtttatgaatgaagaccactggttctctagagagaactcactgagtggagtcgaaggtgagggcttacataaactggggtatatcttgagggatatttccaagataccaggaggcaatatgtacgccgacgatacagctggttgggacactcgcatcaccgaggatgacctccagaacgaagccaaaattacggatatcatggagcccgaacacgcactgctagctaccagcatttttaagcttacatatcagaataaagtggtaagagttcagcggcctgccaagaacgggactgtgatggacgtcatctctaggcgtgatcaacgaggatcgggccaggtgggcacctacgggctgaacacattcactaatatggaggtgcagctcatacgccagatggaatcagagggaatctttctgccaagcgagttggaaacccccaacttagctgagagagtcctggactggctcgaaaagcatggtacggagcggcttaaaaggatggccatttccggcgacgattgtgttgtgaagccgatcgacgatcgcttcgcaacagcgctgaccgccctaaatgacatggggaaagtaagaaaggatattcctcaatgggaacccagtaaaggatggaacgactggcagcaggtgccattttgctctcaccacttccatcagctgatcatgaaggatggccgggagatagtcgtgccttgtaggaatcaagacgagctcgttggtcgagctcgtgtgagccagggggccggatggtccttgagagaaactgcatgcctgggcaagtcatatgctcagatgtggcaacttatgtactttcaccgccgggatctgaggctcgccgcaaacgccatttgtagtgcggtccccgtggactgggtaccaacatctagaaccacttggagcatccatgctcaccaccagtggatgaccacagaggatatgttatccgtttggaatcgcgtgtggatcgaagagaacccctggatggaagacaaaacgcatgtctcaagctgggaggaggtgccttatctgggcaagcgggaagaccagtggtgcgggtctttgattggactgaccgccagggcaacttgggccacaaatatacaggttgctatcaaccaagtgcgaagactcattggtaatgagaactaccttgattacatgacctccatgaaacggttcaagaatgaaagtgacccagagggcgccctgtggtga

SEQ ID NO: 13543 - RNA, 9879 nt, synthetic construct
  misc_feature 1..9879: note = derived and/or modified CDS sequence (opt3) from DENV-1__JN819415__SS-prME
  source 1..9879: mol_type = other RNA
agcgtgaccatgctgctcatgcttctgcccaccgccttggctttccacttaactacgagaggaggggaacctcatatgatcgtctccaagcaggaaaggggaaaatctctgttgtttaagacctcagccggtgttaacatgtgcacactcattgccatggacctgggagaactttgtgaagatactatgacctacaaatgcccacggataacagaagcggaaccggacgatgtggactgttggtgcaatgctaccgatacttgggtaacatatgggacctgtagtcaaacgggagagcaccgccgagacaagcgtagcgtggccctggcaccccatgtcggcttgggtctcgagactagaaccgaaacatggatgtcctctgagggggcctggaaacagatccagagggtggaaacttgggctctgcggcaccctggattcaccgttacagcactgtttctcgcccatgctattggcacctcgatcacgcagaagggcattatcttcatattactgatgcttgtgactccatcaatggccatgcgctgcgtcgggatcggaaacagagattttgtggagggtttgagcggcgcgacatgggtagacgttgtgctggagcacgggagttgtgtcaccactatggcaaagaataaacccacactagatattgaactcctgaagaccgaggtgacgaaccctgccgtgcttaggaaactgtgcatcgaagctaagatttccaataccacaactgactctcggtgtccaacccaaggagaggccacattggtcgaagaacaggatgcaaacttcgtttgccgccgaacttttgtggacagaggctggggtaatgggtgtggactcttcggcaaaggcagcctgttaacctgcgctaagtttaagtgcgtaacaaaactggaggggaagatcgtgcagtacgaaaacctcaaatattccgtcatagtgaccgttcacactggagatcagcatcaagtgggtaatgagacgacagaacacggcaccattgccactatcacaccccaggcgcctacatcagagattcagcttaccgactacggggccctgactttggactgtagtccaaggacaggactagatttcaacgaaatggtcctgctcacgatgaaggagaaaagctggctggtgcataagcagtggtttcttgacctgccgttgccctggacctctggcgcatccacttcacaagagacatggaatcggcaggatctcctggtaaccttcaaaacagctcacgccaagaagcaggaagttgtggtcttaggtagccaagagggggctatgcacactgccctgaccggcgcaacggaaatccagaccagtggaacaactaccatctttgccggccatctaaaatgccgtctcaagatggacaaactgacacttaaggggacttcttatgtgatgtgtaccggatccttcaaattggagaaggaagtcgctgagacgcagcacggtacagtgctggttcaggtgaagtacgagggcaccgatgcgccttgcaaaattccattcagcactcaagacgaaaagggggtaacacagaacggacgcctcataaccgcaaatcccatcgtcactgataaagagaagcctgtgaacattgaaaccgagccaccctttggcgagtcgtatatcgttgtgggtgccggggaaaaagctctgaaactttcttggttcaagaaaggctcctcaataggaaagatgtttgaggccacagcaagaggcgccaggcggatggctattctgggggacacggcctgggatttcggaagtatcggtggcgtctttaccagcgtggggaaattggtacatcaggtgttcggaactgcatacggcgttctcttttccggtgtctcttggacaatgaagatcgggattggcatcctgttaacctggctgggactaaatagccgatcaacaagtctctccatgacttgtattgcggtgggcatggtgaccctgtaccttggggtcatggttcaggctgacagcggatgcgtgataaactggaaaggccgcgaattgaagtgtggttctgggatcttcgtgacgaacgaggtacacacatggaccgaacaatataagtttcaggccgattcaccgaaaagactgagtgcagccattggaaaggcttgggaggagggcgtctgcggtatcaggagcgccactcggctcgaaaatatcatgtggaaacagatttccaacgagctgaatcatatattactggaaaacgacatgaagttcaccgtggttgtgggcgacgcaaatgggatccttgctcagggcaagaagatgattcgccctcaacccatggagcacaaatactcttggaagtcgtggggcaaggccaaaatcattggggcggatatccagaacacaacttttataatcgacggaccagatacccctgaatgtcccgacgatcagagagcctggaatatttgggaggtcgaggactatggcttcggtatctttacaacgaacatttggttgaagctcagggatagctacacccagatgtgcgaccaccgtctgatgtccgctgcaatcaaagattcaaaggccgtgcatgctgacatggggtattggatagaaagtgagaaaaatgaaacttggaagctagcccgggcatctttcattgaggttaagacatgtacctggccaaaaagccacactctgtggtccaacggagtgctcgaatcagagatgatcattcccaagatctacggcggtcctataagccaacataattatcgaccaggctacttcacacagaccgcggggccgtggcacctgggaaaacttgagttggattttaacctgtgcgaaggcacgactgtagtcgtggacgagcactgcgggaatagaggaccctctttaaggaccacaaccgtgactggcaagatcattcatgaatggtgttgccgctcctgtacactccctccactgcggttcagaggtgaggatgggtgctggtacggaatggagatcaggcccgtcaaagaaaaggaggaaaaccttgttcgcagtatggtgagcgccggctctggtgaggtagactccttttcactgggcattttgtgtgtgagtatcatgatagaagaggtcatgcgaagccggtggtcgcgtaagatgctcatgaccgggacactggctgtgttcctactgctcattatgggacagctgacttggaatgaccttatcagattgtgcatcatggttggcgccaacgcatccgataggatggggatgggaaccacgtatctggctttaatggccacatttaaaatgcgccctatgttcgcagtgggcctcctgtttcggagacttacctctagggaggtcctgctactcactattggtctgagcttggtggcctcagttgaactgccaaacagtttagaggaactcggggacggactggctatgggcatcatgatgcttaagctgttgaccgagttccaaccccaccagctctggacaactctgctatccctgacctttattaaaacgacactttctctcgattacgcgtggaagaccactgccatggcactgagcatagtgtccttgttcccgctgtgtttatcaacaaccagccagaaaactacatggctccctgtcctgcttggcagttttgggtgcaagccactgaccatgttcttgatcacggaaaataagatttggggacgaaaatcttggcccctcaacgagggtatcatggctattggcatcgtatccatactgctaagctcgctgcttaagaatgacgtgcctctcgccgggcccctgatcgccggaggcatgttgattgcttgttatgttatctcaggttctagtgcagatttatccctggagaaagccgcggaagtgagctgggagcaggaagctgagcattctgggactagccacaacattctcgtcgaagtgcaagacgatggaaccatgaagatcaaagacgaggagaaggatgacacactgaccatacttctgaaagccacattgctagcagtatccggcgtgtacccaatgtcaattcctgccactctgtttgtctggtatttctggcagaagaagaaacagcgcagtggcgttctctgggatacccccagcccaccggaagtggagcgggctgtgctggacgatgggatctacagaatccttcagaggggattactgggtcgttctcaagtcggcgtgggggttttccaggacggagtatttcatacgatgtggcacgtgacacgcggcgcagtcctcatgtatcagggtaagcggttggaaccttcctgggcctcagtgaaaaaggacctgattagttacgggggaggctggagattccagggcagctggaatactggggaggaggttcaagtgatagcggtcgaacccggcaagaacccaaagaatgtgcagaccacacccggtacctttaagactcctgagggcgaagtaggggctatcgccctcgatttcaaaccaggaacctccggctctcccattgtcaacagggagggtaagatcgtggggctgtacggaaatggcgttgtgacaacgtcgggcacttatgtcagcgcaattgcccaggctaaagcctcacaagaagggcctcttccggagatcgaggacgaagtgtttaagaaacgaaacctgaccataatggatttgcacccaggatccggtaagacacggcgctacctacccgcaatcgttagagaggctattaagaggaaactgcggaccctcatcttagcccctactcgagtggtcgcgagtgaaatggccgaggcactgaagggcatgccaattagatatcagacaaccgctgtgaaatctgaacatacggggcgcgagatcgtagaccttatgtgccacgccactttcacaatgaggctgctcagccccgtgcgtgttcctaattacaacatgataattatggatgaggctcattttaccgacccggcatccatcgccgcccggggatatatctcaaccagagtcggcatgggtgaagctgcggcaattttcatgactgccacacccccagggtctgtggaggcttttcctcagagcaatgccgtgatccaggatgaagagagggacatacccgaacgcagttggaactccggatacgattggattaccgacttcccaggcaagacagtctggtttgtacctagcatcaaatctggcaatgatattgcaaactgtttgcgaaagaacgggaagagagtgatccaactgtcacggaaaactttcgacacggagtatcagaagaccaaaaataacgactgggattacgttgtgacaactgacatatccgagatgggagccaatttcagggctgatcgcgtcattgacccccgtagatgcctcaagccagtgatcctgaaagatggtccggaacgggttatccttgcgggccctatgcccgtgaccgtcgccagtgcagctcagaggcgcgggcgaattggaagaaaccagaataaggagggcgaccaatacgtgtatatgggtcagccactaaacaatgatgaagaccacgcccattggacagaggcaaagatgctgttggataacatcaatacccccgaggggattatacctgccttatttgaaccagagcgggaaaagagcgctgccatcgacggcgagtacaggctgcgcggagaggcgagaaagactttcgtagagctcatgaggcggggcgatctgcccgtgtggctttcgtataaagttgcatctgaggggtttcagtactccgaccgtcgctggtgcttcgatggagaacgaaacaatcaggtcctggaggaaaacatggacgtggagatttggacgaaggaaggtgagaggaagaagctcaggcctcggtggttggacgcccgcacctatagcgatccgctggctctaagagagtttaaagagttcgccgctggcaggcggtcagtgagtggggacctgatcctcgagatcggaaaacttccacaacacctgacattacgagcacagaatgccttggataacctggtcatgctccacaattctgaacagggcggtaaggcttacagacatgccatggaggaactgcccgacactattgagacccttatgctgctcgcattgatagcggttctgacagggggcgtgaccttatttttcctatccggaaaaggcctggggaagactagcatcggactcctttgtgtaacagcctcaagtgctctgttgtggatggccagcgtggagcctcactggattgcagcttccatcattctggaatttttcctcatggtcctgcttatccccgagccagatcgccagaggacgcctcaagacaaccagctcgcctatgtggttataggtctgttgtttatgatcctgaccgtggcagccaacgaaatgggcttactagagactacaaaacgggatctggggattggacatgtcgctgcggagaatcaccagcacgccaccatgctcgacgtagatcttcgtcccgcatctgcttggaccctgtacgccgtggccacaactgttatcacgccaatgatgagacataccattgaaaacacaactgcaaatatcagcttgaccgctatagccaaccaagcggctattctgatgggcctcgacaagggttggcctatctccaaaatggatattggggtgccgctgcttgccttaggctgctactcacaggtcaatcccctgacactcaccgcagccgtgttgatgctggtcgctcactatgcaatcataggaccaggcctacaggccaaggcgactagggaggctcagaagcgcacggccgcagggatcatgaaaaaccctacagtggacggaattgttgccatcgatctggaccccgtggtatacgacgctaagttcgaaaaacaactcggccagattatgcttctgatcttgtgtacctctcagatactgctcatgcggactacctgggccctgtgcgagagtattacattagcaactggtccacttaccacactgtgggaagggtcgcctggaaagttttggaatacgaccatcgctgtgagcatggccaacatcttccgaggctcctatctcgcgggtgccggcctagcattctctctgatgaaatcactagggggaggcagaagggggactggagctcagggcgagacactgggtgagaagtggaagcgccaactcaatcagcttagcaaatccgaatttaacacctacaagcggagtgggattatggaggtcgatagatctgaagccaaagagggactgaagcgtggcgaaactacaaaacatgcagttagcaggggtaccgctaagttgcggtggttcgtggagcgcaatctggtcaagcccgagggcaaagtgatcgacctcgggtgtggacgaggcgggtggtcatattactgcgccggattaaagaaagtaacggaagtgaagggctataccaaaggtgggccgggacacgaggaaccaatacctatggccacatacggctggaacctggttaaacttcattccggcaaagatgtgtttttcatgcccccagagaagtgtgacactctgctatgcgatattggggaaagtagccccaatcctaccatcgaggagggaagaacactcagggtcctgaagatggtggaaccgtggttgcggggtaaccagttttgtattaaaatcctgaatccctacatgccatctgtcgtggagactctcgaacagatgcaacgcaagcacggcgggatgcttgttagaaaccctctgtccagaaattcaacccacgagatgtattgggtaagctgcggaacaggcaacatagtgtcggcggtcaacatgacctctcgaatgttactgaatcggttcactatggctcatcgtaaacccacgtacgagagagacgtggatttgggtgcagggacacgccacgttgccgtggaacctgaggtcgctaacctcgacatcattggacagaggatcgaaaatattaagaacgagcataaaagtacctggcactatgatgaagacaatccatacaagacttgggcctatcacggctcctacgaggtgaagcccagcggctcagcatcctctatggtaaacggggtggttcggctgctaaccaaaccttgggatgtcatcccaatggtgacacagattgccatgacggacaccactccctttggacaacagagagtgttcaaggagaaagtcgacacacgcaccccgagggctaagcgaggtactacacagatcatggaagttaccgcgaaatggctttggggctttctgagccggaataagaagcctagaatatgtacaagggaggagttcactcgcaaagtgcgtagtaacgccgcaattggggctgtatttgtggatgagaatcagtggaactccgccaaggaagcagtcgaggacgagcggttctgggatctcgtgcatagagaaagggagctgcacaaacaaggaaagtgcgcaacctgcgtttataatatgatgggcaaacgcgaaaagaagttgggtgagtttgggaaagctaagggaagccgagccatctggtacatgtggctgggcgcgcggttcctcgagttcgaggcacttggctttatgaacgaggaccattggttctctagagaaaattcactgagtggggtggagggagaaggtttacacaaactgggctacatcttgagggatatttccaagataccagggggaaacatgtatgccgacgatacggctggctgggacacccgcatcacagaggatgacctccagaatgaggccaaaattactgatatcatggaacccgagcatgcactgctagctaccagcatttttaaacttacataccagaacaaagtcgtgagagtacagcggcctgccaagaacggtactgttatggacgtgatctctaggcgtgatcaacgagggtcgggacaggtcggcacctatggcctgaatacgttcacaaacatggaagtgcagctcatacgccagatggagtcagaagggatctttctgccaagcgagttggagacccccaatttagctgaaagagtgctggactggctcgagaagcacggagccgaacggcttaaaaggatggcaatttccggtgacgattgtgtcgttaagccgatcgacgatcgcttcgcgactgccctgacagctctaaacgacatgggcaaagtgagaaaggatattcctcaatgggagcccagtaaagggtggaatgactggcagcaggtaccattttgctctcaccatttccaccagctgatcatgaaggatggacgggaaatagtggtcccttgtaggaaccaagacgagctcgtgggccgagcccgtgttagccagggtgcagggtggtccttgagagagaccgcttgcctgggaaagtcatacgcccagatgtggcaacttatgtattttcatcgccgggatctgaggctcgcagccaatgcgatttgtagtgctgtgcccgtcgactgggtgccaacttctagaaccacatggagcatccacgcccaccatcagtggatgacgaccgaagatatgttatccgtatggaaccgcgtttggatcgaggaaaatccctggatggaggacaaaactcacgtgtcaagctgggaagaggtcccttacctgggcaagcgggaggaccagtggtgcggctctttgattgggctgacagcaagggccacctgggctactaacatacaggtggccatcaatcaagttcgaagactcattggaaacgaaaattatcttgattacatgacatccatgaaacggttcaagaacgagagtgacccagaaggtgcactgtggtga

SEQ ID NO: 13544 - RNA, 9879 nt, synthetic construct
  misc_feature 1..9879: note = derived and/or modified CDS sequence (opt3) from DENV-1__GU131838__SS-prME
  source 1..9879: mol_type = other RNA
agcgtgaccatgctgctcatgcttctgcccacagcattggctttccacttaactacgaggggcggggagcctcatatgatcgtctccaagcaggaaaggggaaaatctctgctatttaagacctcagccggtgttaatatgtgcaccctcattgccatggacctgggcgagctttgtgaagatactatgacctacaaatgcccacggataacagaggcggaaccggacgatgtggactgttggtgcaatgctaccgatacttgggtaacatatgggacctgtagtcaaacgggagagcaccgccgagagaagcgtagcgtggccctggcaccccatgtcggcttgggtctcgaaactagaaccgagacatggatgtcctctgaaggggcctggaaacagatccagagggtggagacttgggctctgcggcaccctggattcaccgttattgcatttttcctggcccatgctatcggcacatcgattacccagaagggcatcatatttatcctcttaatgctggtgacgccatcaatggccatgcgctgcgtcgggattggaaatagagacttcgtggagggtcttagcggcgcgacttgggtagatgttgtgttggaacacgggagttgtgtcacaaccatggcaaagaataaacccactctggacatcgagctactcaagacagaagtgaccaaccctgccgtgctgaggaaactttgcattgaggctaagatctccaatacgaccacagattctcggtgtccaactcaaggagaagccaccctggtcgaggagcaggacgcaaactttgtttgccgccgaacattcgtggatagaggctggggtaatgggtgtggattgtttggcaaaggcagcctcctgacttgcgctaagttcaagtgcgtaaccaaattagaagggaagatagtgcagtacgagaacctgaaatattccgtcattgtgacagttcacaccggagaccagcatcaagtgggtaatgaaactacggagcacggcacaatcgccaccattactccccaggcgcctacctcagaaatccagctcacagattacggggcccttaccctggactgtagtccaaggactggattggactttaacgagatggtcctactgacaatgaaggagaaaagctggctcgtgcataagcagtggttcctggatcttccgctgccctggacgtctggcgcatccacctcacaagaaacttggaatcggcaggacttgctcgtaacatttaaaaccgctcacgccaagaagcaggaggttgtggtcctgggtagccaagaaggggctatgcacacagccttaactggcgcaaccgagatccagacgagtggaaccacaactattttcgccggccatctgaaatgccgtctaaagatggataaactcaccctgaaggggatgtcttatgtgatgtgtacaggatccttcaaacttgaaaaggaggtcgctgagactcagcacggtaccgtgttggttcaggtgaagtacgaaggcacggacgcgccttgcaaaataccatttagcacacaagatgagaagggggtaacccagaacggacgcctgatcactgcaaatcccattgtcacagacaaagaaaagcctgtgaacatcgagaccgagccacccttcggcgaatcgtatatagttgtgggtgccggggagaaagctctcaagctgtcttggtttaagagaggctcctcaattggaaaaatgttcgaagccactgcaaggggcgcccggcgaatggctatccttggggataccgcctgggactttggaagtatcggtggcgtcttcacaagcgtggggaagctggtacatcaggtgtttggaacggcatacggcgttttgttctccggtgtctcttggaccatgaaaattgggatcggcattctcctgacttggttaggactgaatagccgctcaacaagtctatccatgacctgtatagcggtgggcatggtgacactctacctgggggtcatggttcaggctgatagcggatgcgtgatcaactggaagggcagagagcttaaatgtggttctgggatttttgtgactaacgaagtacacacctggacggagcaatataagttccaggccgactcaccgaagaggttgagtgcagccatcggaaaggcttgggaggaaggcgtctgcggtatccggagcgccacacgcctggagaatattatgtggaagcagatatccaacgaactcaatcatatcctgttagagaacgatatgaaatttaccgtggttgtgggcgacgcaaatgggattctggctcagggaaagaaaatgatcagacctcaacccatggaacacaagtactcttggaaatcgtggggcaaggccaagattatcggggcggacatacagaacactaccttcatcattgatggaccagacacacctgagtgtcccgatggccagagggcctggaatatctgggaggtcgaagactatggttttggggtgttcactaccaacatttggcttaaattgcgtgatagctacacacagatgtgcgaccaccggctcatgtccgctgcaatcaaggattcaaaagccgttcatgctgacatgggatattggatagagagtgaaaagaatgagacgtggaaactggcccgagcatctttcattgaagtgaagacctgtacttggccaaagagccacacactatggtccaacggcgtactggagtcagagatgatcattcccaaaatctacggtggccctataagccaacataattatagaccagggtactttacccagactgcgggaccgtggcacctcggcaagctggaacttgatttcgacttgtgcgaggggacaaccgtcgtggtggatgaacactgcggaaacaggggcccctctctgcgcacgactaccgtcacaggtaaaatcattcatgagtggtgttgccggtcctgtaccttacctccactcagatttagaggggaagacggatgctggtacggcatggaaatccgccccgttaaggagaaagaagagaatctggtgcgaagtatggtaagcgccggttctggcgaagtggattccttctcacttgggattctgtgtgtcagtatcatgatagaggaggtgatgcggagccgttggtcgagaaagatgttgatgactggaacactcgctgtttttctgctactgattatgggccagctcacctggaacgacctgatcaggctttgcatcatggtgggggccaatgcatccgaccgcatgggaatgggcacaacttatttggctctgatggccaccttcaagatgcggcctatgtttgcagtcggtttactcttcagaaggctgacgtctcgagaagtgcttctgctaacaattgggctcagcctggttgcctcagtggagttgccaaacagtctggaagagttaggagatggcctcgctatgggcatcatgatgctgaaacttctgaccgaatttcaaccccaccagttgtggactaccctcctgtccctaacattcgtcaagactaccctgtctcttgactacgcgtggaaaacgacagccatggtactcagcattgtgtccctgtttccgttgtgtctgtcaaccactagccagaagacaacctggttacctgttctcctggggagtttcggatgcaaaccacttactatgtttctgataacagagaacaagatctggggtcgcaagtcttggcccttgaatgagggcattatggcaatcgggattgtgtccatcctcctgagctcgctactgaaaaacgatgtccctcttgctggacccctcatagccggcggtatgctgatcgcctgttatgtgatttcagggtctagtgctgacttgtccttagaaaagaccgcagaggtaagctgggaacaggaggccgaacattctggagcgagccacaatatcctggtggaggtccaagatgacggcacgatgaaaattaaggatgaggaacgggacgatactctcaccatcctgcttaaagctacactgttggccgtttccggcgtgtacccaatgtcaatacctgcaaccctattcgtgtggtatttctggcagaagaaaaagcagagaagtggggtcctgtgggacacacccagcccaccggaggtggaaagggccgttctcgatgacggaatttaccgtatcctgcagcgcggtcttttaggccggtctcaagtaggggtgggagtctttcaggatggcgtgttccatactatgtggcacgttaccagaggtgctgtgctgatgtatcaggggaagaggctcgagccttcctgggcatcagtcaaaaaggacttgatcagttacggaggcggctggcgatttcaggggagctggaacacgggagaggaagtgcaagtaattgccgtcgagcccggtaaaaatccaaagaacgtgcagacaactcccggcaccttcaaaacacctgaaggggaggttggagcgatagctctggactttaagccaggcacctccggttctcccatcgtgaatcgggaagggaagattgtcggactctacggcaacggcgtggttactacctcggggacatatgtgagcgccatcgcacaggccaaggcttcacaagagggacctctgccggagattgaagatgaggtcttcaagaaacgcaatcttacgatcatggacctgcacccaggttccggcaagactagaaggtacttgcccgccatagtgcgggaagcaatcaaacgaaagctaagaaccctgattctcgctcctacacgcgtagtggccagtgagatggcggaagccttaaaggggatgccaatcaggtatcagaccactgcagttaaatctgagcatacaggacgtgagattgtcgatctgatgtgccacgctacctttacgatgcggcttctgagccccgtgagagtgcctaactacaatatgatcataatggacgaagcccatttcactgatccggcttccattgcagccaggggctatatctcaacacgcgtcggtatgggggaggccgctgcgatctttatgaccgcaacacccccaggatctgtagaagccttccctcagagcaacgctgtgattcaggacgaggaacgagatatccccgagagaagttggaactccggctacgactggataactgattttccaggcaagacagtttggttcgtgcctagcattaaatctgggaacgacatcgccaattgtctccggaagaacggaaaaagggtcattcaattgtcacgcaagaccttcgatacagagtatcagaagactaaaaacaatgactgggactacgtggttacgaccgatatctccgaaatgggtgcaaactttcgtgccgacagagtgatagatccccggaggtgcctgaagccagtcattctcaaagacggcccggagcgcgtgatcctggctgggcctatgcccgtaacagtggcgagtgccgcacagcgaagaggacggatcggcaggaatcagaacaaggaaggtgatcaatacgtttatatggggcagccacttaataacgacgaggatcacgctcattggactgaggccaaaatgctactggacaatattaacacccccgaaggcatcattcctgcattgttcgagccagaacgcgagaaaagcgccgctatagatggagaatacagattaaggggcgaagcccggaagacatttgtcgagctgatgcgtcgcggggacctccccgtgtggctgtcgtataaagtggcgtctgaaggattccagtactccgatcgaagatggtgctttgacggtgagaggaataaccaggtccttgaagagaatatggatgttgaaatctggaccaaggagggcgagcggaaaaagctgcgccctagatggctcgacgcaaggacttatagcgacccgttggccctgcgggagttcaaagagtttgctgccgggcgaagatcagtgagtggagatctaattctggaaatcggcaagctcccacaacaccttacgctgcgcgctcagaacgcattagacaatttggtaatgctgcacaactctgagcagggtgggaaagcctacaggcatgctatggaggaactccccgataccatcgagacactgatgcttctggccctcattgcagtgttgactggcggagtcaccctgttctttttatccggcaaggggctaggaaagacaagcataggtctgctctgtgtgaccgcgtcaagtgcccttctgtggatggctagcgttgaacctcactggatcgccgcatccattatcttggagttctttctgatggtgctcctgattcccgaaccagaccggcagcgtactcctcaagataatcagcttgcttatgtcgtaatcggcctcctgttcatgatattgacagtggccgcaaacgagatggggctgttagagacgaccaaaaaggacctaggaatcggctacgttgccgctgaaaaccatcagcacgcgactatgctggatgtggacctccaccccgcctctgcatggacactttacgctgtcgccaccaccgtgattacaccaatgatgagacatactatcgagaatacgaccgccaacattagcctgacagcaatcgctaatcaagccgcgatattgatgggtctggataaagggtggcctatttccaagatggacatcggcgtcccgctcctggctcttggatgctattcacaggtgaaccccttaactctgaccgccgcagttctcatgttggtggcccactacgctattatcggcccagggctgcaggcaaaagccacaagggaagcgcagaagcgcaccgctgccggaataatgaagaatcctactgtagatggcatcgtggcaattgacctagatcccgtcgtttatgacgccaaatttgagaagcaactgggtcagatcatgctccttattctgtgtacgtctcagatcttgctgatgcggacaacctgggctctctgcgaaagtataactctggccaccgggccattaacaactctttgggagggatcgcctggcaaattctggaacaccacaattgcagtgagcatggctaatatcttccgaggttcctacctggccggcgcggggctcgccttttctctaatgaagtcactgggaggcgggagaaggggaacgggcgcacagggtgagaccttgggggaaaaatggaagcgccaactgaaccagctcagcaagtccgagttcaatacttataaacggagtggaatcatggaagtcgacagatctgaggctaaggaaggccttaaacgtggtgagacaaccaagcatgccgtgagcaggggcactgcaaaactgcggtggtttgtagagcgcaacttggtgaagcccgaagggaaggttattgatctgggatgtggccgagggggatggtcatactattgcgctggcctcaaaaaggtgacagaggtcaaaggttacaccaaagggggaccgggccacgaggaaccaatccctatggccacgtacggctggaatttagtgaaactgcattccgggaaggacgtcttctttatgcccccagaaaaatgtgatacccttctgtgcgacataggagagagtagccccaaccctacaattgaggaaggtagaactctaagggtgctcaagatggttgagccgtggctgcggggcaatcagttctgtatcaagattttgaacccctatatgccatctgtagtggaaaccctggagcagatgcaacgcaaacacgggggaatgctcgtcagaaatcctctttccaggaactcaacacacgagatgtactgggtgagctgcggcactggtaatatcgtttcggccgtgaacatgacctctcgaatgctgttaaaccggtttacaatggcgcatcgtaagcccacctatgaaagagatgtcgacctgggggctggaactcgccacgtggcagtagagcctgaagtggccaatttggatataatcggccagaggattgagaacatcaaaaatgaacataagagtacgtggcactacgacgaggataacccatataaaacatgggcttaccacggctcctatgaggttaagcccagcgggtcagcctcctctatggtcaatggagtggtgcggctcctgaccaagccttgggacgtcattccaatggttactcagatcgcaatgaccgatacaacgcccttcggtcaacagagagtgtttaaagaaaaggtagacacccgcactccgagggccaaacgaggcacaacccagattatggaggtgactgctaagtggctatgggggttccttagccggaacaaaaagcctagaatctgtacaagggaagagtttacccgcaaggtccgtagtaatgcggccataggagcagtgttcgttgacgaaaaccagtggaactccgctaaagaggccgtggaggatgaacggttttgggacctggtccatagagagagggaactccacaagcaaggcaaatgcgcaacatgcgtgtacaacatgatgggtaagcgcgagaaaaagctgggggagttcggaaaggccaaaggcagccgagctatttggtacatgtggttgggcgcccggttcctggagtttgaggcgctcgggttcatgaatgaagatcattggttttctagagagaactcacttagtggagtagaaggtgagggcctgcacaagttagggtatatcctgagggacatctccaaaattccaggaggcaatatgtacgcagatgacactgccggttgggatacccgcataacggaggacgatttgcagaacgaagctaagatcaccgacattatggagcccgaacatgccctcctggcaacaagcatcttcaaactaacttatcagaataaggttgtgagagtccagcggcctgctaaaaacgggaccgtgatggatgtgatttctaggcgtgaccaacgaggatcgggccaggtcggcacatacgggcttaacacttttaccaatatggaggttcagctgatccgccagatggaatcagagggaatattcctcccaagcgagctggaaacgcccaacttggccgagagagctttagattggctggaaaagcacggtgccgagcggctcaagaggatggcaatctccggcgacgactgtgtggtaaaaccgattgatgaccgctttgcgacagcccttaccgctctgaatgatatggggaaggtgagaaaagacatccctcaatgggaacccagtaagggatggaacgattggcagcaggtcccattctgctctcaccattttcaccagctaattatgaaagacggccgggagatcgtggttccttgtaggaatcaagatgagctggtgggtcgagcccgtgtcagccagggggcaggatggtccctcagagaaactgcttgcttgggcaagtcatatgcccagatgtggcaactgatgtacttccatcgccgggaccttaggctggcagccaacgcgatatgtagtgctgtgcccgtagattgggttccaacatctagaaccacttggagcattcacgcccaccatcagtggatgaccacagaggacatgctctccgtgtggaatcgcgtctggatcgaagagaacccctggatggaagataagacgcacgtgtcaagctgggaggaggttccttatttaggcaaacgggaagaccagtggtgcgggtctctgatcggattgaccgcaagggccacttgggctacaaatattcaggtggccataaaccaagtccgaagactgatcggtaatgagaactacctcgactacatgacctccatgaagcggtttaaaaatgaaagtgatccagagggcgcactttggtga

SEQ ID NO: 13545 - RNA, 9879 nt, synthetic construct
  misc_feature 1..9879: note = derived and/or modified CDS sequence (opt3) from DENV-1__GU131839__SS-prME
  source 1..9879: mol_type = other RNA
agcgtgaccatgctgctcatgcttctgcccaccgccttggctttccacttaactacgaggggcggggagcctcatatgatcgtctccaagcaggaaaggggaaagtctctgctatttaagacctcagctggtgttaacatgtgcacactcattgccatggacctgggcgagctttgtgaagatactatgacctacaaatgcccacggataaccgaggcggaaccggacgatgtggactgttggtgcaatgctaccgatacttgggtaacatatgggacctgtagtcagacgggagagcaccgccgagagaagcgtagcgtggccctggcaccccatgtcggcttgggtctcgaaactagaaccgagacatggatgtcctctgaaggggcctggaaacagatccagagggtggagacttgggctctgcggcaccctggattcaccgttattgcatttttcctggcccatgctatcggcacatcgattacccagaagggcatcatatttatcctcttaatgctggtgacgccatcaatggccatgcgctgcgtcgggattggaaacagagacttcgtggagggtcttagcggcgcgacttgggtagatgttgtgttggaacacgggagttgtgtcacaaccatggcaaagaataaacccactctggacatcgagctactcaagacagaagtgaccaaccctgccgtgctgaggaaactttgcattgaggctaagatctccaatacgaccacagattctcggtgtccaactcaaggagaagccaccctggtcgaggagcaggacgcaaactttgtttgccgccgaacattcgtggatagaggctggggtaatgggtgtggattgtttggcaaaggcagcctcctgacttgcgctaagttcaagtgcgtaaccaaattagaagggaagacagtgcagtacgagaacctgaaatattccgtcatagtgaccgttcacactggagaccagcatcaagtgggtaatgaaacgacagagcacggcaccattgccactatcacaccccaggcgcctacatcagaaattcagctcaccgattacggggcccttactctggactgtagtccaaggacaggattggactttaacgagatggtcctactgacgatgaaggagaaaagctggctcgtgcataagcagtggttcctggatcttccgctgccctggacctctggcgcatccacttcacaagaaacatggaatcggcaggacttgctcgtaacctttaaaacagctcacgccaagaagcaggaggttgtggtcctgggtagccaagaaggggctatgcacactgccttaaccggcgcaacggagatccagaccagtggaacaactaccatcttcgccggccatctgaaatgccgtctaaagatggataaactcacactgaaggggatgtcttatgtgatgtgtactggatccttcaaacttgaaaaggaggtcgctgagacccagcacggtacggtgttggttcaggtgaagtacgaaggcacagacgcgccttgcaaaattccatttagcacccaagatgagaagggggtaactcagaacggacgcctgataacagcaaatcccatcgtcaccgacaaagaaaagcctgtgaacattgagactgagccacccttcggcgaatcgtatatcgttgtgggtgccggggagaaagctctcaagctgtcttggtttaagagaggctcctcaataggaaaaatgttcgaagccaccgcaaggggcgcccggcgaatggctattcttggggatacagcctgggactttggaagtatcggtggcgtcttcacgagcgtggggaagctggtacatcaggtgtttggaaccgcatacggcgttttgttctccggtgtctcttggactatgaaaatcgggattggcatcctcctgacatggttaggactgaatagccgctcaaccagtctatccatgacatgtattgcggtgggcatggtgactctctacctgggggtcatggttcaggctgatagcggatgcgtgataaactggaagggcagagagcttaaatgtggttctgggatctttgtgaccaacgaagtacacacgtggacagagcaatataagttccaggccgactcaccgaagaggttgagtgcagccattggaaaggcttgggaggaaggcgtctgcggtatccggagcgccacccgcctggagaatatcatgtggaagcagatttccaacgaactcaatcatatactgttagagaacgatatgaaatttactgtggttgtgggcgacgcaaatgggatcctggtccagggaaagaaaatgattagacctcaacccatggaacacaagtactcttggaaatcgtggggcaaggctaagatcattggggccgacacccagaacacaactttcatcatagatggaccagacacccctgagtgtcccgatggccagagggcgtggaatatctgggaggtggaagactatggttttggggttttcacaacgaacatttggcttaaattgcgtgatagctacacccagatgtgcgaccaccggctcatgtccgccgctatcaaggattcaaaagcagtgcatgccgacatgggatattggattgagagtgaaaagaatgagacttggaaactggctcgagcctctttcatcgaagtaaagacatgtacctggccaaagagccacactctatggtccaacggcgtcctggagtcagagatgataattcccaaaatctacggtggccctattagccaacataattatagaccagggtactttacacagaccgcaggaccgtggcacctcggcaagctggaacttgatttcgacttgtgcgaggggacgactgtggtggtcgatgaacactgcggaaacaggggcccctctctgcgcaccacaaccgttactggtaaaatcatacatgagtggtgttgccggtcctgtacattacctccactcagatttagaggggaagacggatgctggtacggcatggaaatccgccccgtgaaggagaaagaagagaatctggtacgaagtatggtgagcgcgggttctggcgaagtcgattccttctcacttgggattctgtgtgtgagtatcatgattgaggaggttatgcggagccgttggtcgagaaagatgttgatgaccggaacactcgccgtgtttctgctactgatcatgggccagctcacttggaacgacctgataaggctttgcattatggtcggggctaatgcctccgaccgcatgggaatgggcaccacgtatttggcactgatggctacattcaagatgcggcctatgtttgccgtgggtttactcttcagaaggctgacctctcgagaagttcttctgctaactatcgggctcagcctggtggcatcagtcgagttgccaaacagtctggaagagttaggagatggcctcgccatgggcatcatgatgctgaaacttctgaccgaatttcaaccccaccagttgtggacaactctcctgtccctaaccttcgtaaagacggctctgtctcttgactacgcgtggaaaacaaccgccatggtgctcagcattgtttccctgtttccgttgtgtctgtcaactacaagccagaagaccacttggttacctgtgctcctggggagtttcggatgcaaaccacttacaatgtttctgatcaccgagaacaagatttggggtcgcaagtcttggcccttgaatgagggcataatggcaatcgggattgtctccatcctcctgagctcgctactgaaaaacgatgtgcctcttgctggacccctcattgccggcggtatgctgatcgcctgttatgtaatatcagggtctagtgctgacttgtccttagaaaaggcagccgaggtgagctgggaacaggaggcggaacattctggagctagccacaatatcctggtcgaggttcaagatgacggcacgatgaaaattaaggatgaggaacgggacgatactctcaccatcctgcttaaagccacactgttggcagtgtccggcgtgtacccaatgtcaattcctgccaccctattcgtctggtatttctggcagaagaaaaagcagagaagtggggtgctgtgggacacacccagcccaccggaggttgaaagggctgtactcgataacggaatctaccgtatactgcagcgcggtcttttaggccggtctcaagtgggggtcggagtgtttcaggacggcgttttccatactatgtggcacgtgaccagaggtgcagtcctgatgtatcaggggaagaggctcgagccttcctgggcctcagtgaaaaaggatttgattagttacggaggcggctggcgatttcaggggagctggaatacgggagaggaagtacaagtcatcgcggtggagcccggtaaaaacccaaagaatgttcagacaactcccggcaccttcaaaacacctgaaggggaggtgggagctatcgccctggactttaagccaggcacctccggttctcccattgtcaaccgggaagggaagatagtgggactctacggcaatggcgttgtgactacctcggggacatatgtcagcgcaatcgcccaggctaaagcctcacaagagggacctctgccggagattgaagacgaggtgttcaagaaacgcaaccttacgatcatggatctgcacccaggttccggcaagactagaaggtacttgcccgcaattgtacgggaagctatcaaacgaaagctaagaaccctgatactcgcccctacacgcgtggttgcgagtgagatggccgaagcattaaaggggatgccaatcaggtatcagaccactgctgtcaaatctgagcatacaggacgtgagattgtggacctgatgtgccacgccacctttacgatgcggcttctgagccccgtgagagtccctaattacaacatgatcattatggatgaagctcatttcactgacccggcatccatcgccgccaggggctatatatcaacacgcgtaggtatgggggaggctgcggcaatttttatgaccgccacacccccaggatctgtggaggctttccctcagagcaatgccgttatccaggatgaggaacgagacatccccgagagaagttggaactccggctacgattggattactgactttccaggcaagacagtgtggttcgtccctagcatcaaatctgggaatgatatagcaaactgtctccggaagaacggaaaaagggtgattcaattgtcacgcaagaccttcgacacagagtatcagaagactaaaaataacgattgggactacgttgtgacgaccgacatctccgaaatgggtgccaattttcgtgctgatagagtcattgacccccggaggtgcctgaagccagtgatcctcaaagatggcccggagcgcgtaatactggcggggcctatgcccgtgacagttgccagtgcagctcagcgaagaggacggattggcaggaaccagaataaggaaggtgaccaatacgtctatatggggcagccacttaacaatgatgaggaccacgcccattggactgaggcaaaaatgctactggataacatcaatacccccgaaggcatcattcctgccttgttcgagccagaacgcgagaaaagcgctgccatcgacggagaatacagattaaggggcgaagcgcggaagacatttgtggagctgatgcgtcgcggggatctccccgtgtggctgtcgtataaagtcgcatctgaaggattccagtactccgaccgaagatggtgctttgatggtgagaggaacaatcaggttcttgaagagaacatggacgtggaaatttggaccaaggagggcgagcggaaaaagctgcgccctagatggctcgatgccaggacttatagcgacccgttggctctgcgggagttcaaagagtttgccgctgggcgaagatcagtaagtggagacctaatactggaaatcggcaagctcccacaacaccttacgctgcgcgcacagaatgccttagataacttggtgatgctgcacaattctgagcagggtgggaaggcttacaggcatgccatggaagaactccccgacaccattgagacactgatgcttctggcactcatcgcggtcttgactggcggagtgaccctgttctttttatccggcaaggggctaggaaagacaagcatcggtctgctctgtgttaccgcctcaagtgcacttctgtggatggccagcgtggaacctcactggattgcagcttccataatcttggagttctttctgatggtcctcctgattcccgaaccagatcggcagcgtactcctcaagacaaccagcttgcctatgtagtgatcggcctcctgttcatgattttgacagttgcagccaacgagatggggctgttagagacgaccaaaaaggatctaggaatcggctacgtggctgcggaaaatcatcagcacgccactatgctggacgtcgatctccaccccgcatctgcttggacactttacgccgtggccaccaccgtcataacaccaatgatgagacatactatcgagaacacgaccgcaaatattagcctgacagctatcgccaaccaagcggctattttgatgggtctggacaaagggtggcctatctccaagatggatataggcgtgccgctcctggcccttggatgctattcacaggttaatcccttaactctgacctctgcagtgctcatgttggtagcccactacgctattatcggcccagggctgcaggcaaaagccacaagggaagcgcagaagcgcaccgctgccggaattatgaagaaccctactgtggacggcatcgtcgcaatagatctagaccccgttgtgtatgatgccaaatttgagaagcaactgggtcagatcatgctccttattctgtgtacgagtcagatcttgctgatgcggacaacctgggctctctgcgaatcgattactctggccaccgggccattaacaactctttgggagggaagccctggcaaattctggaataccacaatcgcagtctccatggctaacatattccgaggttcttacctggccggcgcggggctcgccttttcactaatgaaaagcctgggaggcgggagaaggggaacgggcgcacagggtgagaccttgggggaaaaatggaagcgccaactgaatcagctctccaagagtgagttcaacacttataaacggtctggaattatggaagtggacagaagcgaggctaaggaaggccttaaacgtggtgagacaaccaagcatgccgtatcaaggggcactgcaaaactgcggtggtttgtggagcgcaatttggttaagcccgaagggaaggtgatcgacctgggatgtggccgagggggatggtcctactattgcgctggcctcaaaaaggtcacagaggtgaaaggttacaccaaagggggaccgggccacgaggaaccaatccctatggccacgtacggctggaacttagtcaaactgcatagtgggaaggatgtgttctttatgcccccagaaaaatgtgacacccttctgtgcgatattggagagagctctcccaatcctacaatcgaggaaggtagaactctaagggttctcaagatggtagagccgtggctgcggggcaaccagttctgtataaagattttgaatccctatatgccatccgtggtcgaaaccctggagcagatgcaacgcaaacacgggggaatgctcgtgagaaaccctctttcaaggaatagcacacacgagatgtactgggtttcgtgcggcactggtaacatcgtgtctgccgtcaacatgaccagtcgaatgctgttaaatcggtttacaatggcgcatcgtaagcccacctatgaaagagacgtggatctgggggctggaactcgccacgtagcagtggagcctgaagttgccaacttggacattatcggccagaggatagagaatatcaaaaacgaacataagtccacgtggcactacgatgaggacaatccatataaaacatgggcttaccacggcagctatgaggtcaagccctcagggtccgcctctagcatggtgaacggagtggtccggctcctgaccaagccttgggatgttattccaatggtgactcagatcgcaatgaccgacacaacgcccttcggtcaacagagagtatttcgcgaaaaagtggataccaggactccgcgagccaagcggggcacaacccagattatggaggtcactgctaaatggctatgggggttccttagtagaaataagaaacctaggatctgtacacgcgaagagtttacccgtaaggtgcggtccaacgcggccattggagcagttttcgtggacgaaaatcagtggaacagcgctaaggaggccgtcgaggacgaaagattttgggatctggtgcatagggagcgcgaactccacaaacaaggcaagtgcgcaacatgcgtatacaatatgatgggtaaacgagagaagaaactgggggagttcggaaaggccaagggctctcgggctatctggtacatgtggttgggcgccagattcctggagtttgaggcgctcgggttcatgaacgaagaccattggttttcaagggagaatagtctttccggagttgaaggtgagggcctgcacaaattagggtatatactgcgcgatattagcaagatcccaggaggcaacgtgtacgcagacgatactgccggttgggacaccagaatcacggaggatgacttgcagaatgaagctaaaattaccgatataatggagcccgaacatgccctcctggcaacatctatcttcaagctaacttatcagaacaaagtcgtgcgggtgcagaggcctgctaagaacgggaccgtcatggacgttatttcgcgtcgagatcaacgcggatcaggccaggtgggcacatacgggcttaatacttttaccaacatggaggtacagctgatcagacagatggaaagcgagggaattttcctcccatccgagctggaaacgcccaatttggccgagcgggctttagactggctggaaaaacacggtgtggagaggctcaagcgcatggccatcagtggcgatgactgtgtcgtgaagccgatagacgatagatttgcaacagcgcttaccgccctgaacgacatggggaaagttcggaaggatatccctcaatgggaaccctctaaaggatggaatgactggcaacaggtgccattctgcagccaccattttcaccagctaattatgaaggatggcagggagatcgtcgtgccttgtcgaaaccaagacgagctggtaggtcgtgctagagtttcccagggggccggatggtcactccgcgaaactgcatgcttgggcaaaagttatgctcagatgtggcaactgatgtacttccatcggagggatcttagactggccgcaaatgccatttgttctgcggtgcccgtcgactgggtgccaacaagccgcaccacttggtccatccacgctcaccatcagtggatgaccacagaggatatgctctcagtttggaaccgggtgtggatagaagagaatccctggatggaagacaagacgcacgtcagctcttgggaggaggtgccttatttaggcaagagggaagatcagtggtgcgggtccctgattggattgaccgcccgagcaacttgggccacaaacatccaggtagctatcaatcaagtgagacggctgattggtaacgagaattacctcgactacatgaccagtatgaaaaggtttaagaacgaaagcgactcggagggcgccctttggtga

SEQ ID NO: 13546 - RNA, 9879 nt, synthetic construct
  misc_feature 1..9879: note = derived and/or modified CDS sequence (opt3) from DENV-1__GU131841__SS-prME
  source 1..9879: mol_type = other RNA
agcgtgaccatgctgctcatgcttctgcccacagccttggctttccacttaactacgagaggcggggagcctcatatgatcgtctccaagcaggaaaggggaaaatctctgctatttaagacctcagttggtgtgaacatgtgcacactcattgcaatggacctgggcgagctttgtgaagatactatgacctacaaatgcccacggataacagaggccgaaccggacgatgtagactgttggtgcaatgcgaccgatacttgggtgacatatgggacctgtagtcaaacgggagagcaccgccgagagaagcgtagcgtcgctctggccccccatgtgggcttgggtctcgaaactagaaccgagacatggatgtcctctgaaggggcatggaaacagatccagagggttgagacttgggccctgcggcaccctggattcaccgtgattgcttttttcctggcatacgccatcggcacatcgattacccagaagggcatcatatttatcctcttaatgctggtcacgccatcaatggctatgcgctgcgtggggattggaaacagagacttcgtagagggtcttagcggcgccacttgggttgatgtggtcttggaacatgggagttgtgtgacaaccatggcgaagaataaacccactctggacatcgagctactcaagacagaagtgaccaaccctgcagtcctgaggaaactttgcattgaggccaagatctccaatacgaccacagattctcggtgtccaactcaaggagaagctaccctggttgaggagcaggacgccaactttgtgtgccgccgaacattcgtagatagaggctggggtaatgggtgtggattgtttggcaaaggcagcctcctgacttgcgcaaagttcaagtgcgtgaccaaattagaagggaagatagtccagtatgagaacctgaaatactccgtgattgttacagtgcacaccggagaccagcaccaagtcggtaatgaaactacggagcatggcacaatcgctaccattactccccaggcccctacctcagaaatccagctcacagattatggggcgcttaccctggactgtagtccaaggactggattggactttaacgagatggtgctactgacaatgaaggagaaaagctggctcgtacacaagcagtggttcctggatcttccgctgccctggacgtctggcgcctccacctcacaagaaacttggaatcggcaggacttgctcgttacatttaaaaccgcacatgctaagaagcaggaggtggtcgtgctgggtagccaagaaggggccatgcacacagctttaactggcgccaccgagatccagacgagtggaaccacaactattttcgcaggccacctgaaatgccgtctaaagatggataaactcaccctgaaggggatgtcttacgtcatgtgtacaggatccttcaaacttgaaaaggaggtggccgagactcagcatggtaccgttttggtgcaggtaaagtatgaaggcacggacgctccttgcaaaataccatttagcacacaagatgagaagggggtcacccagaacggacgcctgatcactgcgaatcccattgtgacagacaaagaaaagcctgttaacatcgagaccgagccacccttcggcgaatcgtacatagtggtcggtgcaggggagaaagccctcaagctgtcttggtttaagagaggctcctcaattggaaaaatgttcgaagctactgccaggggcgcacggcgaatggccatccttggggataccgcttgggactttggaagtatcggtggcgtgttcacaagcgtagggaagctggtgcaccaggtttttggaacggcctacggcgtcttgttctccggtgtgtcttggaccatgaaaattgggatcggcattctcctgacttggttaggactgaatagccgctcaacaagtctatccatgacctgtatagcagtgggcatggtcacactctatctgggggttatggtgcaggcggatagcggatgcgtgatcaactggaagggcagagagcttaaatgtggttctgggatttttgtaactaacgaagtccatacctggacggagcaatacaagttccaggctgactcaccgaagaggttgagtgccgcaatcggaaaagcctgggaggaaggcgtgtgcggtatccggagcgctacacgcctggagaatattatgtggaagcagatatccaacgaactcaatcacatcctgttagagaacgatatgaaatttaccgttgtggtcggcgacgccaatgggattctggcacagggaaagaaaatgatcagacctcaacccatggaacataagtattcttggaaatcgtggggcaaggctaagattatcggggccgacatacagaacactaccttcatcattgatggaccagacacacctgagtgtcccgatggccagagggcgtggaatatctgggaggtggaagactacggttttggggttttcactaccaacatttggcttaaattgcgtgatagctatacacagatgtgcgaccaccggctcatgtccgccgctatcaaggattcaaaagcagtgcacgccgacatgggatactggatagagagtgaaaagaatgagacgtggaaactggctcgagcctctttcattgaagtaaagacctgtacttggccaaagagccatacactatggtccaacggcgtcctggagtcagagatgatcattcccaaaatctatggtggccctataagccaacacaattacagaccagggtactttacccagactgcaggaccgtggcatctcggcaagctggaacttgatttcgacttgtgcgaggggacaaccgtggtggtcgatgaacactgcggaaacaggggcccctctctgcgcacgactaccgttacaggtaaaatcattcacgagtggtgttgccggtcctgtaccttacctccactcagatttaggggggaggacggatgctggtatggcatggaaatccgccccgtgaaggagaaagaagagaatctggtacgaagtatggtgagcgcgggttctggcgaagtcgattccttctcacttgggattctgtgtgtgagtatcatgatagaggaggttatgcggagccgttggtcgagaaagatgttgatgactggaacactcgccgtgtttctgctactgattatgggccagctcacctggaacgacctgatcaggctttgcatcatggtcggggctaatgcctccgaccgcatgggaatgggcacaacttacttggcactgatggctaccttcaagatgcggcctatgtttgccgtgggtttactcttcagaaggctgacgtctcgagaagttcttctgctaacaattgggctcagcctggtggcatcagtcgagttgccaaacagtctggaagagttaggagatggcctcgccatgggcatcatgatgctgaaacttctgaccgaatttcaaccccatcagttgtggactaccctcctgtccctaacattcgtaaagactaccctgtctcttgactatgcttggaaaacgacagcgatggtgctcagcattgtttccctgtttccgttgtgtctgtcaaccactagccagaagacaacctggttacctgtgctcctggggagtttcggatgcaaaccacttactatgtttctgataacagagaacaagatctggggtcgcaagtcttggcccttgaatgagggcattatggccatcgggattgtctccatcctcctgagctcgctactgaaaaacgatgtgcctcttgcaggacccctcatagctggcggtatgctgatcgcctgttacgtaatttcagggtctagtgccgacttgtccttagaaaaggctgcagaggtgagctgggaacaggaggccgaacactctggagcgagccataatatcctggtcgaggttcaagatgacggcaccatgaaaattaaggatgaggaacgggacgatacgctcactatcctgcttaaagctaccctgttggccgtgtccggcgtgtatccaatgtcaatacctgcaacactattcgtctggtacttctggcagaagaaaaagcagagaagtggggtgctgtgggacacccccagcccaccggaggttgaaagggccgtactcgatgacggaatttatcgtatcctgcagcgcggtcttttaggccggtctcaagtgggggtcggagtgtttcaggatggcgttttccacacaatgtggcatgtgactagaggtgctgtcctgatgtaccaggggaagaggctcgagccttcctgggcatcagtgaaaaaggacttgatcagttacggaggcggctggcgatttcaggggagctggaacaccggagaggaagtacaagtcattgccgtggagcccggtaaaaatccaaagaacgttcagacgacacccggcactttcaaaacccctgaaggggaggtgggagcgatagctctggactttaagccaggcacatccggttctcccatcgtcaatcgggaagggaagattgtgggactctatggcaacggcgttgtgaccacttcggggacctacgtcagcgccatcgcacaggccaaagcttcacaagagggacctctgccggagattgaagatgaggtgttcaagaaacgcaatcttacaatcatggacctgcacccaggttccggcaagacgagaaggtatttgcccgccatagtacgggaagcaatcaaacgaaagctaagaactctgattctcgctcctacccgcgtggttgccagtgagatggcggaagccttaaaggggatgccaatcaggtaccagacaaccgcagtcaaatctgagcacactggacgtgagattgtggatctgatgtgccatgctacatttaccatgcggcttctgagccccgtgagagtccctaactataatatgatcataatggacgaagcccacttcacggatccggcttccattgcagccaggggctacatctcaactcgcgtaggtatgggggaggccgctgcgatctttatgacagcaacccccccaggatctgtggaagccttccctcagagcaacgctgttattcaggacgaggaacgagatatccccgagagaagttggaattccggctatgactggataaccgattttccaggcaagactgtgtggttcgtccctagcattaaatctgggaacgacatcgccaattgtctccggaagaacggaaaaagggtgattcaattgtcacgcaagacattcgataccgagtaccagaagacaaaaaacaatgactgggactacgttgtgactacggatatctccgaaatgggtgcaaactttcgtgccgacagagtcatagatccccggaggtgcctgaagccagtgattctcaaagacggcccggagcgcgtaatcctggctgggcctatgcccgtgaccgttgcgagtgccgcacagcgaagaggacggatcggcaggaatcagaacaaggaaggtgatcaatatgtctacatggggcagccacttaataacgacgaggatcatgctcactggacagaggccaaaatgctactggacaatattaacactcccgaaggcatcattcctgcattgttcgagccagaacgcgagaagagcgccgctatagatggagaatatagattaaggggcgaggcccggaagacctttgtggagctgatgcgtcgcggggacctccccgtgtggctgtcgtacaaagtcgcgtctgaaggattccagtattccgatcgaagatggtgctttgacggtgagaggaataaccaggttcttgaagagaatatggatgtggaaatctggacaaaggagggcgagcggaaaaagctgcgccctagatggctcgacgcaaggacctacagcgacccgttggccctgcgggaattcaaagagtttgctgccgggcgaagatcagtaagtggagatctaattctggaaatcggcaagctcccacaacatcttactctgcgcgctcagaacgcattagacaatttggtgatgctgcacaactctgagcagggtgggaaagcctataggcacgctatggaagagctccccgatacgatcgagaccctgatgcttctggccctcattgcagtcttgacaggcggagtgactctgttctttttatccggcaaggggctaggaaagaccagcataggtctgctctgtgttacagcgtcaagtgcccttctgtggatggctagcgtggaacctcattggatcgccgcatccattatcttggagttctttctgatggtcctcctgattcccgaaccagaccggcagcgtacccctcaagataatcagcttgcttacgtagtgatcggcctcctgttcatgatattgactgttgccgcaaacgagatggggctgttagagacaacgaaaaaggacctaggaatcggctacgtggccgctgaaaaccaccagcatgcgaccatgctggatgtcgacctccaccccgcctctgcatggactctttatgctgtggccacaaccgtcattaccccaatgatgagacacacaatcgagaatactacggccaacattagcctgaccgcaatcgctaatcaagccgcgatattgatgggtctggataaagggtggcctatttccaagatggacatcggcgtgccgctcctggctcttggatgctactcacaggttaaccccttaacactgactgccgcagtgctcatgttggtagcccattatgctattatcggcccagggctgcaggcaaaagccaccagggaagcgcagaagcgcacagctgccggaataatgaagaatcctaccgtggatggcatcgtcgcaattgacctagatcccgttgtgtacgacgccaaatttgagaagcaactgggtcagatcatgctccttattctgtgtacttctcagatcttgctgatgcggacgacatgggctctctgcgaaagtataaccctggccactgggccattaaccacactttgggagggatcgcctggcaaattctggaacactaccattgcagtcagcatggctaatatcttccgaggttcctatctggccggcgcggggctcgccttttctctaatgaagtcactgggaggcgggagaaggggaacaggcgcacagggtgagacgttgggggaaaaatggaagcgccaactgaaccagctcagcaagtccgagttcaatacctacaaacggagtggaatcatggaagtggacagatctgaggctaaggaaggccttaaacgtggtgagactacaaagcacgccgtaagcaggggcaccgcaaaactgcggtggtttgtggagcgcaacttggttaagcccgaagggaaggtgattgatctgggatgtggccgagggggatggtcatattactgcgctggcctcaaaaaggtcactgaggtgaaaggttacacaaaggggggaccgggccatgaagagccaatccctatggccacctatggctggaatttagtcaaactgcactccgggaaggacgtgttctttatgcccccagaaaaatgtgatacgcttctgtgcgacataggagagagtagccccaaccctaccattgaggaaggtagaacactaagggttctcaagatggtagagccgtggctgcggggcaatcagttctgtatcaagattttgaacccctacatgccatctgtggtcgaaactctggagcagatgcaacgcaaacatgggggaatgctcgtgagaaatcctctttccaggaactcaacccacgagatgtattgggttagctgcggcacaggtaatatcgtgtcggccgtcaacatgacttctcgaatgctgttaaaccggtttaccatggcgcaccgtaagcccacatacgaaagagatgtggacctgggggctggaacccgccatgtagcagtggagcctgaagttgccaatttggatataatcggccagaggattgagaacatcaaaaatgaacacaagagtacttggcattatgacgaggataacccatacaaaacgtgggcttatcacggctcctacgaggtcaagcccagcgggtcagcctcctctatggtgaatggagtggtccggctcctgacaaagccttgggacgttattccaatggtgacccagatcgcaatgactgataccacacccttcggtcaacagagagtatttaaagaaaaggtggacacgcgcaccccgagggccaaacgaggcactacacagattatggaggtcaccgctaagtggctatgggggttccttagccggaacaaaaagcctagaatctgtactagggaagagtttacacgcaaggtgcgtagtaatgcggccataggagcagttttcgtggacgaaaaccagtggaattccgctaaagaggccgtcgaggatgaacggttttgggacctggtgcacagagagagggaactccataagcaaggcaaatgcgcaacctgcgtatacaacatgatgggtaagcgcgagaaaaagctgggggaattcggaaaggccaaaggcagccgagctatttggtatatgtggttgggcgcccggttcctggagtttgaggcgctcgggttcatgaatgaagatcactggttttctagagagaactcacttagtggagttgaaggtgagggcctgcataagttagggtacatcctgagggacatctccaaaattccaggaggcaatatgtatgcagatgacacagccggttgggatactcgcataaccgaggacgatttgcagaacgaagctaagatcacggacattatggagcccgaacacgccctcctggcaaccagcatcttcaaactaacataccagaataaggtggtcagagtgcagcggcctgctaaaaacgggactgtgatggatgtcatttctaggcgtgaccaacgaggatcgggccaggttggcacctatgggcttaacacatttactaatatggaggtgcagctgatccgccagatggaatcagagggaatattcctcccaagcgagctggaaacccccaacttggccgagagagctttagattggctggaaaagcatggtgccgagcggctcaagaggatggcaatctccggcgacgactgtgtagtgaaaccgattgatgaccgctttgcgacggcccttacagctctgaatgatatggggaaggtcagaaaagacatccctcaatgggaacccagtaagggatggaacgattggcagcaggtgccattctgctctcaccactttcatcagctaattatgaaagacggccgggagatcgttgtgccttgtaggaatcaagatgagctggtcggtcgagcccgtgtgagccagggggcaggatggtccctcagagaaaccgcttgcttgggcaagtcatacgcccagatgtggcaactgatgtatttccaccgccgggaccttaggctggcagccaacgcgatatgtagtgctgtacccgttgattgggtgccaacttctagaacaacctggagcattcatgcccaccaccagtggatgactaccgaggacatgctctccgtctggaatcgcgtgtggatcgaagagaacccctggatggaagataagacacatgtttcaagctgggaggaggtgccttacttaggcaaacgggaagaccagtggtgcgggtctctgatcggattgacggcaagggccacctgggctactaatattcaggtcgccataaaccaagtgcgaagactgatcggtaatgagaactacctcgactatatgacatccatgaagcggtttaaaaatgaaagtgatccagagggcgcactttggtga

SEQ ID NO: 13547 - RNA, 9879 nt, synthetic construct
  misc_feature 1..9879: note = derived and/or modified CDS sequence (opt3) from DENV-1__GQ868601__SS-prME
  source 1..9879: mol_type = other RNA
agcgtgaccatgctgctcatgcttctgcccacagccttggctttccacttaactacgagaggcggggagcctcatatgatcgtctccaagcaggaaaggggaaaatctctgctatttaagacctcagttggtgtgaacatgtgcacactcattgcaatggacctgggcgagctttgtgaagatactatgacctacaaatgcccacggataacagaggccgaaccggacgatgtagactgttggtgcaatgcgaccgatacttgggtgacatatgggacctgtagtcaaacgggagagcaccgccgagacaagcgtagcgtcgctctggccccccatgtgggcttgggtctcgagactagaaccgaaacatggatgtcctctgagggggcatggaaacagatccagaaggttgaaacttgggccctgaggcaccctggattcaccgtgattgctctgtttctcgcacatgccatcggcacatcgattacccagaagggcatcatattcatcttactgatgcttgtcacgccatcaatggctatgcggtgcgtggggattggaaaccgcgattttgtagagggtttgagcggcgccacttgggttgacgtggtcctggagcacgggagttgtgtgacaaccatggcgaaaaataagcccactctagatatcgaactcctgaaaacagaggtgaccaaccctgcagtccttagaaagctgtgcattgaagccaaaatctccaatacgaccacagactctaggtgtccaactcaaggagaggctaccttggttgaagagcaggatgccaacttcgtgtgccggcgcacatttgtagaccgaggctggggtaatgggtgtggactcttcggcaagggcagcctgttaacttgcgcaaagtttaaatgcgtgaccagactggaggggaagatagtccagtacgaaaacctcaaatattccgtgattgttacagtgcacaccggagatcagcatcaagtcggtaatgagactacggaacacggcacaatcgctaccattactccccaggcccctacctcagagatccagcttacagactacggggcgctgaccttggactgtagtccaaggactggactagatttcaacgaaatggtgctgctcacaatgaaggagaaaagctggctggtacataagcagtggtttcttgacctgccgttgccctggacgtctggcgcctccacctcacaagagacttggaatcggcaggatctcctggttacattcaaaaccgcacacgctaagaagcaggaagtggtcgtgttaggtagccaagagggggccatgcacacagctctgactggcgccaccgaaatccagacgagtggaaccacaactatttttgcaggccatctaaaatgccgtctcaagatggacaaactgacccttaaggggatgtcttatgtcatgtgtacaggatccttcaaattggagaaggaagtggccgagactcagcacggtaccgttctggtgcaggtaaagtacgagggcacggatgctccttgcaaaataccattcctcacacaagacgaaaagggggtcacccagaacggacgcctgatcactgcgaatcccattgtgacagataaagagaagcctgttaacatcgaaaccgagccaccctttggcgagagctatatagtggtcggtgcaggggaaaaagcccttaagctgtcgtggttcaagaaaggctcttccattggaaagatgtttgaggctactgccagaggcgcaaggcggatggccatcttgggggacaccgcttgggatttcggatcaatcggtggcctctttacaagtgtggggaaactgattcatcaggtattcggaacggcctacggcgtgttatttagcggtgtttcctggaccatgaagatcgggattggcatactgctaacttggctcggactgaattctcgaagcacatcacttagtatgacctgtatcgcagtcggcatggtgacattgtacctgggggtgatggtccaggcggactccggatgcgttattaactggaaaggccgcgaactcaagtgtggtagcgggatcttcgtgactaacgaggtgcacacctggacggaacaatataagtttcaggctgattctccgaaaagactgtcagccgcaatcggaaaggcctgggaggagggcgtatgcggtattaggagtgctacacggttagaaaatataatgtggaaacagatcagcaacgagctgaattacattcttttggaaaacgacatgaagttcaccgtcgtggttggcgacgccaatgggatcctcgcacagggaaaaaagatgattcgccctcaacccatggagcataaatattcctggaagtcttggggcaaggctaaaatcataggggccgatatccagaacactacctttattatcgacggaccagatacacctgaatgtcccgacgatcagagagcgtggaatatttgggaggtggaggactacggcttcggtatctttactaccaacatatggctgaagctaagggattcgtatacacagatgtgcgaccaccgtctgatgagcgccgctattaaagattccaaggcagtccacgccgacatggggtactggatcgaatcagagaaaaatgaaacgtggaagctcgctcgggccagtttcattgaggtgaagacctgtatctggccaaaatctcatactctgtggagcaacggagttcttgaatccgagatgataatccccaagatttatggcggtcctatctcacaacacaattaccgaccaggctacttcacacagaccgcagggccgtggcatttgggaaaactggagttagattttgacctctgcgaaggcactacagtggtagtcgatgagcactgcgggtatagaggacccagcctgaggaccacgactgtgaccggcaagattatccacgaatggtgttgccgctcttgtacacttcctccactgcggttcagaggtgaggacgggtgctggtacggaatggagataaggcccgtgaaagaaaaggaggaaaacttggtccgctccatggttagtgcgggcagcggtgaggtggactctttttccctcggcattctgtgtgtatcaatcctaatcgaagaggtgatgcgaagtcggtggagccgtagaatgctgatgaccgggactctcgccgtcttcctgcttttgattatgggacagctgacatggaatgatttaatcaggctctgcattatggtgggcgctaacgcctcggaccgcatggggatgggaaccacatatctggcacttatggctacttttaagatgcggcctatgttcgccgttggcctgctatttagaaggctcacctcccgagaggtgctgttgctgacgataggtttatctctcgtcgcaagcgtggaactgccaaattcacttgaggaactgggggatggattggccatgggcatcatgatgctcaaactgctaacagacttccaaccccatcagctgtggaccactcttctcagtctgacctttattcgcacaactttgtccctggattacgcttggaagaccatggcgatggccttatctatcgttagcctcttcccgctgtgtctttccacgacatcacagaaaaccacttggctgcctgtgttgctcggcagctttgggtgcaagccactgacaatgttcctaattaccgagaacaaaatctggggacggaagagttggcccataaacgaaggtatcatggcagtcggcattgtatctatcctgctttccagcctcctgaagaatgacgtgcctttggctgggcccttaattgccggaggcatgctgatcgcctgttatgttatatcgggttcatctgctgatctcagtctggagaaagcagccgaggtgtcctgggaagaggaagcggagcacagcgggacttctcataacattcttgtcgaagtgcaggacgatggaacaatgaagatcaaagacgaggagagagatgacaccctgacgatcttgctaaaggctactctgctcgccgtaagcggcgtgtacccaatgtccattcctgcaaccctgtttgtctggtatttctggcaaaaaaagaaacagaggtcaggcgttctttgggatacacccagtccaccggaagtggagcgtgccgtgttagacgacgggatataccgcatcctgcagcggggactcttgggtagaagccaggtcggcgtgggggttttccaagatggagtatttcacaccatgtggcatgtgacaaggggcgctgtcctgatgtaccagggtaagcgactcgaaccttcttgggcatccgtgaagaaagacctgatttcatatgggggaggctggcggttccagggcagttggaatactggggaggaggttcaggtgatcgccgtcgaacccggaaagaacccaaaaaatgtgcaaaccacgcccggtacatttaagactcctgagggcgaagtaggggcgattgctcttgatttcaaaccaggaaccagcggctcccccatcgtcaaccgcgagggtaagatagtggggctgtacggaaatggcgttgtgacaacctctggcacttatgtctcggccatcgcacaggccaaggctagccaggaagggcctttgccggagattgaggacgaagtgtttaaaaagagaaacctaaccatcatggatctgcacccaggatcaggtaaaacaaggcggtacctccccgccattgttcgagaggcaatcaagagaaaattacgcacgctgatacttgctcctactagggtggtcgcctccgaaatggcggaggccctgaagggcatgccaattcgttatcaaaccacagcagtgaagagtgaacacaccgggcgggagatcgtagacctcatgtgccatgctactttcacaatgagattgctgtctcccgtgagggttcctaattacaacatgatcattatggatgaggcccactttaccgacccggctagcatcgcagcccgcggatatatatccacgcgagtcggcatgggtgaagccgctgcgattttcatgactgcaacacccccagggtcagtggaggcctttcctcagtctaatgctgtgatccaggatgaagagagagacattcccgaacggagctggaacagtggatacgattggatcaccgacttcccaggcaaaaccgtctggtttgtaccttccataaagagcggcaatgacattgccaactgtctcaggaaaaatgggaagcgcgtgatccagctgtctcgtaaaactttcgatacagagtaccaaaagaccaagaacaacgactgggattatgttgtgacaactgacatctcagagatgggagcaaatttcagagccgatcgggtcattgaccccaggcgctgccttaaaccagtgatcctaaaggatggtccggaacgagttattctggctggccctatgcccgtgacggtcgcgtccgccgcacagagacgggggaggataggacgcaaccagaataaagagggcgaccagtacatctatatgggtcaaccattgaacaatgatgaagaccatgctcactggaccgaggccaagatgttactggataacattaatacacccgaggggatcatccctgcactctttgaaccagagagagaaaaaagtgccgctattgacggcgagtacaggctgcggggagaagcccgtaagactttcgtggagcttatgcgccgaggcgatctgcccgtatggctcagctataaggtggcgtcggaggggtttcagtactctgacagaaggtggtgcttcgacggagaacggaacaatcaggttttggaggaaaacatggatgtcgagatatggaccaaagaaggtgagcgcaagaaactgagacctaggtggctagacgcacggacatattccgatccgctggccctccgagagtttaaggaattcgctgccggcagacgcagcgtgtcaggggaccttatcctggagattggaaaattaccacagcatttgaccctgagggctcaaaatgcactcgataacctggtgatgcttcacaatagtgaacagggcggtaaggcctaccggcacgctatggaggaactgcccgacactatcgagacgctcatgttgctggccttaattgcagtcctaaccgggggcgttacactgtttttcctctctggaaaaggccttgggaagacttccatcggactgttgtgtgtgatggcgagctcagccctgctctggatggctagtgtagagcctcattggatagccgcaagcatcattctggaatttttccttatggtgctcctgatccccgagccagatcgtcagagaacccctcaggacaaccaattggcttacgtcgtgattggtctgttatttatgatcctaacagttgccgcaaatgaaatgggcctgctcgagaccactaagaaagatcttgggataggacacgtggccgctgagaaccatcaccacgcgacaatgctggacgtcgatttgaggcccgcctccgcatggacgctgtatgctgtagccaccactgtgattacaccaatgatgcgccataccatcgaaaacaccacagccaatatttctctcactgcaatcgctaaccaggccgcgatactgatgggccttgacaagggttggcctatcagcaaaatggatattggggttccgttactggctctcggctgctactcccaggtgaatcccttgacgctgaccgccgcagtcctaatgctggtggcccactatgctatcattggaccaggcctccaagcaaaggccacacgggaggcgcagaaacgaactgctgccgggatcatgaagaaccctaccgtcgacggaatagtgacaattgaccttgatcccgttgtgtacgacgcaaagttcgaaaaacagctgggccagatcatgttgctgatcctctgtacctcacaaattctgttaatgagaactacgtgggccctttgcgagtctatcacactggctaccggtccactcactaccctatgggaagggagtcctggaaagttttggaatacaactatagccgtatcgatggcaaacattttcaggggcagctatctggctggtgccggcttggcgttctccctgatgaaatctctcgggggaggccgccgggggaccggagcccagggcgagacacttggtgagaagtggaaaagacagctgaatcagttgtcaaagagcgaatttaacacgtacaagcgttccgggatcatggaggtggataggagtgaagcaaaagagggactgaagcggggcgaaaccactaaacatgctgtctctcgcggtacagccaagctccgatggttcgttgagagaaatttagtgaaacccgagggcaaggtcattgacctggggtgtggaaggggcgggtggagctattactgcgcaggacttaagaaagtgaccgaagtaaagggctacactaaaggtgggccgggacacgaggaaccaatccctatggctacatatggctggaacctggtgaagctacattcaggcaaagatgtttttttcacccccccagagaagtgtgacacgctcctgtgcgatataggggaatccagtcccaatcctaccatcgaggagggacggacattgcgcgtgctgaaaatggtcgaaccgtggctcagaggtaaccaattttgtattaagatccttaatccctacatgccaagcgtggtcgagactctggaacagatgcagaggaagcacggcgggatgttagtgcgaaaccctctgtctcggaattccacccacgagatgtattgggtttcatgcggaacaggcaacattgtaagcgccgtgaatatgacttcgcgtatgttgctcaacagattcaccatggcccatcgcaaacccacatacgagagggacgtcgatctgggtgcggggacccggcacgtggctgttgaacctgaggtggcaaacctagacatcattggacagagaatcgaaaatataaagaacgagcataaatctacttggcactatgatgaagacaatccatacaagacgtgggcctatcacggcagttacgaggtcaaaccctccggcagcgcttcatccatggtgaacggggtagtgcgccttctgacaaagccttgggacgttattccaatggtcacccaaatcgccatgactgataccacaccctttggacagcagagggtgttcaaggagaaagtggacacgcgaaccccgcgggcaaagagaggtactgcccaaatcatggaagtcacagctaaatggctctggggctttctgtctaggaataagaaacctcgcatttgtacccgtgaggaattcactcggaaggttagaagcaacgcggccataggggcagtgtttgtagatgagaatcagtggaacagtgctaaggaagccgtggaggacgagaggttctgggatttggtccatcgcgaacgagagctgcacaaacagggaaagtgcgcaacatgcgtgtacaatatgatgggcaaacgggaaaagaaactcggtgagtttgggaaggccaagggatccagagctatctggtatatgtggcttggcgccaggttcctggaattcgaggcgttaggctttatgaacgaggaccattggttcagccgcgaaaattctctgtcaggggttgagggagaaggtttgcacaaactcggctacattctgagagatatcagtaagattccagggggaaacatgtatgcagacgataccgccggctgggacacacggatcactgaggatgacctacagaatgaggctaaaataaccgatatcatggaacccgagcatgcccttctggcaacgtccatttttaagctcacctaccaaaacaaagtggtcagggtgcagcgtcctgctaagagcggtacagtaatggacgttatctctcgacgcgaccagagagggtcgggacaggtgggcacttatggcctgaataccttcacaaacatggaagtccaattgattcggcagatggagtcagaagggatctttagcccatccgagttagagactcccaacctggccaaaagggtgctcgattggcttgaaaagcagggagctgagcgcctgaagagaatggccataagtggtgacgattgtgtggtcaaaccgattgacgatcggttcgcaaccgcgctaacggccctgaatgacatgggcaaggttaggaaagatatccctcagtgggaaccctctaaggggtggaacgactggcaacaggtgccattttgcagccaccacttccatcagctcatcatgaaagatggacgagagattgtagtgccttgtcgtaatcaggacgaattggtcggcagagctcgcgtgtcccaaggtgccgggtggtcactgcgggagacagcatgccttggaaagagttacgctcagatgtggcagctgatgtattttcacaggagagatctccgcttagccgcaaacgccatatgttctgcggttcccgtggactgggtcccaaccagccggactacatggtccatccatgctcaccaccaatggatgaccactgaggacatgctgtcagtgtggaatagggtatggattgaagagaacccctggatggaagataagacccatgttagctcttgggaggaagtgccttacttgggcaaacgagaggaccagtggtgcggctccctgatcgggctcacagccagagcaacgtgggccaccaatattcaggtcgctatcaaccaggtgcggaggcttataggaaatgagaactacctggattatatgactagtatgaagcgcttcaaaaatgaaagcgacccagagggtgccctatggtga
